United States Patent 9,487,797 (GENOMIC PLANT SEQUENCES AND USES THEREOF) - sequence listing, part 54

SEQ ID NO: 67911 - DNA, 56238 bp, Oryza sativa
  unsure (1)..(56238): unsure at all n locations
aagtcctgtttgggtctcctggcgcagtttacaaatgaggaaactgtggttatggggtgccaacattttaactgtggtgttacgagatgctcttaatatgatttctataccattggcatcttgctgtcagagaaacaaagatatggggaaaatcgaatgttggcagtgcagtcatggactagtgagaatgggctggggaaccttcattttaagcctttatgtcccccatgaataatttactggaacacattttgtctacaattgctccaaatgtttggaatgcatcttttcaagccaatgtctgtatgactgacgtggtttcaaccattctgccctgcaataggccagaaggaagttgcaccatcaagctgaccaccaattctgtggggaaaaggaaatcctaattcgatgactacatgttctcaatcgcgagatgcaaaatgcttcttgttttgcgaaattcacatttggcctgtagtggagtagactcgattcttcatattttgtaactcgaggagtcattacttgttagactatccacctggaatttggtgacttaactttctgtattggctgtttttaattcctgttttgtttggtaggtcgatgctgttgtttacttggtggatgccgctgacaaggaacggtttgcggagtcgaagaaggaactcgatgccctccttgcagacgattccctagcaaccgtgcctttcctgatactgggaaacaagatcgacatcccatacgccgcgtcggaggaggaactccgctactaccttggtctgagcaacttcaccaccggtaagggcaacgtgaacctagccgactccaacgtgcggcctctggagatcttcatgtgcagcgtcgtccgcaagatgggctacggcgaaggcttcaaatggatgtcccagtacatcaaatgagaggggcttctgctcctcaattgtcaatagcagctgctgctcctgctgtccacagtgggagtgggtaattcaggcctctggttctgtttatcaactctcctgatgctttggagaaacctactgcacctgtaaggaaaaaagtttgtcgtagtggtggatagtgaatgcctgtaagttggtgttaatactagaaatatgacggggtttatttgtttgattgtttatgggtggtgtgaccttattagctagaaaatgtgggttgctggaatcgtttcttgacaacaggaaatgtttcagccaatgtattcacgctatctatctagccagtgatatgtgtatgagcaacttcggtctcttggctgctaacgtctcccctgtgatacttgatcaaaactctttttttttttaagataatggattaaaacacgacctctatattcaaattcttgatactaaccatcaacaaaagagaagaatttcgattcgctaattctatcatataccaagttcttctacctattgtagacgttggtgttatactgaattacaactaatagaaaactatgaaatgaatatagcactatgaaatgaacatagtttaattgattgaattcatttggatttcttacaatggaaacttagctgattgaattccttttgatttcttatgatggaaacttggcatggatgctcccaaatattactaattaattattttgttagtggtagctgttatactcgtagatagtgagacgttcacgatgattttctcaatcttaagttatactaactcaatttcttgaagatgctagggtaggtgagggtaggtgtgcatgtgtatttaggggtgataactgtgtttacctaattttttagaagtgttagggtagtatacgtaatttataagggtgagtgtaagtattatgagtgcttatgtttgtacgtgttttaaaaaaaaaagtaggatagaaaaaaaaaagacatgcactttgcatgcggagaaaaggaaaggcacaaaaacggataacaagcaatgatcttgttatttggcgaccaagatttgatctggagttcctatccgcatctctgggctgtcgacactccaaacagagagcgactcttgtggccagagaacaacgctcagttcatccgttgccttgcctctaccaattgccgaacaaagcaaatcttcattcatctgtggcctgaagaccataaacagataatggaaatgtgcatacctttgtgtgcctcatctacagaacttgttattgcaaaccaaaataaaatagacgtggaaacgttatggattcaatattaactagatgggtaccctgcgcattggtgcgtgagaattacgtgataatttttttgcggggagaattgtgtgataaattaggtgttatttgctctgtgttcccaactcctctccttcgtattccatgcgcacgcttttcaaactactaaacggtgtgttttttacaaaatatttatatacgaaagttacttaaaaaatcatattgatctaattttgaaaaaaaataaccaatacttaatcacgtgctaatggaccactccgttttccgtgcggaggagatgggttcctaacccgaacgaacgcatccttagtatatattagttgtaattttttcttactatatgattttctttcatgtgcttatactttgataaattattcaaacgttataaatacttaagttgtatggtgtgtctttcagggagaagagatacaatttgcactcttgatgaatcatctaaagactagaaataattgagacgatgtgacttaagggagaattagtattaactacaattagtggtaatgacgtttttctttaaaatgtggacttttttcatatggacttgggtgggtatgctagctgtgatgtccattatgaaattgtgttgaacagtagaattttatgatattatgggagtacgactttgaaagagcgtagaagcattactaagggcctgtttagttcgagaaaagaaaaatttagagtgtcacattggatgtttgaccggatgtcggaagggcttttcggacacgaatgaaaaaaaaatattttcataactcgtctggaaaccgcgagacggatcttttgagcctaattaatccgtcattagcacatgtgggttactatagcactttatggctaatcatggactaattatgctcaaaagatttgtctcgcgatttcatccctaactgtgcaattagttttttcatttatctatatttaatgttttgtgcatgtgtccaaagattcgatgtgatgtttttgagaaaaaattttggggaactaaacggggcctaacaaacatcgacgtaactttctggtggaacacagtgctttagtacatatatattgtactttcttacccaacaacactattacctattgtcattttctttttcttgacttttacaaaacatttgattgcacatgttacaacacgtttgattgcacatgggaagaactgttctatcatgctggttggaagattgttctatcatgctagtataaaccgtgctacagtttaaacttaagatgcatcgagtttatgacttcattcttcccaccgatgctagcccgatcgaagccaaacagtaggctcgaagttacaagtacattaccctctccatcccaacaaaaatactaacctaagactcctactattatgaatctggatagattagaaggggtcctactagattggcttttttggaaggagggagtacaccttcaattccaaatacaaggatcttttttttccttctttgtttgaaaagaacctgacatcaaatgcacaccaaaaaccaaatcttgggattttgactccacacacgtagggtttgaaagcttgaagtgccaaaaaggaggagcagatcgatcgattgatctatctacaggccagttgtggccacccattcctcgtcgatcgatcggtcgccggccggcatcctccggtcgccaccgccggctgtgcgccacacgtttcgccccctcctctctctctctctctctctctctctctctctctctctctgatcgccgcggcggcagccggccagcagcgagagagaaaacacgacgccgcttggattggatcggatcggattgccgtgtatatctgccgtcgcgtcgagtcgcgtcagccccagggtggccggattggcgcgacgccgacgcggcgcttgtcgccactcgcgggcgagctcgtggtcgtgggttgccgacgaccgcaagctggaggaggaggaggaaaagaagactttggaattttatgccggcacgaatgatctttcgctcctgtttccgacctggcagggtgctgcgtgtcgccgtgtcggatttctgccgtttgatgccagctggatttcggtgaaaagtctgaagaaaacctaactcaccgtcgattttcttttttttttccctattacgaagggcttgtttagtttggaagaaattttaaccaataaaaatagaaacgcatgcacatatcgattcgtggaaacttttcaagaggtttgggtttgttttgatagtgaaataaataaaagaagcgggattgggatagagaaatgagtgaagattaaatctgccatgttctaaactgattaagatatagattttttttctcggtttccattagcacgcttttcaaactgctaaacggtgtatttcgtacgaaaactttctacataaaagttgctataaaaactctaataaatccatttttttaagattttcacaattaaaactcaattaatcatgtgctaatgacttatctcgttttacgtgcgcacttaatcttcatccttgcagtagattcgaacgggagagggataatggatggttaggattggtgggtgggaaattatttcactaacccattagccaagcaaatcccatgagtggatggaaaattttctatgttttctctccacaacttgtaggaacgagaaattccttttattttgaatatggataagatttgcatattttatattacgcttggggagttactttaccagagcaaaacaatcggaacaatgaaagggaaaaaaaacaaaatagcttagtgctaattctcacgatctagcttggcgacttgtcgaccatagcactcattgcccctacagctgcatgctcgttaagtgccatagcgcatcttcgtctacctcggtagcttcgcgcatggttattgaatactcgttgttccgttccttttaaattgtccaaactatgaggcattttttttagaaaatggattaaaatccggtctctacagccacaatggatgtacacagtccaaactatgaggctaaagatcgtgtcgtaaccatgtcgttgtgctttggtgatctgcttcgctaccacaccaccaccaaaggaaggaagtggagtttgcagggaagcaatgcgcctgtcgatcgcgcttaggatcgcccaccatagctaacgtgactctggacgctggatcaagatatgatcaatggattcatcagcttgatcgtagaagacatagttgtcgggatgtagcagctctcatcggatcaagcggttagccatccagcacctccaatatatacgctccctatattactacaaaccaaatggtgtttatagaaattaatcttttggaatccaaatctcttgttttttcctctaaactgaacaagctctaaaaatcggtaattatagagctttccattcgtagaactacagaagaacatgttgacttttttgtcacatcaccaacacattttgtggtattgattggagtcaccaaccacctcaaccttgaaaaactcctaaggctatgttcggttaatccctgtcagcgattgtggtgtggaattattccccctcaatcccctccaattcctttcaacccccttcaaaccgaacaagacctaattgagatgagttcatagattaaaaccagctagcaaaaccaatttagaaaaattgggataaacatgtctcatggattagatggaagtttttttagacaaatctacaaacaagatttacactcggggcgaagagtgaaggcttacaacgcaaaccgatgaagatgaatgaaccaagataaaaactagacaagaaagtagatgtaatatcgaaagaacgatttaattgagtaattgtgttggttatagattgtttccccaattaacctgtcctaagacggtaaatctaattggagaggcccgaaggggtctccacaagatcctctccacaaatttcttcggtgctctaaatggtagtatatttgatttgggtaacgaagactacccccatgtataaccggagaaactttttttttggaccaaaaccggagaaactttagcgagaaactttagttagaaggtttggcgagttttgaacgtctgatcaaacggcaatctgtctattagacggctcgcatgtggagaaggctactttcagtttcagaacggtgcaagtgtgcaagatgcagacggaaacgggatgggcaacggcaattgaggatgcattacttccaattccatttccagctctggcaatgctccagtccagccagccaacaaaagaaaagaggcgatgtgtaccgtacgcgtataaacgtctccacgtaatacgtacaaaatacggtatggtttctcggcaagcaacgcgtacttgatacgtacagtacaatgcatcggatgcctgtcacttgcttgttacacaggagactgacgaggagtcgacgacgcaagctatgtacagtacgtttgaatgttcattacgtgttccgatacggttgcctaccctgccaaccagttgacatatatgtcttgcttcatgacgcagcttagagacacaaatgggcaatatagacagacaccagtgccaagtcctgagtccaattaataaatttctaatatagtttagagtctaattaattgacatttgatcttcatctatctgaggtccttctttttttagtgtcaaaacagaaaatcagcatctgggtgtgacacttgtatggcattccactctgggaagaaagaatcattgctgcagtagcatacagcagcactgcagcagtgtggtgtgtaaaccaacaaaatgaatgaacggatggatgggatctaaccacgtccgcgaatcacatcaatctgacgaccaggaaggctccgatcacgagcagcttcgccggcaccagcaggacgacgagcagccgggcgtgcgcccgcgcctgcctcgccgtctccctcccgccctccacggcggcgtccaggagcacgccggcgccggccagcgcgccgtgcgcgccgagcggccaccacaggaggagccgccgccaccgcccccgccgcgtctcccggtgccgccgcacctccttgcgcaccacggcccggacggagcggaggtaggagttcacgtcgtggtcgcggtacacggcgcccttggggccgtaggcgctcttgtccttgaggatctcgagcgggtgcggcgagttgaagaaggtggacatggcggaccggagccgccgcagggaggtgcccgacgacgacgacgagtcgctcaggtggtagatgccgctgtccggcgggaggaggtcgtggtgcggggatagcctcttgtcaggttgcaggatgaacatctcgcccattggggcgtacaagagcttctgcagtgaaatccacagagagggttacaaccattgttggtcaattttggtaacatgcaaacaaagtgaacattttacaaacaagaaaactaagtggtgatgggtgatgactataagagctgcatattgcagtactcagtaaagatccaagtgttctttgccaatattttttttaactacttttacttttgttttaaaaagaagtgttgtttttcagtccctgaaaatgtgacagccaggacatcatgctagatcttcaacctgcagggcacagttcgctgtataattcaaccaactgatgggtttattatttgttctccatgtcaaagcatcagataaattttctttgtagtcttaagtcattaaattcaggaacatatactgttattaccacataaatgagctaatttatcaactgaagtggattcatgaatctacctgatttgtgaggcatgggtgactgcggaaattcccattggctagtttcagaatattagcaacatggtcagggtagttgcacgaaaagactcgaggaacaatatctcgatgcatcgtgactgactgaacatgattccttggcaatccaagtttacgaagcaagtggtcaccgccacacatgatgcatggtgcaccaaatgttattacaggcaacaacgacgaagcaggtgctgctcctctcatcagtagcattagattcacaagcaaagccagactaccaccaagagaatgaccagtgaagcgtaacgttgcagatttaccagaacttctcaagtgagatttgacatatggcaacatttggtgatacattcccttggctgcttcatatattcccctatgaacgagcacatcgagtccctgcaaaacatcacaaatgtcttagcttacataaatttgtcaagcccttcctacgtctaatatgtcaaattaaatgtttgtgtgtcaatttaatacacttgatcaatccatgatgcacatctaaataatgaagctgctggtgcacaatgaatgaatattggcaagattgattctatccatcattcatgagaaactgagaaatgtaggatggcagactagtaggatacctcaaatttaactggttcaaataggaggttggcctgccaagaagcgattgactccgagccctgccaattaacaataaaaaattgatgaagatgaaccagggaaagtgaaaattacacgaatcatgatatattgggcagaagacatacctgaaccacaaagtatcttgtgctgccttgatcatcatcacaaatgaaccattcgcaaggacaagatcttgaagagttcagatcatctgcaacagcttgtcttgtttcttccttggcagcaaccatggaggtaactgaatttgtagtggccacaaatgaagcttcatccatggttaaaccttcaccactctcaccgtttacaatggccatgatggttggatcgttcttgccatcattcctggaaccaaagggaacgacgcccatagcccgtgaatgtaaataagaggcagcagacgacatgacatggtatgcgccgaaggggtttacccccaacccactttctttcttcttattgctccctggctcagggttctctacaacttcagattcttgatctgaagattcaccttcctcagtcttcagctcctgcttctgatcaacaccagttttggctttctcttgtactgatgaagtcacaaaccgcaaattgtacctccgcagcaattttggctgagaaagcaaacagttgctaagtcaggcaatgaaatactaatatcacacagaatgtcagaaaggaaacttgcaaattgcaatcataatctagttatgaggtactagaaaggtaattgtgtaattaacaacatcacgattaccacaccaaataagtatccatatgccagaagcagcagctcaagtgaagcaaccaattgaaagacaacaatagacaaatacaactcaggcacagatagctccaagagtataattgcattaagcagacctggcactaatccatcaaatccttcaggaagaccccactataaggtccaaaagcacataggggaccaggacgaataatcgataatggcataatgcataattttgcagaacagtaaaggaaattcttcactatctctgtaaaggaaatgcatagacaatacgtagtagaagccaaaacagactaaataagaattcttagtaacaccacaacctgcatttctcttgaatttacagcatggacaaggactcaaccatgaacagttcatcaccagcaatcgaattggcgtgtagacaatccaccaattattggctgtgattaccgcatcggtgaattgtagaatagcagtcactcgcattgatgctttcgatcttaccgtgatcttggggatcatgtaggcgatgttgcagaggtaggacatcttggagaactccttggcctccccgagcgacactttcctgaggagcctcgagaaggtcgcgcggtcgaacaccttgccgtcgctctcgtcgtcctcctcgacgccgcagcatccttcgtcgtcacctccaccgcacgaggcgcagcactcgtcgccgtcgcggcccgccgtgagcgcttcctggccgccttctcgagcggctccggtgactcccgcggcttcggcgtccgccgcctccgcccactgtggctgcacccgcagcatctgcagcacccagttcccctgcttccgctcgtccgcctctgcctccgccgcgcgctggctcctcgcctcctcgccgcgaaccgcaccaccgaccgcaccgaccctctcccctcctcctcctcctcctcctcctcctccgccgccgccgccgccaccgagcggccatagccggagcagcggcgcgtgcagaacgccccgcgacggctgctgctggtggtgccgctgcgccaccggaggcggtggcggctgcggagccgcggaggcggcggggctgatgccgcggacgaacctcagggcctccatggccgcctcctcctcctcctcctctcgcgaccgcgaggttgccgttaacaatagcggggttaagtttagccaaatcggcgatgatccccgtgtgctccaccactcgagatcaaccaaccaaccaaccaagttcactctcgactccggcgatcgacggcggcgggtggtggtgcgaggagaggagcagcaatggaggagagaaagaggatgggagggaggaggaggcctcctatatatgcggagacggcaacgccatgggagggaggtaggagagaggaaagagaggggtgggattgtttgtgggggaggagagagaaaccgtgaagaaaaatccgtccgtccccgggttgcttgctccgctctaatatctttggtaggctcgttttggcatcttgttgggttcctttcaccctctgatttgacgcattcacagtagttttactgtctgaatttggaattattgtaattttaggagtactctgtattctcacgcctatttcaaaagtcaatatatatactatgttaaggtgagtgaaattttattacgtataacaatcattattaacactacacgtaagcataaggtgtggtgatactgtactatttttaaacaaatactttcatacttttatatgtttttcttgccgtgttataattagtattttattttttaagaaaaactatgtggagtgtagaacgaacattttggtcagaggaaggtatgccatgttagtacgtttaccacgtgccaggacaacgttgtatgcgtacgagcgtatcggatacgagcgacacggcggaggctccatccgttttttgccacctaggccgagccgcagaagatcaggaggaggagtcacttccgtggacgcgtcgtccagcgacacatgccccgggacacgtcagcggatgagaacttctccgaggtatacgtggaggccttgcgtgccccatgcaggcgtgggcctcggttttatccacccacagccaccacaaatccacattgcgagatccggcccatcactggagtatgggccgagttaacttttgctgctgcgtaccatgtgcaagtgcgaatgggcttgagatccatctaccgttggatggtcggacacacacatttgaggaccttgaatagcccatctcccaccatcagcttaaatttttagattaagctgatcgatacatgtaacttaacatggtatcaaagctataggccttgagttcgtatgctgcctggcgagcctcgtgtaaggggagtgttggaatataaaatgaattgctcatcttttcccatcaatttaggtttttggattgaacttttcgatacatggttgaataactaattttgtgataactattcgaggctacaaacgaaagaattaaccattctaagctattcgagagtacaaacaaacgaattaattattacaaagttaaaaatacattaagatatttttctaagaaattcgtaataaatagttttctaaaaaaatattaccatttaggacacagggaagcgtaatagctgaataaaatggttccatctgaagaacacgacctgtgtgctcaactgtcaatagagacacaataacttcttgcaattatcctctgtgctgtttgacattttcttggttagtgaagaacagatgggtaaccgtgtacttagattggtgattacttgcacgaatcagtaaaaaagaaacattttctcggggaataaataccgtagttttcatcacgtcaggtacgtggtaggtttctcaacccaccagatttttcaaaacttgcccataaattcagtagcaagtaatcaacatgtcatttctgaaaatgataacataaataaaaatgattaattttgtgtagcaaacaggggtgaacgacgtacggaaacacggagcattagatcatcgccatgaaaattgagatcaggagatcggtagattatggtcaagattagttggccagcttttgggaaaaaatagatttatgctcaaatcagagcagaattaaggagattgatgcttagtggctactgtgttctgtactaccacccagtcacacacgttacacatgaaaaacagagaagcgtgcagcatgttttctgaatgcgaaatcgatccccgctattatatattcagagtttcagacaatcaggctggtgctatctatctacgcttgcatttcttcctcctgtcctatggcacataagaacgagcatgagaagttgtgaaaagtaattgacaagaacgataatggcttgggtctccatgacctggtgttggcacaggagcttcttgctcatgatggcgtgcgtctgcagctggtcgatcacttgctgcaaatcaggtttacactatgctgttgctgctcttttggtgtcatatctgaaactgaaatcgatttttgtttgcgtttttctgaattctgatgcatgcagacgaagcagcagcaggagccttccatggtcagaagaggagcactgaagacatcgtcgccagagctatcatctgcttcagcgatcgatatgtaagcacatcctcttagcaaacattgactgctcgtaatcaagcttgaacagtaattaacacagtttcagaccaaaagaaaaggagagaaagaattcgagaagaaaattaatgcacgctgtttctgattatgtgctgcgagaaatgtgttttcttgcagatcttcagcgggtgccaggggcagtacaggctggggccggagggcgcgctgcgcgtgccggcggcggcggcggaggcgttctgcggcgggccgtgcctggcggagacgaggctggtgctcggctgcgtcgacggcatcatggacagcttccgcttctacaacggcgcctccgtccgcgacgtccgcctcgcgctcgaccgcggctgcggcctccggggcgacttcgacgtgctgcggcgcctcgggggcgacggctacgactacggcggcgggccacgcggcctcgtgaccacgccggcgcctctgctgctgggcgccgtcgtcgcggtgcttctgtggggatgatcaatggtgattaaggaaattagaactagtttctggtgattatacatgtatgtagacagtacagtatagtatgtactctaccagagttaattaactgcagcactacggtaccagggcgtgtacgtacttcgagttagtcaaccgtatgtgagccttttttgtccattttgtagaatgtccaaggaccactgtgaatttgtttaagtgaaaaataaacaaatatttgctctttgattcaaaggatttaagtttttcaaatcttgtgaaattttaattgaatgacttattacatgtagattttagagaaaacttagcaaaagatccaacctcttagaaaaattcctttaagtttatatctctcattcgattcatatgtttttcctgcgatccaatagaacgatgtgtgtttctccgtgttttcaattcactattttacacttttcatttctatcataattttatgtatttttatttctctgtttttccattcctacgattgaaagagtagtgtccaatgtccttttaacaaaagaagttatttattttgtttattttattatctaagagttaaagtatttaaattagtacttcaacgttgagttgagccattggtacataattaattaaatataaattagtttaaatttaaaattttgattaatactatcttcatccaaaatataacaatttttagttataaatctggacacatactttcatagctaaaaatgtttatatttggaacgtagtgagtataattatcaggcgacaactatgagcgatatgcttgtcactccataccagctaacacgcgcggctatctatcttgctcgccgccacctgcgaagctgcggtgcatggttggtcgatttctgattgatgtcaggagtggcgtactagtgctgctcgttgtcgtcgttgcttgaacgcatcttcgtcgttctccccagcggcggcgacggcggcaccgcctcgtccaagggcggatgcagaaaatagcatgagcgggtgctaaggatctaccacttagatagactaaggatctaccgcttaggtagactgaggaaacaaaaaagtgtcaaaggggcatttggccccactcgctccagttatgtatgcacggagtgagaataaaccttagactattagccacgcgcaaaacaaaaaacatgattagtatgattaattgagaaattaatttgatttaatcttgcaattttaaaaatctaaaaataaatttatttgatttttcaatcaattattatatataaagtttagtactttaaaaagcataaatgaaaacccgatccctacgtttgaacaatccctaagtttttcgtggttacgtggaattactatgaaaatgagtctaaagataacattcctgtagttattcgaaaattcattaagcgcataagaaactgacagtttcgatatgttacgttatccacgcacattttttttaattaactatataataattctctctattattcctttttttcatgaattttagatctatctataccatgcttgattaccaaaaatatataaagcttttgttgtttgatttatattataaaatatatctgtagcgttagcacatgcatattactagtaatacaaaatgaaattgttgaaaagctttcatcactttcttaggtacattacagtaccatatattatcccaggctttacacattcgatcaggcgacaactactagcgatatgcttgtcactccacaccagctaacaaacgcagctatccgtctttctcgccgccgccgtcggtggcggcgaagctgcggtgcgtagttagccaacttctgattgatgtcaggagtggcgtaccagtgttgcccgtcatcgtcgtcgctcgaacgcatcttcgtcgttctcccccgcggcggtgacggcggtggccaccgccgtcggtggcggcgaagatgcggtgcatagttggtcgacttctgattgatgtcaggagtggcgtaccagtgctgttcgtcgtcgtcgtcgcttgaacgcatctttgtcgttctcccccacggtggtgacagcggccgccgctgtcggtggcggcgaagctgcggttcgtagttggtcgacttctgattgatgtcaggagtggcgtgcgtaccagtgctgttcgtcgtcgtcatcgctcgaacgcatcttcgtcgttctcccccacggtggtgacggcggccgccgctgtcggtggcggcgaagctgcggttcgtagttggtcgacttctgattgatgtcagtaatggtgtaccagtgctgcacattgtcgtcgctcgaacacatctccatcgttctcccctgcgccggtgacggcgccgccgcctcgtctaggtaacatttaaatataatttttttttgaaaaaacgcgtgcattcggaaaaaagggaaacaaattgaaaatataccgtttattttttttctctcaaaatattcggatgtaattttagtcgcacaaacataccgttgatactgtcgtctcgcacggtgagagcgggacctaattagcgagaccgacagcctcgccgttaatcactgattaattagtgattaattatcttgattagcaattaattaattattaattggataattaatcactaattattattaattaatcgctgatcagtctatttccaaaacgctgtcgcaccctcacgatgcgagaccgctcccacatcagtttgccaaaaaaaaaatacatcaataatattactgaggaaaaaaatatatgaacggtatattttcaaatttaattcaaaacgagagtccgctgctctcaaacgcaggaggttggttagtggcaggaaagagtattggtgttttggcgcgaaaagagtcgagagggcgcggagccttggcgccactaattcagggagtgggtggcagtttcgtaataaaacttgtttattttccgcgagctcccagaattccgtagaccctctcctgctgcgtgcgtccccaaatcaggagtcctcccaaccctcgccaccggcgccgtccgccccatctccgacgccgcctccccccgaagcgaagcaggtacacgccacctccaactcttccctcttcctcctgtttattcgatggcctcacgcttaggtccatctctgcagtagatctgatcgctaggtcctcctgtttaggactagggtatcagtatcaggtatggctggagagaacggcaaatttccttggctggattttcttaggaggggaactagtggtgatcaaggagggaaccacatcgattttcctgtcgcaaactgaaaacccgagtccgagtggttgtgcccttcttggattaaatgaatcaaggagttaaatgaacttgtgggctggatttaccatgtgcttgctaggcatgatcccgtgatagaactaccaggagtaggagatttgtgggatcccaatttgattgcttgcctgtgtcatcagattggtaattctgaattgtgttgatgaatatgaaaagccatgcgttttgcagagatggatacatcaggacctgcagcattcgtcaatggagagattctgaagatgttcgtcggccgaagagtgcgcacggtggtccaagcccagcgcgaggaaggcgggttgcttatcgggcagtccaccgatggtcatcagctaaccatcaaaggggcctccggtgcccctatgtcgcactatgtggagattattgggatcgctgaacccaatcaggccatccgggctgaagtttgcacagattttggtgaaaacttcggtgagaattgttgcgcctcgcattcttttcctccagtaaatagtactatgaattgttagtctgtacagtttgttatcttttacataaatccagacagtgcctgtatcttgcctattctgatgctcccccaccaatggttttttaacatgttacatagtgattggggttcgttattcttgtgttctatattttcttgagcaaaaaaatgtacagttcgcataaaaatcatactttcataagtacgttttgttacatttttcatcgtattcatgcttacaagagcaaatttctgcctttgtaaatgtgtagctgtttgtgttctatacgaattcccaaatccagaagcattcaaaaactaatattgattgtttaattgttggactttttttacctacagccaaatttgactttagttgtatgggaacttcaatctcacccctatttgtgtcaaatttgtgtctgattgatcatagagtagattttaggatgacatgcactcttgtctggttggtaaaatgtagcttttgaagctcatgggcttaacttctgggaatgagcgatttgcgattgatcatctagagtagatttcaggtggaaaaacattcttcaactaagttgaaaatgtagctcttgaagttcatgagtatacttctgggaatgaaaagctattttagcttatatgcccaatgttacagcgtttctttgtatcaattaataaaataatctcaatcaacgtttcttttgttctcgtctgacacaggacaactagtatgtggtgctaaatctttacatttgctgcaagaattttatcttagacaccctcattacaccattgatctctctatcatgtttgtctgcagatcctgcaccattcaatggactgtgcaagcttgcgaatggccagatgaaggatttgttcctgtagaggtcggcatcacatacaagacattctgccaacaaagcatgtctcatgttcatgatttctctagctttaagatccgtccaactgtttttgtcagtcatctcagtataatcaagctacttagggtcagtattggtgcttattaagacatattaaccttaagctatgtgaggacaagcgtgtgcttttgttgctgaagagcttgtggtgtttgctccttctaagcaaagcaaaccaaagcgttgtgctgcattgttactgtcgcttgcatttggatccttgaaagctgtgtttcttgttatgctctccggtgcatcttgatgaagtgagctagtatgatgctttctgatgaatttcaacatatcaacatagtaacccaaagtttcaaattaactgcatgctcattgtcctgatgcaagcatattactttgattcatttgttttctgtttataaggcgctttggtggttgtttccgactaattttgcacgcatccacccaaacttgggtcgtttgcagcatatatatgctcacttctaaaaaaacaattaaaatgaaggtcgtgactgataagtctgaacattaatcattcatcctcttcttggaacaaaaatcttttcaagcattcaagatcaaaatgcttcttccttgataggagtggattggtattgtgtcactctcgtacctatcacagcgattacgaggcctcatctttttttcacttaaccatagaaacatggtatcttggttatgctatgaacaaatcaaagagacaaaaggaaaaggtttcgtttgggctcctcattcgtgtctcactgcgtttgttaactactaccgacttcagtgtcttcgccgacagactacttgcatcaacaactacttgaaaacacaatggtgatgatgatgatgatgacaattgtcaggctaatctgtttttgaaagcaaaaggcatgacaatttcactgtattaattgaggaggaatatcacctataagagttttttttaatgaatgatatatttcaccacacgcacactaaaaataagcactttattagatcatgcagaaaataacaagaattagtggtattaagttcccatcaaagtaccaaaccaaaggccaaaagatcaatgtagccagtcaaatgcatcacagtgatttgtacagttgtactaatgcacatctgaagtgatggatcaatgtagcattgccacaaaaagatagaaacaaacagagcaaaattttaatttacatcctttgttttccttttcttttttcatgcaagccctcgcaagattacgtaaagtgctatttgaacttcaaaatgtggcgatttggtagttttccctttgaaggcgggttttcgcgtttacgcttttacccagaggaaagcggatgcattgacttggcaagcccgtagctccgggccccgaacccgaggcatccgaggacgaggccctgccggtacggcagcgacgtcgcgcgccgccgcggcggcggcgccgacgacctctccgacgaggtggaccgccgcgccggctgcagcgacggcgggcacgggcacgggcagggcaacgctagcgttgctgtcttcttggaccgcgacgacggccagatggacgggggccaaaagcccgatgacctctcggcggcggcggcggcggtggcggagatcgctgttcgccgtgctgccgaggaggaggtcacgcagcgatatccgccggcgagtgctcttggcggaggacgaggaggaggaggaggaggaggtggaggtggaggaagacgacgacgacgcgaaggagtccgagggctcggcgatctaggctagatcgaggtccgcggcggcgacgccgatctggccgcgggagcagcagcgcggtggcggccgctctccccctcgtcgacgcaaccttcctcctgctccccgaagcccgcctcctcctggcgtatgggcgagaggcacccgacgcggatgcgccccgcgacgaacagctcctcggccgagctcatcgccgcggcgccattccctgcaccatgctggcgcgcggcgaactcgaagtccccgccgccgccgccgccgcatccgtggtcaccgtccacgcccggagcatagtgcgccgccgccgccgtcgtcgtcgtcgtggaggacggcggcgagcggaggatgtagtgcacggggctggccggggcgctgaagaagaagaactgctcgctgccgccgccgtcatcgtcagcgtcgtcgacgtcgtccttcccggcgcagcggcggcgcgtggggcttgacggcgccgtggcggcggggctcccggcggcggcgtgggcgtggctcagcatcggcggcggcggcggagtgaagggaagggaaggcgaggcgagattttgaaggagacgtgggtaagcggagtggttagcggccgggggggaggtatttgtaactgtgcgcgcgcgagtctcgatcgtgggcccagactcgcgctactacgtggggcccgtggcatttaggtaaataaatgatcatttctatttcgtatttatttcgaaatttctaaagtatagaccgaaagaaatttctaaagtttagaccgaaagaaaaaacaaatcataatttaggccgaacgaaagaaaggtgaagatatagggtgtgattggttactggccacaatttactataactaacattagataaattgtgacagtcacaaaagtgtggtgaataaattgctaaccacaaagtgtagcaaagttgacaagaaaatctagtttacgacatgtgggatatgctattgaaaaaatatggcaagtcacaatcaaatggctggctaacaaactgtggtagctaaaactgtggtatggcaaagtgtattccttagtatcaagattgttcttgaattgttgtgagaggagttgcgagaaatgatgagatcgagtgtgaatagttatatttggattaattggtaaatttaggttgtatcatcgaaaccttcgtatgccttttgtacactaaatgagctaatactaaagcacacgtcgccatgcatcatacttgatctattccaaaatgttaagcaacaaactaatgtttgatcagttccaatatttcaaaacgagtgcaatctagcattcgagctgtgtagtgacagtgtgacacacacataagagcttagtgctgagcctttctcaacggcttaattgcgcgtgtagtttataactaattaattactactaatcaatctttatatactaccttaaattcggcggggtcaacaattctttatatgcaggcttcgatgaacgtggcgagcacctgcatgcacatatgcaggctggcacgcacaaacgagaattttttttttttgagggaaacacaaacgagaataattatttacttaattagtgcgaaaaatacaaacacgaacacggtcgagacagtggagaaaagtgagaggaattaaacaaccaacgtcaacagcaacaacacgtagcgcccatgtatagatgtatagtacaggtggtgacgagcaatataatacggagtatatctagctctctcacagagaaaaaaagaaaaggagaagtgtatttgcgagtaatctacgggcacatttaattttatgggagaagcggctataatatatctagatcgagtgtatatcagtactatataggagtgaatcgtagattaatttgtagtggtggaacgtacgtgggtgccaaagttttggcaaaccgctccttcgcaaaagctacatgttagttattaaaataaaaagcacaaaatacaccagtgatatgatggtaaaatcgtagattcatgacttcaactatcacggtttaaattaatcccaatactcacaaatattacacgtacatgtaaattgattttcaatgaggatgtgtcactgatgtccgtctatttgaacgtgtgtacatgcatgtagtggtagtttcaaattactttttattttatttttttcctaagtaaaatttattggctttcaccatcaattaataaattaatgtaaataatatttatggttttagattcatcataagaaatattttcatatcatattatttacatgttaaattatatattttttaggaattaatggataaagttagaaatatttgacttaattatattaggatacatgataagtaatcagaaatgaagggagtatataaatttatgttgtagtttacgtgaaccagcgtgtacattacgaatattaggtacggtgtgcagtgccgttttgatcttgatttcacacataacacaagttcattttgatacatcaacaactttattaaagcatgtgtaagtatagttgtgtgtgtcttttatgtaaatgagaaaaaaaaaactagaagcaaattgagatggaactgttaggatttcttctagccctgatccacatgtatgtcctggaacgatgacagacgcgcgtggcgtgagttcaggtcacatttttctctacaagcataaataaagttgtaggcctcctttcgctttttctccgagagatatcgagacaccctaactaaactatcaaagtaatccttggattgcaagtccaaaaaaggccacatatttggattgagcgagacgatcggtcgatgatttcgaagcctgtcggcttaatggcaattaggacagcatgtttagtggtcggctgttgaacatcagatacaattatctgctaatctgcaagcgacaagggaacaaatgtaaacccctttagatgatcggtttgtcctcaatcgatatataaatcactcagcttaacatttttccctctgcaatatttcttctcaaatataagagatagtactatctactactactagttgttgttggcttcttcttgctgcatttttttttctgcgagattaattcgttttattttgcaatgttgtttatgtgtattaattttgggaggtttaataaattgtgaatgagatgctggttgttggtgatgatgaggattagaaatggttgcgacctactgctgaagcagatgtgcacgtcctctccaagctaatcaaacatcaatcgacttggaacgagtagtagcatgggtctgggtcagaggcaggatgatcacttgcagctagcaactcgccttcacgtagcaaattgcaaaaggaatggaagaaagtgatgggcgataaggatttttcgacttgttcaaagtctttctcgaacgatgtgttaattatagttcagtcctcgtcgatctgggtactctcttgtttaaggtaatacgttttatttatgtttttttgcaaaaaaaaaatccctttttttttatcgggaacatgagcttgtgtagcaagatgatgttgtacgtgagtattggaacaaaatggcccaatcatctcctctcagcccaagtagttgttttgggtttggattagggccgttagcctgacgaggccttttcagtttgtacggtctaggtaaccattgaataagccaaatgacatatttgcaaacgagaagtaacttttaaataaaataagccaaatgatatatttgcaaatgataagtaatttttaaataaaacttttatatgtgtgtccttagcgacctaaaagtaaatggtgaaaaataaacttcgatgataaaaacttagaaatcagcttcaaatttaagtttgaaaatttaaattttggccgataagtataagtataaccgaaaaagtggggcctgtaaattatctgcgagatttatgctggcagtccactcgtcagcgaaaaccgccgacagctgttgctgctggattttgaagcgtgattcctatagcggtccattttgaatggacaccattgatacgaacagatcatttcgattttgtatgggatacaaccgtatccgacgaatcgccgatctcatttttgtttcttttttcttttactctaggcggcggttttagtaggcgttggatgaaagagcaacattacaaagggtacaaccagagttcataaaaaccgtgcggttatcaaaacttttcaacttttgaaaccatggtaaatctcacgaaaatcacatagttaccacgataactgatccacggttacctcaaccaaaatagtttggtgaaccctgagtacaactacaccaatatcgttatgtttcttgtttgatgcaaaggccattctctctggtactataaaagcagagtcgccattctctctagtactataaaagcagagtcgccatctgccattccgttcgtgcgcatgtttgcacactccacgtgagtaacaatacaatgctttatcatcaatcatcatcctagactatccctaattatatgagcatggtccattacattgtataagtacttctactacatatacttaaaaaatatctttataggattcttacgaataataaacataattgttttgatttaactagatgaaaattacggaaaatctaaaatttagacatacttacaagttagcacgataattggtgctagtgagagtttagtaaaaagaaaaaagaaagtactacatatacaacagaactcacactaccaaggcttctgcagctaaattgttgctaagcgcttgctcacatatattctccttaatggatataaatcctcttcgaagacagatctaaaccctcgtatcctctctccgttgccttgccgccgcccgagtaggtcactggccagtcgagcggctgctaggaaggcggtggcggggttgttactcggcaaggaccttgcatcctatgttgcgacgaagtggggctgtcgagtctggggttcccgtccacagatttggcagtagcacaggagacggcagggaggtgggcagcggaggcatagcgacgatgggcgggcccacgcctagccacgtgggttggtgtcgggaacggaagtggtcaggagggcggcgggtagcggtgaggctacagtagcggcgtccctttgggcaacggcgggtgtggcgaaggatggtggcagcctaagcgttgatggtcagtcctcggcagggaaaaggtggatccggtggacgtggtccctaggcagtggtggcgggctgggagtccaggaggcggaggaggattccgtcaacggttacggccctatggatgacagaggcataggaatccagcaaagtggaagcgaatcctatcaacttgcgtttggtcggctaattctaactagatgatgatgaatgaaggtgggctaagcggtggtgtatggcgtcagctcacttcaagcggatgaagatggcatcagcgaaggttcgcaactatggcacaattgggcagcggcgactagtcgactaccacttgccaaatctagccgtttcaagagaggatgtcgagaggcagggttgtaccgaggtcgtaggtttttcttgcttcttcttcttcttctttttcttcttctttgttgttgttgttgttgtgtgttcttctctttgttgaggtgtgagctatacttttggttatatatatccttcgtggatgtaaagattggattaatgaaaatccattaacttaaaaaaaatctgcaaatgactactggggaaaagtaattcagcattatcaaagcaagataaaagaaaaaagaacaactttgtataacatggctacatcacatgtccacactcttctgttgaagaattgaggtgcaggatcagttgggagtgtgagctgattcatcagcaactcgtagccaaacccaacctttacaagccctctcgattcgctgcctcgttggcaccggaaggcgctctcgcctctccaaagcgaatcaaatcgatcgatcgctttccccgccaaaaagcaaggcatgcacagcctcgctgaaagcaaaccgaatccgaatgtcgccctccacctccaccgcacggaaaccctcgcccggcgtggattccttcccttcccaccgctgcaacccaccattattctcctccgggcaccacgtcgaacaccttatatacgccggcaaaagcgaagcgatccgcaggcgaaatccttttgattatattcgttggtgtggttgagctcgtcggggtgagtaactagcatcgatgcaggcggcgatgccggcggcggtgacgcacgacgacctgtcgctgcggaaggcgcaggagaggcgggcggcgcggtcgagcgggcgggcggcggtggcgctggtgtcgctctcggtgctctgcggcatcgtcggcttcatcctctgcctcgccgccgaggggtcgcgctccgaggcgtcgcactacctcatgaccgtcggcggcggcggcgccaacgcggcggcgaacaacgggcaggtggacgtctgcttctacaactccagcggccgggcgccgctggcgttcgccatcggggcgttcctgatgctcgccgtcgccatgttcgccgagcacgcctacatgctgctcgccgtcgccgcgccggactcgtccgcggcggggctcgccgtcgccgagggacacccgcgcgtcccctccgaccccgccaggctcacctggcagacctgctgcctcttcttcgtcacctggtacgtcaatgactagtctaccgccattgatgacgccatgattggggtttcgaactaacgctcgatcgtcgctgctgcggcgcaggatctgcttcgggctcgcggaggtgatgctcatggtcggcatcgcggtggagtccggccacgtcagcgactggaggaagccgcgggcggtgtgccaccgggtgcgcccgggggtgttcgcggcggcgggaatcctgggactcatcaccgtcgtcgtcggcttcgtcgtctacgtcacggccctgcagacgaacaagctgcgggcgcagcaccccgtcggcggctactacgtcggccacggcgccccacacccgggcatgccgccgccgccgatgccgtacggcccgcacccgcacccacaccagccgccgccgccggcagcggcggcgacagcgccaagcgcgccggagatcacgccggccgcttgccaggtccagccaagccgagcggcgtgcgtcaccaagcagtgcgctgatgcagtttgaaacgagtagaagaatttggagattaagcagagacggtgatgtttaaaaggcatctactcttttccgcgtaacatgttctttcgtgatttgctatattagagcatttgatttgagttatttgcttgtatgtcacaccatttgtttttagcacaaacatgatttgaattgtaaagcacttgattcgtgattacatctcaacaagtttcaatttaatttacttggtctattagcctccgctgtatcatctattcggaaatacgtgcagcatccatcacaaacaggtagaccggagttacagctccttggtggtaagcacggttatcacgcagtaaccgcagtaaaccgtacgaccatgtaaaatttatcaaaatttcaaattatttttaaattttatttgaatttaaggaggttaccgtgaaatttatcaaaatttcaaattatttttaaaatttatttgaatttaaggagattaccatggttttcctttcaccgtacccctgcagtaagagtggttcggttttgcaaaccctactcagtggtattaactaaaaacgcagatgcaaagagatcactagaatagtagaaccgaacaaaccctagcaatatataatttaaaaggcataatggtttacatgtccggacaaactgcaactcagcacactcctgacgaaactcaaaaccagacgggttcaggaatgtgttgtgacggctttgcagaagcttcgactcaggctatacaagtagcaaaatgttgcacaccatactaaaagatgcaaacactacatagtagtagcctgatgaaaaacgcagacttcaaagctttaatccctgttacagacgtagtgatatgatatccgtgaccagtagggaaataatgtaacactggcccccttgaaacctttagcttattgaaccaccagaacaattcagtaccccgcacagtggccacaatttaccacctctggtcaaatctgtcgaggaaatttgaaatcattacttgttgcctcaagtgaatgataccagaacagaaaggatttatggtaagagtggaaacaacccacaataaacacaaaccatgttgaggattgagagtacctgtatttatttgaattgagcagcaccaccgccttggccaaagtcaaaagtagcaccttggggagcagctaccgtggtagctcccattgtatcatcctcctcatccatccagtaggcctcaagaatcttcacagctttttcatagatctcattgttatcatggctctgcaagttctcaatcttttccaaaccttccgcttcatcaatcatctgggaaaagacattcacatcacctgcagccaaggtcttgtcggtttctcctactttaagaatgttctcgagaccctccaaacaaactgtaacgattcttatatctgggcaaataagaagatcacacaatggcttgatgcagccctcgctcaccagatacctattttaacaaaccatacaatatcaaatccaaatgaagcttaacatgaaactatgaaagcggttatatttgcatttcataaagctgaatagaactggtgcaaggtgagtaaacatacttgatttgatcatggctaccgcctgaagtagcatttgagatggcccatgcagcttccttcttgatatcgaactctgccgtttggagcagattcaccagaggaccaataatgccagcatttatgacagcctatggtagtcaatgcagcaaattgttgaacatttcagaacatgcacaatcaacaagatctatagctataggctattataggttaaggacgaaagattgcagctaagtgcacaagttcccaaccgtgtaaatgaatcaatcatccatatgctcccatcccctccccttctaggaccccaggtcccagcagcaacatttggactagtgattaggctgccattgatactttgcgagcaaatcatacataagggtttctttaagttactaccatgttctcagtctttgtacaacaaggatgagtctgctaacaagtgtaatcatcatgaaaggaaaagttgacctgaaagcttgcatggaatatgaacattgtgtggtgtttatggtttggagagggaacacaattaaaactactaagtatgcactacacaaatccttcatgacttagtagaatgatgagcatgtcagtattttttaagtctgtacacatacctgtatctgatctttgttaccagcagtaatatttgaaatagtccagcaagcctctttcttgatgcttttcttgagattttgtgtcaacagacttaggaggcaagggagggcttgatgatcaatgatgcactgtacaaaaaaagggggtggggggagatgatgagatggcaatatggatgtcaaaaaagcaattaactttcatgctgtgatctacagtagatatttcatattatatgaacaccagctttagcatagcagaaaaattctcagctctcctaaaactcaaacaataataagaatacaataagaaaagccaagtttggctgaaacaagtacagcagctatgacttgctgcaaagcaggcaatgaatttttaggcaaactagcaaattgcctatgcgttgcaatgaaaaaaaaatcatgctgtgcacactgcatgctcatcatttgaagaatatgtagactggctcttttcaacccctttatggattccttccctgtagatcttaccaaacaatatggacattatcttttggaggacgtttaaatttattgagcatgtgggtttcacccaacatggagggcccatacattagtgatagaggtagtgctggcagattcactgccaccaccactactaccttttaaagtagtatagagtatagatctaagtgatactgtgagaggacaaatctcaagtatttaagtgacacaaactagacaaatctttaattgatgggcgtaaagagtaggtcaaattgccaaacatgtgcatctacatatgacaaatatgtgcatttatttttcaatagtttttacaaaacattttccacattagatgcaacctctagatttaatatcaactatgatattaaacattttccacaagcctaaaatttaatatcaactgtgatgaacacaacctctaaatattaagctcaagattcatgagtcttagtagttgatatcaattgatacaaaatctgtcagatatagagatgcaaaaaatcaacacaatacctgagtttgcgcgtcatctccagttacaatatttccaacagttcgtagtgcgggtataagcactgaaggtgatggatggcttcatgttgtaaacagtataaaatattaaaaagggtataatgagagtagcaaataagaatctaaaggaaaatggcagaaaattgtaatgcaatgttgtcacttacaggagaagctccacaagacgggggcaaacaccagcttcaatcacggcttggatcttgtcattagtgccatcagataaatatgaaagagcccagcacgcatcagtgagaacttcctcatcattggagtgaataagccgtgccagtgctggaagagcaggcctagtctattgacacccaataaacatcatgttaaggaactgtctttccctactaactacagtagagtacaaagaaactttgtccaaacctgttcaaatgatggctgtggttttcctctgcagaagttcgataaagtccaagttgcattccttagcatagagagtttagtgtgctcattcaactgtgctagcagaggcagcaatgcaccattggcaagaacaaggtcacggcacttaggggaatcaccagcaacattgcccaatgcccatacagccttcaattttttttcaagaggtaaaaacattaataactccaacaatgcactcaatcaaaataatatcaaggaagtacagaaagcacaaagacaagtcaggagatgatcggatacctgctcacgaacatcatcactagaagaaccaagaagcttcacaaatattggtacagccccatgatcaatgacaacctttgtattctccgaagtgccagatgcaatgtttgtaagtgcccacgcagcttcgaactacaaaatttaattcaaaagcaccacagtaataaatccatttttatttgaacctaccagataatgaaaataatattgtgttggcacacacctgtagctgggggaaatcctctctggtaagaaactgcacgaatctaggaacaacgcctgattgaataacctcttcaattggagggctcctctctaattaaaaattgtaatgggtgtaattagtaattaacttttgttcaactattattttcacaaggtaacagcccaaaacatttaagaggtttgtacctatagaaagcaacttgcggaactgtgttgtggcctcaagctgaaggttgttatcgtccgaataaactccaccaatcatagcaggaaggctttcgagctacaacattcaacagagatatcaaatactcaacttcccgtattaaaccccaaaaagggtttaaaagcagtttccttctcttttaggggtggtgcaaagaacagaaaccagaggtagtttaacagtaacataaatgtatgcgttatcaatgtaggacgtctctagaaacatgaccagaaacactactatatgatttatgtgcttccatgtactaaagacaaggttcagtcataaggaaagttgcactggaccctcaatttcaagatagcacaaaaaatagctataaagatataatatggcatcagctcatttgtatgcttctatcaaaacataagatgaaacaacagcaagatgtacactaaaaattatcaggaagatcaatcattattacagttcctggtcacctaactaattatccgcagtgaatccgtggaagatttgatcctaagaccacaatctacatgtcctaaaactaaaactagatcactggagctagcaggcatgtacctggaaacatttcaaacgctaggagttcgcaaccgtgccaactaacagtacttgtaatattgtcaacagaaggagaatcagaaatcaagtgactaatcgaggcatcgaaacgtggtgctaagtgttgcctacatctagcaggaacctaccctcacccgcacgctagtagacatgcgggtataataacaaacttaaacaaatatgccgcagacgaatcaaaaaccctctcaaaaagtgcaatccaatccaacacctacctaaaatatgggatccaggacacgatgggatagcgtcatcggaggcaggggaggggaggggaggggagcgggggggaatcgaggagtatactactcaccttcttatcgacgccggttgcggcggaggcggggacgggggcctgggcctggagcccctcgcggcgcttcttgaggaggctctcctcgcggcggctcttgcggatctccaccatgttgtcctcgcgccgccgcctcccctcctcggcgtccaccgccaccttgtagcggttccgccgcacctccacccgctcgctcgggcgcagcgacatggctggctcgccggctgggtgctctccccccctcctctcctcgcggcagcggcggcggcggagggagaggcaaaaaccctagcgaggcgtcggggcggaggaggagaggaaagaggaggagaaaccctagtggccgcggggaaagggggggagttaaagctcacacaccacgatccaaatattctctgcgatttattttctttttctttttttttaatctgcagagtctgccacaatgacctcttccgcgggccgcggcttcgtcgtgttgagtttcgagaaggaaacgcgtgttgggcccaccgatgattgagcccggcccatctgtacatagtctcggtcaattttcattttttaaaaaaaaaaactcgtttcttacatccttcaaatttagctgtacagatctgttgaagtattagagcaggtacaatagcaggctataagctagctgcaaatatattttaaagagataaataaggagagataagggtagcgggctaaagatttgtagccagctgtagcacggactctaagacgcagtttatatatgacaggtgggaccatgtattaatagtgtagtatgtaactattgtatgaatgagctattagattggctatagatgaattggagctagtagttggctacactattaaacttgctcttaggaattattcaatggtgtgttaggtagtaatattttaggacggtggtagtagtgttgtttgctactctctccctcttagaatataagaatttttaggtttgagcacgggtattaagaaaatatgtagaattaaatgtgtgaaggttgtgattggttgtgaagtggaggtaagtgaaaaaattgaatggtgaagggttgtgattggttgagaagacagtgttggtgaataagttgttatattttgagacaaatcttgagagttataagttgttatattttgggacgaagggagtagtagaaaaatttttagtgaggggcaaataaacttatttctattgcacaaatccttcaaagtcagccagaaattcaatgctttgaaaataaaatgttagcaagaaattattgcattttcaaggtcttatgagctgaagctaatttcaaattttcgaagaaatacacctttctacgaagggggggggggggcaagggggataaactgtttcatgtgcgcatcctccaaattcaaccggaattcagttctggggggaattagctagaaatgcatgcattttcaatgtctcctaagctgcagttgattttaaaatcgaaattaaatttaggctctggaattgcaaatatacaaaaatctttatttatatataatggtgctacaaaagtatacatttaatttagtcgctgttacacttcaatatactgctcatgcacattttgacatcaaggataaattacaacaaaaaagaatcaacaacatttccattcaaaattagaagaccctcttgaatgtgccttctctttcccgagaccaacaattacaagttaacacatttttcactaagaaaacaagatcgttaaaaaaaaagaagcgaaagaaaacaaattaaaaagagaagcttcaatcaccagcgctgctggagcgcgcttgctcgctctcacgcaaagggtcgccggccggcggcacgcgtgcgcggtgcgcgcgccggcacggtggcgggcggcgagagcgatcgatcagatcatgttggagagggagcggcagatctcggacatctcgaggagggaccggttgaagtggtccatggggttcttctcgccgaccttcctgaactgctcgtcgcagccctgcatgtcctgcgccgccatgcccatcatggcgcggatggtgacggcgtccttgaacccgatggcgcgccgcgccgcgccgaggttgtcctcgacgtccaggtacaggctgtcgcacaggtccagcgccttcgccgccttcggcgtcgccgtcttcaccgcctccgtcaggtgcttccgcgccgcctccgtgcgcagcgcgaacgcgtccacctgcatgttgagcaccgccagcgggtccacggcggcgccgtacttggacgcctgcttccccgctgtggcaatgcacacctccgggtacgacgtcttcttgcatatctccgccacctcctcgttctcgccggccgccgtggtccagcaggccgccgccgccacgacggcaacgacgaggagcagcgtcgcgtgcgccagtgatctcgccatgtctgcctctggtcttcactagctagtctccactcggttcccaacgccaacgttgtcgttgcgggatcgattgaggttggccggagacaggggcgagagggagataaatactcgcgaggctgatccgccgtggggcggtgtggtgagggaagcggcaaaaatggcgggtggcctccggctggccagctgcttcgagccgctcgtttggtgtttgctaaaatgccaagctttctatttttgcatggaacccgcggagccgttggaacacaaagattgcagtaaaacttcttttttggaaacattttgcatttcttgccaaattaacacatgcatggttttaacttggtagcaaaagtaaataactaaatactgggaatatattttatctgcaattttgcagaaaatctgtacatacaagtacaacaatgcctagattgcaccatgcatctgcaagccaagggattaaagtgtacatttgtgatcacgccagctgtccatggatgatggggatcacggtcctttgctgtggtcaaacagacctaaccgaaaagtctgaattcctaccgcgccacaaaaattgttgtctaattaatcaagctatagtatacatgtttttttatactcgatcaggtcataaatatttgatgtttacaatcaaatttagacaaactttttaaaattttgataattaattttgtatcaagatgaatatgtaaaatcctacaagtttttaaggcaaatcaattgaaggacttaagaaattaatggttggaatttcaaaagcttaaccaacgtatgacgtattattctaaatgccaaatatttattgccaatctagccatcaaagggtcagtttggtatttgaggtttccgtttattcacatcagtcttctagtaggtatagtgttggcttaaaaacatcgtgggactcactggatgtgtcacatggttaatcctaatcaatatttctgttagaaaacgtttttgcccttaatctgcatacactaaataagagaaaaaaaatagagttgtacacgtacttcctattgttttagcacgtgcacacgagggttgagttttaaatgattgtagtatgcacatggaagtacataaatatttcctttttagataaaaccaataagaaagtattgtacgcaaaattcaataaaaaacatcatataatgatgggttaattggatccatgctattacaaatataccttttagataaatgacactattattcacatatcagctacatgccactggaatttgggaaaattgaaatcgtgtcactctgtcaagtttcccgtcatatccctagacgtgaaacccacatgtcggttccatcttcatccatcctccctcttctttcttcctcacgtatagttgattctaatagagatttttaatagaaaacgtgatggagtggggcacggttccaatttccccaaattttagtggcacgtagccgatatcataaacaatagtaacatttatctagaatgacatatttatagtagcatggatccaattaactctataattattgttggatacttggatgtaccgctgacatgaacttagttatatgggtgtctcatcatacattttcaccacatgaattgcaatgtgtgtgtgtgtgtgtatatatatatatatataaggggtataagggtcgttgatcaaccatccatgtagctttgtaagaacatgttcagttaatatctaagagagaggggttagagggaaagcgattatacagcagtagttggttaggtttacccagctatgtagcttttctaagaacatgttcagttaatatctaagagagatggattagagggaattgagggaagtaatttcacactataaaataggtgtgaactaatctttttcaaaccaaacaaggactaagtaagttcaaaagaaagagtttgaactaaaatataaaaacttaaaagagtagtaggatagacatatcggaattttaaggaccaaactgagacatgagtgaaacttggagaaccaatctggctattcacctaaagtaatgcaaagtatgtcttagtatgggcggtacatgccgactaaaattaaaaccacacttgagctagaagaagacaacccttattacacctttacgtgccaatggcatatacgatccatctaataataaataaatattttctataagtatggcagaaactaaacatatatataacttaatcagacctgctcatcttaaattatgacatggtgaggtaatttgtggttgcgacccataaaacgcctaggtcgttctcttgatctctaacacatgaataaacatacacggaaagtgaaatggttcggcacgacgaaggtcgcataactcttttacccacccggatttaagtcataagttaatatcactgtcatatccttcaccaaaactttttttattttcttaaagacgaccaagtgagtagtccctccgttccaaaatataagtaacaatcacccttaacccaaagttcaagaaacaaatattttcactttctaatctggatcaccctaataatatagtgcatgcactcaatagaccaatagaattaaagatcttgagagtggaggatttagaaaaataataatttagtgaagaagatgtgctaattaattatatgcatgcacaccttatattatgaaacatctagaaaaaaagttgtattatattatggaatggagggagtaacaactaacaagcaagttgttatgatttccaactagtagcttttattcatttaatcgagcaaaaaaaactgcataaaagaaacaacttaattccaatgttttttatcaactgcagtttaattaggctggtcaaatccgccataattaacttcgattgtttcgcagttaagcatctgcctaagttagttatttcaccacaccaactttatgatccattcgttaggtccatggtttgtcctcctactgaaaacctcacttgtaaaggattttgacctctacctgtatacgggccagcaaaagtcaagcaaaccaatacaaggtcatggcttcctcccgccaggtcaaagctggcaaccgaaatcaaccacgggaaagcgccgtcctggacgagattaacgtctctgtctcattcttcagaggaagaaaatgacataacccaaagaattagtaattaattaaatacgatcatggataaaaatgagccttacacatcagttagtaattaattaattacggtcatcagtttactactccctgaaacggtcatcagtttactactccctccgtttcaggttataagacgttttgaccttggtcaaagtcaaactatttcaagtttgactaaatttatatataaatatagtaatgtttataatactaaattagtttcatcaaatcaataattgaatatatttttataataaatttgtattgggttaaaaacgttactacttttttctacaaacttgttcaaacttaaagcagtttgactttgacaaaatttaaaacgttttgtaacctgaaacaaagggagtaattaattagccaaggaattaaactgatgtgttaggctcttgatgatgattcgtttgctgtcgtcgattgattatggaagaggtaaagtgtcattatcagtttggtaggggggagggggggggggggggagggtncattgggcacagggcaggcaaagaatacgcatgatggcacacacatgtggtctacgtctaccgggatatgatacgcatctatggctctcactactgtaccaccctacatggcatcgtcctttgagtgattaaaataattagtagtactattagaaatttgattagtttacgctaacctagtagtagattagtttagtgtgagctatcactgtttttttcttcttccatttcagtaggaagcctaaccggagtagaatatcctttgattacaagcacgactgattcaaagtttgaaattcaagatagaaataatttcaacattaggctacgatcagttgagccactgttggcaacatgtagaaaaaccaacaaaatattaaaaaaatatttatggctaaaatttttacatatctaatatgagtagtttaaatgccaaggttgtgctcgggaggagaggttagcaacctctccccatacacggaaaacgtggttacttattaacatatggttaattaagtattatattaaaaacttaaaaatatattaatatgattttgtacaacaactttcccatatatcttttttattaaaaaacaatgtttaacacttcaggaagcatgcacgtagaaaacaaaagaatagaagttggtactccctcgatcttaaaatataagcaatatggattgattaggacacaccttattactacgaatctggatgtaggaagtaacttatagacattagtaactgaagaatagattatgagaacaaatataaaaaaactcataagttctctttttatttaaattttaaagttttttttagttcatacttgtaccatgtgtctgctcgtggtgaatttcgtggtgttttttttttactggttggtttcacctgtcagtggcagtgccagcttcgagcagtgcaacggaaaagggcaaaaaagtcagcaggcggaaaaaagcagcagcgagaggagagaggagaggggggcgcaggcgcaaaaagcaagctaccaccgcagcccagctcgaggccaccaccaccaccaccaccacggcacggcgaaaggggaagaagaagaggaaaggaaaaaaaaaaaattccgcagctgctacctctcgccgccttcgccgccgccgccgcgagaaacccagcggcgtcccgggaaaccctagccccatcccccaccccgccgcgcgccctcatggggcgtccgcgtcggcgccagtagtagacaggagcggggggcccgccccgtcgccgacgaggggcatccaacgatggcgcggatacggcgcgcgagctccggacgaggttagtgtggcccgatctgagctgagctctccctcccgcgcttgctttgctgctggctttagctaggtggtgtcgtgtggtctcggtgttcgcgctatagctaagcgtagagagcaatccgagggtttagctttcgcggcacggcggcggcggctcgtgcctgtgcggcgaggtgatgcggcgaggggttgggcttgaggggagaaggtgcgtgatgtcggctaatcaactactgtggtggcggtgggggggttggcgggtttgttccaggatcttagtcgtcgccgcttgttcggtagctcaactctcaggccgtgagaatttgggtttggtgtcgcgggaatggtggtcatactactatgtaggattcagtgctctctgctgccgtggcgatactggatatctggaatctgatcgaagaagtggggcttagcttaggttatcaattatacaaatccatgccttggatagctcttggttctcttgtattgagcttttctatgttgattacttaaagctgtaaggcggttttctaccacagaagcactatacattttctggaccttccatgtcaaattgcaccagttcggagataacaaccattgctatacagaacaagtactttttagtctagttcatctaggatttgtatcgaccaaaaatatacgatgagcagctggatgtccctagttcagcatacattgggttttaaaatagtcaaaattgacattagtctgtatttgttgtagcctctgatctaagtttgagtcactacaaatggatttgtgatattgattatcaaattcaggccaatggatcctcctttacaagaaaatggtcattactgaactcttgttactggaatgatgagaattcctgcattgctgggtttgcggaaagtatctactttatgcagagaaaataggcaacatcatgtttaccatgtttggccttttctgggaaagttattataagttttaatttgtgtttatggcttcttatggaaggaagctctttcgttttcttgcaataacttgtctttctagaactaattagctcaagtcaaaaaaatgtttaatccaccaccatagccatgttaattagattatgctttcatgcagggtaataaacatcattataggttgaacatataccatcactgtctctgctgagtttatcaactggagataaacactttgaaaatagctgtcatactatttctggttctttatagctaaataatggtggtttatcgaaatatttacatggtctgtaaaatctttaactacacatgccatgaggtcttatgaaatcctctttgctattgatttacactatctttacttatacttggaaacatctgtgaatgcatataaatatatgcttgtgaacttttgttcaactactccctttgattccaattataagtcgctttagacttgtggacacaaagtaagaaaacagctcaaatgacttagttgacttcattggaaaagatgagccatttatttgtgagaggggtatcatttatttagcaagggcaaattgggaagaataactgcagaaagtgcctagaagttccataacttcttacatttaggaaagagttgagaatgctaaagcgacttatatttggaattggagggaatatttgatttatgtgttagagtgactatcttgaaaggtgattctgtacatcttttgagtgttcatattcattagttgcacctgaccagtgtcaatgtacatacatattctttaaggcgttgacttgttgattcttcattgtactgtttcttggcagggcttttggaagatgctcgaaggaaaaccttcttaaattttttggctgtggtatttactctggaattgattaccagaatcaatttgattgcccaaacatcagctctaaatgtggttgcccctgctatatctccatctcaaagttggagaccagttcgctccatgttgtcaaaagctaaagttgacattagtatttcagtcagcgaacaaagacgaaagaagctatattcatcaccagctactctatctgtgcaccctccaatgtcagcgccaagctatagctccatttctggtgattctgatctctccttttattcttcagacatgtcagataatttggtgcagcataacagacgctcagaagcagaaatttctactcatgtagatgctgcgcctcctgatgcagcctcaaatactagtgcagctccttctggattagtacaacctccagtatctcctcacaatggtatgtttgattgttagagccttggaatcatctaatttatatgattttcattattcaagcatgacttgaaattatatggtgtaaatacaatgcgtaaagggccatctggttattcgagtagatacacaaaatgatgcctgtgtggttatttctgatttgcctttccaagaatttgttctttgattgcacctcaaccgtaggcatttgagtaaattgtgcaattcttttaccaatcaaccaagtgatatcaacataaattattcaattgcaatttgcttattaatagttaattagaaatgttaactctattgtgcatatccacattcacattggaatgtacaaagcttttacttagatctgtgtggtatcatggtgcaccttgatgattcggatcaacattttggagatcaatgctttggatgtttctatgatcgcaaacgccggcaacagaaaacgcgcaaagaaccagaattaagctgaggggataaagctccatcattatcttgcttaagttttgttggtcattatcttttaagttagtcgtcatctttagttcactatctcaagattgttagccatttatctccaagtttgttaggcgtgtcaaatcccttgatctagaaaagggtatccgggtgtaaggaataattaagtaagattaatctaatcaagtttaggcatgtttagagcctctcgctctcgggggaagagccctgcctcccgccagaggatgatcgcgagtttcgcccctaccccctccaaaatcatccactcgagcattcactgctctgacagccgctgcaacaccatcaccatcgtgcgcgtatcactgcatacttgaagcatactgaaatgctcagtgcctgcgatccttttggccaaatccaattctctgaatactggtgtcagatgtgaaactggctggttgttttgtaacctgtttggttggcattgtaccagctttcaataaaggcttgcagcgagcacatggaactttgcaaagtccatgtatgcggtctaagccaatttataagctaggtctcgcttgtgctatttgtcactctgctttttcctgtcatgtgagctattgctattgacttgaacaactggcttctgtgattaagcttactctcattgatcttaacttttactgctcctaattttggcttatctgcctgatcacttgagaactctatagtatgtccagcttatgtggcctaaccacaacccttttttatgctcacattaaacaataagatacaaaatacatgtggtaagtaaacattggtatttttgttgttatcttgtgtaaaataattaatgaattatgtgaagagtgttatatgaaattatagtatggataatatcttctacaataatctgttttatttgaaacatgatagtattctgttgttatcctatttgcagtttattctgacttgcttattgaacatggcccccaaatattgtgggacttcagcttagttttcttcatcccttagtaatactgaagtacacattattgttgtgctgtctgcctaagaaacgtttatgctacaatatggcatcttttctctctcagttatttccagctctctaagatagctcagtgagatttaaccttactgttttccccatttattttgcatttggaattttctcatgtccttggttttggcctatttgatccaaatattttagtcacagatttgttgttaaccattatttgatttgtagtattctctaacagctatagatatgctgttactcacattataatttaccttctgttttaccagcatgttgttcacataacatggtacaaaagagagggagccaagattgccattgtgtttacccagtaagagttgagctttttctccgaaatgtttcactgacgtcaaattggagcgatgaatttctgggggaacttgcttctcaactcagtctgagggttactcagtttgagattgtaaatttctatgttgttggggcttctgggctaaacatcacaatgtatatagctccccatacaggaattagtttctcagccgaccaagttaccgcaatgaattattcacttagtcagcatacagttcagatcaaccctgtactagttggtgactacaatcttcttaatttaacctggttcaggccactggttctagctcctggtaatgctaactgatcttgactttgctctatatattacaatgccgcagtttattttagtgttaaggtagagaacactgtaagactacttcagtttttttttgcttctttaatctctattgtctactgtactagagaaactgaagaatatatatagtatgtggtaatactgctcatatgtttgtgattatcaaataagcagatgattataaaaaaatcactgtgggttggcatattccattctatagaatcaattagcaactatatgccaaagaaaaaacagaaaagaaaagtaagataaaattacaatattcagttccttacatttcttattctgtttttgttctgctcctctatacccttcatgcatacatagagtgcatcttttaatttgcatccagttctactgagatacatatatcttatactacatatgctttgagtttagcactggttgatctagtactctagtgcaaactttgtacacactacacagtttcttatacatattccggtcattaattcttggtgtatcaacttggttatacagttaatgtgctattttctttggtgaacttggctgtgcttcctttgttgatgatgtgacagaaaaggatgtttggtgatatcaatatgatacttcctatgaatgatataaacattatttctttatatttacagccctgtatgctgtccagctatggtttttcttttaacaaatctcctttcctaatattgtgatctttcatttctatttcagctccaacattcacaatatcacctaaaccctctccatctcaagcatctacagtaccaagacacagtgcggataccagcaatgaaaaacacatgagcttgattactatcatttgcatatttattggtgctctaattgctgtcttggtgattgccatgtttatttgcttctgcaaattaaggaaagggaaaaggaaggttcctccagttgagacacgtacgtgcagagttatctattctcagctacattccttgaaaactatagatttgttatacttcatgagatctctaataattgatagtgaagttagatataccatgtccatagctccccataatatttttggtttcttaaccaaatttaaatgaattatgcttattttctggttcattatgcatgttggagcattcttttaggagcattaataatatcagttctcctgtgcagccaagcaaagaacaccagatgcggtttctgcagtggactcacttcctcgcccaacaagtacaaggttccttgcatatgatgaactgaaagaagcaaccaacaactttgatccgtcaagtatgcttggagaaggaggttttggccgtgtctttaaaggggtactaactgatggcactgccgttgctataaagaagcttactagtggagggcaccaaggagataaggaatttctagttgaagtggagatgctgagcaggttgcaccaccgaaaccttgtgaaactcattggttactatagtaaccgtgagtcatcacagaacctactgtgctatgagcttgttcctaatggaagcctagaggcttggcttcatggtatggccaattgagtcaactatttctccttctgaaattgctgcataagttccactcagttgcagttgaatgtggtccttcattgtttaattaattagtggtgatcatgtaatcatgatacaccttgactcttgagtctctgactacttacatttttttcaggtacattgggagctagccgccccttggactgggacactagaatgaggatagcactagatgctgccaggggattggcataccttcatgaggattctcagccttgcgtaatccacagggatttcaaggcttctaatatattgcttgaggatgactttcatgctaaagtgtctgattttggtttggccaaacaggcaccggaaggttgcacaaattatctctcaacacgtgttatgggaacattcgggtaagcaggttgaccaccttgaagtactccccagatgtttctgctctgcttttgcttcatatagctgtcgtgctttcaggtatgtagcaccagagtatgcaatgacaggacacttgcttgtaaaaagcgatgtatatagctatggagttgttctacttgaactacttactgggaggaggcctgtggatatgtcacaaccttctggccaggaaaatctagtgacatgggttagatttctttctgctcttatcttcagctgttattgtattacctttttatatctgaacatggatcctttagtatgataattgtcatctgaagttcactagccatgcatgttagatatttatcgatatatctcgacaaggcaaacaaacaaatggacttagagcaatattactactaatctgtttcctttttcgaaaaaagagagacattttttatgttcctctctattcatatgcattgtgtacatccttgggtggaaagcagatttatgtgtgagtaaatttacacttcaacatttttttatgcctgttgtgccaaagcgccatctatctgtttgtttctttttgtgcctatgtttatgagcttacacaaatgtttcctgatctttccactaaaagccttgtgtcacatcaacctttgctggccaatttgtcaggtttgttcattaggtttttgaaagccaactctcaaacgtcaacgtatttcttgtagacagtaccaaattcttatccctgcataggtgtagagatacttatttgctcaattttgactacgcaggcacgaccaattttacgagataaagatacgctagaagaactagctgatcccaagcttggtggccagtatccaaaagatgattttgtgcgagtatgcacaattgcagccgcctgtgtttcaccggaggcaagccaaaggccaacaatgggcgaggtggtgcagtcactgaagatggtccaacgctctgagttccaggaatccataccaacacctccagcacgacccaatgttaggcagtcctcaaccacctatgaatctgatggcacttcatccatgttctcttctggacccttttcaggcctcagcccctttgagactgagaacatatcgagaacggctttctctgaagatcttcacgaagggcggtaacagtggtggtttgtgaagctgttttgggtagagcctcagagtctctgaccacccatttgaaggctggtggtgcaagtgacctaaccagttttattgggaggtaaatcctgtaaattccatttttattcaccacctgcgaaagaccaaattgttacaagaacattcggtggctttgtatgatggaaatgattttgttccaagttcttttttgctcctatagctcctgtctcatttactgtatggatcatagacatttaattaggtgatgtggttgtattcttcagtgacaaattgtggtactgtagctcgtgtcctgattgaacagcagagagctgcgctggtgaccctacacgtgtcatgcccatggcgagtgcccctctcctctcgtggacccggcaagcgctcccagtcgctgacacgtgtcaccccgctaatactgtttccctcagcctcctcgttttgctcctctcccctcgtcatctcgattgctgtgtgcgcctcacactgtcttctccctaccctctgtttgtctcctccctctccctctgctcatggctggtagggttcggtgctcgccggcggtggcgctggcgctcgtcgtggcggcggcggccgcggccgcggcgacggcgaagctgtacagcccggcggacaggatcctggtgaactgcgggtcgacgacggacgggctggacgcggaggggcgcaggtgggtggcggacgcgacgaacgacacgtggctgacggactccggcaagtcttcgatcatggcggccgccgacgagctggagacgatgctgccgtcgtccatcccctacatgacggcgcgggtgtttaccatggacacggtgtacaacttcacggtgaacccgcgcgaccgccactggatccggctccacttctacccgtcgtcgtacaacgggctggagccccaggacttccggttctccgtcttcaccaccacgggatacacgctgctccacaacttcagcgtctacttcaccaccaaggcgctcacccaggcgtacctcatcagggagtactcgctgccgcgtgtcccggagggccacttcggcgtcaccttctcgccgtcgcccatgatgaacgtcacctacgccttcgtcaacggcatcgaggtgatctccatgccggacatgttcaacaacccggccaccatggtcggcttcgccgaccagaccgccgacgtctccgccgccgcgttccagaccatgtaccgcctcaacgtcggcggcgcctacatcccgccgtccaacgactccggcctcacgcggccgtggtacgacgacacgccgttcgtccagggccccctgcgcggcctcgtctacaacgccggcccgcacttccacatcaagtaccccagcgacgccgccgagtacgccgcgccgccggaggtgtacctcggcggccgctccatgggcagggaccagcgcctcaaccagaactccaacctcacctggagcctccacgtggagtgcaacttcacctacgtcgtgcgcctccatttctgcgagctccagctcatccacggcaaccagcgggtgttcgacatctacatcaacaaccggacggcgcagacggacgtggacgtgctggagatggcgacggagcgcggcgtgccggtgtacaaggactacgcggtgaggctgagcaacgacaccgccgacgagcatctgtgggtggcggtgcacccctcggtgatgctccgcccgcagttctacgacgccatcctcaacggcctcgaggtgttcaaggtgaacaacaccggcggcagcctggcgtcgccggaccccgtcccgtacaagctgctcgcggagaaggagctcggctggggcgggccgccggagttctccaccgacaacccggccaacatggcgtcggtgatgggcggcacggcgggcggcgcggcggcggccgggatcgtggcggccatctgcgtggtggtgtacagcaacaagaggagcaagaagctgggcggcggcggcgccgactcgcacacctccgcgtggctgccgctgtaccactcccacaccagcggcaagtcgtcggggcacatcacggcgaacatcgccggcatgtgccgccacttctcgttcgcggagatcaaggcggcgaccaagaacttctccaacgacctggccatcggcgtgggcgggttcggcgtggtgtaccgcggcgtggtggacggcgacgtgaaggtggcggtgaagcggtccaacccgtcgtcggagcaaggcataaccgagttccagacggaggtggagatgctctccaagctccgccaccgccacctcgtctccctcatcggcttctgcgaggaggacggcgagatggtgctcgtctacgactacatggagcacggcaccctgcgcgagcacctctaccacaacggcggcaagcccacgctgtcgtggcgccaccgcctcgacatctgcatcggcgccgcccgcggcctccactacctccacaccggcgccaagtacaccatcatccaccgcgacgtcaagaccaccaacatcctcgtcgacgacaactgggtcgccaaggtctccgacttcggcctctccaagtccggccccaccacgctcaaccagtcgcacgtcagcaccgtcgtcaagggcagcttcggctacctcgacccggagtactaccgccggcagcagctcaccgacaagtccgacgtctactccttcggcgtcgtgctgttcgaggtgctcatggcgcgcccggcgctcgacccggcgctgccgcgcgaccaggtcagcctcgccgactacgcgctcgcctgcaagcgcggcggcgcgctgccggacgtcgtcgacccggcgatcagggaccagatcgcgcccgagtgcctcgccaagttcgccgacacggcggagaagtgcctctccgagaacggcaccgagcgccccaccatgggcgacgtgctctggaacctcgagagcgcgatgcacttccaggacgcgttcgacgccgccgccggccgccccgtccccgcgctcgacgccgccgccggcagcagcagccacctcgacgacgggagcacggccagcatcaacacgctggccacgtcgtccacgtcgcacccgcacgagccgtgcgtcgacgttgtcttggagcccgacgacgtcgtcgcggagcgcgccaccttctcgcagctcgtccagcccaccggccggtgacagtgacaccactacggcactaccacaagtgaaccatgcacatagatccaaagtttaattagttccgactttttttttatttctttcgaggaaattagttctaattaatgccaaagtttgattagttccgagtttttcttttgtgttaattaatgctaaatctcggtttttggtttatatccctattccggaccagattcattcgtttccgagacctaaatcgagttcatcccaagtccaattccgaaacctctccgaattttcttcctctatcttaagcaacatttggaaaaaaactctccgaattataccattataaatttccagtcacccatgtaacgtgtgttcaacttgcaacgaagctaacccaaacgattaactccgcctcgaccgggagcggatttcaactccgcctcgaccgggagcggattttaaaaacatcccctcattatttgcatgccatctaaatgattataaaaaattttaaaaaaaatgactagatagattaatctaaattaatatatttcacaaacatgctggttaaaattcaacttatacaaactataatgaaaaaacaaatttcattgcaacttgttgaagttaaattttggataaatgtgacatatcctacattcaaaatcctttatattttgaaatggagggagtatatatgttaactcaaatataagtttatagctagttaactctactattaaacatcttctataagtttatatctccctagtagcaaaacacatatttttgatggttggcttttggggtggacaagaaagagagcaagcataacacatattcttgtaggagcttctgctatacgttgggctttgtagttgtgcaggaataatgcggtttttgacaaatcaccatctattacatatatgcaggtaatttttagggtaacatattggcttcagctctgagctcaactacaaagatctgaagaagatggtgagttcatacaagtagcatgtcggaagcttgagacggcggttatgcaactctttaccaattatagatggagattaacaaatagacttcgataaatgtgttctccttatcttttgttttggttggtttctctttaatctttggtggatgtttttgttgttttgttgaactacaaacatcttctaaattaggatggagggagtagcaggatcagggtttaccaaaccgtatggttatcatggttatcatgtgcggtagcctttttagtttttgaaccacggtatatctcgcgaggttaccgcaataacaatcaaaccgcgggttaatggtaaccccaccctaaacggtttggtaaaccttgacagaacccaaccacaagtattctattgctctgtaacgaataaataatggtttcaattctccagaaaaaaaagatgatgggttgatcagggggagtatccttaatgtatgttcattaagagcatgttagtttttcaaactattaaacggagtgaaaactttctgtatacaaattgctttataattttatctttttaataattaattagttatatgctaatcacgtttctcattttagttgtagaagagagggaaaaaaatatgagcatgttttaataatgtactccctccgtttcacaatgtaagtcattataacattttccatattaatattgatgttaacgaatctagacatatatatctttctagattcattaacatccatatgaatatgggaaatggtagaatgattcacattgtaaaatggaggaagtaactattatttattattttatgtattttacacgataaaaatatattagatttatttatatatttttattaagagaagaagtatgtttcatttgtcccggccccacgtatcaatgaaaccagaggatcccaatcctctactcctagcccaccccaaccaaaccatcgtgattcccgagccggacggacccgaaccacagttcacccgtttaggtcgccgcctcgccgcttcccactcccgaaccctcccctcccccctcccgcccgccgcgtacggcgccggcggccacggcgagggccctcgtcgtcggaggccccctaccactggcctggcggggctcacccgccgccccctcctcctctcccgaaggccgaagaggcgcgcctccatcatcagcaggtcagtttgggggtggtggtggtggtggtggtggtgggcgtcgtgtacctgcgtatctgtggacgcgtggggtggccgcacccggtgggaaccaatgccggcctagagccgtcggtcgcgcgcggcgcggatgcggctcttaggggtagagagggggtagggcgaggcggattggctcgatttgttcgcgcatctgttcttttgttttttttccctcgctcatagaaatagcggggatggatagtgttccgcgcccttctgagttggggggcactgcgtatatttgtccaaggttaaactgatagacgcgaggatttatgagatggctagggattgcttatgcggacgctggtagtggtagggttcggaatcgatttgctgctttttcgctctctgtgaaattttagaattttctacattagaaatgccatgaagcatgaaagaaaagaaaatctttagtcgtatatgccacttgtaattcagaactgtatatatatattattgaaatgcgcatgagttcaatatcatcgtgaaagagatattcattggctgcttttatgaacttcatgagaagcatgtttcagtttgtggcttttagggaaatgtaggtctggagccaatttttttgatcgaattgaacatgtcctgtatgatatcgactagtacgtgcatcctagtagcttatatgaactaagggagaaagcaattatgggcctgcttgggagcgattgctgtggcttttggggctgcagcggcacagcgcagccgcttggctgcatctccaaaaggccacagccattgcatcaatcagctgttgcgggagaagctggctagctgctgcagcacagcgacaggcagctgaaatgaacaagccctatggttcaaccaatgacaaaaaatgccctctaggaactatgtttacttttatgtgcaacagcttctatttatttacattgataagcaaacatcactgcagacttgaaatatttcttttgccttcactaaacaacttcttccttctatttcctcagcttttcatagcaaagactagcttgaatagattattatctgccaatggcaagggaaccaagtcctgaaattgatgatgaactattcaatgaagtttatgggaaggcatacagtggtccagttgcaacaactactaacaatgtgacgcctagagtgaatgatgagaagaggcccctcgaacgtgaaaagtcagatgaggaagatggccccccagatcccaatgctgtccctactgacttcactagcagagaagccaaagtctgggaggctaaagctaaagctacagaaaggaactggaagaagagaaaggaggaagaaatgatttgtaaaatatgtggagaatcaggtcattttactcaggtagtcttttctctgaataaattacaactggcatgcttgttgattgagatagacacataatgcattactagactttgtttatccacttgcagtattttcaactctgcagtaagtcagtaacgagttacactcaatattgatactgaatttaacagttagcatattcaaaatggagattgctctgtaaaaagattagtctgctgtagtgttgtatcaacctttattttttatcttgaatctaaaaagtatattataacaaaaataaattctgtgactactattatttgtcattttcttttcctttttcctttcatctttatttatcatttttcagacctttctcctttttcattactctcaatggtgaatttggacttaaaaactttaatacaaaagaaacatgttcagtagtacatccacaagttcattcattctcctatctttcataatttatatgctaatctgattgctcaaccaaacattcgtgcactggataccttaaattcattgagtctctttaaagcacctcagggagttgcctctatacatcttgacattgattacagtttagagacactgtagtgttttatgtgcattgtttgtgcatacttataggccctgtttctttcagcttgggattattataatccagattattgggagtaagctgagagaaacagacaacttattgaaataacttattataatctagagcccagcctattataatctgataagctcatttaggtgagctttttccagattattgggtgaaaaattacccaccataccaccccactccctctttagacttgcaaaccaaataatctaggctctaataatctaggaaagaaacaactaaccgcttattctactacagattataacaatctatcttatagtaatctgactcaataatctagattataataatcccaagctgaaagaaatagggcctcaaaatttgtatttcagcttacaattttttccctttggaacagggttgtccatccacgctgggagcaaataggagaaatgcagatttttttgaaagagttccagcaagagataaacaagtcagggatctattcactgagaggacaataagtcagattgagaaggatgtggggtgtaaaataaaaatggatgagaagttcctgtttgtcagtggtaaagataggttaatactagcgaaaggtgtcgatgctgttcataaaatcattcaggagggtaaaggtaaaaatacttcaagcagtccaaaacgggatcgtttgagatcccctgtgcgaactaccagtgatattcgcccaaggcacactgattctagatggtcacatagtccaagaagtgctccgcgctctcaaagtaaaggatattataacgaaaggcctctagatggccgttcacatgatgatatgcctaagttttcgaaagaatctccacaaggtagggcgctcaagcacactcgtcttatcattgttgtatcggcaaatattaggagccaggcattttagacgatttgagataaagaaaatgcctctgatccctttttgttggttaccaccatctatggtaatttgtttggttccttttgcagctagaggtaagttcaagatttatgtgctcaaatgactcaatgtatgtctggttatgatcagacaaatttacttgaatacaacaagttccatatcgaaaggttttccagacatctgacttggatggcctgcaatttgtgtattgcatctggcattattcctcctttcagtgta

SEQ ID NO: 67912 - DNA, 1779 bp, Oryza sativa
gcgggcgcaccgcgggagggtgaaaaagctcagcaagctcgcgctgcggcgggcgcgggactggcgcgcgcgcgtcgcgggcctcgcggaccgcgtcctggcgctggcccccggcgcgcccgtcggggacgtgctcgacggcgcgcgccccgcgccggacgagctcgcgttcgtcgtgcgcgcggtgggggtggcgtcctggcggcgcgcgctcgacgccttcgagtggctcgtcgcgagcggcggcgggcgtgccccgggcccccgcgtcgtcgccgtcgtcctcggcgtcctcgggcgcgcccgccaggacgcgctcgcggaggatgtcttcctccggttcgcccgcgagggtgccaccgtgcaggtgttcaatgccatgatgggcgtctacgctcgttctggccgcttcgacgacgcgcgccagctgcttgacgcaatgcgtgaccaggacatcgagcctgacctcgttagcttcaatacccttatcaatgccagggccaagtctgggtgtttggccgctggtgtcgctcttgagctcctacatgaagtccggcaagctgggctgagaccggatgctatcacttacaacaccctcatcagtgcttgctcacaaggttctaatttggatgatgcagtggcggtgtttgaggagataatagcttcagagtgtcggccagatttgtggacgtacaatgccatggtctccgtgcatggccggtgcgggaaggcacaggaggctgagctgatgtttaaggagctggttgagaagggttttcagccggatgcagtcacatacaactcgctcctttatgctttcgcgaaggaaggcgatgtggagagggtggagcgtgtgtgtgaggaattggttaaggctggtttcaggaaggatgggattacttataataccatgattcatatgtatggaaagatgggcaggcttgacttggcgcttgggttgtatgatgagatgagggctataggctgcactccagatgctgtgacctatactgttttggttgattctttagggaagatggataggatttctgaggcagggaaggtgctggaggagatggctgatgcaggattaaagccaactttggtaactttcagtgctttgatatgtgcatacgccaaaagtgggaggcaggatgatgcggagcgtacatttgatcgtatggttgagtcaggtgtcaaacctgatcgtttagcctatttggttatgttagatgtttttgcaaggtctgatgagactagaaagctgatggttctgtaccgggctatgatcaaggatggatataagccagatgatggtttatatcaggtcttgcttgctgcactcgcaaagggaaatgaacacgatgagattgaaggagttatccaagacatggaggccgtttttgaaatgaatccactagtaatatccagtatactcatcaaggctgaatgcatttctcagggtgctagtctgttaaagagggcatgcctccaaggatatgagcctgacggtaagagcctactgtccattttagacgcatatgaaaaaatgggtaagcatgaaaaaggtctctctttgcttgaatggatccggcagcatgttcccaactcccacaacttaatatctgaatgctcgatcatgcttttgtgcaaaaatgggaagattgttgatgccattcaggagtacagtagaaaacaaatgttaaaacgtgatcctttggtcaagactgcgacttgtatgagtacttgattacttaccttgaggaggctgagttattt

SEQ ID NO: 67913 - DNA, 1798 bp, Oryza sativa
tgtgcctattatcatgtccaccacatcactgacgttcatttagctgacctcatttgctgtatcttttgcttatgagtgaattgaaattataatacaatatgtaacttgtttacatcttttagctgaagtatttacataaagatctacttgacaggctagacaggcttacctgattggcaacaaagctctagccaaggaattgagtatgaagggacagacatataacacacaaatgaaagcatctcatgagaaagcaagagaagctatttatcgacagaggtcgcctaactggttccctgttctttctgcgctggatggaaaatccttttcatgccaatttatactttgtccacccgattgacaagctgcgccttgtactgttcctaatatttacaagtacacttaacatatcatatgtttttgttgcaatgttcctcaggaacccatcttcgcaacgagggagcgaccgtctgatcgatctacatggtctccatgtgaacgaagcaatccatatacttaaggtcgagctcggtactcttaagagcaccgcgagggctacaggtgagaggatgcaagtcatgatatgtgtcgggacaggtcatcacaccaagggttctcgcaccgccaggctgcccatcgccgtcgagcagtttcttctggaggaaggcctccactacacgcaggcacaacctggtttgctccgtgttgtggtgttctaacatctcttaggtcagcagcacgaagaaaaaagaagcaaaacaaaaaaaggagaaagagatgtagggaaaagaaaaacctaaaaaaaatggccgctgttgcagcactgtaattttcttgtagttgtatattaaaagaggcagcaggagaatagcctgacaacagaatacagtgtaaaattatacatagcttcattcaattcacattccattcccatccggttgttcttgcatgttcttgacgttttcttttgaggtactcgaaggttgtttgggatgcatatgcgatttagtatttgccatttcttgctgatgattgatgatgaacatttctaatagaacgagttagaccatgttttgaatttctgaaaattctcctggttactgtggttgttgctggaacggaaactgatcaagggcctgttcactttgatgttaaaaaaaaccttaccaaattttggcattgctaaaattgctaaaattttggtatagttaccaaacttttgacaggattttttatatactttatccgtttcacaatgtaagttattctaatattttttacattcgtattaatgttaatgaatctaaatagatatatatgtctagattcattaacatcaattttaatgtgggaaatgctagaataacttacattgtaaaacggagggagtagttatcaaaatttagtagcaaactaaatgtaaccacttttttttgacatcaaagtaaacaggcccgaagtttagctatccaaatatgccccaaacgttcaaatccaaacgaaatatgttgaaaaattgaaattatgtcggcctgtcagaggctctttcatcgcttctgaaacactgaaactgcagctacgaaatttgagacagatttttcaggagcagggagacgcgcgaggaaaaatatcttgcgctcgattagtgattacccgctcaaactcccgcaacgttatcatctccactcttccacctccatgcccatgcgcgactgatccgccgcccaacgcgatgcctctcatggccgtcgcctcccaacccttcctctccaccttcacctccacctcctcgcgccat

SEQ ID NO: 67914 - DNA, 8406 bp, Oryza sativa
agagcgagtaactagtttgactagtcaaattagatgaagaattggttatataggtgtttgagttggctatatagttgtttggagagtccgatttagataggctgttggtgatgctctaaaaaaagaaaaaaccaatctaaagaaagatgtgacccttccttacaacgaatctgaacagattccttctagtacagcgtgttcatatttgttttagtaggagaggtcacatcctctcttagattgattttttttaacgaagggagtactccgcattagtattaacccaagtgaagtgtagctaacaaaagaaaaaagtacattaaattaatcagaaaagctgttgaaagttgtcattatgtactactgtcgaacgattttttttctgagattacccagcaaacacacatccacacaccactatacacgtaacaccaatcactgttaatgaaaagacacgacgacttgagagatctgcttagctccagtgcagatccaaaatactgacaagatacacacattctagttagtttaatcttgtaactgacaagatgtacaaattagagatcaatgagtcgattgtccaataagccgatatagcatgctagctgatgcttataccaggcgatgtcaatagagttttgaacaatcggctatatttccaatgtaaattctgacacttgagtaaataatctatcgatgaaacaatttaactgacaccaataaaaccctagaaaagatctagtcgatacatgtaaattgagacttcgacttagattaactaagatatatgataaataggtgtttacatcaacaatattagagtgtcgaggccctagcccttccgatacaaatagctataacaagccttacccctcgttggagatcgaagccgatgcagcccaactcgaaacaagacctcgtcgagaaagacgaaaataaaaaggatggcgatgcgccgaagttgtattgaccgatagatagattacaaggatctcgggtgtacatatttatacccatgagtggatactaatcctgagcggatactaaacaaacttttctaaagataaaagaaaaaacataaaatcctcatcggacatgaatcatactttcctaaatacaaaacttgcttaactaatagataaactaaactgctatgacgtggtttccatggttccttcttaaactcgaactcttttagataagctttccataggctcattgtgctctttccttaaccgaatccattaaaaaatcttaccaaattttggcgttaacacacacttacacccccgcgaatgcgcccctaacaccaattgcatattcctgatctcactaaagtcatgttgaaatttcatttgcttgtgcataatatttataggcaccaggatttgaacccagtaaagtcatgcacccacaacttcaccatcacaccacttgtatttccagaacgagcgatttggtatcacagcacagcgataatattttgtgtgcgagtgtgtgtactccctccgtgaaaaaaaaagctcaaccttggtgaggatgagataacctaagacaacaaatcttgatagttctctgtccagattcgttgtactaggtgatgtccaaccttaatatcatccttacttaaagttggacggagggagtaagatccatcgggctggtctgttgtcttacgtggcgttggcgatcaatcatggccatggaatgaaatggcacagatggcgtctcgagctcgtgccgtaggcgtagggtatacacctacaagatatatatcactatcatattttatcacacataaagtactattcatattttatcatctaataacaataaaaatactaattacaaaaatatttaaataatacgaacggttaaacgttggatacaatcaatgcaaaactacccttattttaagatggatagaaagttatgtatatgggactgcctatatatcatctgacagattttttagcatcttatcatacagatttcttactctttggatgaacatctaacagatgatgacagattttttagcctcttatcatacagatttcttactctttggatgaacatctaacagatgacattaatatacacaaacaaaatataaaacaacaaacaaacaggccacatggacaatctgaagctcacgtggactcaaatgggctcaagttgatttcagacttacatcataaatacactaaaattacatatgtaattttcagacttacatcgtaaatacactaaaattacatatgtaattaatatataattacagtgtaagtacggtgtaattagtacgtgtgggatcataaacaaattagcattagaaaacatagctcaaatcgataatgatggagtcggcaaaaatgcaccacgaatcttgacaccatccaacgcacataaatctgcaagatatgtgactcaaaaatctgtcaccaaacagatagcaattccgtatatcggaattcctgagtcagaactgtatatgatgatgatgatcagtcagcggtcatatatcatatttctattattcatatatacatattattaatcatgtatatattattatatttaaagacggcgtcgttgaattattatgggttaatttgatctataccactacaaattttgctattcagaaaaataatattacaattcgtttattcgtaaccataccactgccgttaggtttccatccattttcttccttctccatcttcttccttctctcttccgtcttcttcccggtgatggtggcggcgaggccttgtcccggtggcgagccgtctcccacgcgggagagacggtgcggcggcgcccgcgcgccacgaggtgaagcaacacggcagtgctcgcgcgagtctgtcgtggcggcatggtggttctggcgcggaggcggcgaggcggctgctcccaaatgagacagatcgtgagcgcattataacaaagaccaagcgtccatgctgcatcctactgtactgtatcactccctccattttgattgaatgggacctattatattaccaatctaaggaggtgtttattagggggtgtaaaattttagtgtgtcacatcaggtattatatagggtgttgtatggagtgtttatgcactaataaaaaaaataagtatccgacagtaaatatgagacgaatttattaagccaaattaatatgtcattagctcatgtttactgtagcaccacattgccaaatcatggagcaattagacttaaaagattcgtctcgcaaagtagtcacaatctgtgcaattagtatttttttaagcatatatttaatacttcatgcatgtgctcaaacgttccatgtgacatggtgtaacatttttaggtgggatctaaacaggccctaaacaaaaaaaaactaggatacattgtatttaaccaaaatctattatattttaaaacggaagatatagaggctagccaaaataaatcttactagcgtccaaattttgataaactgacaatattatcgtttatcaaaatttttataagatttcttatctatttacctcaatttgacgagaaactaaatacatacacatctttgataattttagtaaaaagtaatatggtttaaattttaaaataatatcaatctgaatagcccatagtattcactgttgagggtacgagctgaattgaatggctccatagtactagtactgaaacgactgatccagtagtcattgtagcaacagtactgtagaaggtaggactgacggactgtggtggaagtgtggatggatatacggccggccatcatccattcattcgtcgtttcctgtatccaaatattccataaaaacgaatctacgatcggatgtgacatattctaatacgataaatacgaatctacaatcgaatgtgacatattctaatacgataaatctgaatagatgtatatccagatttgtagtactatgatgtatcacatccggtactaggttgttttttatgggacggagggagtacacctttaccttttgtcctaaaataaatttatttttcacaaatcctacatatatcaataaaaagttttaaaaaatatttctacaatatcaaatcctaatgtaactatttctcattttatctactctcaatattatttttttcacttttataaactttaatgtaataattactttaaaaataaaataagaattcattttgagacaataaaaatggctaaaaataaatttattatggaacaaaggaagtcctttgacaatgcatatgcgctaaaaatctgggactattaggccatccccaataaaaaaactatcaaactatcaattagctttcatacatgttattcatgtagatactgtataaaaactatatattcaatggatgatgtcgtcaaattaaattctcatccaatcatctctcttctctctttttatccacctatttcctatttttcattatttgttcttgcgtagagatggttttttgcgagagaaatgatttcttcatttttttacctccgtcattaactctattaactctcttgtcacatcagattttttattatgtgacaaatatttaatgctacctagctgcacccgggctgccttcaatccgttctgtaaccccaaccccagatgcgttgtgcaatgcattctgacacactcaggtggtgtttggatccagagacttaactttagtttctatatttagacactaatttagagtattaaatatagactacttacaaaactaattatataaatgaaagctaatttgagagacaaattttttaagcctaattaatctataattagagaatgtttactgtagcatcacatagactaatcatggattaattatgctcaatagaatcgtcttgcgaattagtccaagattatggatgtgttttattaatagtctacgtttaatatttataattagtatctaaacatctgatgtgataagagcttaaaagttttagttccatctaaataaggtatcaggtgtcgttgtttccaatttttaagtttataggagtaataattaaaacttaattaatcatatattgataatacttctattttatgtgtccttgcttctttatcggatgaaaagaacacctcctgtataacttatccgtttaattgcttcttgcatgagcacaatttatacacagcaccaagctggtgcatgggcccatcaatcaatggttcgactcacaaccagggttgatgttaccaccgtaaccagggcttaccgcggagtatggtaatataaataccgcggtaacctccttaaattcaaataaatttaaaaaataatttgaatttttgataaattttgcacggtttttcatggttaccgcggcgccggggtgcggtaaccccggccccggcggtttgagaaaccctactcacaacacataggcctcacgtacatcacgtgacatatgcctccatcataacagcctcagacgccgcagccacctttcgtagtccttttggctgccctggggcgtcattgtttttctttatgttttagctctttaaaaatttattttacaaatatacctttataaaaaacttacttagaaataaactatttttctcgacgtcaagattattagaaccgagtttcaatgtcttgacgtcaatcacactggcaccaatagcctcaatcagacccgttgatgcccaagagccaaatagacgaccgcatagggtctatgattttttttgggcccatgtgaagatgaaggactatagtctattgcccacaactatagcatgcaaggcaaatcgccaagcccaggtggccacgcgtacgacactgcaacatcatcgcatcgatcctaattctgtgattgcgtgcgttgtggctgctacgagaatgagacgagattgtcgatcccaattccatgccgcggtgaccagcgaggcgacgatacaacttgcgactctgagtggcagcgcgatggccgtagattctagtctccgagcagctctgcagtgtgcagctgcctcctgggctcctggctcctgccttccttacctcttcgctcttttagtatgattatcataatatattttaaaatagtgtacattatagcacatattgcatctacataattgagcgaaaatatgttttgtttatattagacatgctttttttaaaaaaattatagggcctcaatttgtatttcaacctggtgccccaaagtactggagacggccctggcctcaataggtgaagggagtctatagttgaagtaggaatgagggttccattccatcagctgctcagagcactgtagggaccacgatagtcaaagaacggaccgagaaagagacttgagtactaccaccattgaccagaagagactaagcctgtgttctttagcgttggttggaaactaatcctccacgcaccgaaaataaagcggtaaattagcatgtgattaattaagtattagcttaaaaaaacttaataaataggattacctaaaccccaatatgattttttaaaaaacaattttcgtacattctttttttattaaaaaaacactgtttagcaatttaggaagcatgcacatgagaaataaggttgtgttcttaactcaaggttcctaacctccactccctcgtttcccacgcgcactcctccgaactattaaaggtgtgtgtttttgaaaaaaaaatctacagaaaaattgctttaaaaatcatattaatttatttttcaattttttaagctaatacctagtaattaataatgttaatccatcgttttgttttgcatgaagagtggaggggtttccaaccccaccaaatgaacacagcttaagagtggagaggtgaaaagagaaagaagaggatggagagtgataagtgggtcccattgtattttctatttttctttccaaatgtaataccattgaagagccacatcagatgaaaactaggttaacttgccacgtaggataaatctatatatcatccaaaccgtttgaagagaaaaaaagagtgttttttttatagttgggggataaaataagacttaggtactagctcagctcatttaaactcgttatcttagagagccagcttgtctcgactcgtaatcttattgagtttaaaaggtcaaggtcgattttgcttacgaccgagctcgctctatctcgtctatatcacctttataattttaagtttgatattttattgatatatattaacataataataacatgtactaaactcgctagtttggatatagttaaaagaataagcattagtatcagttaagaagtagtagagctgaagccacgaggttatctccggccgctatccacgaggcatcatcgccgggggaggtggagctccggccagctagcggtgcggggagtcaaagtgtcaccgccgatgccgatcgagatcaccaccaattaattaagctcgctgtcgctgctaccgaccgaccgtgactgagaacaatgcaaggccgcctcgctctagctagctgtgtttagttcatactaacattaaaagtttggttaaaattaaaacgatgtgacggaaaagttaaaagtttacgtatgtagaaaagttttgatgtgatgaaaaagttaaaagtttgaagaaatattttgtaactaaacacggctgctcatgctcggcacctgtgctggagtggagctgctcaccgtttctattcacagcccaaaaggtcaatttcatccgttcacattgagaaaagaacaaaattaagcaagtcaattagaaactgaccaagtgccatttaggcaccatttgatgatgagccaaccccatttacggaatcacattttggccattttagcatgacaccatcacatatatttctcctaaattacaaaccaaaacaatcatctaacaactatattactctattcttcttcttatcattgtttattttggaactgtaaaatataggagcaaatctatattacctcatgagtttgtttaaaatggagtacttccccgttttaaaatataaagtgtattttgttatattggaataaggttttgatcaacaattgatctattaagatcaagtttattaggcggtatggcgagctaaggcgctgcacacccgcctcaacactattgcggtatggcggtaagacggacggtcaaacgttaggcacggatatccacggctgcacttattttgggatggatgtagtaaaaaatgctatcacaatcaaatggatccgaccactcatgacattatttttcactattcgatcaacctgacaagtaaaagggctattctagtctaaacaggtgtgattcttccaatcaaatgataacaatacaagtggacccaaaagctacttaacaaataggagtagggctgcaggaatt

SEQ ID NO: 67915 - DNA, 26832 bp, Oryza sativa
gtggttttgtgaaactacaacaccaaaatatatgtacttaaacgccaagtgtcaaagtgtgggtggttttctgcaacttggactataaaatgtgtaattttgtgaaatttactctaatttctaagcccgtttggtacggctacaactccctaatttaactctagaagttagatctcaagtaaagttagggagctgcttaagcccagtttccaactctctaattttagtcctcagatcgatatcgatcttctctcgcttatctggtgacattagctgctttgctctccagtaaaaaatagccacaaggcattctctccattaattagcatagcagccagtgctctccctccatttacagtttttaaatttcttctacaagaatacgggctcaaacacgcgtaaacatcaccagcagatcacaaactcaagtctccaggcggcagatgcagcactgaagcagcaacatcaacacctgctcaaattatggcagcagggaagggccattgaccacacgcacaaaccagacaagattgatgatatccccttcctagatttcactgttagttagattccaaaaaaaaaaaaaacccaacctagaatgggatgggacatgttctaggacaacgtatttggactgtctagatacgttgtactagaatatgtccaatcacatcctagattaggttttttttttttggacggagagagtagatcatgcttcacaaaaatccaaggtgggccatccaacactccatccaacctaccctagccccaatccccaattgtgaatcacaatcattactgtcatcatgccagtatcaacatcttctggaaaatttatataacgcagcagctaccggaactgaagtaccctgcctagacatccttcaccaaatgcaaagctacggctgccccaccttgtagcctacggtacatccggagcataacctcatccccatttatcctcgtttcatttgaaagctcaacgtacgcttcattgatcctactgaaaacaactcgaagcgggatgcatgcaatgcccagagatttaacctattactgacttcttgtttccggcacctctgtgatttatgtcgaaagatgaaaggctccgcatctttcttgaggaaggcacatgatttttttgtgtgcggtcgccatgatttctctgtttcgagttcggacatcttcctgtggcttttgggctctgttccacctgtgtgtgattccagacatcccaggcttgaagcttaatccttcttcactggtccatcaacagtgcttgtggcagggcggtgatcacttacacctgatgtaggaagaaaacatacaccatccgagactggataacccacaacgggtcttcggttccatatactcattagggaaacaagaggaccagttggcttgtttaatgaactcttgcccaccttttcttccaaaaggataaccttattgattgatatccaaccctgtctttgtgatatctaggctccaatgcatttcgttccatgttgttggccccatgatcagcggagctcatgatttgcttagtaaaatttccgcgttcgcatcgggaagatatgctagctttgctgcagttggtaggtcgccttttgcgtttgcagataggatcctttttttttaaaaaaaaaaaaactaaaatcgacaagagaattgtcgggttggcactgccataaccaaattattttttgaaaaaacactatgatgtagtatgcaatcaaaggacataaaaacagaatcctctcagaaaatagaatataacaatgatcacggtttgtcttgatcttgtaatcgtcaagaaatcgaatcaggggaagagaaaaggactagatgaagagaaacagtgtgtggggggggggggagaagaacaactaaatagattaggtcatggaattgattgttctgaatttgatagatcttcatgaattatggatcacatttggatagtattttgaaaaatctgatcaaaatctgccaaaattcttccataagaattgggtgttttctttaaaaaaatatatatggtgaagtgatcactagaataggcacacccagtataatttttctgggtccgccactgccgagagaaagaaaagattacggcggtttgaaagcaaactctctatcgttgatgtcctctaggatgacagctacattgtgggcaatatttgggagttctcctttaaagacttttgcatttctcatgaaccaaatatgccaccatgtcgttattaaagctccaatatttattcttgcttgcaccctatttccagaggaggaaatatttagaatctagtcttatatgttatcctacatatgatggtttgggattccttttatcgttgagattgattgccagatctgatttgtgagatcacatcctctgaatagatgatcagagtcttcaaaagcgcccctgcaaagtggacaaatccaatcacaaggccaatgcctaattagtaaattctctactgttaaggtcttctggtgaaggattagtcagcccaggaatctttgcttagattgagcttctgctgtccatatcatcttgaaggctgggtttgtctctgatccaatgaattgggcttggtaagaactctttgctttgtagatacctgcagcatttcttgtccacacaatattatcttccccagtttcaatgagagtgatttgtgtgagtaaacttccaagttgtactagctcatgaagagtttcaacatctgttatctgtctaaaggatgacagccaggtgttgtcgttaagctctgttttgactcttctatttttcctgattgccatgttgaataggttgggtgaaatatcttggagcatagaccatggagccagttatctttccaaaacatagttttctgtccatttccaagagtgatctttgtgcaagcttgaaaaagttgatgatctgaatcattacatgggagatacatcagttcccatggtttcgaagagtctttccatttcagccagagccacctttattaccaaggcagaaggttcacactctttcaaatgatctgggggaaattcaggtgataagcaggagtcaatcaaaaatataggaagataagctctttttccttgccgaagcgttaccgtgatatatatattcattttttgctgctcgtcatatcgctgctatgcatatggttagttgcgtgttcttcagttaggttcctctgctgtttggtgttgataaatgtacggttatatatacttgaatgatcccgataataactcgttcttgctggtgatggtaaatatatatacataaaatctgtttgtgtatcagtatcagcagccaaagcaaacattgatgaatcatttgaacaaaagccatattatttttcctcgcctatattatgtaacttgttcttacagccataggagcgtactatgcgtaagaaacagcaataagcttctgttccgtcctctattagctactccatatagcagtaagtaagttgtaagtagtactccagttactagtactataaatttaacaagggcgatggatggatggtgtgttacagtagtataattgagatggaagaggtaggatggatggtcaggcgaagagcttctcggcgaagatgtcaagaagggatagggcctcggcgacggtgagctcgaggcggaacttggggccgtcgtagtggtgcagcacgggcctgaaggcgtcctcctccagcggctcacagatcttgcgcgtggccacccgaacctgcgctgggaacctggactcgccgccggggcacttgctgtcctcccaagcgccgggatcgatgttggatccgccgaagctggtggcctcgaagatgccgtgaagctggtgggtggagtagttgtagaggaagagcgggaggccgggcctgatggccctcaccgagtccctgtacctggatggcaggccgaacagctgcctcttgagattctcctccatcgtctcgttgttgcacacgaatatgtatcccccgatcgcctcctcctttggcaccgactccgacgccggcagctggctcttcttcaacctgctgctcatcttgttgtcgttgctgctgctgttcttcttgttgttgttcctgcctcctcctcctcctccagcaggagcgtcgacagcggccttcttcttcccgttgaacgcatctacgacgacgctgttgctgttgtagttgaagttgaagttgttgttggccggcctgccgacggacttgttgaagtaggtcttggcggtggcgttgttgttgctgttgttggcgagggcgagcttgttgctgctatgatcgacggcggcaggcgagggggaggaccagatggagtcggcgatggagaggctggagaagttgtggaggcggagctggtcgctgaactgccagaactcacgctcgtcgtacccctccatcttctgaattaacagaaagatcgggtctgctgccaccgccgatgggagatgatcgattgatcggaggaggaagaagcagcaacaccaatttactcaattaacagaaagagagaggaaattaaggtggagaggagggagttaatttggcggtgcacgcgggtggatggcacttcctagatatgcttgggttggatggggagatggaatcaaagtgaacacttgctttgcagctaagcaactaggcggacgactgaggactaattatatgaatcggacgcgtagaaacaaagaaataaatggacgaaaagaaattatggttggacgtgcaatcagtcaataatctgatttttaaatttcattgcatccatagacacgatgacacgtacacatagagtggtgaagcaaagtctgcctttttgaacgcgtcaacggcccggacttcttcttctagatggacctgctactatacattcatccatccaccacctgaccgcctaaaatttccttttaccaaacaccgtagagacatcttcaaagatgttactttgcccaataatatctactccctatgtccggatttctagtttttcttacaacgtttgaccattcgtcttatttaatttttttttgcaaatataaaaaacaaaaagttgtgcttaaaatactgtagataataaagtaagttacaaataaaatacttaataattttaaatttttttaataagatgagtggtcaaacgttgcaagcaaaaactcaaaatcctttatattatagcatggagggagtataaaactaagatgttttaaataaaaaaagttgcatattatgatagtatgtttaatgataaatctagtaacttcaattttacacgattgattctttttttttctattagtggttaaaattaaaaatgtttgacttgttactgtactaaaagtgcttatattttgggacagaggaaatacatttttttcacctgttttacgtataggaatatacatgtttcgaaagtacacaagtggggatggaaacttgcaccgaatctgcacagtgagtgtgcgaactaatgatatcgcgcaggccaatagcagagtcggacccgcctcgagttcgtgcagaacggcaccaagtcgcggcttcgcgcaaagaaaatgtgactcgtttcattagctagttaggaattaggattccacaggaagtcgtcgcgacttcttgatgttccggtgagtatactcgaggatggggtccgagttcgcgcacccactatgcgagctcgttgtgagttcgtgtataattctaccaattctttcgaaacatgtataaacctcgaaaactggttaaaatagtttttttaaagtcatctttaactttatcccaaaagactatatttttacttgccacgaattaagaaaatttatctctttaaaattcaaaatatacctcttacatgccgcttcagaatactacttaaggataccttttgatcgaaatgaaggatatttaatttgatttttatcctcatcactattttattaactttgttaaagaaaatgcgaaaataatacaatctttgtgcggcgagagagatcgagtaaatattgtactatgcagattactagtttttgtttataatatgtatgctatgaataactacagtatcagcatgatatgaaagtatttttaagtatacgactctaatgtatggcatgcatgacactaagtatatatattagtactagtttcgaggcgcctacaaatcggacgtccgatttttttagcaaaaatcggctgctgttttaccacatagattagaattgtttcactaaatatatcgaaaatgtttcaatattaaaaaaactgaaacacaaccaaatcatgaataaaacattttgctacaacgtatgaaaacaatgattttcaaaaaatcaggcgttgtttcaccctatataaaaacaatgctttagcaaatagcaaaagaatgtttcaattcactgcactatttgattcatatataatgaaacatcatgagtacacttattgaaatattgttggtggaaaaaaaagaaacatattcccttaatagaacattttcgtaatatacggatgatttgttgcaacggcgcatgtggtgggatagcgcggaggcgcgggagacgacgggcgcctgatttttctactgctgatggggcgctcgatcgtggtcattttcctactagtttaattacatgtgtgcgaagagatgaacaaatatatactggattggagtttctagtagtaggctactagctaatactacctccgttttttaacagatgacgccgttgattttttctgacatgtttgaccattcgtcttatttaaaaattttatgcaaatgtataagatataaatcacacttaaagtactatgagtgataaaagaactcataacaaaataaattataattacgtaaattttttgaataagacgaatggtcaaatatgtgagaaaaagtcaatggcgttatctattaaaaaatagagggagtatatataagatggtggtaacatacatacatacatagaagaaattaaagtggtgtgcatgcttttggttaattagtggcgtaatgagtggtgtgcgtacgtcgagcaagcgcgatgatggcgactcatcacctatctttgaatcttgctgaccgtgacgccgtaccgcgtttaacatttcctccctcaatttaattttcttcggtcagtatcaaagttatgtcatactatatatctttattttaaaatgtaataatcttaagatggatgtatattctagtagttcgataaacctaaacaaactcctttgaaaaagataaatataaacaaaccattccaaaacgacctaaactaaagcaacccattaaaacccaattgtgattccctatttgaatgaccaaaccagccaattgcagggacggatggttgggtcgtggtatcatcctctatcgtccgtcagtctaaacaaactggatccatgcatcgatctccgcccagtccggcttcgatcggctgcctcctcaagcaagcagatcgtctcgtctccgccgcctgtgctagctacggtactcgatcctcttctcttgtgcaagcagtagtacagtagtgtacaggagtactccgtagctagcacgtactgtacggactccatatatatgttaggcgcatgtacgtacgtttctgcttctgcggtctgcctgttagtaatttgctacacaatcacatccagatggtgaacaccgtccgtccctcctacacacacacacacacgcacacgtatatatatgatcagtcggccggcgatcgaccacactatcaaatgccaaattactactctactctactgtctagtagtgcttcctacatactgtagtagaaagtacataacataacatatacctgcagaacgccgtcttataacgaaaaagcacacgctgatgacagcgtagcacaggacaagaatcaatcccttcagataatgtgattctccctcctgaaacatatatatacttctaataaaataccgacaatcttaagagttttactgtactactgtatttcactttgattctgaacaagatcgaaccaataatttcagcttttactagctagtacttacctggagggtgaaggctgtcactaatattgctagaaacagagagccagtctccagcaggttgaaatcaagatccattgggattcccatagtccaggctacaatcacactcactggaacctgccgcacagttcatcacttccatcacaacaacatactaacacgcatgtctacatacatactccactaataactattccctccattccaaaatataagacacaaccacccttaacccaaagaccaagaaatagttattatcaccttgtagtttggatcatcctaataaatgtaatgcatgtatccaatagagttagagaatgtgagagtgaaggattttaaaaaaaatagtaatttaatggagaattgtcatagttaatggcatgcatgtgtatgtatgtcttacattatggaacatgtaaaaaaaagtggttgtgtcttatattatggaatggagagagtatcaatgtatagagcgaggttagtaaattactagtactacgtactagctactcctacataccacaaacatggagatctgtgtggcagagcccaaagacactccgagagtaatatcctgtcgtcacaagtcacaacaaattaatgataagaaagaccaatactctgctgcatatatatatatatatactgtatgtgtgtgctgcttaattatatggagtaccatcttgttcttgagagcaaatatgacggcaccggcatgctctgctgcgttcccaacgatgggaagcaagatgatgctaatgaagctcactgatagttcccatgattctgaggccgcctgtacattcacaagatacgtacaaaaggtggtttagctagcttcattatgcatgcatcttgccaattcactgaagattaatacagtacagtacagcagcatatatgtaaatggtactaggatgatatatatatatactgtacctcaattgtgctcacaacataccctgacaagagcgcagtcaggagagtcatgagagccagccaaatcatggcactcgagaatcccagtactggctcatcatcttgagcgatcactaaatcatcgtcgtcatcatcctcaacctaattagaaaaatataataattaccatttggtgttggtgggatcgaacgtagtacaggacatgcatcgatcaatcacagacgggacgtacctgttggggctcaaacagctggcgatgcgtgttgagttggaagaagaggtaggccaggtaggcgatgagcatgaggatgctgcaggcacgcgacaggtggagggcggcgtcgccggagacgatggcgtggtcgccggaggtgacggcgtacctgagcatgagcggcagggagtggcagaggacggcgagcatgaggagggcggtgttgacgtgagcttgcttggtgtcgtacggctggtgggcgcggaggttggcgatgccggcgaggaagagggaggtgccgaggacaagcagcaggttggagaggatggatcccagcagggagcatttcaccacctcaatctttccttctcgcagcgccaacagcgcgattatcacctccgtcacgttcccaaatgtcgcgttcagtagtcctcccactgcaaccatgcatgcacttcacttgatgcatttccacttgatcctgatcgaaacgaatagctagcatgcatggaattcacttaccagtaggaccggtgtaaaatgcaatctgcctgcatgcatacacgcaaccaattaattgtcacaaaattcaagatcactattataattactctcccccatttatacttataagtcactttgacttttctaaaagttcgatcaagtttataaaaaaatatattaatatttacagcattaaattaattttattaaaactaacattcaatatattttatattttttcttgttttatgttaaaaatattattataaagttaattaaaactaaagaagattaatttagaaaaaaatcagaacgacttatgatcagaagagtatatggttgcatgcatgcatgatgtacattatctgagcatggtaggaattagttaagggagcttactcggtgaggaagctgagtcgctcagcaagaggaacgaggccgattaagctaagcacaaacacccacacctgcaattaatactgtaagaaagctggttgatcatttagttttttttttgaatggttgattatttagtttgtacttaggttgtgtttagatctagaggtgaaaagttttggcgtatcggatatacgaacacatatttgaagtattaaacgtagactaataacaaaacaacaaatgacagattccgcatgtaaactgtgagataaatttattagcctaattaatctatcattagtaaatgtttactgtagcatcacattgtcaaatcatgaaataattaggcttaaaagatttgtctcgtaatttacacacaatctgtgtaattagttattttttttatattaatacttcatgtatatgtccaaacatttgatgtgacagggtgaaaaatttcacagggatctaaacaggcctttagcttagggatgttacagtagtttttggttagtacagtactagtggagtgtatctaggacgcaccgttgccatatggctgagatgcgacgacgaaaaatccgtgaccgtgaggagggggattaatattagcctggccatgcatgtgatgggtgtgtcaagtgtcaacttgcttaattgttgcaattccatgattccatctgtttgtattttaatagggtttcacaggctgcaggcaacttcaccacatgcgcgagcacatgcactcagctagtacaaattaatctaatcgccatcatccggctcgatcttgtattcgtcatgtgttgttggtggagtgttttttttttttggaaaattataaaaaaaaacctgttatgctaagtttaaaataccctcctaatttactttggtttgacgtaatttagtgcatctcttgatgaacatggccccaaacatatttctcagcgacacagtacgcactactcacatctttcttatctcgaatctaacgaacaaaccaaacatcgttgaaacccatgagacaaatgcagtttatcttgcggtaacataaatgttcaagagctaagactcacgaccttcactgcctaacgatacgatgggcgccatgggtagggattatagggcttggccaacaattggagtttttttgtgtttagccccgtagtttttttaagctttagctttttattttgttttttctctcttactctagtataagccggtctggctgattgtgttgtgtaattatacttttttcttctaatatattgacgtgtaattcttttgcgcatccgtaaaaaaaaaaaagggctgggattatcgaccacagttccttgcctagtactagtattgatatgagcatgcttgtggcttgtcataagaatggacgagcaacgtaaattggagagagatggatgaggagggtacctgtccgaagtggaggtaagtggcggcgatggcgaggaggacggcggggaagaggaggaagagcctggtggtgaggaggacgtcgttgagattggcgaggagggagcggagggcggcgcagggaaccttgtggaggagggaggcgtcggagcttttgcggagggaggaagatgagaggttgtgtgcggtgcggcggcgaggagaccccggaaggaggtggtgccgcacggccatctccttggccatcgtattcgactccatcatcatccgcgacactggcatcaagctctagttgttcctcgctcgctgagtcgctgtgcgtggttggttggatgagagagagagagagacgatctatcgatttcatacaaatgcggccgccgtcgtggtgctaggattttgctgtatgtatgtagtgaatgactaattgaggaggaatagtatattaatggagcagctcagctcatcggggtggatgcaaatgtcaaatgctccatgaccagagtactccagcatgcagtagtagaatatggagtacagatattaataatgaggaggcacaagcacaacacaagaagaagcagagagagagagagagtggactgatggtctggtcgaatcccgggttctctaaacttaaacgtacaaaatatcacgcgaataattagtatgcattcttggtagtactcctcctgttaattatgcagttactagtaactaggcaaatgcaaaacctccgtccaaaaggtacctaccatagacaacggagctgcaacagagcagaaagaaaccaatccaatccaaatccagtgaggactgaagaggaggtgagagactgacaaaaatggaggaagctccggtggtctattccgctccttccaggggcgtcgccgtcgatcgctgcttctcttgtcttctattgtgctcccctccctaatccaatccgtacccacccaagggatgacaatcccaatcatattaaacccttttcttcttttggattttttgtctccggtgcaacgcagccaaggcccacacgcttacaaataaagtccatacaaatcacggcccaacccaccacaccaacctatccttttaggcccatttgatggataatagtttggaggaaaacgttcacattatgtcctccaatttatgggttgagtttcatttgcatccctcaaccgtaaaatcaggtatatagcgcccttcaattatcaaaactagatcaaattgggtcccctctcagtggggcatgcatgtcagtggggcccatctctcttccttccttctctctctctctcaccatcctctcctgctgtagggcggtgatgacatgtgcacacatgatggaggcttgcaacatcgggtagaccagcagaggcccactgggcaggggagctcgatgtcagctgctgctctgctcgtccttccattgaggctcggcttcttcccaatcaacatcaacgtgcagaggggatccccattcccccgtcgaaagcagagcgcctcccaccttgatggaagaggcagtcaacggcaacgaccttgcatggctgttccaggaggccgtcctcaacctcaagcgcaacgccaatgaggtcctagctaggcttctccttgccattcatcatcgacacctctgcgcccatcgctattctgcagcgctcgccgtctttggccacatagggaattgtcgtcaaggcgatagtggcggcttggtgtcctcttcatcctcaagggcttgatggtggtcatgggacaacaagcaaacccctttccttggacacgacagcgacagtagtgctggctacaccaggtacttcgaggcctgctaccccgtcatcagtagcaaagccggtgaaggaagggacctgttgagcgtgcatatgttgtgaccacggcgatgattggaggagatattgaactatatgccacttttagatgtggcaattaactgtttgccactagactcacatgtcatagacacatgtggacccacatgtcattgagatatgtgtggcaaatagttaattgccaaatcgaaaagtggtaaatagttaaatgccccttattggagatagagaaaaatggaatcgtaaggggaaagagtgaaaggtcccacatatattttttgtttctattttttcaactataattccacatgaaccccagagcatattagagaccatgacacattatgaaaccaccaaccaaaccgtgagggatgtaaatttaccccgctttaatagttgggggtatccttcatatctagttttaccgttctagtacatgaatcaaactggggctatcgttgagggatttaaagtgaactttttcctagtgtggaccagcgttattgggctggggtacagttaaaaaatgaattgctcctactatagttgaactaacatttttcactctgcattatactccatatgttttgcatatattttgcattatactcccctgtttcttgtctgaggctgagcagattcgagcagggaggccatgcatagggcagaatagatgaaggtgaagttgtgcactctggttgctctgtagtggacagggaagaagagggacatcaccagcttcatcgctggattgatcgtcttgcatacattgaatgattgattgctatactagtacatatacatacacgaagaacatagtatatattgtagctgctgccgtacccatctgctacctgttggagaagatggcctcaagatccttgtagagtcccttggacttggagctccactgcgaatgcgagttctcgggtcccttcgccttggagtccgacgacgacgccaccgacgacatgctccggctcccaccctttgctctgctccccgacgcctccgcctcccctccctgtccctccttgctgaagctcgccttggccatctccctcagctgccccagccacgacctctccgtgccaccaccaccaccacccagtgccactgcctccggctgctcctgctgcttcttcatcttctccagctgctctccaagcgccgacgacggcagcaccagcagcagcagccccacccacgccgccttcgcgccctccacgaacgacctcctgtccgagctcagcagccgcacctgccggtacagcgcgttccactcgttgcacacctgcgccgccaacgccaccgcgaacaccgtcagcatggccagccctaccccgctcccctccgccacggcgctgcccccgctgtccaccagccgaaggcatgcggcgaacaccaacacctcgcttgccaccgccacgatctccaccagctgcacccgcttcttgatgaagggcttcttgagcaccatgaagaagagctggaaggaggcgatggcgagcaccaccacggcgtgcgcccgcgacgagtggtccgacgacgcgtgcgcgcccgccacgatccccagcgccacccgcttcaccgactccaggaacgtgtagtagatccgcagtatgccgaacagcttctgcaggaacggcgcctcggcgtcctcgttctcgtcgtcggacacgatgatccgctccgccgcgcgcttgccgccgctgccgccggcgatctgcgagagcatgtacttgggcgggccgcgcaggtcctcgaagagcgggccgagcttgacgaggcaggcggtgcgggcggggtccttccacgtccactgtccacgcttgccgggtcccagcgtccggcgaacaatctcctggtaccagtggtactcccgcccctcctggtgcacctccttgtactgcagcagcctccccgtggtgacgcccagcgacaggaacagcagcagcgctaccaggaacgccgttagcacccccgtcagcacgatcccgacggccagccccgccgttgtgccgcctcggatcagcgccgccgacgcctgggacacgcagggcatggcgaggatgacgagcatcagctccagcctggggaacacgagcgcaccgacgtgtgtgtggctgtgcctgtggcgcagcttgaggtagaggaggagggtggcgtgcagcagcaggaaggcggcagcgatgacggccagccagaagatgttcctgaagaagtacttccatccgtccagatcctgcagcttcatgatgatctgcgcctcgggcttcatgtcctggttctcgaacagataccggtactccatggcggtgagaggcttgccgtccaatggcgacgtcgacggcatggccattgcaactcctggagctgcaggagggcggcggaggacgtcggcggcgagagcggtgcggtcgagcatctcggagtaggcgatggcgggcatggtggagtagccgacgaaaggatcggcagaggggccttcccatgggaggcgcatgtaagggatgctccactccagccccttgctcagctcgtagtactccaccggcagatttatcgacagccatcgcgacagcgcgaatacctgaatgtggcacgccattctctgaaaccaacatcgccatcgattactgctctacctgctagttactccatatgattctatggaattcgattgtagtgtaccaaccaagagatttcgtgatggctcggatacgaggtaagaaggcggcctctggatgacacctgatgccagtagcgacgatgttgaaacagtcagcagcgtggcgaatgctgcggttgctgtaaaaattaccgtcgtcacgatcgcgatcgatgatgatgatgcaggaacagaatctgcactcaacacagtaaaaatgcacacaattagttcgtgcgtgcatctgtctgctattgctacctaataattcaggttttgacgagcatgcatatatggactctgcttatgctagctgacaattactactacattacgtatccagactcatgttactaagatttactccctccgtcacaaaaaaagacaaaccctggtttccgtgcccaatgtttaaccatccgtcttattcaaaaaaattatgaaaaaaattaaaaagacaagtcacgcacaaagtattaatcatgttttatcatctaacaataataaaaatacgaattataaaaaaaattcatataagacggacagtcaaagttggacacgtaaacctagggtttgcctttttttgggacaaagggagtatgtattttggaacgaagagagcaagtagtaatgatgcccttacaatgcctcacttccagacgatctgacggtaagttggtatttcctgcaacgtcctgagcagagttctcggcgacgtggaccgaaaccagattatcaaccgcctgtatctgcgctgtgtatatgctcttactagcttcatggaagctgaaaaccacgacgaattcgtttaattattaggaagctgcatgcatgcatatggatggatggatagatgggtttgttcttgcctgaggagattgcccccggaaacctgcaccgcagaggaagtgaagttgaagacaggctttgcaaactttatcaaaaccgggatgttgcgtgaacttgttctgacagtggatgtcgccagcttaacagaaggcctttgattatctgaacaaacattctcttgtacacgtgttatcgtattgaaaactgaaagtaacgtatggattgagtggaagtggagcagagtagtactgtatatatgattggcttactaaccgtaaagaaaagtgtatggctctgaagaagaaacaggagttccttgtctgctgattatggaattcccgtcacaggaaacagtgacaacggcggtgttggatgtcctcttaacctggaaatggtatggaatgaaggttgttaacccagcaagcaattaagcagtgggattagctaggacatgacagtgagagtggattagagtaacgtacgaggtatccaaagcggcgattcccgagcgtgcttcggttggttggcgtgagaatggcatcggtggcggtgagagcggcgaggatttgggaggaagaattcatgacgggttcagcgaaggagaggtataccctgaggtccttgtcgtcgttggtggcttccaccaccctggtggcgccctcgatctgaagcagcttctcagggatgctgctgccgatgttcatcgagtcgctccgtctgtctgcagtacatccaatctcgatcgatcatgaataatactagtactagcaagcaagcaaagcaaatgaaagtgtatctagtgtaggtatacgtaccgaagcgcagggtgaaggtagagttggcggttctgatgaagtggtggccggcagcatcggtgcagaagcccttggccatgacgagaatgaggcggccatagagcaactccggcgggatggtgacgtggacggagtattgcagggcagggcggaggacctgaagactcgacggatccacgcgcccgggaccgtacacgctcagctgcaaatgcaaaattccaattaataccgtattacattccattccattcagtaacaaaatgatactactccatgtggtagtgtactagtggctcgtagtacatggcagtaggtggcgttgcaggtgaatccgcctccgccggggcagggctcggagaaggagacgagcaccgacacgttggatccgctcgtgaaccccgcctccgccttcacggacgccgtcggagcaaccgtgtctgcatccaaaccattttcatttctactactataaggttcccgcctgttaaccacattactggagttgtacgtacgagtactgtactagtaacggcaacaatcaaatcaaatactagtacaagtaaaaaggatgggaattaattaaaatgctactactgtactgtctagcaatagtaatagggtgttgttactgaaccaaccaacatcccaggcgtaggtggcgcaggttgttgttgttgttgttgttggtggtcgtcccgcacccgcgcacacagccaaggtgtggttgccgtctttcagccgcgagtacctcaccaccgctgtcccgttgctgctgctgctgtttcttccgcactcccacgccctctccccgtccacctgcattcacgcatgcacccaaataccaacttacattcgcatcttcttcaatactcctaccttttttctcacttaattaacctccttcctacaaaaaaaaaaaccttgatactactactacaatgctgtaccacaacttgttggcttgttgcaaatcaaatggtctaatccgccaagacatttccacctacctatatagtaatctgaccaacatctatgatctatccttgtcatggtagtactatactagtagtatcaccggagaaattgatgcatcgatgaatgcatctactatgaggctattattaactgactaattgctctttcaggggaccaggcacccaaatccacaaaaaggcacggcatatgctaactgaaaccacatttttacacttgattctctctatgcattccactggagtaggagtactccactaccactacctagggagataactcgaggcaacacatgacattagcaactgtaaaaaaaaaagagatttcatttcagacagaagctactcctaggtagcaccgcacgcacacatttggaaaataaaaatgatggatgtcgaaattaatgccgagacatggaatatatgcaatgcgagtgcgtgatgaagcagatgagctagaaaagcatggaatggaagcaggcaggtggaaagtgaggagtgaccttgcaggtgatgaggcaatcctggcacgggcctgatccattggtgtgcaggacctggaaggtgaagacggccgacgccgacctggagacgcggggaggggtcttggagaagctgacggagaccacgtcatcggcagcatcggaggagcacaggagcgccgccgccgccgccgcaaccgcaaacacgacgccgccccagctcttccacaccatcctacgcgcgcctactattatctactcctactccctagctactcagcagcagcagcttgctatgctactccagtactgttgcaagagaaaagctcaagaagttacacctggtgtgtgtcgacctactgagctactcctactgaattcattcatgcaggcacccagccaacagtgttatggactggagtactggacagggagggaagtgaatgcacgccacgctgctgcctctgcctttgggaaaggaaagctagagctccctcttgacaatggcagtattactgacttgagttcagtgtggtgaggtcgcagtgcagtaagtatggtggtagattggaacagacaaaaaatgaagggagggagggagggaataatggtgggggacagacaggaggggagagggggccaaatgcacactggcaggcatcgcatcgcccgccatgtgaaggacgagacggaccatggttgaaatgcatggttggctgcaatgcaagcagaggactgaagaagaggaaatggattggatgatgcacatgaggactagagcgcccaaactgtcttttgtgcatttctaccttttatcctattttccctaatcctttcaataatcaatcaatcctccttcctactcactagctcggatgtaatccatgtcattcgatcggcctagcttgcttccatccatagacaggaagaaaacaacaaccagcgcgagatgcacagattgctacagtacgcgacgatccaaatttgcgagcaatactgatcaactgtggcagcaaggacaaacatgcagctatcaccgatcgaggcactgaaatttcagtcatacggtggcgacatgacgatgttacgtaatcaaaattaaggatgggcctcgctcgcgaaccactgaatcaggatatgatgcctggggattagctcaccatgggtggctgctgtccgtcatttagaccatgcatcaacaacaacacctagtaactcttcactagttacatcgatcaaagatggagtactacatacatgtaagagtagttaatactagtttatttatctcagcgcgctcagttatcatcgaaaaataagggttttctgacagcaaggcatactgctagttgccaaaatgcaatcggtgacatgcaggtcccaaaatatgatggtaggagtatatattggaccagcaagccacaaaccctcttaaacttcttctttcaccctcaccctcaacaacaacatgcatggtcctcatcacagacagattcacggtgctgtgtgaaacatacgagtaactagtacataatctcaaataagcatatgattgtagcacaaaaataggggaatcctctctgaatcttggaggagactccagatctgtacgtgcacatgcagcagctgcctgccccccgcaataaccaccatgcacattgtaggtcagctaacttcatatatactccagtttctagtattcttctattgtgttgtgtcaccttttctacactggtctccaagattcatatcgtacttcgtacataccacagtgatttagtaaagaaattcttaccacaacttgtgttttttccaaaaaaaaaatgcaagtcggaagaacaagaacatgtccattctatttcgtggtgagcgttagtagtagtagacgacaaacaagctaggtgtggtaaggcctgattcatagtgcgcagcggttataaaagaaattgtcatgcatccatgggcagctctgaattaacgtcgtgtcgccagggagaagggggcactatttcagagggtcggtctgtaacatgtagtattgccaatataattcatctgagcatttacacatgtgtacaactgtattgactgcagatcgacgacgagggaatccagtcagagacgtcgttggacggatcaaaccttttctccattgtaaatcaggcagatcactgcagctgtagtactactagtgctggagtcatgtgattatcactgaagattactgcagtccatccggttgcctccgactgatgaatgaagaatcaatcagtagcaagagcatcccaggttagttgatttttcaaattatttatattttaaaagatttaaaaaataaacattccaaagttcttaaaaaaacatactccttctgcccaactgtagggcgaggcatataaatcccctacagtacggcaatctatataacgtggcacctggcgagagaggcgtgccatggcaatttttgcaagcagccccttctcagcaataaatcgcattcccctatagcgatttatcgccaggagggaatggtatggaaaattatcacagcgcaaagttgggtgatggatggagtgtgccatgtcaattttgcaggcggcctcctcctggcgataaatcgcccttccctaaagcggtttatgaccgggagggggtcgtctgtaaaatttggcaggcattgaggaatatatttatgtaaaactttaaaattgtaatttatttttttaatattttaaaaaataaataaaaaatcaggttagttcccggctaatatatgatgaagtcaaattggaccttttccacttgtatcatcattgttgggttctcgaagccaacccatcctgctctaaatagtactccgtagggctgggcctgtttagttcgtgaaaagaaaaattttgggtgtcacattggacgtttgaccggatgttggaaggggttttttggtatgaatgaaaaaactaatttcataactcgcctggaaaccgcgagacgaatcttttgagcctaattaagccgttactagcacatatgggttagtgtagcacttatggctaatcattggactaattaggctaaaagatccgtttcgcgatttacatgtaaattgtgcaattagttttttatctatatttaatgctccatacatatgtcaaaaattagatgtgatgtttttttaactaaacaaccccgtagtattaggaaaaagtacaccgaaggtctctcaacttgttatcgagttagaaaattgtctcccaaccgcaaaactagatatatgacatctctcaactcacaaaacctttgactttaggtccttcgatggttttgatctgatgtgacggttgagtcagcgtgggacccatatgtcaggatgccacgtcatccctttcccattcctcctatttctctcgcttctttgcgcagggccggcgggtggggaggatgccgtcatcgttgaagaagccgcacgcgtccggcgagtcgcgtggccccgacaacccccacagcgggtcaccagcctccgccgcgtgccgcctcagctgctgcagcatgtacttgtgtcgtagcactggaactcgcccacctcccgtcgctcccgacgggtatcggagctcgccgttcggtcccaaccccactgtcacatcctgcgagaggaagaagagatcctggaatgataatgcacacatgcgtccatggtagatggtcggccggcacaggactgcggcgacaacggtgaacggcggcgcgacggtgaaaacggatcggagggcaccggaaggaagagcatgacgcggggaactcaccgaggggcagctcgacgacgacggacggcaaagggagcttcaaacagcgacgaggtcgggtccaaggcgacggcggcgttcgacgctctttggcggcaacgaacgggtggacggtcttcaccttggtcctgcgaatccaacggaggcgacatctaatcttggcgtcgatgggaatgccggtgaggcttggccggaggcggagtagatcgatcgagttcacacttgacagtgacagcggtgttccggtggcttgtggcttcgaggagatggttgccggcggtcttcgtttggcgagatgcggctggagcagcagccggcggcgttatgtaaatcagtgattcagtaaatttaatttgggtatatatgtgcgccatgtccgtcccgctcctccgtctcgctcgccgtagcacttgtgatttccaccgccgtcctcccactcgtcggagcggaggtgcgtccgccgccggattgtcaaacgacccccacctgcaagaccgcgggtttgtcagcgaggtcaattgcatacatgcccatgcgtgcaagctaaaactcacaggatttattttcatggcgggttgctgccaccagaggtaggactaggagttgaagacgaggatacgtcggcgtgggcggcgtgcttgttgatggaggcggcgcggacgatccggtcagcgatgcggtggcgcagcgggtgataggagttggattccaccagcaccttgccgcgcgcgttaacaacaccttcatggcgcaccaccactccaacagaggagagggaaggaggaagggagagagttagaggaaaaaggaaaggtgctaacgtggacaccttgacatgtgggatccacgtgggtcctatgctgactaagccgtcacgtcggataaaattgggtcaaaaccacccaaggacctaaagtgaacagttttgtaagttgagggatgacaatatctatttttacgattggaggatgattttgtaactcgatgacaagttgagggaccttcggtgtactttctccgtagtattatgggcttatggccacatccccgcgtataggtcgagaaatctaggcgcatacatatacgaggcctgggatttgggccccctcaacctcaagggccgaatgtgatctcgctcgctcaacttcttttcggtcccccatccccatccccatgtaagataccatagagttttaatctttgaatgaattcttggcacagcaaacaaggaatgaaatgtctaaaatcatcggataagtggctgaattaggcttggttcgatagtagtacttctagctgtagctttgcgatggtataatgtataacgatatgagttactagggtacgagttgtaattaactattcactgttaataaactcaaaaggtaagtttactttttaaaaaaaacttacataaagtttccttttagaaaaaccacaccgtataacagtttaaaatttgctcacagtaaatgagctagttgaaaaagcaaaacgtggaaacataacccttagggctcctttgaatcaaaggatttatataagtatttcatacgattcaaatcatataggaaattttcctatttggccctttgattcaaaggattgaagctttccaaatcctatgaaatttttatggaatggcacattgcatgtggattttggagaaaatttagcaagagctccaacctcttggaaaatttcctttgagtctatctctctcatccgattcctgtgtttttcatgcgctccagtcaaacgacaattcctgtgtttttcttgtgttttgtaatcctctgttttacacttcaattcctgtcagaatcctgtgttttttctattcttttgttttttctaccctgcgattcaaagggacctttagagtgtgttttttgcatggctgtagaggaaaatttgtagcgcacgtgaaacgagaaaacccattaaattaaaaaataaatacatttgatttttttaaaaaaacaaaatttatataaaaatttattgtaaaatacgtatcatttaaccgtttaaaaaatatattaagaaattgaaatgtggagttaaaagaaaagagctgagcttagtcccactaggccactactacagtcaaaataattgaaaatttgcagctacactattagttttcaaaataattgaaaagtgagtagtttagtggtttcgtgcagtgtgcggagcattgttgtacgcaagcatgcatgtgtgcacgtgggcagccacgtggcaatataaaaaccaactcgtctacatctttgagatgcagacaagagtcaatgccgttctaagaaaaccatgagatatcgtacgagtagaaaatagaattgagtaaattacataaattttctaaatattgactaagaaacagcacactaggagtaggggatatgcttcccagcggtctaaacatgtataaactgttcgttccttacttttttatgtgcccgtgatttagatcccgcgtacctcctaagaggccaaatctaaaaaagcggtttgttctgctccccgctgaaagagctcgggctccgatagatatataatcgtagttactttcttcgggttaatagtatttatcatcttgatcaaagctgatgttaaactttaaaatatttgattatatcatagaaatatgaacgatatgtatagagtagtattagaaaatactacaacaaaattgttgatatttctagttacattataataaaaaataatagttaatgctatttatttgaaacgataaatactgtcaaacctgaagggaatatggtactagtgctacacaaaagcacacagttttgataaattctacttataaatcagacctgacattttagatggtaattttatataatctgacagaaactctaaagtggataaaagaacttgtggatcttacatgtttgttttgggtttttatgattttagttttgtgaagcacggatactgtaatacctaggattatgtatcacgtgtaaagataaacttgtgattttatataacttgaacaacaacgctataagattagtgcaatttactgaataaaataaaatgcaggacaaaacatatagtagcacaagtagtggtagggggaggagcagcgtacgtgtggtttgcgacgtggtgtgcgtgggcggtgcggtgggcatgtatctgcatctgcatgatactagtgtccaccacatattacgggactattttcatctgctttttatttattcattgattgattggtactactactgctagaagaaaaggcggtttaggctgtgtttagttctttttttaattttttttaacatatacgaacatacatttaaaatattaaacgtagattaataacaaaataaattatagattccgtccataaactgcgagacgaatctattaaacataattaattcgttattagcaaatgtttactgtagcaccatattggcaaatcatgacgcaattaagtttaaaagatttgtctcataatttacatataaactgtgcaattgatttatttttatctacatttaatgctttatatatctaaatatttcgcaaccttagtttaggctggtggcagcaaggtgaccgttgcgcgtccccatccaaacccaaccccccgtaccataccatagatatccccaatctccccctctcttagctttctctctctcgagacttccttccttccttcccttggtggtggtggtggagactggagagtggaggcgaaaaaagaaacgaatagaatctctcgtccctcctcctcctcgatctc

SEQ ID NO: 67916 - DNA, 1537 bp, Oryza sativa
ggttggtttgttcatttgcgtcgcaggtgacgccgtcgcgcagcggcaccgttggtgtcgctgtcaccgcacagtgcaggtgcgagtgcacacaggctcgctcggcgcggcggggtggtgcggccgcatccgtccgtttcgcgtgggtgtcccatgtacagcagctgttcgcgcgcactgggccccgtccccgtcacgatgtggagtggagatgtgatcgtggcgtcgtcctgctgtccggtggcgtagaccgctgcaagtagcacatgtactcgctacgtgatcacgtggtgtggtgtatggtggtttccaaaagtgacaagatccaagaaacgggtggagatttatcgtccgcccaatgtgccgctcgagcctgcacgttgcacggatctctttgatcgatcagtttccagctgcaaattctgccgttcgcgaacataacaggtcaacagccagcagttctctcagctgattttcgctatttgtctacggtctactggatttctgggctgggctgaccgttgtcgatccatttcatcaacaggctgggccattgcaaagatttttggaataagttcagaaatcgtccctcaacttttcatcgagttgtatgacatccataatctttacccctaaactatataaaaccgtataatttaggtcttatagcagtatgtatatctggttttgctaacgtagcatcctagtcagcaaaataaaaattaaatttttatggggcccacatataagtgagtaaagtggagactgcatctcttctttcttttctttttctcctctcatctcttttcttttctttcttctctactcttcttcagcgagctaggaggcctgcgagcccagccgagctccgccgcctcgagctcgtggagggcgccgccaacgccgtcttcggtgcgctcgtgaagatcttggccgcgcggatgagcgacgccgtcgtgctccgtgagctcgcctccgccggcgaccgccacaccctagaggccatctagagagcccacaacatgtgtggcgcacttgttggcctcgtcacgagccctgtctcctcgcaagtcaccaaggcctccctgttcatgcacctcctatgtgccctagaagaacctgtccttctgccgttgctctggccctcccagtgccaccatggcgcccaaccaccaccacccccaccgcaacaataacagcaacaacagatcaaatcaagaccctcacagtcgctatctctcacctcataaatcctgcggacacaatcttgcacacgcaaaaaccgaagggatctcaccgacgacggatcgatgagctgtgcaaggcaagaaaaggcggcgttttcttggggggttttgggtgcctcctccgcccaacccgcctctgtcctctgtgtcaagctaccctcaccgccccgtcagtgaccgccgtggggaagtcattggtgaagaggagtcggtcagtcggggagcttgtccgtcacagactcatggaggcgtgcgctgacactccccaccatcgtcgatgacccctctgc

SEQ ID NO: 67917 - DNA, 2715 bp, Oryza sativa
ccacaggaggcccgaagtcacccgcgtctcggccctctccgtcctcgttgctttcgacgccggaggccgagagacaggcgacgcgcacgtctgtttgcgccgttgccgcagatcagcctgacgaggtaatcgtgcgcgtgcgcctgcgcctcgatcgatcgaccattcctgccctactcctcgatttgttcgcagtcgaattggattgcgatgtgctctcttcctcctcggttttcatcgatcgcttccttctttttgggcgcgttacttcttgaataaatccttttcattttctcaaactgtcaaacaccttgaacaatatttgccgttatctcgattcaccattcatacccttcttactttgtgatgatcatcacctaggtttattcgacttcaccaatagtctgtcacgtttattgtgttacaactgagaattaacaaattctttctgaccatttttccaattcattgcagataccagctctaccaacaactcccgttacttctctgtatgatgcctgttctgaactgagtcttcatagatagagagaaatgggttctctcacagatatcggcgtcgccgcaggaataaacatactgtccgcattgggttttcttctcgcatttgcggttctcaggatacagcctatcaacgacagggtctactttcccaaatggtacctcaaagggacaagaagcagcccaagaagcatgggaacggttttctcaaagtttgtcaatgctgatctctcgacgtatatccgcttcctgaattggatgcctgcagcgctgcaaatgcctgagcccgagttgattgagcacgcaggcctcgactccgcggtatatgtccgcatatatcttcttgggtgagcatgctgttcgtgtttcgcaattggtctttttttttgtctttaaagtttccgaaaaggttgaattcaactgataaatgtgactatatgatttggattggatgtcagaacatattcggtgtattatgcttactgcatagttctcttgctatgcaggttaaaaatatttgtgccgattgctgtgctggcattcattgtccttgttcctatcaactgggctagtggaactttggagaaggaaaagagtctaagttatgatcaaattgacaagctttcaatatctaaccttggaaaaggatcgaaaaggtataattctctgtgcttcatgtgtgtgtcctaatgcttgccgcaccaccatggatcgtgcctttgtttctttgaatgattacctgtgtagcgtataatgttaccgctagtctttacttctattccggtatatgcaacctcatatccttcgaacaagataatgacatagaaggtttcctttcctatctgtactttgaaaaaatggcggtcagacattttggaattttgtgaatatgtttgcagtttttcaatatcggtgcactattagatactttccattaatttagtacaaaaatatttatgcagtgataacctatgcttaacctaaaattgtaacaattaatggagactggtgtgactaataatccaaactggacctcttcgaaattgatgcatgttctaactttttcacataaatctgctctattaatacagaagtggcaaaccttctgccctttcttcaaaaagaaaaaaaagcttttcacataaatgaatgcaaaggctttgcctccaaataatttcccaattatcgatgattattctagcatttagtcatcatcacttttatcaaatcagtttttatgatgctctagcactagaatttgatcaggctcttgcggtatttttctaaccaacacaaatgcctactaattagttttttttcgttgtcaatttcactagtgagagtttagccgaatttatatcttgtgttcgatatcctgataggctgataatttctctaatgaatttatgttttttccctgtcaatagattttgggcacacatagtgatggcctatgtatttacgttttggacgtttttcgtgttgtatcgtgaatacaaggttgtaacaactatgagattgcgctttcttgctattcagaatcgtcgagctgatcagtttacggtgagagatctttcccgtaacactcagatcaacgaatttaaacttctttactagattatttcaactttgcaacttattatatagttatgcttctttttttttttgaatttacggcggtgaaaattttcttatttatctaggtcctggtgagaaatgtaccacctgacccagatgaaacagttagtgagcatgttgagcacttctttgctgtcaatcatcgtgatcattatctcagtcaccaggtaataaattttgctatcttcaatccgctgtggacttcagcattgctttttgtggaaaaactagataattaagttgtaaggaaatccaaataagaaacgactcattgtatttccttttgttctgttctcctgaattaccgacagttctttactcttagcacataacaaatagtccagctcaaatgtgtgctcctcatttggagtaatttcttttttatcatatgaccaacagaccgtatacaatgcaaacacccttgccggtttggttgagcagaagaaaggcttgcaaaactggctggtctactacgaaaaccagcatgctaaaaaccctgcaaaaaaaccaactatgaaggtacgggttgtctgttgcagatttattctcatggaccca

SEQ ID NO: 67918 - DNA, 8924 bp, Oryza sativa
  unsure (1)..(8924): unsure at all n locations
gatatacagtaggtttgttcatcttaaattagaatgaacccgttggaaaactaaccataggcgccttgcgagcttgcccgatcaacttatacaatcaaatgctaataatgggttagaatacaataaatgagctttcctgaatggtggtatcttcacaaccacttgagatccgtaatgacatgatctgcaacacagagagttatattgtcttggagattctaaattaagtgcttaccgtctgacctagtacatttgtaaatacgattactacttcctctgtttgatatatattcgtctttttttctttaaaaagtacagacgcagacgctcataatacacggacacttatccttatgagcataaacacatgtatcttaatcttaagattgataaaatcatcacagacgcctagctattgacggtatgtcaccaaccactgttggaataattaattgtaaatatgagcacccctgtcaagcctagtatttaacctgatgggtaggttccaccacaattaatctaaccagttgagagctatgtccacttcacactgaacgtgtagagatgtagcctagagggggggtgaataggctttcctgaaattttctcaacaattacagcggttaaattaacagggcccgaaacctcctggtgatgaacaccggaacttccgggcaggatgagtagcccgaaacttctggagttattgagccaggaacttccgggcagctgagataaattaaaactgagatgaaaaacatgtcctagcaagggaagtttaggcacacagaggaacaagatgaagatcgcagaatatcagcagattcatacaaagatcatacacaagagagacaaagacgatttttttcccgaagttcggattacacgaatcctactctccgttgaggtgctccaaagagccgggtctcgattaaccccttgcctcacttatgaaaagatcccagaagaggtccacagccttcaactcaacacttctaggtcattttctagaattgagtgaccaccaagatccaactcaaaatttcttctagaaaagaccacaagtgcaagttgctctacctaggacaacctctgaaaactcagcacaagaatctttactcacttaccttgtttccttgtggaggtgaggaaaaccttcccaaactttcccgggacatccacaagatctttggaagctcacgggcaacacctaaccgtctaggagaagatctccaaaagtaataagcccaagtgacagcccacaagatatccaaagtgctcaatcaaacctaatcttcaagccatctccaaaacactcctacactctcatctaatctcataatctcacaagatatgctctagatttgagtggaggaagcaaatgaagcttgggggtggctagaaaaccctagaacatgaatgaacagaagtggaatcgccaaaaggtgacctggggatgaaatccatatatataacggctaggtgacgccatctagctgttactcacaagtttgaactggaaacctgctaggaggttccggataaaagtgccaggaacttccgggcagcacttaggaaatttttgcaaataaacggtgcccggaagttccggccagaacctccgggtagccctctctgtcccggggagaaaaacatttttcaaaaatgattccaaaaatcttttgactcatggataagactaagagcactttgtataccctagaaccacacttgaaacccctcttaatagtacggtttttcctaaactcaatttcgaaagtgaaaaacctagtctaatcaccttcgatgatttttgcacttaggaacattcgaattggggggtctccttgcattcttagccatcacaactcgctttgggactaaactcctgtgaataaacttgataaacacgttagtcccctttaaccaccttgtcattaatcaccaaaacccactagggggtttaagtgcatctccacacacatgttcgcttttgaactactatatcattttgcctgccttgcctttttttttcttttccataaatataatgggagtatctataaaacattcaacattttttaatgaatgttttaattataactatattataattggggtataattacattgtatctataatatagttacaacttaacttatatatgcacaaatataattggataaaacaaatggtgtggacgattagcaagcaagcattcagccatcctgtaattcgactcttggcttcagcatgcgtgtgtaatttttcccatcctgtgcaaatctcgaggcgatcagaggatcagaaaattcaaaagttttgagcagaaaaaaccgtccaatgtttttttaagccattccgaattacaattagcagagacacattgtaagatgaattagttacagtcagcatataacaggcaattctatacataaatcagttctatacatatcacagtatcactatttttagcctcaataccattgccgatcgcacgctagcagcttagccgcacggcgcttcatcttgccaaataagcaaccatctcactcctcctaaccgtttttcccaatttcccactagctttactactccacaaatctgcgtgacagcgaccgtacgtgcacgttacacttccgtggcgcgactcggcccgcccccgccgccgccgctgcacaccctgcaccgcggccgctcggtccaaacctaagcacaactctgtcgagactcgagagggaacgggtgaatcgatctgaacgggtcgcatcgcatcccgcgatgtacgctggcgacgcgcaccatactccatcccactccgccgcccgcacggctgcttctccccctcccgtgcgcgaccgcgaccgcgagagcccaagaaaggaatagctagcgcgcgccaggtagtttgccgcgcggggtggaaatgcttggatttctccgtgcggtttccttttcccccccgaggggtgggacggatcgggaatagtattatcgtacgtcgccgcccacccaccacgcgtgcgtgcgtgcgtgagcctgcgtacatgctctccacgaacgcaggggatatcgcgagagacgtggaggagatcgagtagtaaggagaccgaatcgatgggagagatcggtaatcggaggaggaggacagaataattaaccggtgtgtgctagagattatggagtccgacacagattagcactccactgctaactaagaaaaagaaatgattgattattgagagtggatgaatgggcaggcagggatagattattatacaagtattttgttggccgaactagaggggaactaggtggtgtttggattaagcactaaactgtagtcactataacatcggatgtttaacgctaattcaaaatattaaatatagactaattacaaaactaattgataaatgagagctaattcgttagataaattttttaagcttaattaatctataattagcataggtttactctaacatcatatagactaatcatgaattaattaggtttaataaatccatctcgtaaattagtctagagttatgaaataggttttatcgttagtttacgtttaatatttttaattagtatataaatatccgacgtcatagttttagtccctagtggtcttagattcttggggtcggagtcggagggttagtgagtggaaatgacgccattagctggtcgaaaataatagtggaaaaacgccgcccgtgccggcgttgtcataggtttcgtgtatagcgcccgggggaattattttcttcttcttttcgttcaggaccgcttggttttgtttcttctgatgaggatcggagttcgtgtgcatcgctccttctggagagatgtcgtgagctatccggcctgtgtgtttccagagaacacatggttcaatgacaacatgacaacagcacggggtgaaatcgcggtgaagtcatggtcctgtacgccggtgggctgtatgtgtaaaacatggaaaagttctccagaaaaaatgaaaacgtcggtgacgtctacgcagacttaactctgcagggcagtacggtgctgctgctgctgctacggaagctgtggatctcctagttacgccagccaccgttgccatcatccacagtgctagtggtacattttgtactctctcctcgtagtagtagcatgcagcagcaatagccacgggtactgcacgcggcgtcacggacggtggatcgaatcgaccgagcggctggtggtggcgggggcacggaaactactgcagcgacgcagggggaagcagtaaatggtccgaagcttaggtaggaatgaaaaaaaatagaaatagaaaaaacaaagtgtaaaacagataattgtaaaacacggaaaaaatcatcagattggaccgaaaaaaaaacacaagaatcagatgagagatatactcaaagaaattttttcaagaggttggttctcttggtaaattttctttaaaacttacgttcaataagctattacagataaattttatagaatttagaaaacttcattcctttaaatcaaatgaccaaatataaaaaatgtcacgccccgaactagtcccgaccggaactagcccgtgacgctccaaattaacctgttaatcgataccagtcccaggaaacagtgctggtatcacaggaagacagaatatcacagcaacagaggtctctttattatagagtaggagtacagtcatgttgggccgcggacagatcccgagctcacaaaagggaagcggaagccaagacttggaccaaacatcacaggcgcgacttgggaactaggccgaaaccctaaaactcatcgtagccggcttgctcctggaagaactcctcgtcagcgggatccgcttcatcttcttcagcaagggtgagtacaggagtactcagcaagccatgggaaataagtgtttaatgcaggcttcaaagaaaggccgttgtttttgcgattgattttatttaaactcttttttgaaacaactaagggagtgcttctcaaacgacacggatgagacagtgcgtctcgtccggtcggagtatgtgcaatgtttcagtcttttgaattgatcaagattggcacccggccaacagctttcaaacggccacccgggcctggctgatcccatcagccgcagattttccaaacatcaaacccattccacaacagcaaatttcacaaggcagtagtcaaacaaaactatgctaggaatcacctcacatccgcccatgaccgtgggcacggctgctcgaacagttttaataacctctgcagagggggcacactttacccacacgacattactaacccggatcatccagcccgtgcagaacggccacgactagagaccttaaggctttcatgacaaagaatttcaaaagccgacacaggttcaccatatgccaacgagaggggtcccagaccaacaccagattaggtcccagaccatactgtgccaggaagccaaggggtcctccccgacaccaccccggcgaatccacatgtctcttagcatcatggctcccccgataagctagttactcagccagaggtgtcccattccacccatgtggtcgtacttgtcttatattcggatgaaattccaaggaaacggtccttaagtgcaagagcgggaaaccgtacacccggtacgttcctcggtccgcggttttggaaattcatttagttcgcaagcaccgacccaggtgtcgggttttccaagtcttttgtaaaacccaagttttacccaagatgtttctcagattttaagtttgaaggcgaccgtcgatacccgtgcagagtgcacgattaccgaggcgcaactaggtgggtacaagggaacatggtataacaattacaatggaagggtcaaatgcaacaaattaggtaggtccgccaatctgccttgcagacgggacaagcagattaagtgcgatcctatcaatgcataatatttttcaagcaacataattaagttcaaatataggctcaagatgttcaaatgtggcttgccttgctcgagatcttgagcttgatcctcgaaatcctcgcactgcgggtcttcgggctccgaaactacacgcgaaacgggacaactcagcaaacggcgaaaataaagccctattattgacctctaagcgtgccattagatagatctcgagatttgagaattttggaagttgaacggagtcaatcggacttacggttgggaagatattgaatttctaagattattggatttttggtctaaaggaaaaggatttatttaaatcctttttgaaaaagaaaagaaaagaaaagaaggaggcagggaaattagactttcctcgggcggctagggcgcggcccgagagaatggggcggctcggccgagcttaatgggccggtcggcccaagaaggcggcccaaagcgcgcgcgggggcggggaggggagagagagagccggtgggccgggtccatcccgcgtggtcccgggtgggacccgcttgtcggcgactcggctcaccgtgagcgaggtgcacgtggggcatgctagggtttggggagggaggcgcggcgcatgcgcgcggttcgtggaggacgcggtgcggcgggcccacgcgcagcctcacggctcgcggtggaccgcgtgcgcgagggggctgtcggtgacatgggaccgggagtatcatgactagaggcttgggcagccgcgatcacccacgtggcctgaccccctcgggggggggtcgggcccgagggtgatgtggccgcccctcgccgnttgtctccccgaggggtcggaccattcccgtttcggccccgagggccggggcgccccgaccccctgtgggtttggcaccacgtatatgggttaggtgagcacagcggggctcacctaaccgcatttattgcgggttggatgagcgcgtcacgccgcatgtaatgccgcgcagcgagctcgcttatccggtccgtgaccaggcgcagcgtgtgaccggtcagatcgcgggttaggtggtggcaggtggcctgttacacgcctcgccccgtcccgtcggaatgatgagagcctccaggcacttatccctagccggagccggcgtgccaactcctggggttggcacgtcagccccggccagatacatgccaggcttcatcccaaccattacaaggaagtaattgtatgaagaagggcagacgtgcggcatgctaaactgacacatggtggacaagaatgaccggtctgtgactggtctgacaccggtcacgtcatcggcaaacaaactgtgctcccacattgcgtctgcagccggcggagtggaggtaggtatgacccgtcccatcgaagggtcattcggacaacagccattgcaaatctctgcccattaatgaaggattgacaaggtgatcccctgtgtcaggcgagtgtcggcgctgggtctcactcaaagacaagctatgacttagcttctaggagaggtggtgcatgtggtatccccttgagatataaaaggaggaccttgcccaccggaaagaaaaaaaaaggagagaaaggagaagacgatagctgatagaaaacaaagagtagggagagggtctctagagttcaaacgctcttgctctccacctctttataatttcttcatacacagatccaccagaacacaggagtagggtattacgcttcccagcggcccgaacctgtctagatcgcccgtgtcttgtgcatttgctctctcgcgaaccattccacatatcgagggcttagaaccttactcagcgcccccggccgaaccggcaaaggggggcctgcgcggtctcccggtgaggagccccacgctccatcaggggcggagggaagcggcggaccggggtctgcttgacccggtcgcggccgaggtggcaccgacgtggcgcctacgtggctgccacgtgggccggcgggaggtagacgacgacgccggtcgaaacggacggcggacgacagcggcgagcggcggagcgaaccatggcgatacaggcgaaggcgagcacactgggatgttgcacaggacgaggggagacgagccaatggctcggattcgccgggggatgctcgacggcggcggattgcggcggcggcaaccgacggcgggagaagggggaaacagcgatgaggtcacaaggggccgattcccggcggtgagagcatctacgcggctacgggaatccgttgctagcgtcggattgggcggagctacgccgagcgaggccggcgacgagcgggcgctacggagcacgggcggcgacggcggcgagcacacagcgagcagcggcaacgatcggggcggcgccagctagctacgggaaggctacacatgctactaccgaaaactaaggggaggagatggatcgaggagggagaacgggggaatgcactaccgagatgaggcggggcgctgtgacgagaggccgacggcacgggagtgatctctccggcctcgggccggggaagaggaagaaggcgagcgcccggagtccccttccgtgtcctcgctcgtgccggctcctccgacacgtgcgacggcgaacggcgacagcgaacagagcacgggaggcggcgacaatggagtggaggcgaatgggagaggaaaggaaaggggggggaagcttgggtttatatgggcgacaatgtcggtttgggagaggggaaccgactttggacggtcaagccagcgagctggcgctctggctagcagccaaatcggcgacagggagtaggggaatgactccggcagaggaagaaaaaggaaaaaggaaggaagaaagggggcttgccccttgccactttgggaaaaggaggaggggagggggcgacgcggcagagggaggaggagctctgcctccgtcccttggaggctagcgcgcggagtgtccggggcc

SEQ ID NO: 67919 - DNA, 5792 bp, Oryza sativa
  unsure (1)..(5792): unsure at all n locations
agagagagagagagccggggagggagggggagatgggccgagagggattcggcccatcgaacccgagggaggcaaaatagacttttgcggagggatttgatttgggaaggatttggattcgggattgaactcgacgatagatcggggatttgagatctgagatggcacggacactagacaataagcaaagaaacggatttcgcaaatagggtttttaagagatagtttttccgctaggcgccacgacggaacgggcgctacagaatttctataaaattcttctactaaattcttttgattcaaatggccacaggaatcagataagagatatactcaaacaaattttcctaagaggttagtccttttgctaaattttctttaaaacctagattaaattagccattgcagataaattttataggatttgaaaactccaatcctttaaataaaatgatcaaatagaaaaaatttctataaaattcttctactaaattcttttgattgaaagggtcttaggccattctcaacccaacacactagacatagtttccataagctccacatcatcaaaaaaactagtactagacactactcttacaatgcaaaaaccattattccatacttaaatttagtgctacttatctcacatgatgtcttggatattgtgtagaaccatgtctcatgcaaaacatggtttcctttgctttcctcatttattcatttgccacgtcacttttcatcttaggtagtaacttatttaatgctatagacaccattcttgtcattgggttgggaatggcattaggagtagtacgtccgctgtacgctgcacgagccggggagcccaacggttggtggctgcctgccttcgccaatttatttcgccgcaggccgcacagccgatcgatctgcagagcagcagtaaaaacgctcgtaacgacggggtgttttggaccggaggaatggcaggttccagatcgatgcaaattcgcggtgaattcttcttctgctactgctactgctgctgccgctgcgttatattagctgtgatctgggctgtgaagtcgctcgggggatagaaaaaaaaattgctcgtggctgtcaatgtgaatgtttgttggtgcagataggtcgttaggtacttgcatgatggtgagggttttgggggcggcttcggatgcaagggattgggttacttctagcacggttggtgttactacgtacgtacgtgcatgcgtgcgaatgattatattctagcttcaagtgcacactatctgatcccagatcaagtcgtggtagggttcatacactgggttgtcgatatatcagttacaccttacgagaaagatatggtgaatgcctgttttcagacaaaatatcttttttttttagaaacacaggccaataaatctatgggtatatctatacctttgaattctaaggttgtgtttgtttctaatggttgggaacctttctcctctagcacgtaaaatgaaacgacggtgttaacacacgattacttaagtattnctaaaaactttaaaaatagatttatataatttttaaaggaactttcctttataattttttttgaaaaaatacaccattcagtagattgtgaagcatatgcgtggtaaaagagagagtagagattggaaaagtgtatgattaattaagaagagaattggagaacattaaaaagataagaaaaacgagatgaaacattatagtatacgattaattaaatattaattattttaaacttaagaaacagattaattaatactacctccatattttaatgtatgatgccgttgacttttttttcaacgtttgaccattcatcttattaaaaaaatatataattataatttattttattgtgatttgattcgtcatcaaatattctttaagcatgacataaatattttcatatttgcacacaaaatttgaataaaacgaatggtcaaatgctagttaaaaagtcaatggcgtcatacattaaaatacggatggagtatgattttctaaagcaattttcgcatagaagtttttttataagaagaaacacaccgcgcagcactttgataggcgtgcaggcggaaaatgaaaaattttcctctcagaccctgtttagatcaatttgatgtggcaattttttttagaaaaagttttggtggcaaaagatttggtattgaagttttgctagttggtgtttagatgcatggtaaagttttaccattttactagtaaagacagagagagcacggttcccaacatacttttttggtaaattttgctactctaaactttcaaatgacaaataccaaattgccaaccttttctaccagtgtttagattcattttagcaaaagtactctaaaacagcaaaaaaaaatttgttattttggagaaactaaacaggacctcagccatcttgtgccgaacacagctaattaattggataattccaaaggcgctccgatgtaaaccaaaaatcttacacattgatttcatgtattattgcgaccatagatactgttgagagtttgtaataaataaatcacgtaactggaaatagtgtgcactctactttactaattttgaaatttgtaattaataaatatgatatcgtaatcatttcgaactctcagttagtttagtgatatgtaaaattaattataatattccaatttactactctgctatgttccataatatagtaaccgagaataagacgagagtacaacaaataatctagatagacgtatccagattcgttatattatgaaatatgtttcatccaattataggctgctataattacccataactagttagggctaatgacttatctgtcgtttttagtctttcatgggtaggctcatggggggcgctgatccgcggctactcgcgcagccgtgcatgcgcaatcagctacacccctctagtagatgtatatacagatgtatatacgtatgtataacatgcatatgtataaattttgtatactaaggctgtgtttggcattccttattcccaaaaggaacagtgcgtatgaaaaacgaagcgattcattagcacgtgattaattaagtattagttatttttttcaaaaatagattaacttgatttttttaaagcaacttttgtatagaaactttttttgcaaaaaacacaccgtttagcagtttgaaaagcgtgcgtgcgaaaaagagagaaatgggttgggaagaaggggtgccgaacacagcctaaaaagatcaaaaaaactgcaaaagataaaaaaagaacaaagaaaacagaaaaaaggaaactgcgcgccaaagaaaataaaaagaaaagggaaccacgttgtccgccgcccccactcttcgcgcgtgaaacatgtcgagtcgtgtgggggagggcgcacgagactagttacgaattagcattcacataggagaaaagtagaggttatcgtaccccggcagtataagcccgataaccatttagttatcaccacgaatagtaggaaaattggacggaatttattaaataaataaatatcgcttaaatgtattttgaatttggtagagctattaggctaccttaccgttaccgcacccaactactacggtcggtaactggcggtcggtaagagaagctctccttgctgttcccatctttccaatgccacccaccgtgctatgtttaaaaaccgtgaattaattatttctccgttcagctgaaatcgaatcattccatataaaattcttgtattctaaactggcgcttgcccatgctgtgcgttcgtaaattgtgttttttcggaaagagaagtggctcacttagtgaaacaggacttagacttacgtagctgggcgtttaagcctccttgagctgtgttttttatcttttgtaatcaaggatctgtttgtattctgtttttcttcttaatcaaattccggcagagctcctgccgtcgtcttcctcaaaaaaaaattgtgttttttctactatattcaccacctgaaacgtttctaacgatagcattcaaaaaaaagctggaaggctggaaattaatgggcagcacgtttgccttgtcccgtcctgttgcacatatttgtacagaagtgggccaacaacctgaagcctttgccgttatttggcgacatctttcggatgggtgttacatgtagtagacgctttgtgtgtcaggtcaggctgcccctctcaacggtaaattattctccctgggtcaccaaatccctttcctttgtctttacaatcacaagcagagacggagaaaaggacaaagcagtaggaggctgagctcacagttcctaattataattgcctgtgtttctagaccgtcgctgggatatgatgcatctggatctggacggtaggtagctgtccgtgcctgaatctgttgctgcccacacgaagctgcgtcgtcgcaccttctcggctatttcaggacttctgtaaagcgacagtttcatcagacggtgagtattcagaccatcagtcatatttacaattttaaactgaagatatactccctccgtaaaaaaaaaagatttttttggacggggagtataacttagtggtcaaaatcgtttttcatgtactaactttgaaaattctatgatcaaagagtataacataatctctacgtctcaaaatatatataaggatttttttatgaatcttgataatttctggctataatacctgttcagattcataagctagaaatgattatattttaggccggagagagtagatcatcaagatcatcgtcatatttacaattttgaatctgatcaacaggtatttattctatttgtaaatcataaaaaaattgaatggaaacttctatgctcttcatcaataaaaatgaacagtactcctacaacttcaccaatacatcaatgatgctttctcatatagattgttcttatgttcattagctttagcgacacggaaaatgttgaaaatacttgagttggggatatggggaatgcatgcatgcaggcagcaggttgtgtaccggcaaagtgccaaaccattaaagtttgcaccattaattgggggcaacacagctcacaacctaaccatatgccacgagccggtgtaagcgggattgggagccttcagtcatgaacgagccatatttttttttcttttcttacaaacaaagaaaaccacttggagatagggttaattagtcgtcaaacgtatgtacgacttgtagagctagctggaaacatttgatagttttagttgataccctaatgttatggaatgtagcagcatgtgcataggagtatataatactgtcacattgctacgacggttgttgtatgtactaattattaacaagccatgtgaaaaatacactaaactaattgacatcgacgcttatttgtattaatttcttgagaatctattgggtgatctttaataaattttaccgcgtttagacaagtctgcaggaaaatgtgtgttattacgcgcgtcgacttcacttgattggttttgaacccctgcagcttaggcaagtctacagcttgagattggagcaagaaacggtcagttcattaaataattatcaccgctaattggtcccatggcatgtcaatttcgcggctaatcccatcgtgaacaatcgttcaattcgtcaattagagtacgtcactgcatacctgaactgaaagaaagttgggcatgtgaacagtcaagtcgtcatagggaagaaaaatactgaaagtaccacgcgagacaaattcaaaggatactat

SEQ ID NO: 67920 - DNA, 13648 bp, Oryza sativa
acacatgtatcagctagggatatgtctcctcgagagtctagggcctatttagagaagcttaagattttgagaaacagctggttaattggtagccagcttctgagaatatggaaaagctgggtttcctagcttctggtttctagttcatttcctggattctacgtacaactacagtttcttagaatctggaccaaaagctggactgtttgggagagcttctgattattagagaagttgtagcagctaaaagctcttctaaacatacccttataatcgtttctacgccatagctactatacgtaggttgcatgcatgtaattgtattcgtgcgcgtatgtgcgtttgatgtgccgtaggcatcgtacgttgcatgtattgttttgtatgtttgctcgtcacatggtgaattgagcacacacgacacatctcatcatcagctgctgcccctgggatttgtagccttcttgtatacctgctgcatggatgtggatttgtacatgcagctggggggcacgtacgaattaaagggcccaaggaattgatcatcgatcgatcggcaataattggtttagtggatcgaattccgtaatcagtggtacctgcatgcccccattggatgatgtttgcatatatgtgcatttatatttatattcgtattgaattattgatattagcgtgttggaccattgatccggatcttgattaattcagtgccatggatgccagctgctttaagtagcttcccgtggatgaacggtctgttaaaccctatgtgcgagaagtgatatgttaaactcgaattgtgattggatgatgtagttaagtgtcaacctatatatagtctcgaagctgtggacactaggacagtacgattctgattgttatgcacttgtgtgcccatggttcagttacctccccaagctagcaaagcacatgttgataggctatttatgagcatttttttcccatgagctgaacccgtgtgatctatctgtagatttttgttgatcgattggactagtaagatgactcatcacatatccaaattgttgcgcaccactccattgaagcagctagccaaattaatgatactacgaggcacttactatatatttccccgatctatttttgatagtcatatttccaaatctgaaaaaattattttttagacatatttcaatccaacaacttattatcttaatgactttctccgatttaatacgtgactctccattcctccacacaagattggttacatggacatcgagaaatataaatattaatgaatcacttgtttacaaggaatgactagtagcatgtttagatagatgataagattgatcttatacctcccggtccagaactagaattacttatcattagtctatatgtcaatatgaaatatgactatcaaaagtagatggaaggagtatgtcgtaattaaaattagttatgtatgtgaacaatagttaagtagtgctgttttaatgaaagaaccaaattacttaaagttccgtgtttttctgtgtgatgattaaccacgcctacctttaggaatcaacttcgatgagaaaaagttggtaagctaacacacaagtcaagacgaacataaatacaatataccctagagtatggtcggtcgatcaaagaaatgaatggcaaaagggaatggattcaagtttaatttggttgcaataattggatgggtagttttcaggcttaccaactacgagagaaagaatagattggaaacattttatgaccttatgtagttggtggtgtagttggagtcctaacccttttgaggtaacaaaactaagatcctctagttgtagatgtgagtgatttatcaagctaggttaattaaaaaacagaaacaaagacagataatgagacaaatcaatatcaataatgtatctgagcagtaagccatatatacggattgcgatgctatttaggacatgtataaagggggagcgtatcctatgcacacaagccctcgcgtgtacacaccgtgtacaccaactaaaaattatcacaaaaaattctaggaaaattcatacatgtactttcaatagtattacatctacgtgcaaagtcgcatcttcaaattcattctacatagagaataataaaaaagataaaattctgacaaaattgcaaccttaaaactgtcagattttttgttttttttgttacggctaaaatataatgaatttgacgttaagattttaaccctaggtgtaatacaattgaaagtatgtgtatgattttttctagattttttggtgacattttttagttggtgtgcatgtgtgtacatgtgagggcctgtgtgcataggatatgttgccgtataaaggtgagacaatcttgctatatatatatcttgtaaagacaactgtacagcgatcacaaacactataaatacaatattgcattattgtctttagaaatagacttcacaataaatacaccacaatttattatagctaacccatagacaatcaagttgtgttttttttttctttcatatgcccaagagcttgtatattttgccttctataacacatcaaattctcgtgacatgttcaccagaataatccacagttttgttagtagtattattttgcaatgataattgatcgatgtaatcttcttctatggagccccacaatgcataacagttatcaagcatatatagtcaacacatcatcacacgcttgatcatccaattaggatgacacacacagcactagaacaaggaaaaacacctgtcctaagtcctgaccgtgtcctagttaaggacatgtaggcagaagagaaacatggacagttctgtacagtctgttgcatctctgtccgtcaacactaagaatcacaccctgtttatatgcatttgattgctgtacaaggtactccatcatccagcctatgcatgtgctataaccgcatcaggtacagagaaaatgcatagacaaaggaaaaaaaataaagctataattaaaaaggtaagagaggatgattaagtaaaccaagaaagcccagatgattatcaacaacggcagatggtttctaacttagaattaattaaatcaagggttagtttgggggggtatggcccaggtttgttaggagtctctaatcatgcttgcagttgcattagcacacacactgtcgaattgccagcatgttatgttctacttgcatgtgtgctccctcatttagacagaggaatgacatgtacacgcaagctaccccctgaatttggatggcactgttgattagttaatgctacttgcacttagttgcaccttaatttggttcgtgcaaatgggtaaattgtattgaatgtaagatttttaggaattgttaattactacctccagtcacgagtcatttggacatacacctgatcaaagttttattttttttcttaacaacgtattataaatatttgtattggatatatggatgtcatatatatgcatggatctgcataaaagttactcacatgttataagtttattgggtttcaacaataatacatagtacggtagaaaattagtggtaagtcacagtaaaatttcagaggttatgtgattttttctcgaataaaaaagggttatgtggatgcttaaaatggcatattatatatgtttaggttgttttcaaaagaagtggtagtaggtgcaattactaagtgttcacgagccacctcacccccaagcggtgagccagacaataaatcatgatcgaagcagatggattgcttgatgaacctaggagtttcacgtgaataataatagaagtggtagcacttgaattttcaaatagatgtagtcaactgtagcatagcttagcggtgtagcacgtctctgtggctaatgactgtgctttacttaattaattagctccctcaattgttcgttgggcggactattttatatggacttgtaatcattaaaacggcagcaatataactaatttgtccatatgcatagaaaattgcatctttatttgagagagtatataaaaaaatgcatatgatatatacaaacaggggattgatgccagagtgacaccaaacttggtttaattttctatctgattccttcttctagacttctagtcacccatgaatgcatagttggtacgtacttggtagcctgcattttctctctccttggagcagagataacaacctgctaataaataaccaatttcctcaactaattttaacgacttgcattacttgcacttccatataaccaaaacgacaaatcagattagttgtaggcttcatacaatatttgaaaatgacaataatatttcgatgctaagtaaccaatctagcattttattaatataagttgtgcgccatggtttacctttccatttccgaaacaaaaacagctccccattggttgccgggctatcggctaaaaaccagtaaaaaccgacgtctttcactcaacaccttacgaaaaccgttaaaactgaacaattttcataaaccgaaaaccaacgatttaaaaaaaagatatgattcgtgaaaactctgttgtgcacgatataacccgagtctgagatagtaacaggggtccatgtcactcttctgtaaatgatctgtacatttgttagtatgtggcgacgtgaggcatcgattgaaacatcgtttttctttttagaaaaggatagttgcactgtgcgcagcttgcatccaacaactgtgagaaatctgaaaaattagcaacagtagcaatcaattgaatggattgatcttatccgctcttccattacttaagtgagcactagtagggtttagctgtgatgatgatgatgatgaaccggtggtttgtatggagaggatgccatcgggtagatgctcttgtcccttttatttggcgatgtgatgataatattgcggtcttcaagacaaataagaaaaaagaaaaggatgataagattgtgtgaatggtactcaagtcattcgtggcaggccaactgatgtgcacttgatgcggcctagcatgatatgcatcgtcccaactttcgcactctagttaattggaggtgatgtcgtgtacgaatcattctggcgtcaacttaaaacaatagtagtgactctgatgcggagggataataatttaattagtcacttttcaaggtgtatctaattcgttttaggtgattaaaaaaaacctcaacttcttctcttcttgtcaaaaagaggacctaatgtggcctttaaaccaaaaaaaaaaagaaaagtgtgtggtcatgagtagagtttcatatctattatatactaaaagtatataataaagtccatgaaacttcatacaaacgctcccaagccgccatgtggcgctctaataaaatagagaaaatcctataaattctataaaaaaaaaagcagaacatatatcccttgattttcacttaaattggtgggtccaatattatacaccgttagataaaattgatcttaaaacaaactaaataccatgggtcccacctatcctcctcccgcgcattggcaggtggagtatatacgtacgtacatggtacgtacgttcctcccccacttttttttattttttcttctttcttcttcttttttccatttatatatataatggatatatttttaaataattataattttacaaataaagaatctaccatcatataacttaaaccggtttactttgtactattattttcaaataatgcactattttaaaataaattttacacaattatatcgtgtacctatcaaataaataatatctatattaactaatttatacgtgcacttaagtgcacttaaactgatggccccattatataaatcatcggatctactttttattacattgatatattattctcaagtaatgcactgtttcaaaataaggtgcacaccatgtgtacccattaaaacatcaatttaaaatatatattaactaatttacacttacactagaactggtggacatattattataatcatcggatctattgtttgcttataaataaagcgtctgaaattctctttttgcccgctgcacaatacacgtctgcacctttgcctttcacacttgtgacaaagcgtagtatctgagacatctaaggtgatcgcaaccgatgtagcgctaccgctttgccacatatcaaatcatatatggagatgattaattttgttaataacatgaaaagaaaattaaaggtgtgatgcagcgagagaataattaagtaccatgggttatgtttttctcaatactaattagctctatttaagttgaaaccaagaattgattacataataattgtaatgtatttgtgttatgtcgtatttggattttgtactatttattcgtacaggtgaaaggaatcattatgttataaatgtgagagtaatattgacgaatatccatagaactcttactacgacaagggtgataaatagagttttaaggccctctctttttttttccccgattccatattttggatttttgtttgcacgctttctaagtttctaaatgttgtcttctttaaacaacattctaactttttagaagtcaattcattcgtttataccctcaaatagctatcacataaattatataattcatcaatttcatctatcctaaaccttactatatatttttttcatgcaagtcatggtgattagtaaattggtgaacaacggatcatcgaagtcgtaagatgaatatgtaagagttactctgaacaattgtaaataggtatcaaaattaattgctattaattagacataatggcttgctagccacaaaattaatttctctctacatgtatagaaacatggacgaaactggaacaaatactaccatatgtcccatacatatatattgcgcagttaatattctaattagtcatttaaaattccttaaaatgctctcaagctaccacgtggtgctctaataaattagggcaaatattagaagttctaaaaaaatcaaagtatctattacttaattttcacttaaatcggtaggtccgatattataaaccattagattaaattgatcgtagaacaaactaaatactacaaggtcccacctcagcataggtgtgtacctacgtgcgcgggttcgtacgcctcccctcccttttttcatttttctttcttcttctttttcccatgcatatgcttccctccctttattactatatcatgcactttcatgagacgatttaatcaaagaattttaagtatcttgcactcgtattttttatttgcggccatactacactatatgtatatagatggactgcatgataattaactaccaatagtttcttatttactcgagaaaaaaaacatgattcaaaagttgtaaatacttaatccatctcctactcaaaagttcgtgaatggttttctaagataccttaagaaaaatagaacccttaaattattataaaataaaattatctaaactttagtttgtcctaaatctatgagacaaaatttctgaacaaacaataatcttacctttcaataatataagtgcccgcgcatacgtgcgggccaccttcctagttaaaactaaaaacacatttgctagtgattagggtgacaggaatcaaatactaagcagcaattaaatgggataatgcatacgagcacatatctgcaggaaagcgagcggttcaaggctcttcttttcaggtcgaaaggtcccttgcagatgaattgtcttcccctcttcaatgcacatatgaaatcatgaggcaatcatgcataggatgaatacaataggtctacaattccacgcagtgtggtcaagaacaagtcggaccttatcggttactatagtatcaattccatgtagtgtgaccaagaacaagtcgcaccttatcgggtgcttgctagtatggcaatgctccaataagtaccatttttgaaccatgtttttttactgtgtcagataaatctagcatactagttgccgattactatttcccacttcttggcaaaaatttgacgatgagatgaactaagaaatagtgtacgttgccttacctgttcagaggcccttttgttaatgtccatccatccaacctggagtgaagcaaatcgtccacaatgccagaaacctactgttacactggcacattacgtagcaaaccggggtccaactagaagtactttatttttgtacaggtaaaaggaactgaagtactgtatggtatactgggctactggcccgttcctaagagcacagagttttttttttttctcttggcaaccaaactgaagtttcgcatagcttgccatgcaacgcatagcattacagtctggaatggccggtaagtatcagaactgcgcaaacggaggcagcagcagcagcagctcggaaaaacacacaacagcatcagatctgtatcccagcaggatgtagacacagggcacctcctggacatggggcacaggcttggcactccacagtccacactccaaactccaaactcagccagagcatggagaacctatcagcacagccgccaagaggaagagtaaagatccaaggacactatcaattaaattaatgttcaggtccaaacctgtacacgggtaatatgatacaaaaggagtcaggcccataattatacatgtaaaaaacctaggtggtggttatcatgtctatttcaaagttctttttcagccttcatttcgttcttttccccctgctttatcaacacgaaatacaacccgccatgcctatgcgatggtgcctatgtgcaacttgcaactccattgcatgattgggaccttactaaatttgaaatactgcacaatggaagggagcaagaaatcaggtaatggggtcaaaagaataccgcgagactatgaacaaaagccattagaagcctctgtcagtgatgggatatcatcaagaacgatatcggcaggatctccaatccaaagcccatccctccatctgaacttgatcctcagtttcccatttgcatcaacgcctacaacctcacctttactctcatatgtctcctccccccatccccaacgtggggttacaaggccaggtcgtatccgtactctgtcccctaatcggaatggcctcaccttctccacttcccaccttttgcacaaccattgtctttcacagaaacagaaggcaacccaaagttcaccatcctcggcccggtggattacccctatgctattatggttcacgtcaccccactgatatgtgggggtcgcaacacaatccttaacctttacccagtccccgacacagacttcttcctcttcctccaccttttcaacctccgctgggtctatcaaccaagctctcgcaccagcgggtgtatgaatcctaagcttcccatcagcatcaatagatgagatggtccctatactagaatgattatgattagaccagccaaatcttggctggtggatacagagtttgacccgcacgcgctgcccaacgacaaacttgctgactccttcaagctggcttgaaggccctatccacctttcctgctcaccacaaaatgccacatgaatggttccatcccagacatcatcttcatatccaatcccatgtaccacgccaatgctacctggtttgagcgacttccaatcatctgcattatttctcagcctaacccattcacccacctcataaacttgctcaatctcaagatctgcaggatcacctttccacagcccaggcacaccaaagaaggctactcttacttctccatcagcatggacaccagcaattatgcctctggaatcaggctttgcatctctccatccccatctgggctctgtaattccagcacggaaccgaacatgatgaccaatcttgagaggctctactttatcaatttctgtgttatgagttaaccatttccctttcctgaaacaaccagccaactccaggtaaccagagtttgaatgctatgaactactgcaatacttattttcccaacactccagtcataagtaggcctgctcccaatactagatttcaaccgcacccagtctccaacctcaaaagccgaaagcctctcagcatcacctggagctaccttccacaagctatttctgccagacaccttgacatttagagtcccatccatgtctatccttgagatagccccgatggttgctgcagtttcatttgaccatccaaggcgaggctgagatattgaaggtaacacatgaattttttctcctacctcaaaaggctgtgccttctccacatctgcaactgagcaagaaaaaggcttgcttctgaagcagaaagcaacacccatatctccatcttcttctagactatgaaccaccccaatactgctacgagtcacatcctcccagccatatttaggggatggtactgctgccttcactctaacccaatcaccgacctgcaaataaaatgataaatagaaaatgagagtccaattaatttgctgtgctccaagcagagcaaatgctggtttgaaaggaaaacccagtaaacttctaaccttaaacttttctatcttttccatgtctgatggatctgcctgccaatgtacagcccggttaggaatatcaattatgagtagcccatcactctcgatgtcaattatttttcccacgctgtgatgggtttcaccaccccaggcatatctaggctctgcaacagacctttttacgcatacttggtcaccaatctggaaatttgaagaaacatgagcttcacactaaacaaaacaaaaaagcagagcaaacaagcacagatacatgcaaggacaagttcataatcgctgtgccatgtaatctaactacaagagtttacaaagttgaataaccaattctagtaaataagaggctatcacatattaatgtatctgaaagtccaatagaaccctcaacattccatcatcatcaatacagaaaattgtccaaatgctactcatgactgaccataccatccaaatctgggaacagaggattttatatgtgattcacatttctcccacaataattgataacctactaagatgagtgaattctatttttatgagacattcctcaaacattggtatattaatggtaaggactttaacattcacatgcaaatggcaaatcccaaaatcatattttaattttgctttttgcagtaagcagaagagcaacttcagacttataataggtaaacatattagtacaggaaacaaatggtaagagtaaaagaaacagaactaccttgaagggatcaacatgttcaacctcctctggttcacaaagccatggacttgacaaatagcaaagtcccaatagaagactgctgtctggcctgattgagtagacaataccaacacttccaggagtaatagattccatgccatgtacagcaaccgttaatgagggacgaatccgaacccagttaccaaccttatattcttcaacccttacaatttcagcaggatcagctctccatcccctagaagctcctggaaaaccaaccctcaagattccatcatcatcaacacagagaactgtcccaatgctatctcgtgactgaccacgccatccaaatctgacaacagaggattttatatggtgattcacaatttttcacataataaatgattacctactaagatgagtgaatttgttatttgatccatgagacattctccacaaatcttcggttagtatattgatggaaggaattctcattaacattgacatgaaaatcagaacagtggctcctattatcagatttttaaagtttgcctttttgcagtaggcagaagagcaacttcagattttgaaaaggtcaaaaatcagaagcaaatcaccatttgcagcgagcatcattttctttctttgggacgaccaggatgccatcatttttgacaacatccagtacatcagtgtaaacttttaaaaccttttaacagtcaaatgcaattgcaagtcactgaaaggacagatcacctcccaggttttgggtcaatggatcttggaacttcaacttacaatcatgatcagcacagagcgaaacctagcatgggctgcatggcacacagaaagtataaactataaagtagagacgaatttattagctgtatcaataggcctttcacttgcaagtatcaataaatacatgggcagacatctaatccagtaaaccatgtatttatgtcagaataaagtagacataagtccccattacttttataatctcggtgtccagatgaatcaaacaggctaatggatttactgacttggtaatgcaaatcgtttaagacagtcacaacttgcgaagttgtttttgctatgtagtaagaaccacattctccacttcatagaaaggcaccatgcacaaaagagagttcagtgatgagaatatgaaggattaaatttcacttacctaggctccaaaacatcaggtttgagctgcacatgttggcccctatttaatggaatgactttgataacttcactcgtcaaaacgcgggcttctccagaacaaaatgacacaacaaggtggtcatggtctacaacagactgaacaaaaccaatgcttctgggtcctgcaccttgccagccaaaagctggttcagtaactgttcttctaaatttcacccaatctgcgaactcatatctggtaacagcatcaagtaaaccattcagataacttgaggtccaaagcaatcataattccagcatgagatcaaatacgggacagccaaaaaatatcgacaacattatgcctcgagttccttacatggttggggtgagatgaactcctttttcttctaaagtttccatcagttcttcagaaatccattctcgtgggagcctctccagaaaatctcgcaatgtccagcctctgtagttgatagaaacaataccgaacatgtaagtatataataaaagatacaaattctgcactgcacgaactaacccatgagagagttttcaagcagccttgcaataaaatgagaaaatactcgataaccaaaatttgcttgctatttacttctaagataccattcaatcattctacattcctggcagaaggacccatctgaaaatttaatgagcaaaatactggcataatacactacctaagaaggggaactaagagaatcttcactcaatcaaacctcaactaagaatcaccgatacatctgccaacagctattcccgtacacataaggagtatcagaatatctataccacttaaaatgtgtgtagtggtggtgtccattcccacaccatctctaccactgatgtgtgggccccacaatctatactattacaccacctttcaatgagtcctcccctgtttcactgttggttctccccaaaatttaaaatcacctactggttttaataagaaaaaacatagtacttggactaaataagtgtttattaattgatttaataggttagaaactcaaattgttgtccgttgcaacgcacaggctcttggctagtattgaagcatttaacgtttaaaattaagtaaattgcccattgtagtgggtaaatcgcaccctgttttgctttgcacaaggtttagcacataccttttactttgcatcacgttgtatt

SEQ ID NO: 67921 - DNA, 6445 bp, Oryza sativa
acttgcctgtggtttctcacatcaacagccggcgatggctgttgtaacatttgaacaatccatgagaggttttcacgtatcattttagccgcatcagcagctatgtggaaagcgttatcgccgtcgtcatcctggataaccaaatagcacaacattaagcacataataacttggtcctgacatacaatggaaattgaataatgttcgaaggaaataggagcagtgacaaaacaaaatgaatgcatggattttaagttattgcaccataattacagacctggaacaagtccagcagccaacccaccataacacctcatatcagacaaattagaaggaagaataaaggacaaattgcagaacaggccttcctattcatttaaacttaacaacaataatttgaggaaatggagaatctattcctcctgataatctagaaaagcatgctggggccttatactttatggtgagataatacagtagaatttgataaggttcagggtgcaaaatcactgggaactacaataaagcaatattgttgggcattacacatttcatttctgaaatatcaatagataccatagcgcctcttggaaggtttttacgtaaaataagctattgttaagagctgcagaggtctacaaaagcagagttttccctcttctgggtaactatatcccagtggtttcatttttttcattcccattcctgttttttgttctgctattactatccattctacatttgattttgtttcaagtatatacataggctcccgctgccctccacagcggctccaagtaatgaaatgaaaactaaatgttttcttaagtatttcaattctcaataacaacaaaaaaatttcttatcatgcatcaatacacaactatgacagtgcctgacagcaaattgatatcatgatgacttttaggatttgtgcgcatcataagaacaggaaaaaacatattgtagccggatatcgagaaaaagattattcaaacataaaacatctggaatcataaaacattattcaaacatcacattatcttgctatctcaaaaaaaatatcacattattttatttatgtttatatatatatgcttcatgagaaaacatgatgacaattgcataaatccccacaagtacaaaataaatataaattactagtaaagaaatgaatcagaattcagaaggataacaggatcagacaggttgacagtttacaattcctaatacccagttgcacaagagatcatgttactgaactatgctttcagaccaacacactgctatccttaaaaatgatcaatgaagccacagtacctgtagattgcagtttgctccagcagctaaaagcaaaccaacacaggagtttgcacctctgttcagtgcaacgagaagtggtgttgtgttctgagcatttcttatatttacatcaactccagcttccaaaataatctgtcaaagaaaatataacaaagggaataaagcatattttcatatagaattaaagcagaaacagcagaaaaatgaagtaaaattccaaccatcagacaagaacagaaaagcaaaggaaaaataataataataataagtagataacctttaccttaaccaattctgcatcattgatcattgctgcagtatgcagtgcagttcgacagtgtgggtcatcttgtgctgtgggatcagcaccagcagaaagcaatacccgtactaactctcgaccctctgtcacatatatatgtcaatattactattaaaacagacacattttccagtagataaaaaaaaatagacttctgtcctcatccttagtgaactaaaacatgtaagtttgcttgtgctaagtgtgaatgagataaatatgaattaatctctagggtgcccatgtgaatcgcatttaaaatacaactctcgttagtggaataagaagcagagttgtgaatatcaaagttctcttctctaacatgatgcttcttctataacagcattcagtgtatgtaaagaaccaacgagatggctcttgatatttgactatttgtaagtatggatgtgacatgaacaaagtcaggaataacctttctcgtgctcttttttaagagcagctgccatgcacaaagcagtcccaacagggctaggtacatcaattgcttcagctatctcctcttcagatgcaacttcaacccatcttttcaccacatccgcattccatgttttaatacataaatgcaatggcctgtgcaccatgacaagaatgaaatatcagtcgatgaatcaagcaggtaacggatccaaaaggaaaatatttcatgattccacagcaccaacagcataaggaaagccaataagccatataaatagaagaaaatatttcatgattccacagcataaatcaaccaatagaagggcaccaacagcataaggaaagacacatcaatagaagggcatcaacagcttgccatttcaaacaaaaaatcattcttacgttttattcacagaatttggtatgcccatagacctgcaaccaccattttccaataagacgatagcacaatcagtatatctcttggccacagcaatatgcaggatagattcgccttctccgtctattgcattaggatcagctccagccatgagcaattcctgcatgacacacagagaatttaaatctaggaacttgcaagctgaagtcatgaaaggtgagcataataacatacccgcatgcactctggttggccatgatgagcacaaacatgagcaagagtaggaccaagaccttctctaagcctcgaattaacatcagaagatctccttacaagtgcgcgaacacactgtggagagccagcagccatagcaaatattattggaggattttcattcttatctaacaagtccacattctcttgataagccacaatagcttcaacaatttctgctgagcctcttcggcatgctaaatgtagggcagtatatccatctgcattctgtgcttccaagagcgaacgaattaaacggccatttccatctgaggcagcttctgcaagaagattcctgacaagcaaaggttgtgtcagacagtataggctatacgatgcagcaaacaaaaagttgtcaaagactaacctaacaccagcagcatctccttcacatacaagatgatgcaaagcatttggattgtcctggaccatgtccagaactgaggctggtggcacatccgtaccgttgggcatgcttgcatttgtgaaatcactgcttgagcaagtagtgcattagaatcctctgtatcagcaagtttgcatacttcaaaagaataagttggggaaaataacatgcgccttactgcagttgatattatagtaaatcaggttaactcaaatatatttcactatatgttttatacacttttagctaaatttctacaaaccttagttccatttataaagcattgtagttaactaatgaaaaatcaggtaagaaaattacttttcaggacttgcaggtgggctccttggtatatctagaagatgcctcagaaaagtttttagcatgtcctggaaagatggtcttcttgaaggtttgaactgcaaacagtcaccaatcatcttccagagctccccaggaagtcctacaccgactacccttgaatattgaggcggtggcttcctctcttttacaacagacttacaaatttcctctgcacttagcccagcccatctgcatttcaattagcatctaaccacaccattcgaggagcattaagaaacacaaatgaaataatcaggctacttacggaacagcaccagtacacatttccacaagtgtacatccaaaactccatgcatctgactctggtaatattccatttgcactatcccaaaacagattcattgacttcttcaatggcacccaagcctcaggagctgtataattggggctaagaagtgtagcatccaagccaaccatgttggaatcatcagacactctacgactagtgaggttcttaagaatggccgaaagaccatagtcggaaacaactgcatgcccatttgtatccaaaaggatatttgacggctttatactcatacaaacaatacctgctgcatggagttctgctactccacgagcaatatctgctccatatctgcaaaactcacgctcgggaaaaatataatcagaagatataaagacttgagtaaacaaaagggaaggtcaaacataatcagactgaacaaaagggaaggtcaaacataattagactgatgaaaaaactaaatccttttgatgtgctcaagaataataacaacagtatactaggaaaaatgaggtggcaattcttataatggaaaaataagtaaagaaattggcatgctgacaaaataagttattttttccctatgtatggcatgggctatttcatgcacttagtacagaagcaattcgcgccatgtagctaccagacaaaagagaaatctgagttcagaattttatgagttatgagtcatggacacttgtgattgtatatcacattctattagacaactacagttcacaaagttccaccaaactataacagaaatacaggatgctcagaaattaatttgcatcgttagtttgacaatgtgctgatgaactttgacccacatttgtattggcattcgcatcaaatgctaccagagtgtgttgagacaaagtgcttcttgttagtaaagctaactagcccgattcggccattaacttatgtggcaccaaactcccttcttcaaaaagagtaaaaacatgtatcaaattgtttagatcacaggataatcatttcttattctttttaacccatggactaatggtacagttatttgatatccgttgcagcacacagtgagtgtgctattatagtaagaaactctacatcaggtaaacacaaatgagtggcccacactattccactgcacagaagtattcaacagatctttggaaactaaagtttgagttgagaggaacagaattaatgcagcagtgaacaaccatctttgctccaatccctccattctaacagccatatgagttatatcttttatggagaaatgtccagggtgccaaatattacagatatgaaccagaaagtgttggcatttcattcgtcgccgtcacgaacctcacaatattctaggaattataattttgggaataaacgattgcacattgtatagtacaaattcatagcacatacaagtgatcattttgttcacaaattaaagagaactcaagctccacatgtagaatgattgatgtgtgttaaatcaacaaaccaattgcaaaacaaaactatgttattcactggacactgaacttcctgagcagcctggcttgaattttaatcgtagtacaaagagtgatctttcattcctccaagcactaagtgtgataattgttaataatagacctaagcactatgtcacaacacaacaaaagatgcaggacagatggaataacaaagctgccgacaatcacccaaacattgccgaacacgtacaaatactacaaactcattgagatcaaatttggcactactaatcgcaaaaaccgctttccacgtcagtactcaaactacaacattttccaccttttatgatccttctagctagacatgcagcttagcgaaccaccattgaaaccccatgcatttgaacacatacagttagcggacaaactgtcgtatagcgccccagctcaactgtatttttagggttatcattttcggcgatcgatagtttgatagcagcaactataaccatacatgactgcagcaaatataaccacgcaaataaaacttagtatccatgtttagatgcaatgccacacctgaggatctgctccaacgttaggcgaccgccattctgccgcatttctgtctgcacagaccccgcgtaccgatccatcacgaagcagaggtgcccgccgaccctcacagcaccatggaacgtggtaacattccggcaccacgtcgcggcgcgcctcagccgctccacctcctcctgaacgccctcaagcacatcccccgcggtcacgggcaccctcttcaccgccaccggatgcttacacctcttggccccacctcccccaccaccacgagacagcgtgccggaccacacctcctgccccgcggggcccggcggcccgctcccgatgcggcgggcgagcttgaggtccggatgcgaggcgaggtcgaacgaggcgcagcccgcgggctgcagcgacggcgccgccgcccccgcccccgcccccgcggcggaggatcggcggctgggccggccgaagaagtcgtcgtcgtcgtcgtcggagccgtcggaggaagagccgccggagtcggagtggaggaacgagggcgacgacggggacgacgacagcagcgagaggatggggaagttcttccgcagcgcggagacggagt

SEQ ID NO: 67922 - DNA, 22998 bp, Oryza sativa
ggtttgggaaggaggaatgggattttttgatgggggggttggtgatgatgatgatgatgatgatgatgatgatgcggtgggagcctaggagggacgacaagcaaggctctctcctcttcgctcttgggaggggaggggtgtgcggtggtgtgttggccgtttctactttctgttccggttttgtcgagtgttctcgccttctcggggggattttgggcgatgttggaataagttctcctctttggtttgggatttagtacttgagtcatgttcactttgatgtcattttcaaccttaccaaattttaataaagttatcaaaaaagtggctacatttaatttgctgtcaaattttggtaactatataagaaatcctgtcttgccaaaattttggcaactatattaaaattttggtaatgtcaaaatttagtaaggttttttttggcatcaaagtgaacaggtccttggttagtgtgaatgaataactaaaagcaactttgttatgttctcttttttattttcttttttttggcgagctaacttgccacaccgatcaagaaagggctgagctgacggatagaccggtttggagcttgcttgtcctagatgtgcttccccgcaacgtgcccgtacacgctatatgtagtttcagtgatatgctaacttttttttttaccgatcgtttggtccacggagtgatatgattctctttgttggttagataggtataatggtcaaataggcaagatgttgttttgataattattttttccaatgtatggcctcatcctttgccctacggcttataagctaaagccaaaatttaaattttaaaacttgattttgaatttgattttgattctattttaacatagtttttttcaactttggcttttcaatcggtaagaacaatatataaaacttttactcgcatattatttcttaatcgttaagagcaagcttaatagtatagctaactactagctccaaatcttctatagccaatgtaatagacaattcatacaatagctgcttactacactattaatacttagtcccacctgtcatacacatattacgtcttggagtccgtgttgcagctggctacagatctgtagcccgcttcccttatctctcttcttttatatttttaaaatatgtttatagctagcttatagtctgctattgtacctgctctaataagccgttatggcttataataagactagaccaaccgatggggaccgtagttattgtaagtataggagtaaagccaggtatagtattttcaaacttgagaaaaaaaatgtaaaaaaaacgtactactaaggttgtgttcggttctatgggttgggaacccatctcgcacgcacgtaaaacggagcggtctattagcgcgtgattaattaagtattagtagccttttttcaaaaatggatcaatatgattttttaagcaacttctgtatataaactttttgcaaaaaaaatgcatcatttagcagtttaaaaagcgtgcgcacggaacacgaggaagaggagttgggaacatccggtgccgaacacagcctaagtgtgtgggcgctaccatcaatcgtgaaaattgtctccacctattgtaacgcacagatatttttctagtacaataaaaataaaaatatcttgtttgtggcttagctttaccgtatcttatattcggatgagtaaactataccgactatccttaaacttttatatgcatattagagcccataatctagcttgggctactaggtcattttaaaactagtccatgcacatgcatgttcgataagaaagcatgccaaaatacaccatatgagacgaaaacatgtaactgtaacaatgaagttttatactaggtttactgtagcgatctacaaataaggttgaacagcaaaaacaacaaaatactataaaccggctataaaattaagttctgaaatttaaattgtctactgcttatttaggtttatactacttctgttctcatttacttataattgcttaccacaaaagttatttgcaaatacttgtcactacacggatcccaaagcaaaattttccatttcacctttagaattaataattccattccactcagtcatacttattgtttctagagagtactcaactatattgatgattagatagcaaaaatccgacaaaacccccttatgtgaatttggctggggaggctagtcacgtgtaaacaatatagaaacgaaagaaccgatgagttcattaggatgtatacaagctcggaggtacaataccctattcttattatttgtaggattacccctatctgttatgaggatcttacaagtctattgattactcaaaatagttatgcttcctctcttctggatttcctaagaaccacacaaaatatgataaagtctcttttctctcacttccaaccctcctcgcttgtcctggttctccccatatatcttcaccagggaacacctgatgatcaaagctcgaggaaagatattgtttttctttactaaaggaaatatattgttcgtatcgggatcaaatatggtaagtcttgccaggatctcctctcattgcccaccccgctgcccttgggtatgccttggcggggtccaccatgaacgggatatggtgagaactcaccacgatacctagctcaatccatcgtggcctcgggtagcccgagtagggctcgatacaagtagcgtgtggcggtggcttgccatgcacccctactcaatccatgcaagcatgcgaggaatagggttcttcacacattgttggtcataggggcccacctatcaatgtttggtgaatggcagttaaagggtagggatcccgacggggttatgatagtcaaccactctctcccagttccccacactcgtgtaggcatacatggttaaagtaatgggcgacaattgcaacagttgccgccatgtctttcacgcgccttgctacggggtagacatccgtcttgtcgctaataaatcatatgatgtcatgggcccgagacatctcgggctacgttgtttcatgtctctgttatataaatggccacaggctacctcggggcccttgcgaaaaatattcacgcgctgtaaggttattttttgaaagcatgggcaatcccttgagggccaccctttagcactttgaggtggattcatgtgtcatctttgatcggctatatgtttaagtaattatagtaagggtcaaattatcatcttctataaaagttatgattccctatttttttttctccctagtcaataatagcaaatgaagaaaactagtacttcctccatttcacaatgtaagtcattctagcatttcccagattcattaacattaatataaatgtagaaaatgatagaatgacttacattgtgaaatggagggagcaatacatatgcagtatgatgctgaatatcaattatttgcctttgttagttatactttataagacttgttagtttctactttatgagattattactgttttagttgttttagctggctgattacaagatataagtatcatcaacagaacaatacacgcaaaatccacacgataccctcgtgtcgtgcctaccttggatctaatctaaagcccggatcaaaaccaagccaaaagcctagtgagcccagctcgctcccgttgatccggtgagcgagccctaatacttccagaagctcctcttcttcgccgtgccgaacactcgaatcgcatcgcatcgcaccacaaaccctcccccccgaccagaaagccaagaaagaaacctttcttcgtcggtctctctctctctctgcccatggacttctcggagcaggacgtcgaaatcttcggcgaggactacgacgacgccgaggccgacggcggcggcggcggcggtgcctcgtccggctcctcctccccgtcctcatcctcctcgtcgtccgccgccgggtcctcctcctcctccagcggcgcctccagcagcagcggcgggggcgggggtgggggcgaggacgaggacggggtcgaccagggggacgccagggggtacgacgacgacccgttcgacggcgcgcccgcgagggccgccggtgggtacggtgacgaggagaggggcgagggtgatgcggaggaggaggaggaggaggaggagagggatttgttcggctctgacaacgaggattacgtcaagacccccgcgcgtagcaactacctagtcccaggtccgcctctaatatttgctaaattatcgtgcacattttgggtgacaatgatcagtctctaagcatgtctaatcagtagaattaattagggcatttttacaaaatccaacccagttcttttggttgcgggtaagctgatcgtagggtttaggggattcagtgagcatgtagaaaattgcgggtttcacatgtatgtatgatgaattattcttgttctggactttttaattcttccttccactttcgataggcatatgatacgcacaatgtgtcttataaagtaacagtacatcatggctactgtcttctgcttgcaactcacttttaaatcgcaagagatgttttacaacaccatcaagcataattgttggagagtagccattgaacactgcctaacgataagtgttaggggctattggattagctgatagttacattgcactatgctagtatgttaatctcccgttttgattataggtagactacagttgaataacatctatctgcaaacgaatttgaagtataattgaagtgaactctgcagtagattacagttatgaagaatactgcatctgatctgatttcctctgtagaacaatttttttcacattcttctcaatctgccatctaactagaaacatagaagtttgaactttgaaagatcaaagttgataataaaacatgcataatttattgaaaaccttcaatatatgctaatcatatttgtgataggaagctccctaaaatcaatacgctatttgtgatgatttagtgctggaaggaatggagatcatgctaatgctttatgtgtaacaacttgatatctattgttggcatacattttatcaatctactaggtccattagtgattggtaatgcccatgcttgtggtaaagattgtaactgggttattttactggctatacgcttgatatgttggtgcggggcttggggcagctagcactttaaaatgtttgaattatctaggagggaaggttgagcttcaacactatatttcattccatgccttcccttatagtgctaccctcaatacggaacaccaacaatcattctcggggaggatatggggggcggaatggcagaggtccacctcttcttccaaggccaggaggccatccaggacggcataactttggatatggtgggaggttttcgcatggaaatgggcgtaatgttgaaggttttgtttcagaaatgaagcttaataagagtgaagaaactttatctaggaagtttgttgcttttcaggaggtgagtaatgataccatattcttttgatttttatatattatctctggtatctatgtatccaaatcctttcctattcatgcagccttctgagattgcatgctacagccgtattgagggtggggatgtatattttgatgaccgcagcttggtaagatcacagaattgctcacgatcaatttcactttccctttagttcgccatttccttaaagtctgtctatgtagtattacagaaaagtattgttataaatttgctgctgtactaaacatactgttattttagaggctcttcaaacgtaacatttgcgactatgttggtgaaaatctcaataaaggatttgaatcttttatagagaaaagaggtaattccatcaaaaactcatgttttctgtttttatgttctggagtactccctccgtcccataaaaggcaaaccttgtacgagatgtgacacatcctaggagacatgtccaaattcatagtactaggatgtgtcgcattccgtactaggtttgtcttttatgggacggagggagtagttgatataaagagtactgttaaatgtagaaattgttcttatctctggtattgcaaacttctgtttcaatcatcctggattaacttgtccacatttatagaaagttcatgacagcatggcaccttccactaattttacttggataatttattcttccttaaaaaatggcatgagagaaaatacataactactaattagaggttctaattatttctcatagagccaaaagagaaatgaaataaattattggaactaattaacccagaagttctttttttttttttggaatgagttgaatcctacatgtggatccagataaacagtagttctgttatttggaagttgttctttccttttgaatttattttcattcaaggggactgtttcatgacgaatgtggtttaattgtcaatatcagatttgggttcagaaggatttggtgatcttcttgcatgcataagaaattcaactgtacctcttcagaacatacattttgtggtaaaatgctgctgtcaaccttccgttttctattttagtactctatgcatggcacgctgatcatgtatgatgctcttcttgcagacataccgcaacaatcttaacaaggtatgatccttctagttcgaactatctaaaacaaactctgtcttcccctcatttttgtagcatataccactcgttttgttcaatatgcttgtatgtttatagatcgatataacaactaatattgttaccagatattggccacggcttatctaagagaaccatggaagatgggtgtgcacaaaagaaatggtgttgtatacctggacgtccataagctccccgaaagaccacaaagtgaggttgaacgccggaggtgattctctttctctgaatgcttcattaagttgatgtatatggtgatggtaatactgttagtgatgctcgttaaacgcatttatgttgggtgatagaaaaagttgatatctggtatggtaaatatattaatggccttagtttatactttatacgtgaattgtcctatagagattctactttcacaagaaagataaatggagattctcttttgaaaagtgttcctgtttatccaccatcagttatttatatcacaaggatatcttgtccaattttatttctttatgctgttttaattcactggcaaactgatgtaacaagacatgcgtaactgttagattccctgggaagtttgacacatgagattagctgtatcttcactcttgctctgtgcatgtatcatgttgccttaatgtttatagtcaattaatcatatgctcagtgttgttattatcgttacatgggaagaatctgaaccataatactttttttgtgtgccttgtctttatctctatatttactctcagatgttattggggatattcttttgaaaatcttgcaactgagaattccattgatgaggatggaagaggtattgatgcaaatgtagagttctgtgctgtaataaaaacgaaattgggtgcacatcgtattatcatgggtgctgagatggactgctgtgacgcaactgatgatggtaggcggttctacgtggagttgaaaacaagcagagaggttagcattactttttttttttgtgatttgctttagtttgggtaccacatttatttgaaatactcagtttttgagcctctggcgtgtaacagctggagtaccatacagtggaaaaatttgagaaagagaagttgcttcgattctgggtaaaattttagtcctgctgtatttcttattctccattcaattcaatatcatttgtaacttactgctctgtcctgcagtgtgaaagtttattttgtgttgtggttcattctcttagaactcttttttaatcaatgtctaacgctgctatttgcttttgttaagcactgataaaaaacactcaattgcattgtaaagcaataatgagggtagggatgcgtatctgttggcccatgggtaccctttggctcaatggtggagccagggaattcttagagcctgagtgaatctaactatgttagatatttgttaccaaaaatcaatttaattcctagagtaatataaaaagttagtgtacgtttgagttttgatgatgagagtgggctgccgcccggcgctggccgctgggtggtggctccgccactgctttgggccattcaacccagccattggttgcacttcaattgctagttcatattaggtacaaaatgtaaaccaaatgaattagtgtttagctgatgggtatccatggtcaagtggtcaaccaacttgcatctttaactgagagtagatgataaggtagcaatcttgttatgactctgtctaccatgagtccatgatccacttagctgccttttatttttttcagaaagtatgcatattttaacttctaacattaactttttttctttactaaatattgcagattcaatcatttattgctggtgttccatatgttgttgttggattcaggtagtattcattctttattgttttcccttacgccatccattttttgtagtcaatgtgatgagctttctatcacctgacagctggcatttttgcaatggaaaatgattttcgtgataaaatgtttgctgatacaatttacatgttaaagaagctgtgcaatgttagtattgggccttctgcttggctaggagattgacatgctggttatcacaaatcagtatgccactatggttgtcctctacaaggaacaagagtaatttcatttacacctggtgtcatcaactgtgtacgaagcaagctcatatttgtgatagtcagtcgtttctcatggatgtcctgttgcaataaataattgtgctgcctacccaacttttgtggggctaaaggctgctggtgctattacaataaatattttattatttggtactaaggtatatttttcccggtacgtgtatgctcattttcgagttaattttgtctaaataattacaacacgatttcatcttcgggataccaaatctttgtgtagtaaactagaggttcatggagacatggactatttctggtaatatactgatatgtctccatttattgattgtaataggcataataacttaaacacatacttgattttctagattcttcagttcaatttgtttgactgcatcacatgtacttgataaaatcgtatgcttatttttaatacaatgttctgatttggtgtggtattttgctcaatatttaacctaccccatatgatgcaaaagaaggcttttacttttttaacttcgactttgtcccaattttacattgattccagtggcttgtatttgtaacttgaactagtacccctcagcattttcctactaataaaggagtttcaaccatatattttttttacctgcaggaatgatgctggtgtacttatacggactgagagactaagaaccaaagaaataacacaaaaggtgaaagcgaagaactactggcaggtaatcaagctttcttcctagcaattttaaaggacacatgcctagatagacaactataatttagacctatcagcaggttaaatactggaaatgtgaatcatctgtaactctagactcccaaaggacgtgcttcctttgcaacaatttacctgctatgtaaaatatgtgagattagattgtctaaataagtagttctcaattaatttcctgccacttcaagcataaaagggataagaatacaatgtacttatcttgaaaataacaataatatctgatatccgtatgtacttcagggaggtgtttgcttggccttcgctgatgaggtcttatgctggttgtatggcactgttagagaaagtaagttcatttatcattctgaatatctaactagttgcattttctcaaatttttaaatcacggacttattggcactcataatcatatgatactctctgtacgcctgacattgcttttttccatctcttacagacgaggactacatcctgcaatttgtacatccattcaatcgcttggaacttctacgtgcccagtctccctgtcctgatgccatcactcatcatgtggagcagctctctggtacagcaggctaggttaattcgtacacacaacttcggcaagtaaaagggctgtttgaggtagatccgtgttgaaggattctattctaggggtgctgactcttaaacaaaacttcggcaattatataatggttgagctgacgacttacccagccaagcaacataggccgacgactaaatggtttgctctttgaactgccaaagagattttgaaattgtcaaaaccttgtgtttctccagtaacattaagttataaattagggaaatggagagctatgcggcaatgctactactgggtcatgccaccgaggcaccaatgatgtaactctctaccagataccagtaccaagggaaatgatatgaattctagagagtttctgaactaacatgtggtatatagctttattttgaaatgctataaattgagaatattaaatcgtcaagaagtgagaaacccatctgcaccccagcactccctagagcagagcatgacattttttgggttagggcctgtttgaggagtttatgtcagctgaagctttttccagaaatataagttctcacaaaccaaacagtctagcttctcatatagataaggccttctcatctagataaggtcgtgtttagttgcaaattttatcttcaaactttaaacttttccatcacatcaaaactttcctacacacacaaacttcaaacttttccgtcacatcattctaatttcaaccaaactttcaattttggtgtgaattaaacactttcaattttggtgtgaattaaacacagtcttatgagaagatatgagaagttaatagttaaaatgaacttataagctactacaagcaagctagttattttagcttctttacattttcagaagctgcctactagatgatgcaattgactttttattaaacgtttgaccattcattttatttaaaaaattatggaattataatttatttttttgtgagttgttttatcacttaaaatattttaagcatgatttatatattatataatttcctaaaaattttgaataaggcgaataatcaaacatgtgttcaaaagtcaacaacattatctattttatagagggggtacttatcagctgcgttctataatttatctattaatgggctgtttagttcccaaaacaaaaacttttcatccatcacatcgaatgtttggacacatgtatggagtattaaatgtggaaaaaaaaaccaattacacagtttgcgtgtaaattgcgagacgaatcttttaagcctaattgtgtcatgatttgataatgtggtgctatagtaaacatttgctaatgatggattaattaggtttaataaattcgtctcgtagtttcctagcggaatctgtaatttattttgtaatattactacgtttaatacttcaaatatatgtccatatatccgatgtgtcaactaaacctaaaaattttttctaactaaacaaggtctaaccagtcatttttcagaattttaagaattttaagctctcctaaaaaggttctaaaagccttgtattccagttgcgcgtctgtcgccttggcagggaggcaaatctaacgttcgcttcagttggattttccaagaagtattttgccctatttttgtgttaaggtgccacgaatgcgagatttccaaacgggaaacatcttgattcccacaagattgatagaaaagaaaagtcactgatctacgcatcttgattcccacaagatttaaaagaagaacaagtcgttgatctacagtatatatagtactgcaaatttcacaatttcacgggaaatatttcagatcccaaaaaaatggggaaactcagccatcgatatacgctcttattatgttgtaaacaggagcattgtgttcaaaccgctcgataattcaaccatgttttttttaaaaaaaatctactaataatttatttaaaatttaccagttttcatggatgacttaagggttattgcggttattgataaaaccatgaatatgttcatcgtaatctttaacttgttatagttttgattgaggggttgttagaagattaatggtttgcataggatatatggttgtttggttagtgtctaagtttaccacgattaaccttaggccaaacgtggtacggcgaaaaaataatacacccatgaaatagttggtcataagtgtgacaatgttttgccaaaacaaaataagtgaataacttgcgatgggggagaagctaggatttggagattagggggacaaccacaaggaatgttcgtgtggtttataatccattttaggccctctttgtttaggcttaggcttattgggttagacttttaagtcagcttgttggcttatatgatttataagccagtgaatttaatgtcctaagtttagtggtggagtcatacatctatctcatataagccaaaaaagcttctccaacctagcttttggcttaatagtgtaagagtggcttatggttttaaaaaagccaaatgaaaaagctgcttgtttgtttaggcttagactttttgacttataagcctaaacaaataggaccttaatgcgatgcactattcatactctgcattgatacctctaaagcagaggatctgaattcaatggtaatggcttctgatgatcgctatatattgaagggtatttaaacacacggttagtgcggtaatcttacggtatacctagctgatttcaacggtaatggcttctgatgatcgctataactgtgcggttttcacgataaccgccaaaccgtgggtgacgataaccacaccctagatcacatcagatttcttacagttataaattctactacctccattcccaaatataccagattttagttagatgtaatatattataatacaacgaatctggagagaagcatccaaccaaaatctcttatctgtgcgtttagttcacactaaaattagaagtttggttgaaattaaaacgatgtgacagaaaagttgaaagtttgtgtgtatgaaagttttgatgtgatgtaaaagttggaactttgaagaaaaagtttgtaactaaacacggacatatatatatatatatatatatatatatatatatatatatatatatagggacagtactaaattatatcgggaacccttgtcgcaaattgcagtgctagctgcactaggagtacaaatccctagtacagcgtagtactccagtcgccggctcgccgcacaccatcgcccatcagaccctgccgccgcggtctcttctcgaggcctcccgttccctcttcccggcgagctagcgcaccgcgcgggagagaaaggagagcaaaaaggatgggcggcggcgagtgcaggagcaacgactacggcgccgccgcctactgggacgcccgctactcctccccttccccctcctccaccgccaccaccggcggcggcggcggcgcgttcttcgactggtaccaggcgtacccggcgctgcggccgctgctccgcgcccgcctccccgcctcctcccgggtcctcatgctcgggtgcggcaactcccgtacgcctctactacctcttttacctgcgtgccttcactcacactagcttgaaactatctgcgtactcaaattcaacgatttcggcgctaattcgtcgcgcgcgccacatatttctgggaatgcactggagtagtagattaccctgttgcattgttatactaattatacggtcacacctatccgttgcatgatgcagtttgatcttattttggcagttttgtcggaggacatggtgaaggatgggtacgaggaggtagtaaacgtggacatttcatccgtagtcattgagcagatgagggagaaacacgttgatattccacagcttacatgtagtgttttcattgataatttcaaactcatagtttgtgaattatggtttctatgcaaggtctatttacttggtgtcttgtgttttaagatttccagatggatgttagggacatgagtttgtttggtgatggaacattcgattgtgtccttgataaaggtaccttaagaattttatttaccgaagcttgctaatgctcttgtggaatacttttttatggaatttactgaataaattcatttatggtatttgtttatttttcaccactacacttaccttgttatgacggaattatggaaatttctgaaggtacattggacgctatgatggtaagctttacttgttgcacaaacaacattttagctttctgatcaggcatgaaatgaaaaatcatctgaccattattgttgttgcatttgatcttactattttagtgtggcgatgatgctcctcttggtgcttccaaaatgctagcagaagtggcaaggtgtctggcatgaaagtttatccttttcactcttttcaaactagttggttcccaatgattcagtatgtttcatgttgaactatttttccccttgcaggattcttaggcctggtgggatctacatgttggtacatcctctaaatctaaacaatacagtgtgtaatcattttgcgtgggatgatcttatggagcgatgatgttcttttgcagataacatatggttgtcctaaggaacgagtgcaacttttgtaccaatctggaagccacaaaaaaattgaactgtacattatgcgtaagtatttttcttatgctatttcttgattcatggagctggacataatttgaaattccagaaggaaacactgaataatggggagattcaggtttgactgattccaaagggaaacattggttccaaagattggttgattctaatgggaaatcttaaaactttgatttgacgctatgcttttaatttctcagttggaccctgataaaatttactgttatcattttgcagccacacctggataccagttgaaatggagcaaaggtgtttcacttgcacaacctatcatggaggaagtttcattgacagtggatggtcaattaccacctgactatgttcttaaagatccagagtcacattttatttatatttgcaaaaagccagatgccgctaatgaagctaattctgtggttgctaatgaaggggaaaccataacttcaaaatgatcttttgtatccttaatttgcattttgttttgggttgctgacgagccttggatagtatgtgctcataataaattttgtcagatgttactgttggatgaaaatcacgaccctctttagccgcctggggccccaaaggttgccaatctgtgctcgatatttcttctcggaacttggaagatgtgacacaaaattcatatgtatttcaatatgctttggaaggggccagctgagttgtgttaagtttgtttaaaacgactgagttcctctttatatcgacacccataacatcagagtgattttgatgtgatcttgttattctgagatggatcatggaacactgcatgtctgtatgcagtgtatatggaatgatattatggctgtgtttagattggcccaaagtttgcaatttggttgaaattggagacgatgtgactgaaaagttgtgtgtgtatgaaaggtttgatgtgatggaaacttggaagtttggaaaaaaactttgaaactaaacataccctatgcaaactgaactccctgggcgattagacattcccgactaatgctcggttaatccccgataggaaggaatcagaagggattgagaatttgagatccttctcaatacctctcaattctccactagttacggaaaacgagagctcatcatggtatacatttgaaggggagcgagtgctttcaaaagtactttaaagagaatcgattttgaacttaaattttgttacaagatgaaaggagcatagtactagtatgtgagatcctggtttttctgaaggaggtccagtgcacgcatccggtatttccctttccaaaaggcccaatgctgtaccgtcgaactcgaacggtcgggaaaaaaaaaagaaacagaagaaggccgaaataaataaagaggatgaaaagaaaaataaaataaaggaaaaaaaaaagcgcacacaaggacctcccctgtgccaagcggccgcgcatcgcagccgagacgagccgccccccgcaccgcactctccgccgccggcgccgcgccgacctcctccgccgcgccgcctccccggcgcgcgcccccgtcaccctctctcgcctcgccgccgccgccgctgcctcctcgtgaggggggacggtggtgggggcctctgccctatggcgagcggcgacggcggcgacgacgcgggcgtgaagcgcgtggcggaccgctacctgaagcgcgaggtcctgggagagggaacctacggcgtcgtcttcaaggccgtcgacaccaaggtccatctcatcccatcccatcaccccccccccccccccacttctcccgctcctaaaaccctcaccggtgcacatcgtcgcgcgcgccggggggcgcgctgatctgccgccgcctcgagaaatttagtcgccggccggctagttcgggccctccggctcgatccgaccgcccggtggagaggcgggtggtcgggtgatttgagcttcaagggttttgttcccggattgtgaaattgcgtcagtgaacggatggctagagctgttctttctgcaggggcagtctaggttggccacccatgagccgtggttgagcccatgaatgcaattcacctggttttgttcactgccgtgtggattgaactggaggtgttgacactgtgagggtgtttgagctgtggttattgttttgccatctcttcttaagcaaatcgcagtttatccactctgatgggaggggatctgtgggatagcagggtttgttgtgtcgtggactcatgtatctttgtattatgataggctatatggtgccagcctttcactctacagattttgggtgtgctcctagtgcttttaagttttaagtttattacatcagctgtttggaatgtattgtcgtggaattttgcttcttgcttttgttaacttttattgatatcatgaatgttcttcactttgtttgagttaatgttagggttattgaacttttacatgttccttgttttcagactgggaatacagtcgcaataaagaaaatccggctagggaagtacaaggaaggtgtcaatttcactgcattgagggaaattaaacttcttaaggagctgaaagattctaatattatagagctgattgatgctttcccttacaagggaaacttacatcttgtatttgagttcatggagactgatttggaagctgtcatacgagataggaacattgtattatctccagctgatacaaaatcttatattcagatgatgttaaaaggtttagccttctgccataagaaatgggtgctacacaggtatccactaataatcttgctaaatttcttttagagagagtatcctttgacaatctgtgctgtagggatatgaaaccaaataatttactcattggcgctgatgggcagcttaagcttgctgactttggtctggcgcgcatatttgggagtccagagcggaacttcactcatcaggttcttttttgtggaattatatttattagaatttaattctctgtataatctagtcgattgtatacttggaacttgagaatcttgttgctgaaacaaatatgcaatgaacatttcttcaagtgtattgatgtttcttttgtatttttttaactcggtcgatattgctgtttgatgcttcgttgttctgtttatcaaaaagaacatccttgtggatattttgcgcccttatgctttacccttttttcaacaacagtaggcacctaggaagtagaaaagcttaaatctttatggatggaacaaaatgcatgtggggaagttcttatgttatttcctggacatttgagttggcagagttggattttgaataaatgtcacaggatactgatttcggaagtatgtgtccttgaataaccattttcttggtaaatattaatagtgttggaatgactgtttcattctgaattatttgtgctgattttcattcaccatcatatctggaggttctcttaaaccatctttttatcagttatgttgacgatagtcaaggatcaatgctacacttattacagcaatgctgtgtgctttgcttaaatgagtgttttttattttttattagtttcactttgaatcatattatcctgatgctgctgggcacttcagttttgaattttttttctcaacatataggtctttgcacgatggtaccgagcaccagaattattatttggcaccaagcagtatggatctgcagttgatatttgggctgctggttgtatttttgctgaactgctgcttaggcgaccgtttctccaggtttaaccgactcttataattttatgctctgtgtaatttcaatctatttataactaagcactttttatgctctgagaatgttgcatggctaagtttgctgttcctatatgttgtgataactgcatgcgtaaatgtgttacctcaaaatgttgtttccaaagccagattggacttgtagttttcaactgaggaaactggaaatggtcaggctctggtgaggtgattgaactgaacctgtaaatgatttaaactttgggtttaaatttgacaaagtgtttcaatggtaacagtaaaaaaattcctctgtggatttgaacctttgtctgtagattctggaatagaagaagctagttcctctgtgcatgtagttgatattagatttatttaatgagcacgttataatagtctagcactggtaggttcacgcaaattaagcctcgctctagttttagacttcaatataacaaaattatgtatgttatgtggggctgcatgtgcagccgcctgtgcatgacagttgccatgctcttcacaaccaacacaccaactatgttggctcctccacaagtttagtagctagatcatttccactgctagtttgtttgtttccgtaggattaaattatttaagggcttgcctgagaatatgatgcaagctgaaagttgtcccacgatctctctcctaacgccatggtgttgggcgacaaggtgtcacgcccttgtcctcttgccatccatcagcacaggtattatctgactgactcccaagaatcccctgaaccatgtgacaatgtacaccttcacaataatgttatttagagaaccagttagatcagtgaacagacgagtcatagtattggctgggtcgatgcctgcaaacgaccagttttcatgcttgaggtcattgtttactatatgtgaaatctgccattagttgtttacgagtagttttgggtaaggaagctacccctagaaatctgtgcatggggagaaaagggttggactttctagattcactagggtattgtttgtttctttccttttctatgttttttggaaggtagattttgtggcatgtgctcttaggccttactttcaagtgatagatctgattattctcttcaaaactattttaggtagaaaaatgttattcctttctccagtcttatgggatataggcacttgttactaagttcacgggtttgtgcttgattttaagcttattgcctgagatttggttaccctggctacttgttctggccatacatattttggccaaagaagggttttcaggttatcacaactataatgttctgattactggtggggttcttttagcattgaaaattaaaactgcaattccttgttattgttttacttgaattttttgaacatggtgtttttttttttggattagacgcacggagaaaacattaatgcacatgggaggctagataacatgaataaaatatggacttgtggtcttgtgctaaatgtgcataattctttttcactcaactgaaagccttcttaggccagttgtagaggtttaatttgttgcttctggtcttgctgcaggtcctcttgagtttcctgattttttatcttgtgtattctccagaaatgtggaatcatggagttgaatattcttgtgttgatttattttttattggttttttttattataaatttgttttctttatctatacttacaagtcaagttcttagatgcagtagaggtgttaattccattttaaggaattttagatgctcatctaaatttttcatcatgtatgaaaggcttttcatgtcactatccgtggttttctttgtgagaggcagcaattggttgaaaatattttgatctatatctaactatggttctctatttgattttcaatagacaagttgtttgctttctaggatcagatctgtctgcagctctaagtaaatgctctactgtcacaacttcttcatttcttacaaatcaagtgatttgtaaactttgggtttataacctcttaagagagcattgctgcatatgtattttgtaagcgttgtttcatcagtatgcctgatctttttgcatgtgtgctgataagagaaggttggaaaatgtgatatgatatttaacagtgggcagcaattttttcatttggtagctataccttaaaagctttaatgggcacccaagtcactaaatgttaatgttgcagggttctagtgacattgatcaacttgggaagatctttgctgcatttggaactccaaagtcttctcaatggccggacatggtttatcttccagattatgttgaataccaatttgtctctgcacctccacttcgctcattgtttccaatggccagtgatgatgcattggatcttctatcaagaatgtttacatatgatccaaaagcaagaattacagctcagcaggctctagaacaccggtatgcctttgttactgatcaatagaacatctgctatctatctctgttattagtacatgccatataaaaccatgtttatctttcctattaaggtactttttatcagtaccagcgccaacaaaaccatcacagcttccaaggccaccacctaagggtgattcagggaataacaagataccagacttgaacctgcaggacggccctgttgttctgtccccgccaagaaagttgcgcagggtgactgcccatgaagggatggaagtccatatgcatcgggcggatagaacagaagagcatccttcaggggcaaggcacatggatgacatgtccagccagagtttagaataccaatgtcagttgatgttggagctattttgggacacgacctgctcctagaccaacgttaaacaggtaaacgacacaaaccttgacgaatggaaatttggaactcatgtccttgtctaaatgaccaatgaacctaataatggaataaatgatgcatttaggattgggtgtgctcagctcgcccattctgtggaataattgaacatatttatttccattttgcagtgccgacaagtctcgtttaaaacggaaacttgatatggatccagaatttggatacacagagtaaatcaccattttttccatactggcttgttgatttttaaaatattctttggggagatagttccactatctaccaacaaaagaggattgtgtcgaaagccataaaaacttcactgaagggcgctgacaggatggcacagccaactatgctgttatcgtttttgactaccaaagccggctcaggaagaggaaactgaagagttacgtgttacgatgctaatttacaccaggacgtgcacatgccatttcattttggctggcatacataaatctgtaatctttattgcatagatgagtttgcttgtgtgagcatgtttcttccagtgttcgcaaagattattatgaagtttatgtctcaagttctttctggtgtcaattttcgttcacttcttgtatggacattgaattttgattgttgtttagtcggtcatcttattcttaggtacagtaattcttgtaaccaggagcggcttatattacctgagtattctgacacgtcttcctgcaatacgctgtaacaatgcatgagtgaaaaaaaaaagagaaaaataagagcaacttcttttgttcttacgatgaattattatgtgattacgatatctacggctttctaatgtgaacattttattatcctttctttagatgtcttctatactgaaatttctgtgatttatatttgtggaatgggtaaatggaatgaaaatgtttctttcggacttctggcttcaggtttgcaaattagcgcaacttctgtgaaggctcagcatttctgccgtgtagtgaaccgggtgtacaagaattgtttcattctcttttttttttcttcgaaaaacagtaaagatgctcatatacacgtgtggtagcttcaatttgcaattgattaaaaacattacatgttgggtgttcaacgcgaggatcaaaattcaaaattcattgaaccttatagagttgtttttaaatctgaaatatattagcgttaatcggcttgttacctcccaacatcaaccatgtttagacaagcattaatgttactcgggcgtcggaagtgatggcacaaacaaaatagaaatgacggtccataggacatgggtttcgaggcatctcatatgaaaagtccatacgctagaggacaagttgccatgtgaaatggacacttttgctaactttataactgctgtaataaataatgtgtgcagtatatgcatgtgaacttgtgatagtaaatggacctgactaaatggcgtgacatgtggcttgtacttgaatccatattactttatttatctattatatagaatgtggcatgtactcgaatccatataatatcgtacaatattggttatttatggtattccatgcgtatactatgttaaattactgtaataaaaatattttctaattttac

SEQ ID NO: 67923 - DNA, 3918 bp, Oryza sativa
aatgcggcagtattagcgattgtggaaccaacatagagagtcgtatgatatgataagggcaccatggtgtgaagagtggcaccgaggctgacccaaggcgtgaagcgagggtggaaatgaaggagaaaccgtacctggcgcgcggagctagggttagggtttgcgggcgagaagacggggcaggggcggagcgggtggaggtgcgatcgaggggagaaggcagggaggcgaagggatgagtgggcggcggaggagggcggggaggtgggcggtggaggggggcgggggtcgccggaggaagaggaggcgggaaggagagctgcgtgcctgtatgtatgtatagcgcgaaccaacaagaggagaagagaagagaggcgaggcgagaggaggggggagaggagagggcggccggccggcctgtgtctcgctcgactcggttcgggtcgggtcggactcacactcaggacattttggcagggctccagctcccagattcaacttatttggagctgaagtccaaccaaacggttcagatctgttcaaatctggagcggagcgcatggaatcgctaactggtgggttggagcggcattttggtcgctccttaactccaactccaaccgcgttatagaattgcccacatattttcgatgaaattacccgcaaatgccatcgccctacccctcatccctctctcccgtaccgcttcaccccgtcttccccaacctccatctcgcgggagcgaggaggcgaagcagcagacggcgcacggtggaggaggaagcagccggcggcaacgacgcaccggctggaaatagccggcgcatgggcttcccctttcagtgtcgctcccctccttcccatcccggcgcacagcggttgagggcgagcatggcggcgcatggcggttaatggggaccacaggggcgcacggtggctgagggcaagcacggtagcacaaggtggatggagacggcgcaagacgaccccaaatggcggcacggtattttctcccaaaccctaaaaatttccctcacctcttcccttcagatttggttgagtagttgttatcatgtaatgagcaaatggggaagtttcagatctgaagacttgtctagtgatgaatggtaaaaatgcaatgagcgattgggatgtgtgaaatttcagagcagtgatgaactatctagtaacttttttttgtttagtgttgtaccttgtgtttacaattatatacacacttggttggaattgagcatatcagcaaatggttatatacacacttggtttagaattctttagtataaaacctggcagtggaaagaatgtccttttatgggaggataattggattgggggcatacccctggctgagcaattgggagaaaaagaatagggaggaagctatgactttcaattctgtgatagatttgaagctatacaatatctttttatatattgtccttaattgattcatggggtgttttgcagacctcgacggaaagacaagtcacaagtgagattttcaaatcaagatttggttagagggcacctctacaaaggattcaagattgaactgccagaagtccctttttttttgccgtcatcactgttgtccttgctttcacttgttagtttttcaaatatgtgataccgagatgtttcgcaaaggttctgttggatgtaaagtagcagcacaaaacttcagtgggttatgagatgtcggtatgactgagagactaaaactattgttggtttttttgcttggagctgacctggactcttgcttgcaagcaaggccttgaacttattcatggatggatgcattttaccttgtatacggagcacggcaacagcggcggggtcggagcacggcaacgacagtggtgtgcaaggtttccagatctgtgtggaaggtatctgcatggcaacgatgggttatagcatttcattttgcaggttagcagctggtgaactgcaatctatcaagatttcacgcctgccttcagttttatctgttagctaatgacagctagtgcacctttgtgttttttctgctctgtgtattctgctggtttgtgaatagattactatgaatctcttggaaagtcattgaaaattgtctggacctttattaaaaattgtttgaacctttatcaaaaattgttgtaaattcggttcatcaatcatgttttccaagtgattatctgtgttgtgattctgcatgtagcagctgcacaaattgtgatttggtttgatatcttgcaagagagaggccaatactttcaggatgggataacacaaagcattcatgatgatctagctggtcatactgcacgatgatagaccatattatatgttattttgtggtcttttgctctatcttttgatgataatgatgctacaagttgttaaacatttatattactaaggaaaaatagcatattaatccttcatgaagtaaacgacaagaattacaagggtagtattgtccatctcctccctatcctctctttcagaaatttaggagctgaccaaatgagccaaacacttttacatcatctctagctcctacaagagctagctccagctggagttagagtttggagttaggatctgagagttggagctctaccaaacaggccctcactcttgtgactctgctcctccgtccaatcggatcgatcgcctctcgtttctgccccccaatacgaccatcagtattgggccgaaacggtattcgcttggatcgaaagagtccactttcggtcctcaccaactatgactcgggttttattaattttctgaaatcgggtacagagtatccctcactatcaaaaccctctacagtttatcctacatggcacgttgacttactctttgtccgacataacatttacgtatcagtgaaaaaatataatgggacccacatgttaacggtaactatactacaaatatttaacctacatatcagtcatattgaggggaaaaatcatctctctccctatctatctccatccaagcgagaggaattatatgcatgggaggtagaggtggatctgactatagtgatggtgggcggagacgctcgtcatcgaggttgatgaggtggtgggccctgcggagatcctggttgataaggccaatagcaatgcaagctacgccaaggatgtctctagcccaattgaaaataagaaaccggtcagaggtccccgacgccacagtgcaagtgacctttttgcattggggtgaggtgatgacgagacggagacacgaccccacagtgcaagcgcgactgctttgcaggctgcgcgtggactcgtgacggcgaaagcacttgttgctctgtgtgggggcgagatgctatgtaggggcacacagaaactcgccatgtaggcattcatctgagctggccacacgaagaaattcgccacacaagcgcaccgtgaaaggactaatgtgctcaacgtagatgaagtggttgatgcagtagggggatgacaatggcgcctaactgctggaagccgtattggcgctataagacaatcaatcttatattgaaactaatttagaaagcatatttttaatagtcttacgatttaatgtgcaccatttctttcgctattaaattaagccttccagaatcggaattctaaaagtataataaaatcttattcgttaaaaccaaatatgtatgatcagagagagggagtaattgagaaagacttgattctcatcagattgaacaacgatttcggggaatttaactatttgccacttttagattgggcaattatccaaatgccccttttaagtttgcactttttttttgcccctctttatgagatgtcatcttaactatttgccgcttttgcccacgtggcatgtcaacatggcaaggaggggagaaaccgatgtggg

SEQ ID NO: 67924 - DNA, 10395 bp, Oryza sativa
tacagtaactcatcaattgaggtcatcttattctagtgcaaaatctacacatcatgcaagtgaaacacatgcttatgaggcaagggttgaggatggtcaattggataaaggttttacctctatccatgtagatgaactagataacagtggcatcagtccagtgtgtgctgtagaatctggaacagtgtgcacaaatttggtggatccacattgtgaagaatccatagatatgactcataatcatgcagatggaaaaagtaatcaagttgatatgaaaaatgttgacgagcctcaagatctggacactagtagactttctaacaagggtatcaaggaaagtgttcagttggaaggtttcatcggttctacttctgttaaggaaaattccaatcatgtacaacctgaagtaagcaccactgttcctgttaaagatgaatcagaagcttttgacagtgcaatagttgcacagaaagatattgtctgttcgtctcctgtccacagtatgaataaagaggaaagtccaggttcaaagggaagaaacagttgtcttgggaattctaactctatccatccaattgttgtacgccctgtcttgcctaaaaattctctacctgaaaaatacagctctgatatggaaactgaaattaaaacatctggagagaaatctggaccaaatggcacaaaaggaacatgaagattctatccttaaaaaggctcatcttatagaggtatgctggtttatgtatttttctactatgatgttaatcttgttctgaaaagaaaggaaattgtgtttaataggtgaatcttaagagggctggtgaacgatctctctataatatgtctctagagaagaggacaaggggtcactgggattttgtccttgaggagatggcttgcatggcaaatgatttcatgcaggtattttctgaattggtctctgattttgtttttccttgtgctattcttagctaaagttcatccttgccaaaattcttgcgccattcttttaagagttgcttacataaactgtatactgtttgtttgtttgtatttaataggagcgcttgtggaaaaatatggctgcagctcgggtatgccattgggttgtgtctaaaggaagggcaaaatttgaggaagcaatcattcagagaaagcagaaagctgttacaagaagccttgtaaaaggtatcatgagtttttggcgttcagcagaggctttgcgaactattggtaggacagctgttattcaagaacacaactcagatatgctggatacgacaaatcatactggtttgaaagctgaaaaatctgaggtaaacaaattgtttcacataaccttttctgaagggtgatagtgtatttgtgctcatgacatcacatgtgttcacattttagtgccatatattgaaggatgttgggtacttagatgttacaaaaaaaaaatcaggagttgagtacactagtcttatctttgccattttacctgctaaaatcatgttttggcagtttaattggtatatactttgttatagcaagggcagatgattatgctgttgtctgtgaggttgacacaatcttggatttgaacagggtaacaaatcctcggaagcagaagagcctaactatcctcgccaatctcgaattcaggattatgcagttaaatttcttgaatataacagtcagacatctggttctcttgtgttggctgaagcaccaccaactcctgacaggctaaatgactttggtaccttgaaagtgtctgatctttcagaagtaaactactgtaactttgtgcagtctttttatgattgattttttttcatcacttttacttcaagatatctcgtactaacgccctgataaacactcaatagacacacttacctttgttttgacaactagaaacatgcatgaatagtgttcaacagcggttgtttctgatccttttgttgaatttcagggaagtctcttttatacagtagcacctagtgcaatgaaggtatacagggagtctgtggaatctctttctgtgcatcataaggtgaagagagttttttctaatgaacatattatgcatattatatttctggtatgcagatagtgtgttaaaatgctggatcacaagatagactggcattatatgtgtaaacaaacagaaatgataaggtcgcctgtattttcacataggactcataagaatattgttggcaatagaagtttgaaatgttcccactgctgtattaaaatatttctgggctgctggcatatgctgcatttaattatcctgttgcttttgttctgtttggatgtactgtactgcatgaacgccaaaaggaacatatgccattttatttgctttttttgccatttctttcatcattactggcgcactttgctttttccatgttcacagtgttggcactttctgttgtcaaatactatattgatagtgttggtaattgcaaaagactggttacattggtctcaaggatgactatgaggcatctgggtgtgactttgctgcaggtgatacttacctgtgccctatgttattaattcctattattatgtctttactcctcctaatgctttacattttgttctcagatttgcctcaggagaatgcttatgaggatgaaggggagacatgcacttatttaccggaagcatatgatggtggtttgttatcacagatgggccataggaaacaactagggcagcagaggattaacggtgcaagatcatatggaataagtactcatgtgccttttgaaccatatttggaaagcaaattatggaatggaaaaaggccttcatctttccttgcagttcctacgaaacgcatccgtacagctgctagacaacgaatcgtaagcccataccctgctggcattggtggaaccacccaagtcacaagtaaaactgatgtttcaagtggggacacaagctcctaccaagatgatcaaagttcgttgcatggggggtccttgccatggaaaaatacagacttcgaatcaacagttgattttgacagacaattgccatatgatggtagggaagtggtcactaaagctaacaagaagaaaaagcttaagaacccaggatataagacttctcaaaatgcagccaattcctgtgccttggcttctgcaaaggttaattctttaagcatgctttcaattattgttgttttcaatgtttgtccaagtaaatttattctcctattgcttcagggccgtatatgtgatcaacgatcccaagctgatttctttactcagtatgaccaggtttttttttctctttgttttcattttcaggttcatttaatgatgctatttagattattttgcaattttaatttgattttaataccatttatgaacattctattcagaaggactttctgaagaagaaatcagactctgaacaatttgattcaaaatggaacattggtaccttcaccccctctaattattgtgcttgtaccctgtgtcatacagcaatcgaactatttgctctatattttatttgagagaaaacattaagtagctcttaacatctcatgtattgatttttattcgtagcttcccatggtggtcaacatgctttgaagaagcttaaattgatgaggcaagggatagatatttcacaggaagcttctcctgttgcatcacagatgagtaacatggcaaattctgctaaaattataaagataatcaccaatagggatcgtgggagaaaaggcaaagcactgaaggtactatgatttctctaactactaccatgcacctttctctttatttgcataagcatcatagttttgtcagtggtcgaagatgggacctttgatctgctgtgttgcacatttttctgctctgtatacctataatcaagttagaaattaagatgattcttttgtcatgtcatgttcctctttccgtgagcaatagaccagtaagctaatttcacctagggcctgtgttgctggttggtcaagatagagagacagactcagctcaggtcaagcaagcaggtggaagtagtaaggttatagttatttcagttgtatggctggaatacagtgaataatgttgaaaagggttgctgatatccaaggaaaagctgtccataagtccagaaccttctcatttctcatccatgatctaaaagactactatctgtagtcacaaatgcatgtcgttttggacattggttcactattcagaatacaaactgtccccaccaatatggcaatattttctgcagaatatttataaccactgatctaattaaagtttggctgcacatatgttgttcttatggtcttgctttgttcctttccatttggtccttttcagtcagttgttttgctactgaatcttaacatgataaacatttcccttttaagttgagctgtcataaatcataatcatgaacatacaagcataatgttgtggacaacacatgctgtacaaacaggatatctttcctacaatttgcttattgaagttctatgcttttggtagatggcttccagcggtggatggtcaaacttcgaggatcaggtttgcatgtgcacatattttttatgcttttggtagatggctttgattgattatgtgttctttaatacgatttgtggtaatgacttaaatatcataaatttcaggctcttgttgtccttgtccacgacttgggtcaaaactgggaattagtaagcgacgcaattaatagcattgagcaattcaaggtaatttaaaatctgggatagcaactttttctatgtttgtatattcttcaaacatgtcctgcaagctctgattttatttccgttcttggttctaggcattttattttagtggtagatgccattaggagtaagttttgggttctgttgtaaactctagttgcagtgaaaaaaaatacattttatcataatctcatgggctgctgttagtgatctttccctgattaacttgagttttgcataccttgtcatgcagtctgtatataggcaacctaaagggtgcaaggagcgttataaggttctcgtggataaaaattctggtgatggtgccgatagtgcagaggactctggttcatctcaacactatcattttacgttgccaggcattccaaaggcatgttataactactcttttgatttatatatttaattgcttgccacatatgcgggtacatctcacaaaaatgtgatgttggacctatttactgtctgatactttctttctgaattcaggtgttgctttcatcagcaatattgctataagtgaagacatgttgagcatttcactgagttcctaacatgttttattcatatgaacatcagggaagtgctaggcagttattccaacgacttcaaggaccaatagaggaagaaaatctcaaggcacattttgaaaaaatgattctactcatgcggcaactgcacgccagacgtagaaaggttcatgtctctccttatgattattctggtcgctttaatttgttggtggtttataatgtataatcatgcaacttattttgttacatttataacagaggttaggtaactcttgcttttttttttgtcttgcaagaattttaggttgtaatggtgaaaccaagtattcattttctagtcttgaacttgtattagttctatacctgtgcttgtctatgtacctctttatttcaatttatgcatgtacctatgctatatttgataatatgatgtggtagcaaactcttccgttgaactatctcacttccatctgtctcaatcatctttctgaactagtaatgctgaactgataatgtattattcacattatgccagagtgctttttttactacccttcttgttgttactgggaagtatttcttatggtatgttttttcttgtgtcttgtctatagggtaatagccaggaactcaagtcgatcatacagccacatagttctcatgttgccgctctaacacaagcatgcccaaataacttatccggaggcgctttgacgtatgtaatgcttttgaatgttctttttgatatttagtttaatatttttttggtgaaaatactaagatatttcatcttcctatatgttctctagttattattattattttatggccctaacagcatccagtggtcaccttcatgttgatgtgtaatgtgtaacaggccacttgatctttgcgacgctgtaagttcaaacctagatgcaagtacgcctggtagtggttaccagagttcttatacaattgggttaacaccaccaaaccatcatggttccaatggccctacaactcccaattcaactctgaattccaggttatcagggtcacctggtacggttctgagcaacaattttttgccgccttcaacatttagtgcctcttcaaggtaaattcttaattcttcgtagcaggtattaagaagaacgcatgacaaaattcatttaaaaagttctcgtctgtgcaatttcttctatagggatgctcagaaatatggtgttcctagatgtacctctttacaaagtgatgagcaacagaagattcactataaccagattcttagtggtagaaatcttcagcagactggaggttctgttccaggagcatttcctcctggggttgatcgtggtgcacgtgtgatgcctggtacccatggtatgggcatggtgtcaggactaaatcgaggtatgcctgctgcaactgtaggctttcctaggcatagttcccctggaaagccaaatgtggtttcacctggaaatgtattagccaacagtgggcaaggagcgccaaacgcagtaaatgtccatcctggagccatgtctgcccctggaaatccaaccttacggccacataatcctatgcaggcgcttcatgtgagttaaccttttatttattatctagttaaatcttggtgctcacacagagtcagacttgagttaactgcatgttttaacttttaagctcttctccattggttatcatctctcctataaagaaaagaatgggagatttttactggtgtctttgcttgtctttccagttgcaccctccaagcaatccatgcattatttgttattgcataagtgatgccagcatacttatgtcttatataaacaaattcatgagtactgctcccacttagttgctttctatattttttattgaaccaatgttgccagcaaacttatgtaaatgagaagttgcctttatcgaaggatatcagaggcttgtgtaggatgctatgcagcttctctagtgatttgctgctcgaattttttgctgtgtcacattttctttgttttctatggacggattttatatgcttagatgtcatttgccagttaactgattacgcaaatttcaatgttccttcaggacagttaactgattggacatccacatgtttgttccttgggaaattagaaaaatatgaaatttatttttatctgaccaatctaaatagttctgtgtaactgaagcttaaaaagtttgactcaacacattctaaagcttagttgctttagactcggagggattacatttacatctgttatttatgtgacttgaattttatgaaggttaaagtacctcactgaatttataaactgttaaaaactagggatagctaatttatatttcctttcctttagcctggtcaaaatatggaagagcataggcagattgtgatgccagagttctgcatgcaggtttcacagggaaatactcaagccatcagcagcatgaatcattcactctccaatgcggcatcttcttcacctgttcagtcttttcctattcagcaacatcaacagaaacatcaaatttcaccgccatcacacatgtttggaaatccgcagcatcctcagatccaagggatgagccattcgaatccacagcagcaaacatatgctatgcgcttggctaaagaaaggaacatccaacaacgtatggtgcctcagcaacagaatgatcttcctggagcaagtgcagtacccagtgtacagaatggttcgcatggtcagcagcagaagcaatcacctgcagccttgtcagccccatcttcacaaccacagcatcagcggcagcaagctgcacaaaatccaccagatagctgtgcacatcccaatcaaccaaccaatgctacacaacataagccaaagaagagtcaacagcagcctagacagaatcagcaacaaaggaatcaaggtagtcaacaggctaagcttatgaagagcttaggacgagggaacatgctgatacctcagactacagttgacaccactccaaccaatgctgtttctgcgtcttccaaaaagcaaattactgagaacaaactgattcaacatggccaaggaactttacccggaaataaagcatcaaatccgtcaatccctcatcctggaaatcaacataaactatacagttctccattgcctcaatcaccaaaacagttgccagatattggtaaccaaggcgtattgcagggttctcctagtcaggccctcttaacttcacaacagcttccactccatcctaaatcttcactgaccacacaacagcaacaacagcatgtccattcatcgcagaatagcatccaaagaatgatgatgcaccaaaacctccaaagtaattctgattgtaggccagactcacaggtcgttcaagtccaaaacaatcagatagttccaacaccacctattcctcagagtacagagaaaggcagcgctggactttcatccataagccagcagaagcacgaggtgtcgaatgattcaaatgcagttaattcaacatctatgatgcttagctctcctcaagatacatttgctgggggtgagagactattgccatcatctagccatgatgtgctggaaaggcagatgccaggtggtttgcctatgtatggtggccagtggcaccaggagcaatctaagcagcaactgcagtccccaaaccagcagagaccagttgttcaaggcagtgtatatgctccattaaatcctgggcctggctgatgataaattaatctgggttggtcacttttacagagcaacccttttttgaaatctaaagttattgtacaggtatgcacttttaacttccttactttttgacttggtaacggatactgtctttgaattttgttatgtcaatgcagagattaagtaaacttatggaaccatttgcttttccttctgattattctaggacatcaagttgctcgtattcatcatttcttgaagtagaggtagggtgatagaattgatattcgagtcgagcagtttaaatgatccatgtctaaaagcagatgggcttttgcagtaatttaaagcttgtgctactatattctttgtagggagtatttttctgatatttttttaccttatctcacttgctaggtgtcagtgactccgtaacatggaagctgcggatgatagtgatgttaattcaacttggagctaatcgtaatcaccttagtgtcaggtagatagttgtttccgtgccattttaagtccacctttagaaggtgaaatatgttttatgcagtctagataactggatggaggtggctgttgcagcggcaaacttcgtttctttttggtggattctgacccaaatcctgggcccggctgtatattttcgatgcgaggtccatgctttctagaatcaggaggataaagtgtaaccctgtaattgcttcaactacaacttggtgaatgcaaaagtgcttatttgcattttgtaatgcgcagtttgtttgtcatttgaaacacctcgctagtgctgttttgcagcatcagtgtggaaggaggcagaggcaaaggtggattgcttcatttgggttttggtttatgtgggatgttatgattaatttgggtttgggtttgaatcatttttgtgggattttgtggtctgcactgcaagttcagctacgccagcgaaagatgtggagtacttgcattttccatatgaattgttgtgatcttgcaacagagaatgacgggcgttccctgtgttgtactagttacccagatgtaggagtatgtgccgatgtgcgtagtgctcggaaacttgcaagattgaacctgatcatcacagtcacagcagaaagaaaggagtactgtattttattgtcctaaccacccaaaggaaagaagtcaaattagtaggatttctcaacaataaagaaaaaaatcaaagtatgatactctttaacttcattcataatagttactacttaattcgtttacactctcgaataattattacaaaatcattaggttatttagctgttcactgttcaaggggaaaaaagccactcaagccattgttgtagtttttcccccattgcttgcattttattccttgtgcttg

SEQ ID NO: 67925 - DNA, 9617 bp, Oryza sativa
gaggaggaagcttagcggcggcggcgctagcggaggaggcagcggcggcggacaggcccctcatggcagcggtgttggcaaaggaggcgtagcggcaccggacaccggacgggcccctcgcagtggcgtcgccggcggaatagtggcgccggaggaggcgtagcggtggcagcgggcgtggcaccggatcggagggagagaaggagagagaggagaggctgactagtgggtcccacactggtttcacccctccattgctatgttgacctgccacgtgggcaaaagtggcaaatagttaagatggcatctcataagaggagaaaaatatgtgcaatcctaaaaggggtatttggataattgcccaatctaaaagtagcaaatagttaaatttcccgatgatttcgtcacatcatgtagttgtatattcacatgctgacatgcgttctattgatctgcccaacgatgagaaataaaaaaggaagggggagaaacttgatggacgatcagtatctgaatattcggtaaagccatgagctagtattcctaaatcaggaggaatgtctgagagagaatccatccaggttttgacatgacatgtattttcttttcttttcttctactaccacaaagaacagacaaacctggaatatcatttgcacgtgcagggcaagtcagacacacgttctatttccttctttttctttatagagcagagcagaacagaccatatgcgttcgtagtatcatttgcaagcatcagtcgagtcctattgccggctggcaactgttactgctctcacaaggaccaggccacaacagttattaaaccttcacttgtacattgacattcatccatgaagattattagcaacagaatcagtttaaaatccacccaagctatgctctactttctgctacgaacagaggaacatcatcaccagtaactaacatactcacgtctgtgacaaacagcatacataacccttcttctcatagcagttttccttgtccataagttacaagaggctggacacctctccctaatattcaaactttaaaaaagcatcccccaacttcccccaccggtcatccaattccagtttccaaagaagcacatggcatgagagccctgcatgcagaaatctctccaaatacaacaagattcaaggggcacatgtccgcgcaatgaaaacaaatgggaacctgtacaaacagcctaagcattgccatgagtccaccaaacagttgctaagggccaaagccccttagaaccaaccaaacctcttattttccggtctttagtactccacttcagcaggcgtgacccatggagtaggggctctgatgatatgcacaccgccaagattgagacatactagtactgaatcctatcatcgccatcgaaatttaggccctggatgccccgtatggtcgactcgtagttcttagcattcgatggatgcctgccagaaggcgtgcgcctgttgtcagaggagtcaaccatctgtggactccaccgcggggcccctgatctttggaatgcccccggacttgcatctgttgtacgactacgtgactggtcagcttcagtgcttggttctcggctactagagacagcaggtcgccttgaggatccgcttgaccgtcccaaaaaagtcgaactggagaactacacgccacttaaaggtcagatattacatagcaattgtgtataaagtagcacttcaggggcacacttttttgtcatggcactagcaacacaggcatcatgagaactctaagaactcaccactgcatctttagaagttgattgctcatgtccgataggggacttctgcttggctaggctgcctgcatttatagctggaggtggaacctgacgccgcatcgcatccatatctgaccagccgcttctccttccctcttcggtggctacatcatatcagtagacagttaaccaccaaacaactagcaagctttgttaattggcaagactctacatgaatcaagcagtctcaagggttgaccaaacagtagaatattagaatggacgccatctatattttatttgattaaaatataatgatctctacaaatgcaattccttctaacggtttgacccaaccaaaggctccattcctactttactgtcttactaacagatttggtaatgatcgacccgtttgtaactcactaacactaacattacccctttttccatatcttatttggggtggtaggtgatagtaacatcattttattgaatatttccatgattatgagttgatagaaactgaaaaacacctgctgtttatctaggtgaaaataacttaggagctgcagtacaattacaatccactaaagaatagatttatacctgacagcctgttattatttgctataggagccatcgccgagctttgtcctgttgcaggggcctaaaataagatacatcagcaaaagaagagtttgaacataaacccccaacgtgcacacacagtgaggaaaagaggagtggtagttgttttcaactgacaatggcacgtggtggagcactggtcatctgtgactgttgatacttcaggattgtccagtcaaaaacataatcaaactgaaatcctacatgtagaaaaaaaaatcccatcaggtgctttcaaaaggtagcattttgcagtatatacaagtcataaacactgtttagtcactgaaataaatatcgagcatgtttaaagaaaatcaaaacaataaaccaaccctctcgaataaaaaggtctctgaacaatctcttcaaatattggtagtctggcgaatcttcaaagcgcagcgagcggcaataatggaagtaagatgcaaattcagtaggatatccacgacagagggcctatagttgagaaatcacaataagaaatagttcaggaaaggtggtggatgcaatttatagaataatatttacctcagttgaagtagcaattttcctttcgctgattttctcatatttttgtttcttgttcccagcttttagaccctgccacggaaggctggcagcaataaactataagttaatacagaggacgcagttgacgcagagatacaaaagaagaaattacttgaggttatgttgaacaaccttcctctcaagaagtacatcagtacatatccaagagattccatgtcatccctccggctttgttctatggagaagcataaaaccgtattatgatgctaggaagacatacaaaaaggtcatataagcttactaggaacaaataacatcaatgtcaatcttgacactgctactggataaaggaatacatatacagtaatcagataacttaccaattccaagatgagtgtttacacttgcatatcttgctgttcccgtcaagttcttgttctccctatgattaaaagaaaaattggtgtgtttaatttggaagtaatatacagcaactgccatttcaactttcaagtagattaaaggtatccttacctatatgggatgtgctggtgtgttgatgtatccctgtacttctttgcaagtccaaaatctatgacatagacctacacagagaatgaaagcaagggttaagtacacctataattaattcatgaatacgaacagatcaattgaacataactatacctgatttgcccttttacctaggcccatgagaaaattatctggcttaatatctctatgcaagaaagacttggagtgaacaaattcgacgcgattgatctgagagatagaagatggttttggcaaaacaaatgaactgaaatcagttgagaaatgctagctttgggtaaaacaaaaactagaaaataaccaaatgaatagcaaatgggtttaaattgactgctaatagtaccatttgatcagcaagcatcaaaacagtttttagagacagcttcctgttacaaaaactgaaaagatcttcaaggcttggtcctagtaagtccattaccaaaacattgtaatcaccctcgacaccaaaccacttaacatttggaattccagctgcagaacaaaagggtcattagttgatgtgtcagtttaaggaaaacccactggataaagtaacaagcaagcatcaagcatgcattacttcctccctggagtattctgtacagcttcgactcatacagcagttgtggatgcttggtcttcacattttcctagacaaaacattggagattaacaagggtgttatctattaagacaggaagaggactggtggaaacagcagaaacaataaattattctcacaaaatacgcgcagcattacgtcagatcaagtccatgcttgcgatggacgtcaaacaaatttaatcctaatcaaccgcaactggacaagaggcatttgtcagggtataacagtagtatacccagtggtacatctatatagctcttgaaaaaaaaatcatgttttggcagagaactattaacagaacaaaaacttaagtagtaaaagttatgtttcaatagttttcctagcaacagaacacattaaaaactttaacacatactccagacaaccttttatattagaggtgccatatactatcaccaattcaactgcattaaaatatattgttaacaacaaactacattcgcatagcaaccagttgacagatttccaactcagaattcctccaatcaagtatagaacatgtcctctgcatctgagatccccacatctgaagcaatcgaatcataaatcgagtaacacaaagcaatactaggaaactcacgagcttaatagcgacctcctcgttggtctgaacattggtacctgcgagaacacacgcaaagaaaacaaaatagaagtcaccagaggctgatgggtaaagatgagaacttttgaatcaaaacgaggactttgggtagaattgcgcacgaaccaaggtagatctccccgaaggagccactccccagcttgcggccaacacggaacttgttgccgatgcgtggctccatcactgtgtgcaccaagctccccgggacaatcccttaatcacaaggagtgggccctgccagacaaggatcgaaccaattcgatcagctgctccaggggaatttggagctaggacgcataacatagcggtgaggtaaatggggatttatttcttgctctctctcctcatccatttacgtgctgctgcaggtgttgagcacgacacacacaggtgttgttggtctcagaatagaaaaatattaagaaatcgatgcatcaacggaattgggcacggcggcgcggtcggaatggttttccctctctacctgatttttccttctccaagtgatctggatctcctccatcttccctacacagtttcgatcggatccaacttgtttggggctacaaacaaactgttactacttgcttgtattaagagaggttaaggctctggaattaaggaggagaagagcttcatccagatctactccaagagaagctagggttaacgcaagcaaattccagctcccggtgggagagagatgaatcagaaagaggatgggaggtgctcaccaggtccaggataccctgctctgctctgctctgctcgcgcagatggagatcggcagccgcgactcgtcttggcgcaaggagcggagcggaggagacgacgagacgcccccgggagatttctctttcttttacgccgcgagggaatgaagggtactccacttcttcttttttttccccttttactttaaaactgcatttgagatggacaacttctcttctatgctaatatttcgaaattttcatcccaaagctatttcggacattaggacaaaattataagtactaaccaaaactaattagcaacgatggtatattatcgaagttaagcaaaatacgatgacatattgtagaacttaacaaactcaatgacatatatagaacgggaacaaagccagtgacctacatctttttcacttgataattgatatacactttattataaattctataaataaattattggatgattttaaatatttgaaaaatcagggtgtggcactcctcaaccaatggagacgcacaaagtcgctggtttgctccccaatcgaggctgatccgttgccaccatgggagagaggttgccattgtcgaggaagcgattcctcagacggtagggaatggagacccccccccccccccgagtgtgaagatccgaccagggggtttgattgtgagaggcacgaacgaactgcaaatcagaaaggattcgcggggtccgaccaccccgcgcagcaagagacacacaagaatttatacaggttcaggccactcggaggtgtaatactctactcctatgttggtttttattgtcttccctagatcagtgaagtacaaagaagcctttttaggctacaagcgagaatattgatataaagagtccaccccccattccgtatatggtccccttccttttatagttcaagaaggggctcacattattacaaatctcctcttagtcttgtcttatcagccgtcttgtccttgctggctggttcccagacacaatcttcaagaaacccattgagatttgtgtcatgtaatgccccgagctctgtctgagatagttgggttgcgccagtgtgcccaccacgtggtgagtagtgggcctggtgagacccgagctgctcgaaacagtgccacggttgcttttctgcccatctggctaaattaggtggcgcgggacatgcacaatgcgtgtccaaggcagcatcggccctcaatgactcaacattggtgtcttgtccatgtcttttcgactccaaactggctagagatcccccataaacatgtttcatttatggcggggcacaccacatcacagttggctgtggagtgcgcctaacttcctagtaggttatgaggtcgcgtcctctcgcatttaaagtagtttagttattttagtcgagcttctcggagatgtcgttgatgaatggatatttcaagatattgtatcttgtatatttcgatgctcctcgagacaaaggtacctgaaccctacaaggaccgaggtgagcccgggtcccaggataaggccggggccgaggcagacctcggttcataatcttgttggtatagcttcttatgtctccatcctccacaccttgcgaagagagtgacttatgaagactaaggtgagcccggggcccagaacaaggccgggctcgaggcataccttagttcaatctcttaagatgtagatcttatagatctctacgatcttcccgctaaaggacgtaggacttataagaactggggtgagccaggggcccagaataaggctgggccgaaggcagacctcagcttacatccttaagatatgtgttttgtacgtctcaacactcctcttttctgagtagtgtgtgacttctgcaaactaaggtgagcccggggcctagaagaaggtcgagcccaagacagacctcagctttacatccttaagatatgtgttttgtccgtcttgacactcctcttttctgagtagtgtgcgacttgtgcagactaaggtgagcccggggcctagaagaaggccgggcccgaggcagaccttggctcaatcttcttaagatatatatcttgtagggatctacgctcctcttgctgagaaccgtagagcctacaaggactaaagtgagcccgggactcaggacaagaccgtgtccgaggcagaccttaggctatattcttaagatgtatttgggtatgtttggcaccgaagccaggtcccaagatgcccttatattcaaagctttgagtcattgtacatctcatatattgcattcctccttagccaggcagagttccatatatgagaacacatgtgggcccgggactcaccagagtgggccctagctacgccaccctagggttgcctttttatttttaaagatactctaagcatgatatttatctgataatgatcattttgccaggtaaatgggtacctcgattcccatttcaccgacagccatcgccgttagcaagaggttgccattgtcgccagcgggagagggtgaggaggaaaccaccctagctcgtcctcgtcaagttccagttgactgctccccggctcgagggagaggataaggttggtgaaaaagaagatatgggctgagggtattttcgtccatacaaaaatatggtatgcagaaaacaactagcgtaagaacgtcctagacgcatatatagtaacacgattcgaattttacaaaataccagtgacattgagtcacaccgagttttcattataacatattcttaacggcatggatttaattaattgaaccaccatcttacaacatattccaggaagaaatatatattatctgcaatgggtcatccatcgttgtactttttttttcaattaagggtaaactcgatgtgagtgatcgatatatggttatagatcgatcacaaccggtatgcgctaggtgataaattttccatggcttccccggcccactctctggctctttgtcccctggatggagtagctgatggagatagataaataaataaagtagtcttaattaaaatgaagaagtttgtttgtaattaagcgatgggatacaattaataggacatatatgtacccctaatctgtatgctcaccgtgcaggacgcttatcatgtgcagattactggtggcaacgctggaataataatctgtatttagccggccgttgacagtggcagctaggcagtagtatgatgacatatatttgatttggtgatgcacattacatcgatcattgttattgcaggctgcagctagtgatggagatcaattagagatcataagtgtaacggaggaggggatggacaggccagggaggcggccttggccatggcgtggtgggggacgccggcgttgcagatgttggcgaaggagcgcatgtgctttatcccgtactgtcccagcgacccacactgatcctcgaacgtccgcaccatcgacctgaggcactcccagtcctcaaccagcgcagcccgctcccgcacaacctgctgcttgtgcttggcgccgcccaagaggaggcccccgatcatctccacgcttctgtccacgcgcgatcgccgtcccatctcctgcacaagccgctcccgagcctccaccttctctgccgtcccctcgccggctctccggtacttgcgccacaagtagagcagatcggcgtcgcgctgattcacagacacagtgtaggagtggctgcctttggcgccagcagcagctaatttgtggtcgttcgccgtcgcaggtgatgtatccatgtagtagaggtccaggctctgcggtgcgagcgccatgtcgccgtactgcatgacgtgggagccgagcgtgtaggtgccctcgtcggacgtccggttcttcaccgtcctgtactgctgccgcagcgtctcggcgaggcgcccctcctggtgcgcctccgcgtcctccatccacgccacgctgtagaggtccccgaggcaggtgtcgaactccgccgccggggcgtcgtggtcgtcgcccgggcagtaggtgccccagctgctctcctccgcgttggaggccgtggtggcgtacacggagatgtcggaaggcaggagg

SEQ ID NO: 67926 - DNA, 23111 bp, Oryza sativa
atcatttggttatttagctgttcactgttcaaggggaaaaaagccactcaagccattgttgttgtttttcccccattgcttgcattttattccttgtgcttgggttgggtggcagccattgttgtgttgtgttggcttccctttcccctccctcccactcccagtctgtctctctgtctggctgtgctgtgtactcctactatagcgagacagagagagaatctaaatccaatctcaaggacatggccaagcccaagcagccgcctcctcatgctcctcctccgccgccgcccccgcctccggtggagggcaagcccaagcctcctcctcatgcgccgccgccgccgcctccggaggccaagaagagcttcatgcgccgcatgttccccttcctcctcgccgccaacgtcttcgtcggaggtcagctcacccctttccttctctacttagcttacccgatgccgcgtccttgtcatctaccttacctctaccgctgcgctgctactcctccttgcgggatcacctccgtacccagggctgactactgttggtcgcaccagcagttggggctatatcagtattcatctcttaggcgggttggttgttgcattcactctcggctttactcacatgtctcatcactgaaagatccatccgcttcagtaaacttatattaatataagctcatcaactacacataatcttttactcacattgggggcaacttctgtctctgccttgtttgggctagactagtgcattgttgtcttagcatctgcagtgccatttactactactgtatttacgtttattctagttgttcttgtttcttctcaagtgttatgcatgtaatggtaaaccagagctgccaatcatatttgtgcattttttgtctcctcagtatatttgagcatatctattaacaggatattaatgtagtactgaagaaatatagtacatgcataaattgagcgcatatatgtatatatattctttaagttctgaaagagatccacttctgtagctcttatgtgctgttattctgcacttctgcttttcttactcaaatgctattatagttcagttattaacatccttataacaatatgcagcttatatgcttatgaggacctaccaaaaggactcgggaaagaaagataccgagaatgatcctacttcttctacgccgacctcatctcccgcggctgctgagaagcctgcagaaccaattgttgcacccataaaggtgctcacaccaatctcccaagacgatcagcgccagctgtacaaatggatgctggaggagaagcgcaagatcaagccacgcgatgctgcggagaagaagaagattaacggggagaaggcccttctcaaagagttcatacgagcaggatcccttccaagcctataagatcgccaattaactattatttggatctgtagtgctcttgtgtttgatgattgactgggaacggtgcgagtttgattgtatttacaagtccagcactgtaatcagatttccaaatgatagttgtggaaagaccctgttgagcttgatctcctgaattgaattggcttctttcataggacatgttgggtatcaagaagccgatttctgggaggcatggaagatgatgtatgaaactattatcagtgttgatttgggcttttcagctattggtgctgtgtaagttcatcagcatatattgatgtttgtggtctcttacagccttgagcctgcttgtcacattacaaatatacttatgtatagttgccagctcaactgctctgttgacctgaaatgctgccatcatcaatctatcaattactatttcgcatactattatacaaaaggttgaaaagaagccctcacatttgctccgagggcttagaaatacccatgtaaattggagtaaacgatgaatacatgttataatagtgtagattgatcgatataattgtatatgaagtatatactagaagttaagggaatgtttgaggggagaggaaatgagaagatatgcaaaaggtgagtcgttagtaaatgattaattaaatattaattgttttgaactcttggatgaatacaattttttaaagcaacttgcttgtagaagattcttctttttttttttaaaaaaaagcacagtgtttagcagcctgaaaagtatgcgtgcaaaagaaaatcaaaacaactttttatataagattattgtaaaaacacattgtttagcacttagaaaaacatgcgcgaaaaagacgagggggacaccctaagagttgtatatgatcaaattcaacatctattgtatataaaatatatctatgtattttaggagaaacatatttatgtttatagggatagaaactagtctatcactctaatccaatacaaaatacagttgtacgcgtagaaatataaagcagattagctaggagttgtagtaatatagtagcaagtctaaatcaacattttttttttgaaaaaaaataaaagggaaaccagctactccagtttgtttgacatcagattcatagaaaaggtgggcttactgggttcggcccattaaccaacccacggacgcttccacctaggagtagtagtttgggtttgggttcctctctcgtctcgtctgttttgttttcccctccgactccgactccgatcgatctccaccccgaatccctcctcctcaccgccggcgagcttccggctgcggcggagatggccacacgttattggatcgtgtctcttcccgtgcagactcctggctccaccgccaattctctctgggcgcgcctccaggactccatctcgcgccactccttcgacacgccgctctaccgggtaagcatcctccccgccttccttccttccttccttccttccgccaccaccatcctcaccctcctcctccgcctcccgcccgcagttcaacgtccccgatctccgcgtcggcacgctcgactccctcctcgccctcagcgacgatctcgtcaaggtaacccatctcttctcttctccccgatctcgatctcccttgccccccagctctcacgcgattcctattattcctgccgctgctgcagtccaacgtcttcatcgagggggtctcgcacaagatccggaggcagatcgaggagctagagcgcgccgggggtgtcgagagtggggctctcaccgttgacggcgtccccgtcgacacctacctcaccaggtcgctcgctcgctcctgcccctgctgcctctcagcttagcgattccaactcttttgctaaagctctctacctcttccttcctttgcttcttcttcttttctaggtttgtgtgggatgagggcaaatacccaacgatgtcaccgctcaaggagattgtcggcagcatccaatcacaggtctccaagattgaagatgacatgaaggtgatgacctttttcccttgcgaccacataatcactagtcaagacccaacctacatatagtgctgttaatatgtttcgaccctaatgctgtctctagtcattaattaacgacacttggtgtattcttattcttcttgtacataagacataaagttttgccgttcagcgggaattgtttgcttgctttgcaacaagtaggcaagttttgacattatctccataacgtgcaaagttcaagctagtgagctttgttctcctgccaagtgtgtttttacagggtctagcttggtttctgttttggtatgttctgttgttctagccagctatcaacacaaccatattcttgtgattaggcatccacgtctccttttttagcattgagttatcacgcacaacactacagcgtgacctgttgaatttacaacagctgagctgaatgtgttttttaccttcaggttcgaggagcggaatacaataatgtaaggagccagcttagtgcgatcaacagaaagcaaactggaaggtagattgcatgccactgagtttttggctttaagccaattctttcttgttttatttcaaaggactcagaaatgcgagggtatggtttcatcttttgttagtcaactctaattagtttgttttccttctgtatagcttagcagttcgtgatctttccaatctggtaaaaccagaggatatggtcacatcagaacatctagtgacactccttgcagttgttcctaagtactctcaaaaggattggttgtcaagctatgagtcccttgacacatttgtggtaagtatatgctcttttatagtgacatggttagtaatagactgtcatttcaactatttatatgattttcgtcctttcagcaagttgcttattttacttttgtagtttttgttcaatccaacaatgtttagtttgttaccacttgtggcgttaatagttctactagcaggagatgttacccctgtagaaaccacttaaagtaaagatctgtttgacctgtaaattctttactcagattgttttatttagcccttataaggaccttgtttttttttccagcactacatgttgatgtgattagtattcgtaattggttgttatatttgagtgcttttttccttgaactaattattgatttataggtaccgagatcgtctaaaaaactttatgaggacaatgagtatgctctctacacggtaacattgtttgctaaggttgttgacaactttaaggtccgtgcacgtgaaaaaggtttccaggtaaatttgccgtcctaactttttcatcaaaaacctttgtttacacttcacatttagcttttatccctagagccttaggagttccaaataacttgggacagaaattcagtcttgtttttctgtccccatcaatctggcaattctctgtcacccattaacttgtattacgttgaaatacaggttcgcgattttgagtatagttctgaagcacaggaaagtaggaaggaagagctggaaaagctaatgcaagaccaggaagcaatgagggcatcacttctgcaatggtgctatgccagctacagtgaggtgcatgtctttttaggcttatttaataatcctgtcaacaatgacatttctttagagaagaacttttttattcttatgaatgtcatttttgtttcatgtaagttctattaaaattactaccaattaatgtttgatgttcatttcatcattttgcaccagaatagagataaatatgttttcatctcctttagtagcctgacggtcttaattgtccttaaaagcatccaattatgcggaatctgaaccagtaagaagatattgtctggtctcagttgccacttgccagcaatagatagatgccacgctgtgttttatgtttaaattttacataaggattttagtaagttataacttcatggcatactgcaagttcttcctactgctgttattatctcactagaaccttattattcagggataaatccttgtttctgggatgtattaataagcttgtgtttattatccataattgtctattttaatttgtgcagaataccatttatgtacgtcatgctaaagtgcaaaactttgtgcttctctatgtgcgtaaaagaaaataattctgctgttgtttatctctgcttatgcagtgaattgccgtcatgaaggatttgtttactgaactgagttagttagagcctagctctataggctatagacatacttattacatattcactatgtcccaaaaaaaaaaaccaacctagtcaaggatgggatacaacctagtcatgtccagattcgttgtactaggttgtctcatcatgtcctagtcattgacggagggagtagcacatatgtttcttgattgttgggttttgtggtttgctttttctttgattcattcctcgtgaacttgtgttttcatggtgctcagttgtaattgcttacataaaactattctgcaggtattcagttcctggatgcacttctgtgctgtgcgtgtctttgtagagagcattcttagatatggtcttcccccatcattcctggtaatctattctactgttacgtagtatatgatagtcaaatttgtactttgatgcctgatctaatatcatatgctgtttatgttttcatcagtctgctgttctagcaccttctcaaaagggtgaaaagaaagtaaggagcatcctggaggaactctgtggcaatgtccataggtaattcagcgtttgagtttgtgttcattgcattgttagtcacaacatgcacctgcttttgtcattaattgagcctctgaattgcagtatttactggaaatctgaagacgatgttggtgtagctggtctgggaggtgaaaccgaggctcacccctatgtttccttcacaataaattttatctgagcacagtatgttccttgctacctgtggccaggcaaggcagtgttttggagtaattactactttggcaaacaaaaaaccagcgaatggttcggtgtatattataattgtgatacgtcaattctttcttgatttatttacccagcttatatgatcctgtagtttgaaccgatcaataatgtagctttttgggggaacctggactattttcctggcacaatagggtatctgtttggactattttatccccggcaactacaatattccaactgtttcctttagtatatctattgtgctttgagagcaccgtgtaagatgttgtggatattatgtttttgtaactttgagcagccaggttcgtaataaaagatcaatataaataattcaggtcgccgagcctgattgtaaacagtttgttgttgaattcgagctgtctccttttttctttgacgattacgactgttgcactcatatataaatagaaaggtggttgtgttttcacattcagtagggtggtgcaccgtaccccgtacatgataatactgatggtgttgtgacagaaggacaagttgggggttatgtatagaacgtcaatccttggtgacccagttcccactgatgatagtggagtagacaagacacaagaggagatgatggtcaaggtgagaggtgagggtgggtgaaattggatcagcatcaaagtctcatgatgttatcattaacatatgtgagtctgatgaattattgattcactgaagaggatcccaatggaggtgatcgcctcattttgatttgagtaggaccgcgttatgagagcggggtgaggtcggcaaggagaaggatggatcagaatagtcatagatggaaaaaaaaatgcaaggagtaattaagattaataggagtaatgtggatgaagaagaaacagctaggctaggcacataagaagatgattaatgggcaaaatcaatccaatccccctcatcgcgtcgcgtgagaagagaggaggaaatggcatcctcgagattgcattttgtcgtcgatgatccggtccattccggcgccggcgttcacattacacacccaaccaatatcctcaccagtactactattccattctgctactagtatactccttcagtagtgcagtatttttcttgtataaataatactctaggagtgtactaatactcctagagtagtcttgtttcacctacccccgttccgttccttgtatgaatccattgccttgcttctgcttgcccatttgatgatttgatttgatttgattcaatctccaaatcgatcgatttctcctcctccataggagaaggagatacacgtgatgtccaaccggcgtcgcaagcgcggcgaatccaagccccaagcccacgacgccggcgacaccacgcccatcgacaacatactcacctccctcgacgacgccccgccaccgccacctccaccgcgccacgagctccccctcctccagctcaacgaccaccaagaggcagatgacgctgacgcctcgtcgtcgtcgtcgccgcaccagcagcggcggctgtgggtgaaggaccggtcgcgcgcgtggtgggagctgtgcagcagcgccgactacccggaggccgacttccgccgcgccttccgcatgtcccgccccaccttccacttcctctgcgacgcgctcgccgccgccgtcgccaaggaggacaccgccctccgcgccgccatccccgtccgccagcgcgtcgccgtctgcgtctggcgcctcgccacgggggagccactccgcgtcgtctccaagcgcttcggcctcggcatctccacctgccacaagctcatcctcgaggtctgcgccgccatccgcaacctcctcatgccgcgcttcctccactggcccgaccaccccacctccaccgcctacaagacgcgcttcgaggccacctcgggtgtcccgggggtggtgggcgccatgtacaccacgcacatccccatcatcgcccccaaggtctccgtcgccgcctacttgaaccgccgccacacggagcgcaaccacaagacctcctactccatcaccttccagggcgtcgtcggccccgacggcaccttcaccgacgtctgcatcgggtggccggggtccatgagcgacgagcaggtgctccgcaagtcggcgctgcaccagcgggcgtcggcggcggctgggtcgatgtcgtgggtggtgggcggcgcgagctacccgctgacggagtggatgctggtcccctacgcgcagcgcaacctgacgtggacgcagcacgccttcaacgagaaggtgggcgaggtccggcgcgtggccacggaggcgttcgtccgcctcaaggggcggtgggcgtgcctgcagaagcgcacggaggtgaagctgcaggacctccccgcggtgctcgccgcctgctgcgtcctccacaacatctgcgagaccaggggggaggacatggaccccgacctccgctgcgacctcccccccgacgaggaggaggacgacaccgtgcttgtgcagtcggagtccgccaacaaggtgagggacgacatcgcgcacaacctcctccaccgcggattggccggcaccgccttcttctgatcatttcgatttccgtcccaatctgcactacaaacactgtattgaggtttccctcctcccctcctgtttgttcttgttattgctatagattagtttaggtgctccactcaacaacaacaataacacaagattgaaatgtgatgctttgccctcctcgttaataaatcactggaatacatcgcttcgtttcaaaatttgctttgctttttggactattctttatcctggtactggtaaattacacatacaagctgaatatttactcctataagtaagcacgacctacagtatttgggtaggatactagaattctgcgctttgttctattgtctgacctgaaaattttacccctcgtacaaatctcctctacatgtcaacttatcagccacatccagaattcaaactttgaatttagtggcttttattttcagcattagctttgctttaaatgaataagaataaaagttctaacgacaaattgtttttttaatttgtttcgtttatttttctatagcttatccttcattgcacgaacgattagtgtggccttgaaactttaattgtaggggatgacattgaatccaatcctaggttgagagatgccactgtaggaccatgaggcttgccgaaatttttgttctggatcttttgatatgcttgttggccaaatgtgcattgctcccccaacggtgtgctgtcaatgctaaagtagcaaaacatatacagtagcattacaacagtatacgtgctgagctttagttcctctggtgaccaaccactctgggaatactattgcttaataaatcattctgtagtctgtacctttggttagtgtttttgttacagtggggttgtgtgtcttgacttttgacatttcaaaggaaacatgttacttcttctgtcccataatataaaggattttgacattttgcttacactgtttgactattcgtctcattcaaaactttttttgaaattattattattatttttactttattatccaaattactttagtcacagcttttcgttttttatatttgcacaatttttttgaataaggccatgtttagttgttttggcaaaaaaaaaattttgacgtatacgaaaacacatttaaagtattaaatgtagactaataaaaaaattacagattccgcctgtaaactgtgagacgaatctattaagtcttattaatccgtcattagcaaatatttactgtagcatcatattatcaaatcatagcgtaattaggcttaaaagatttgtctcacattttacatgcgaactgtgcatttagtttttttcgtccacatttaatgctatatgcatgtgtccaaatatttgatgtgacgaaaaagttaaaagtttgaagggagctaaacacagtataagacgagtggtcaaacaatccaagcaaaatgtcaacgtcccagtattatggtacagagggaatagaactagacgatactactagaaactagactagtgaaaaagaaaatggaagtctgtgacatgaatggcaccagtggtctagtggtagaatagtaccctgccacggtacagacccgggttcgattcccggctggtgcattttttcttttctctctcactctctctctctctctctctctctctttttttgccttccttccatctatgtgctgatgttaaatacgttttttttcccggttttacttcagcatgaagcaccaacaaaatggccattacaggtttgcagggactttactgttagcgcaaaatgccgttgttgacttgttgtaaagagcggcttgtcagatgtttttcatttttcacaccgtgctgtaacttggaagcatgacgcggacggactgattattgttacgctgaccaattctagctctagctccgtcagggtcatcaaatgagtggttgctccatccgagaattctgcagcctcatcggttggcatatttcaaatagcatatttataagagataatccaagaaatgtgagttctaagaaatatcatcgacaagtgtaaattctaagaaatatcatcatacaaacgattttgtcctaaaaataccatcgtcattagggttctatccattttgcgccgttaaatacactgttcatcctatagaattttaatatcgtggaatgaatggaaccctaacggcgatggcatttttgggacaaagtcatttgtaagatggcatttcttggaacttatacttgtcgatggtatttctgggatttggatgcttgtcaatagcattttttgaattatctctatttataaataaacattaatttgtgaataaaacttctatacacatgttcttagcgatccaaaagtaaatgctgaaaaataaacttctatgaaaaaaaatcccataatcaagttgaaaattttaatggctgaaaccgcaatgatacaatccgtatattgttatctgagtgagccatcctaaccgtcaacgtgaaactacctctgcctcacactgtcgcacacacaaaaccttagcccacatttaacctgtttcaatcagttttatttaagaaacatgatggttcactggcacttaaagggccaaggcctcatatgttggtccagacccccacattgtcattctcacacaaaaaaaaatatgcttgtgatagtattttatttaaaaatttatccattgtaaacgtgtgtttggattggctttggtgaatgaaatggtatttggtcctcacctcatccccaaaagcatatactaccaaataggagggggaaaaaaggtaaaaatgcagtttctaaacacaccccaaataaaaaggaataatatgaattgacttctcaaaccgagctagaaattaaccgagctggtgtgtttagttcacgctaaaattgaaagtttggttgaaattgaaacgatgtgacggaaaaattggaagattgtgtgtagagaagttttgatgtgataaaaaagttagaattttaaagaaaaaatttagaataaattcggtagaggtgaaaccgagagaaccgagtagttgtacttacacatgagatgagatgagatgagatgagatgggatgggagtgcagtgtacagtaaaatatgtttggtgatgagggggtagagtggtggcagcacaccactggctgagcgcgtcgccacgtgtccacgccatttccaaggcaggcccccatcaacggcccagacgtcagcacgtggtgatgtcaacacccctacccactgtgtcactgacaggccggggcccatcctcctcttcgtcctccacccgccagccagccagcgcctcctcccctctcctccccacgcaacccgatccattcccaaatccctcctctcatcaactcgactctcggtcggcgtcaccggcgtcggaggcggaggcggaggcggcggccgcgtcggcaaggtagtgctgtgctggatcgagtcgagcagctggctgcgcgcgcggtttgtggctctctgtgtgagtccggcgctgctgcttcaattccttcttccccagggcacctcccgtgagccgccatctccctccctcacctacctctggattcgctccagatccgcccatgagtaggcccccacgcccaccgcctgctcgccatcgcgcctccactccaccacaccatgccgatccccaccacctctgacactactccgcccctccccctctctcattcccatggaggacctcgccctgcccgccgctcctcctgcccccacgcttagcttcacgctcttagccgccgccgccgccgtcgccgaggccatggaagaggctctgggcgccgcgctgccgcccctcaccgcccccgtccccgcccccggagacgactccgcctgcgggagcccgtgctccgtcgccagcgactgcagcagcgtcgccagcgccgacttcgagggcttcgccgagctaggcacttcgctcctcgcggggcccgccgtcttgttcgacgacctcaccgccgcctccgtcgccgtcgcggaggctgccgagccgagggctgtgggggccactgcgaggagcgtgttcgccatggactgcgttccgctctgggggctggagtccatttgcggccgccgcccggagatggaggacgactatgccgtggtcccgcgatttttcgaccttcctctgtggatggttgccggcgacgcggcagtcgacggcctcgaccgggcctccttccgccttccagcccatttcttcgccgtctacgatggccacggtggcgttcaggttccctttgcttttgtttttgcctcatcacagtcacagcacattaaacgaatccaacacaccgatgataaccttttctccatgctctcatctgttgcaggttgccaattactgcaggaagaggatccacgccgtactgacagaggagctgcgtagagcggaggacgacgcgtgtggctctgacttatctggccttgagtccaagaagctgtgggagaaggcgttcgtggattgcttcagtcgtgttgacgctgaggtgggaggaaatgctgcgtctggagcaccgcctgttgctccagacaccgtggggtcaactgctgtcgtcgcagtcgtttgctcgtcacatgtcatcgtagccaactgcggtgactcgcgtgctgttctctgccggggcaagcagcccctgcccctgtcactagatcataaagtaagccatggactcccattgattccatgtatgagtaattgactcgagtcctgaggataattggatacgaattgccttgttcttcttcgtgcttcagccaaatagggaagacgagtacgcgaggattgaggcgctgggtggcaaggttatccaatggaatggttatcgagttctcggtgttcttgccatgtcgcgatcaatcggtatgcattctcacccttttgacataattgaaccagtgtttgtttgtgcttcattgtttatgcttctccaactttactgatgtgactgtgctgatgatagctgattgggtaattgatgtgtcaaaggaaaagtctcttgactggttcattttgttattttgttctgaattgtgatgatatatggtgctctagggtttgtgacttttctaagtgaaaaatcactggctgattgttgctccctggtgtaatgacattgtacccccaagtttatttacaaataccttgcatcaatgcgattgtttgcaactggtagtgagtttgtacctatggtggcagagagagctcctcggctaattactttgttagtttgttcctagtcatactgttaagtgatttgcgatgctatgattcaggcatatatttctatatttgttagctatgttgccatatgcgatactggtataggcgtttggtgagtatacatgcagttcacaataggaaaatataagagaatatgagagacttagacattgagatcaccttgatggaaaaatattaagagtaatactaaatggcagaatacttcaaagtagtgatttctgtcataccaaacactaggatgagtcactaactacacgacagctgtataagccattgtttgcattcattgtgatcaaggaacagctgtactatatcgaggattgtaaggactgatgtaataatgtgccattgtgcatcaattgagctttggatgttagcttcacaccttcacccatgttgctgcacagcagtcaatcatatttgttaatttactgttgcagtcagatgaggtttcttcccattgaatcttaagggagaaagcctggcccaatatatatcacaagacttgaataactctttcatcagcatttactctgattcgcttttgctgtattgatgcttcaaactagagagagaatcataacatcatgctattcttctgttgtaccccggtttattagttccagtgttcatgtatcctgtcagtttttgttgctcttaacatgttattctgtgactggtaatttgatttcaatgtctttaatatatggcttttgttgatacttcaaagttcaaagtagataaattatgtttgatttattggtgcgcttgccaatacttctggtctgtgcattgatgtatttgcaggggacaaatacctgaagccatatataatcccggtccctgaggtcacagttgtcgctcgtgcaaaagacgatgattgccttattcttgcaagtgatggcctttgggatgtaatgtcgaacgaagaggtctgtgatgctgctcgcaagaggatattactatggcacaagaagaatgcggccaccgcatcaacgtcatcggcccaaataagcggtgattcttcagatccggctgctcaagcagctgccgactacttgtccaagcttgccctacagaaggggagcaaggacaacatcactgtcgttgtaattgacctcaaggcacataggaagttcaagagcaaagcatgacattgcctccatgaacaataacaatagtttataggaagctagaaatgtgggaaatccaagacaatttatttagctgctgcaccggtacaatttgtttagctgctgttcagtactggtgctgctgcagctgcagctgcttctttgccctcgccatttatttctgccgagggatgtactactagtatactgtatttttctacacggtacagactcccaaatctgattcagggtcgaggacataaggtggatctgggaattttggggtctctcaagacaagacagaaaacataacaaaatctgtagatgtaggtaggagtcctaggacagattgggtttctgcctctggcattaatcgtttttgttaaccggtaaagatactgctacttgcaattgctgtttcatatatactcctatatctttcttgtgccttcccttgtgatcaatacctggtgtttctcccttgttcaagacggtcaatgtacttgccgattttggagtacttgaaatacagagaaaataatgtctgaacctgaacttgtacactggtgagctgaagagaaaccggactctagttaactttagtttgcagaagtgtaggagaccaagaccagtgacgaaactaggatctgagtattaggggagtcaacttatcaaatgattatgataaaaaaatagtagtataaaaatatacgaaaatttaaaggtttttcatagataatatatcatatcaatgtaaagaaaatgataatacttaataggtatatgatacagctacaatgtatatatttatttatttcaatcatgagctgcaattaggagtccaatcacctcaagttagcatgtaagtttttagagagatatcttatacgattgctcatgcatttccaaaaaacgaacttaaaacctgactcaaatacatatctgtatttccaaaaacgaacaaacttaaaaaccgactcatacacggatacacggatgacgtaccaaagtaccggaaaaaacatcttcaatttttataatagtagatattttaaagagtaaattgcagtttgggtcatgtatttttacccttgttgcagcttggacaaggtcttagccatgatttccactttgcaccacataaccttgccatttgtttcactctgcaccacccctcatcttctccgagtcaggcagccttattatctctctcccaacctgttcttgttatgctatcaccgatcaggaggaggtagaagtacgacagttttccaaactccaatcaccctatccaatctggagggaagagtagcaaatcatcacaggttcagcaccggtacaggtgctcaagctgagatgaagtgcatggtgataatgctgaagtcattgctggtgcctgagctcgagcgtgggagcagtactacaacacttcgtcagggactagaataggcaaagtaattggggtcgagtatgcaggttgctttcaccagagagctcaatcccaaccacacatggggaagatgaagactttagtatgctaatgactaaattaaagggtgaatagccaaagtggtccttcaagttttatctgaggctcaatttagtccttgatgtttcaatctatccttattagtccttcaagtttttattttagttcaaacttatccttgaaccaacaactctcttgataaatgacacttatatccccatcattcacatatataaaacaaaaattacatgcttgattttatttatagataatgcatagtaaattatgtaaaacgaaaataaattatgtactatacgatagcaattgcttaagtttcatgtgcacatgttgaaataatgggaagtacatctgcaatgttgtttattcatcttggtttcctcttttctagtatatagtatacaaattaagggcaaaagggatattttctaatagaaatattgactagaaatagccatatggcatattaagtgggcccaaggatgatttcaagccaaaataaatatttagaggagctatgtggacaaaatgaaacgtgaaggaccaaattgagccttcggtaaaacttgagggactaaattagctattcaccctaaattaaactaatcgtatcaccttacctaacatgctagttttagtatcaataaagggaggacatggtagtgctcaagctcacgtacagtggcttcagctcaatgaagaagagaagagaggggagatggaggaaacaccggcccaatctgaaacttgtgtaaaattatttagtccaaagtgaaaatattactttgtccctagtccaatgtgtaactatggtaataaaaggtagtccaatgtgcaattcactctattttaaattatgatacagaaagatatatggttattagatatttttattttagataatacttttgccggtcaaaatttattaagaaagaaggcatcagtttataaagccacaccaacaaagctgttgctattgttgtgtgcgtgtttttttttgggggggggggatgggggaggcctcccctatccatagtccatgctagtttgctagagctctaaatttgatacaatgtcagaattttagaggtgggaaatatatctttatcctttgtatgtattttgtatagcaaatccacccatcctgttcttaaaacaatcaaaatcaagtagttcttgatttggctccaactctatggataaagatctagagcaagtaagctgtagacaagtcatgattatctaacctgatgcaagtgagattggttatggttgggcctgttcggctgtctatttgcggtggttgcagctgcggctgcgccgtgtgtgtgcggcactgttagtgccggctgcgccacaaccacagcacaggcagccaaacaggtccattattgcgtgatacgaactctaaagtctctaatacactcaaacaaagctttttttaaaaaaaagtgagttaaaaattgatgggtgaagtttatattagtatgattcatattgaaaaaaaaaattataaaaacgaagaggaagcggaggcgtagtaagaaacgtaggggtgaaaacggagcggatattatccgatccgatccgctctgaatctgtccgatgtgaggatatggtaaggatttttagatatctggccggatgcggatgcggtatgaacgatatccgacggatgcggattatccgatattttaatcggattatccgatgtactgtttggcggataatccgcaaatttcagaccacacaacaactttcaggcccacctagctagcccaatagcccaacccggcctaatctaatcctctcctcatcccccagatccgtctctggctctctctgtgtgccgtccctcagttgtcagtcgaggagtcggagagagtagcgcggcggcacggcacgacggcgaccctgcgcggtggccgctccttcccaacacgcgccaggccgatcctcctccccaacacgcgccagccgttcctcctcggctagcgccaccgccggctgcaggaggctgctagcgccgccgctcactgttgtgtgttttgtgctgtacacctgtactactactgctgtattcctgtatgcagtatgctgcgtgtagcactgcataggggtgctctactgctctatgcttgctgttgttgtatgcttgtatggcttgcctcatgccgatgacttttatttttacattttaagctatgcagtaaccggtgaactattgaactgaacacttatattatgtttttgatggatcgtggatatatcttggattattttgactagtgaactattgaaccgaacacttattacttatagttatactattgctattgaactgaacgcaatgaactaatgatgttttgccatcgtattggggcaaattgtattgccgccctcttgatgtatggattgaatacaaacttgacatccgataactttttgtccgtttctgaaccgagttcgcaccgaatccgacgtccgaaataatccgctccgcatccgcatccatacgtcatccgcatccgcttaaaaaatatggtttaggatatagtatagctattattcatccgaatccgttccgttttcaccaataaagaaacgcatcctgttttggttttggttgtattgtggagcagtacagcagtatcccgtttcgtttgggcttttggtgggggttgggtgggtttcccgtctccttccgattgctgagtagcattagcaaaggagcaaaggaaaggaacctcgatctccatctccatctccgcccccaaaccctaacacacacacgccgactctccaaaccctacacccccccaacccccaaccccgccgatccccccgctcgccgccgatgggtcgcaagaagaacgtcgccatcgatgacgatgagtactccttcccgcaggaggacgccgcccccgcccccgccgccgacaaggacaagcccatcaagaagggcggcggcaagaagggcaagaagggcgccaaggccgccctgcccgacgacgacgactacgagccccccgcgcccccgcccccgcccggggacgacgacgacgacgaggagcccatcaacctcgtcttgaccggtaagaagaagaagaagaagggcggcggcggcgccgtgagctccttcagcgccttcgacgccctcgcggccgacgaggaccagggagaagacgacgacgaggcccccgcccctgcccccgcccccgtcgagcccgatgccgccgccaaatcagacgccgaggacgacgacctcgatttcgacttcagcaaagccaagaagaagaaaaagaagaaggacaagggagctcgcccagtccctctggaacacgacgacctcgacctagataagcctgccccgccgcccccagccgccgctgctgatgaggcagacgacgacgaggctgctgcagctgcagcttccaaaaagcctcagaagaagaagaaaaagaagggcggctttactgtggacaatgaggacattgacaagctcctcgccgagatcgacgatacttctcctcccaccgaagaggctgagccggtggaagaggtgcctgcccctgatgcagatgatgccttaggaaagaaatcaaagaagaagaaaaagaagggaggctttaccgtcgatgatgaggacgtagacaagatcctcgcagagtttgaggaccagccacctcctgtcgacgatcctgagcctgagcctgaggcggtgaaagatgtgggtaatgtggccgcctcaaccagtgtggatgatgcggaaggcaagaaatcgaagaagaaaaaaaagaagagtggaaggacagctcaggaagaggaggatttggataagcttctcgctgagcttggtgagggcccaacgccagcagaaaaggagaaggaggttctgccccaggcgccacctgctgcggcaatggtgaaggaagatactgaaaccgcagaggatggtaaggctggggaaggagaggtggaatctgctgcagccaagaagaagaagaagaagaaggaaaaggagaaggagaagaaggcagcagctaaggaggcagatgctaagaaagaagaggaaaaggctgtagaagctcctaaagggaaggttgacatgaagaagctcccgaagcacgtgcgggagatgcaggaggcacttgccaggaggcaggaagctgaggaacggaagaagcgtgaggaggaagaacgattgaggaaagaggaggaggagcgattgaagaaagaggaggaggagaggaaagctgaggaagcaaagaggaggaagaaggagagagaaaaggagaagttgctgaagaagaagcaggagggtaagctcttgactgggaagcagaaggaggaagcaaagaggttagaagcaatgaggagacaattccttgagcagagtgaacttcaagtagccgatggtgctgtccctgagacaaagaagaggcctatatatgattccaagaagaaaaaaggtcaacagaagactctggagactgcaaaggtagttgaagaacaaccacaagaagttaacgaaactatcaatgacgaggaagaatatgtgttagtggatcaggaatctcagttgcaagtggaggaatctgagaaaaccgaacctgatcaggatgtcgaagaattgaaaccagaagaggaggaagatgaagatgaatgggatgcaaagagctgggatgatatagatgtcaatttgcctaagacaagtgcctttgaggaggaagaggcaaaccctgtcgccaagaaggttgctgaacctgttcagaagcaggaaaattctaaagcacaatctacagtggctactgtaaaaaaggttgcaaactccaataaaggtgaaacggaagatggcgaatccagtagtgcaaatgctaggaggaatagaggcgcttcaaagaaaggacctattaaagaggatgagactaagaatggcagtgaccttcgttcaccaatttgttgcatccttggtcatgtcgatactggtaagacaaaactgctagactgtattagacggaccaatgtacaagaaggagaagctggaggtattacccaacagattggggctacgtacttcccaactgaaaatattagagagagaacaaaagagcttaaagctgatgccacacttaaggttccaggattgcttgttattgacactcctggtcacgagtcgttcagtaatctgcgttctagaggttcaagtttgtgtgacattgctattttggttgttgacattatgcacggtcttgaacctcaaacaattgaatccctgaatctcttgaagagccgtgatgcagtttttatcgttgccttaaataaggtatattgctttggagtttttttttgccctttgacctcatcttttcttacagtctattaatgtctcaattgttttttggcttaatctctatgaaggttgatcgtctttatggctggaaaaagtgtacaaatgcccctattgggaaggctttgaggcagcaaaatgaagatgttaagagggagttcaatatgaggcttactgatgtgcgtaaatttccatcttgatttttctttaaagaaatgacttagcactagcagttgtatttatacaatcacacatatatgcagattgtgacacaattcaagatgcaaggtgtgaatactgctttgtactacaagaacaaggagatggaagatacatataacatagtgcctaccagtgcaataaggtatgatctacagctgaattaattgattcttcattcaactatgatattattggcatctttgcctcaacacatagttcacttctctcaacagtggtgaaggcattcctgatctgcttcttctgttggtgcaatgggcacaaaagacgatggaagaaagacttactttcgttgatgaagtccaggtacggtgcataaatttacttgtcattataaaagcatgcattcttatctcgtttctgtttcagtgtaccgtgctggaagtcaaggttgttgaaggtcatggtactacagttgatgttgtgttggtcaacggtatactccatgaaggagatcaaatagttgtgtgtgggatgcaggtaagagacgtttttctttataaatgcagtttttcaacaaacacagcttattgaagttgccgcctgctcttgttctatgtttatgtagggacccattgtgacaacagttagagctttgttgacaccacacccaatgagggagcttcgagttaaggtgcgtgcccataatagtg

SEQ ID NO: 67927 - DNA, 39632 bp, Oryza sativa
gccgccgctgcccaccgtcgccttagtttccgccgcccggtactgtctctgcttgtaactaaccatatactccactcgatcagatgcttcaatctccataattcctcctcttttcgcctttacatcataatatatgtgtttgttgcattccattagattggattggaaaaccattccattcgacttgtatttcttttgctgcttcattacatcaatcgatcgatcgatcgtcggttgggaattaggccatccactccatatatctatcaccatctcttctccacttgttcatccatttatgctgtctccacttcccttctcttgtacccatgcaattcaaatcatacttcattttcaagcacttctctctctctctccctctctctcttttccaaattattattattattattattattattattattattattattattattattattattttcattcattcttacctgttaagcacgcctccttaataattaaaagaggtcttgaggtacccatgtaaacttttccctttttttttaaaaaaaaaggatccttgctagcttgttatgtcggcaacgcaaagctatttcgtgtcacctcagctgcttcaaacttcaatttgcattcataccctccagtccgaccggaatatatgcaaaagcaagctgcttttcattatactgcagctgcagcattgcctttcacataatcacattgcttgcttcattgattgtattcatgcgtccaatacgcgtctaataatccaatgcggtcactacctttctcgctacagctagctagctgtcacaccaccaccaaagtctctttccgtgcgctctggcttcataccattggagtccacgtttcctgctcgcacttgataatgtgtcactgtcagatttactagtataatactggtctacatttggggtgctggcactgccaactcccattttttaaagctcaaaaaatccattcttttttctgaaataagattttcttttttttcttggtttgcattagcagtatatatgcacacacactcattcctacactaacaatcttactacatcatatcattaacacttgcaggcctgtctagagggcagccatggccactgtttctgacatcggcctctccgcggctatcaacgtctcgatggccgttgcattcttgctggtctttgcttttctacgattacagcccatcaacgatagggtttactttccaaaatggtacctcagaggaatgagagacagccctgtttcctctggtgctgcagtgcaaaaggttgtcaatttaaacatgagatcatacttgaaatttttaagttggatgccggctgctctcaagatgccagaggatgagttgatcaatcatgcaggccttgattccgctgtctatctacggatatacctaacagggtctgttcctttccatcttttatgtttctgctcttctcaattgttccttgttgccatctcattttttgttccaagtcatacttgtggaaataatgccaattagttaatgatacagtgagcatttaatccaatgggtaaaggcctgcggcttcactttgttattgtttctaaacaataagagatgctaatgaagaaatgatgagcaaatttatcactctgcatttttcccatgttaatttaaacctgagaatatgaatcgtatcattgttgtcaaaatctatttgtgcctaacttcaattatgcctgtgtattgatatacctgtattgaccttttacaggatcaagatattcgttccaatatcaattttagcttcgcttgttctgttccctgtgaactggacaaatgacaccctagacagcatgaaggtagtccacagtaaaattgacaaactttcaatatcaaacataccttatgggtcaaacaggtaagcctccataaatcatttgatatctggatgcggtgtattttgatgagttgtgtagagataaatgtttctttttttggtctggttcaatataaattgtacgtaaaacatcaataagattgcccattggtccaccaattacacaaacaaaatctgtatagtgattcattttacatgcagattcaacctttttaagttttgggcggcacctgaaatccaaccacttttacttatcttcatgctgattatgcacatgtacttggtacaatttttaggagcattatcatcttatggttttgggtgatttgataaatatgccacttgcctgtgtgactgtctaatttagtaaggtacaagcactctattttggcctgtgtgcttgggacttagcagctgccctgccaagttcaatattgggtggcagttgctctggttgaaaataaattcatccacactgaacttctaggtttcatttattaatttctgttgatgctagcacatgtctttgctgttcatgatgaacattccatctgttttacaggtttgttactcacttggttatggcttatgctgtcacgttttggacctgctatgtactgttccgagagtatgagataattacaacgatgagattgcggtttcttgcttcagagaaacggcgaccagaccagtttacagtatgatcttgtcaactttgcaaatcccctctctatttagtaccaacatgtttacattggatccacaagaagggtaaaaaattgtaatattaatggactgaaactattcaccactggaaatagtctaagagattgtggctaagcattttgtctctgagcaccctgatactcactttgcactgacttggtttatattatctaaagcaatgttgtagacgggaatggtttcatatctcaattgaataaacacgatgagttaatttccttctggttggtttgttgaatgcacctcaaatgatttattttaggttcttgtgcggaatatacctccagatcctgatgaatcaattagtgagctcgtggagcatttcttccttgttaatcatcctgatcattatctaagacaccaggtaatctttggtaaaaatttgtggataactaagtcagatgtagttctgttgcttttctcttctgggggtttcaacaggtcatcatctgcttaggtaggagctgtgtttctagttatgctgattggcctaatgcaaatagattttttttctactcaacagaacccccttcatatattatccttttcccacaaattattgatggtttcaaatgaacctaatattaatgtttgctagtttcatgttgagattttttcccccagattctgagaatagtccacataatagcctacccacagattatttggatattaatacataaatattttggttttgccaagtaacaggaaagttatgatctcttggttatctagattttcatttaaataatcatattcatatgttaaagggtctaaaaactgtctctctgtgctaacacttcacagtgctaattgctgaatgagatttagaagggtcatatccaaatttgtgtatcatatgcacttgggttttctaccctgacttcattgatttttttattcttccttatactaattactgtatttattccgtcctttttctggccgattgtctatatctataggtggtttacaatgcaaataaacttgctgatctggttgagaagaagaagaaactgcaaaattggcttgattactaccagctcaagtatgaaagaaatccatcaaaaaggcccaccactaaggttagtctgccatatggaccttgatcaatttatttttcatttcaattataatattacattaggatcttttttctttttaattctctgtccccctgttggatttttgttccagactggctttcttggctgttttggttccgaggtggatgccattgaatactacaaagcagagattgagaagattgggaaagaagtaagttgtactccctccgtaccgtaatataagggattttgactttttgcttgcactgtttgaccactcgtcttattcaaaaaatttgtgcaaatataaaaaacgaaaagttgtgcttaaagtactttggataataaagcaagtcacaaataaaataaataataattccaatttttttttaataagacgagtggcatttttgtctattaattccaaataaataataatcccttatattacgggacggagggagtagtatttttgtctatataatcattggaccattcggcattgtccattttttctgattgagttgtatcattctatgaacatgggtttgcacaatcgattcttttttaggattagtattatgtctaagcatcacacattcacaccttgtgggagtttaatttgtttacagctaacagtcagataacaataaattcatgtgtaacaacatgcaggaagctgatgagcgtcaaaagatcatgaaggatccccagtcagctgttccagcagcctttgtttcatttcgttcacggtggggggctgctgtttgtgctcagacacagcaaaccagtaatccaacagtctggataactgaatgggctccagaacctcgtgatgtctactggaataatctatccattccatttgtgtccctcacagttaggaggctgatagttgctgtggcattcttcttcctcaactttttttatgtcattccaatagcattcgtgcaatctcttgcaagccttgaaggaatagaaaaggcgcttccatttctgaaacccttaatcaaaatgtaagtgtttcttcatgtgttgattatttatactattattgcatttccatgatttattcagcgtgtaattaatttgggtacattagacatatggttatcttctgctattcttttgaaatgccctgataaatcttgttgactattgtgcagtgatgtcatcaaatcattcatccaaggttttcttccaggaattgctttgaaggtcttccttatattgcttccaactatactgatgtttatgtctaagtttgaaggattaatatcacagtcatcactggagcgaagatctgcatctaaatattatatcttcttgttcttcaatgtatttttgggaagcatcgttacaggatctgctttagatcagcttaaggcatacattcatcagtcggcaaatgagtaagtactcctatgccgccaactctaccgacttgaaagtttagagattatatacatgcttggttgttcatttgagtcttcccatcttttaataggatgcagtttatttttcctgcttcgcggatctctgtttgttgacaattgtatttttagcaattaattatgggagaacacagaaaaatctggttcttgtcggagatcactttgttcatgccggctgtcaaatagataccaagttcttaattctgttttgattagtactgtggattatatattcaggagctacactttgtttgaatatttagacacataggctaaatcaaatatgaaaaaatgggaccaatctaggaaggactagattgattttgaattaaggagggggtgaggctcgaacccggaccggctagctcgcagcttgcgttgctagccgggaaggccccgggcctttctccttaatcaaatatgtcaagcagtgaattatgatatacattcttattaaataaaacatgtgctggtggttcaaataacatcatgaactcgtgatatattggttcttaagctatcttagaaatagataaattcttttggttacagtgagttagacataaatagcaacataatgatgcttaataggcaaaaggggggccatttgttgataggctaactctgtagatgcagagattttggcatcaaggcaaacgccaaagcatgggcctcagatacttacctcgtggaaactcagatcgtatttatgctttcacgtaccgatatttatgtcctgctatttgtctgtttattttacaactcattcttcacattctctgattgaaaccaaatgatcattacaatttgcagcaagtctaaattagttcttttgcagaataccgagaaccatcggtgtagccattccaatgagggcgacttttttcataacatatgtaatggttgacggttggactggtgtagctggtgaaatattgagattgagggcacttataatcttccatttgaaaaactttttcttggtgaagactgaaaaggacagagaagaggcaatggatcctggtagtatctgttttgattggtgtgaaccacgtatacagctatatttcttacttggccttgtctatgctgtggtgacaccgttattgcttcctttcatattggtattcttcgggctggcatatgttgtctaccgccaccaggtaaggaccactgcagctacttgcgagaattttattgtgttaagttttaagtgattatgatgaactactaaattagcttgctttgtatgactatttagaccatttttccctggtttattggaaataaacttcattactgatcggcacaaacagtttccactcatgatcagtgttgctatgctgttgtgcatgtgttaagggtatgtaataatggctaagatttactaagaatatgtgcttggatatattgttttgagttcgccaacacaagggagtatgctattgtgatagatggacagttatgctagctaaaagttacatgcaataaatctatcagaatggtcatgcaactaaggggctgttcagctgcctgggatgtgcaagaacagttccccaagcacgaaaatagcagcgggcagcagcttggcctgccgaacagcccgctaagatacttccattatcatcaactgcaaagcaatttatatgaaactgcagtgatgcaattaatctacatatgattcctaattttgcgatattaattttatgatttagttgtgtatatagtgttttggtatgcttacttggttgcacatttctttgaagataataaatgtctacaatcaacaatacgagagtggtgcacagttttggccgagtgtgcacgggcgcataatcattgcattgatcgtatcacagctacttcttattggactgttgagtacaaaaggtttcgaggagacgacaccagttcttgttgttcttcctgtgttgacgttttggttttacaagtactgcaagaaccggtttgagcctgcatttgtgaggaacccactacaggtaatgtgtgacaggaagttttgtatactgaaatgtttgttttggtttggtggtaagagtgaaatttgttggatgtgcaggaagcgatgaggaaagacaccctggaacgggcaagggagccaaccttcgatctgaaagcgtacctggccaatgcgtacctgcacccggtgttcaaaggcagggaggaggaggacaatatgtcaatatccgaggatgtcgggatggaggaggtgatcgtgccgaccaagcgtcaatctcgccggaacactcccgcccagagcaagtacgaaggctccgacacgctctctcttcctgaaactgtacacgaacgatagagctacgggaatatcagggtgactactagcttgttgaattctttatagtctgtacagatagattgatacatacctactcctacggggatgttggcagatagctttgctgtacactttacagcacgagaggtatatggagggattgttcaacacccacagactgatgattggattgccaatattatgatttctttgttggtttccaactgcaactagctgtagtagtaaattagtactaccactgtaataatataaaccagctagctagtagcaagtttttgtcagtgcaagtgtgcaaccgcgcaaggttgttaacagtaaaaggagtcaagccggggaagggacgggagatgcatgaacggctttgctttgcaagccaagaatattcattccccactgactgcctgctttgttgggaacatcatgcatctctcattattatatcttcatatctcctctgctatcttctaaattctaaattccgaagtgcgtgtgcgctcatatctggtgtcatttcgagagctctcctctcctctcctctccagaaaagcacaaccaaaacccttcatatgtaggactgctacctgcactgcatttcatcctgctgctgcttgcaatggcggtacaaaagcgatggtgatgcatgtcaccatctccgagtcatcaccacactactgtcgtgcaagtaaccatcaatctccatatcttcctcagtagccgcaaatatatatactccaaaaatacataaattatgtccttggccccaaaacaacatagattcccaattttcattagcattaactttgggtcattggcattatactccttccaaagttttaggtccaataaatgctgagtcttatagttttcagtccaatcacacaagtattgttttcggcccaaaatcacatgtatattgatcttggtatcaaattttcatgcttattaaacatgagccccccaaaagtatctgattgtatttttcagctcgtaatttcagtagtgtcaacctcgagccaaaaaattcataaaacaatagcctttgcttcaaattttcatgaataacttgagcccaaaacgcttgaatatttgcatttcggctagaaaatgaacggcgtttagcttttagccaaaaatttcatgagtggtaacattgaggaaaaaacacatgaatattagcctcctacccaaaattttcatgataattaaccctgggcccaaaaaattgtgtgaattttagcctccggcctaattttttttttgagtattaaacttggggggtttgaaaacacatgaatactagccttcttccgaaaatgcaatggaattcaaattctagtggctatgaacattatgcacacacacggatgcaatttttatggggtttcatgaagctagtgatttgccatggtcttcgtctctttgagaatctattaggggcaaatttgtgagtgtgtgtgcatgtgtagtagtgcatgtatcttccgtgtaatccaaaaaaattctccattattaaccttggcaccaagatacacttgactggcaagggtatgtggtttcaacctcaacaggtaacatgctcatattattttcttaaaaggtaattggagaaacgtctctctaaatctcgttttttaaatcttggcaccaacagtgcataaattctctcttttggcccgaaacacatgaatattagattttgattcaagatttcaggagtactaacttctgaccaaaattgaatgaattttagcctttgccccaaagcacatgagtattgtccttaggcttaacattgcatgagtattatccttggataaaaaaggaatgaaggaattttagctttcggtcctaaatttcataaatacttaccttggcacgaaaatgcatgaatattagtaaatacttttgccccaaatcttatgagtactaatgtgggccgaaacacatgaacaacggcgtccaacaacgacaacgacaggatcgaagcttttcccgtcaacgatgacgagggcgagcatcttcttcatcagtacagatgctaccaacgatgctttggacgacgaaaaagaagcagcaagaggcaaagctgtttgggaatcgccaacttccgcgagcatcttgctcaggattctaccatcatacatgcagagcagagaagaatgagatcgatcatctgtacttgaactgggaggagcagtgcgcagacgtacgcccaacccagctgatcgatcagccgatccatccatccattatatgacgacgacgcccaagtacacttaacaatggtccagtacctttaatactctactgagcatacaccagtgcaaaataggctagaccaccgtatcctccctgtatacacataacagcacaggcagtgcagaataaagccagcttcaaaatgtctatgccacctatcaagcatctataatcagatcaaatgactagaaataggcctgtgcgtgccaacataagtccagtcccgctttgtgtttcatcaagttttcaaaccaaaccattttgacattaactctcatccatgggatcatttccaccgcctctctgggactctgaatccttgtctccagctcctgaagcttttgccacggagtcttcaagagcctccaggaacgaagctactgtgaatttatctgtgccacaaagacacccatcaaataagttttccgaaaacatctcactccatctccagattttacaaatactaaataaatcattttcagacttgaccaactagcatcaaggatgtttgtcgtctagcagaaaaacaacgctcatattttgggcaggggtcacctccataagccattgaaagtaaaagctagactagcaaggtaaatatcatggtcattgaggtatcagttgcagaatttgtgttttttcaatacataaataaaagtttcagccacatgcacaaattatctaccgtgtatttgcgaatgaaaaaaaaaaggagcctgctacatgctgcatttaactttactgttcagtgcaaataaacgagaaatttggttgtcaatataagtgaagatgagaaggattacatttactagggtcaactccaaattgtgctagatctatttgcccagtccgcagcacctgccatacatgcaaatatcagaataaaaataacatttgaagcattgtgtcacgattcaccaagatgttcaatagaaagatgaattactaacatgggtaaacgcttctacttgctgccgcaaaggaggactttgcaatagttcaagaatatcaccagcagtccatgggccctggaattaagcaagcacaataaaatgagtggaagagtcaattgaagtaagaaccaggatgacaaatacaaagttacaaacctctggaagatatgatgccaactgttcaatgggcaaagtttccatgagtggtaacaccaaatcaggcttcaagatgtctcctaatcctaatcctgttacagcggttaaaagtactgatacatacagcaaatcattgaagaaaagtgaatcaatagagtattgtactgtaattaccagcatcagggtctgccacagcatctgaaattacaaggcgaatgcaagtaaaataaaatgagaaggtggtcaaatggaagaacatttcaaaagtgacatgatttttcagctgatacctgatggctgtatagcactcagtattctctgcaggtcttccaaccgtactggcccagcagcagatgtcacctcaccagctaaatcagcagtcatgctctgatcaactaaattcccagctctgatgagaagaaagaaggaaacaaaggggttagaattattaaatggtcattaattcattatacccaaaactcaacacgcatgcatgaatgccatatcaggaacaaattgaggccacactttcatatatatttagcaggaaaaatatcagtgtgaaaataggaagaatgaaaggcagtgcacaataaactcagctagacatagatagtgttaacttatgcatgaaattggagtgaatatacttgtggtttataatgaacgtgcatccatctgttactctgacggccccattgaaaaataaagattgcaatgcaaacgtctaggtttttctgtgctgcacattgcatcttgcagttcgttaaaattacctggaggagatgtcatcatcagctgtgtcttcatgtgacatttcagcttcaatagaaactgcctcaccatctgcacgcccatacaacttaagacacaagaaaaatgagcgcataattaagagttgagatcccaacgttcagcatacctaatggtcggtttatgtaggcattaacttggcgacatatttgtgagtcgtcatcagcacttggctcctgcacagtaaagagcaaaacacaagtaaattttagctggtggaaggacttctgtggttttcaaacagatacacacacacacactcaactgacctgcatccagaagaagaatttcctgctatcgtgcctgaacttcaagatgtaaacccttccagaagattgtgttacctgattaagttgaattacaatcatcaatgaagcccaagaggttcactaagatggtcttgcagaagaaaataaacttgaacctatattcaataccttctcaaagacagcctcctcagggaagacaatttgatcctgtgaaaagggaatcaaggatatacaaaagtacgataatttcctaggatatacacaatggaaatcaggagaaacagacacagccaagttcaaagttcaaacatacgagtcatacaagtacagtatttgcagattaaaaaatgagtgcacgatgactactaactactatctatgctcgagaggatacaacttcaactagattctgtccacgatcaagccattgaaaatgaaccaagccttcttcaccctacaaacaagtggatatgttaactgcactgcaaatccccataaaatatgagaatgcaaatggcttataagttatactggacaaatagaagtacagaacttcaattcaagataagtatgacttttagcatgcatacccttcctatgcgaacaagacccttgcgtgtgtctgggatcactcgtgttccatcaagggacatcttacccgcacgaaactcgcacatgatatcctgacaaacacatgagagattgtttttaaatagaagctcaacaccttgttatatcatagcagagataaatgagatggcaaaaataaatatataggtcattaagattctgaataagcacaagatcttaatttgagatagatcaataagcaccatgcactgcaacagaaaattaactcagttcactgaactactgaaagctcactatacacaacctacatttcttatcagaagattttcttgctacaaattgctagctaaatattttggccttttagagtgcaggcaaagattaacagaagttctatcccagttttctgaaaagaactaaaacataaagaaacaaactgcctagtatacaaaagagacatctatgtttttttttctttttttgtatcatgtacgatgaaaaactggtccaaacatggttcaggcctttgtacatattacacacaaaacagcccattaacatggtactaccaatgccattttctgtcaggctttctttaaccagctggctcacttgtcatacactcaattacttggcaagatttgcgaatagttgagaatttgtccaccacaaaagacaacctcaattatccttttggcaaagtgttgataccaaccaaacagcccataatgtcattttagatggaacttgcagcagctaaatcatgatctcaaatcaacagcaaccgatcatcgcagttaaacactaacaggaaattcggtatttgaaaaaaccaatacttgcagaaacactagaaggcaaagtgaggagtttacctgtaggggctctgtgctctccattgattaaagagtggctaccacaaggtgcaggccctaaaacaggcagtaaaaaggacagtaaagtattggacatagaacaaaatcaagcaagtgtgaagtataataggttatcagtaactagttgtcagaagtgtactgcatgccaattgagatgaacaaaaggtactgtagtctgaaagtagtagctgcctttagaactttgtgcatatgagaatgaaaacattatgcgcatgtgttggtaaaatacagaaaaatgcacttgtgaaggattaaagaagactagatctataaatttatgtacactagagtctttgttgtgcagtatttgcatcttcaagtagcacgtaggcaactgacaaattagtatttacataaagaaattcctgcgtctgcgtgcttgtagatttgtaatttgtaaggtggtttctttgggctttataagatattattactgcattacttttgtgctgctgtagtgttatttcatagtggagaaccaacgtgacccaaaaaacggcgaagactagccaaaaaccctagcagctagcaagtcgcattaacataaaactcgtcaatgattagcttgtttgcaggggctagttccttacaggatggtgcagtgttttatgtttgtttatttttttttcttacatgtagatgtaagcaaggagagcaaaataggtgggtgatctataagattttgctggtaaggacccaagaaaaacatgagcaataaaatcgattggagcagccgtcctagaaagagagatttggattggagagaggaacaggtagggcaagggagaagaaaatatcttagaaacaatggagcaagagttggtcaccactcagtcactcaccaacaagtgggggattacggaggagggctggacgtcgtcgtcgtcgtcggcggcggcggcgggacgggaggagagggattctccgacgcgatgtgatgtgatttggggaggcgatgacgacgggagggggagcagagaaggatctctcatggtgggctgggcttctcttagctgggctggagaggcccgcccacgcatttgatggcccatataaaagcccgctcggcaactccaaagacgaagttgagctagggttttcaatctctttcttctctccaaaacacaaatcgtcgccgcatcccctcaactccggcgatccccttggcggcggcggcggcttccccaatcaccccactccacctgaactacaggatggcgtccgccggcccggggctcgaatcgctcgtcgaccgtgagttcatccctcttttttttttatctcatctcacccagctacccaagattctcctcctcctactattactagtgatagatgatgttttttttttctctccagagatcatatccgtcatcacaaacgatggccgcaacattgtggtgagccccttgtttgatctactcgtacaccttttttgttttttttggctctcgctaatactcactcgaattgccctgcctccgcttcgtcaggggacactcagaggattcgatcaagccaccaacatcatcctcgatgagtcccatgagagggtctattctaccagggtagggttgctcccaactctttctacgcttctttcatgctatcttgcaaaccttcaattaattttacagcaatatcaatatttcactaagctagtactatatgccctgataatccggcaacacacactttacttccatcttcataaagttatgtttacaaggcggtcatacttacagttagttactctgctaaatttttctgcgtttagaatctctaccacagtctgtttggcattttccatagagttgcctgtttgctaaggctacaagttcagccacacaatttttttttgttattccagtatgtccttgttaattgtgaccttctccctggtttgctgtcaaatgctctcattggttcactagtgcagaattctgcaatcagcaataagtttctctcatggtgcttgaaagttagttgccaacatgtattacacagtaccctttatggctaaacacagattgttttcaaagatggctctctttcatgatggttataaatgtcatcatgaagtaatgagttcatattgttgactgttcgtatctatcatcatgtctactgtcagtatgaactgaagttcgtttcctgcaaaataatgagtttatactgtaacatgttttagctgaatttgtcataacagcacctttttcttcaaggattggttcgattaattctaccttgtgcacgttcaatttttcagaagtcatattattttttgtcttcaatagttaggtattggaatgtctttgttctttatggtgcagagttgttgttctaacaatttgcaggcaatgttgactatgaatagttatatgtctcgtatcatgcacctctctattgaatatgggatatgccttcttaaggactaggggccaatgcctttaaattgtcatgcttttagtttgtggcatgtgctgttagtagtacagttgaaattttgagtagtgatgagagaaatgtgttgtacctgcaggagggagtgcaacagcttgttcttgggttgtacatcataaggggcgacaacatgtaagctatttcctcaattgtcgtttgagctgtttattgcttattaattacctgcatggaggtcgtttatggatgtgttattttgtttggtggtgtgcctaactgaagttgaatccgtgggtgatgcatatttacagcagcgtggtgggggaggtggatgaagaactggatgcgaggctggatctatcgaatctgagagcgcacccgctgaagcccgtgatccactaatggaaacgaatgaatgatgtactactactagtagtaagctaaacctaaatgtagtgttgtcccagaagttgtgaagaagtgggtgctagtgttgccgatgagtgaacttctttaacgtacgcgaggaagtccagcaagcggatgagcgagcatgaagaagaatgttatggttttatgtggtggtggatgggtgatgcatgtttgttgaacacgaacacagacacagtgactcagtgagtgaagatttggtttccattgtattgtattgtttgtgcagctgtatcaatgtacatgaatgaggaaggcaggcaggtcagttgttgaagagaagaagagcatattaggagtaggtgggaggggtagccggctggtgctgctcgtctttgaagtagttgcaggtgatgaagacgccgccgttgaagcactcggcgcgggcgcagccgatcctggtgaagttgggcctgaccatgaaggcgaagtggccgcactcgtggaagtcgacgccggcggtgcatttgccggtgtccctgtcgtagaggtgctcctcgtcgccccagcatcggacggcgtcggaagccctggcgttccagccgttcctcccgatgtagaggctctcggcgaagctgttgccggtggagtggcggatctggcagtcgccgcgcatggcgtcggaccaccgccgcgcctgcctcgccagcttgttatcccacctcatcggctgcagcccgtagcgcgcgcgcagctggttgtggccgtccacgaactcccgcggcatccccttgtaccaacccatcccattggtccacgacaccaaccaccccgctggtgccgatgctgatgcgtcgtcgttgaaccaacacatcgcgtcgcccacagacagcagcagaaaccaacacaatagcaatagtaatgggaggatcatcgcggcggcggccattgtctgccgtcgtcccgacgaggacgaggccgcccgccgatccgatccaatccaatagtgctaatgggcttcttatatcctagctcatcttttgccatttgcttttcttggatttgcctctcgctcttccaaccataaacaacgaactaataatgccaatgccaagtttaggcagtttttcttttcttctctgcatcgatcatatcatcatatcgcacggccactctgtccaaacaacaaagcctaacctccccgggcactggcagggcagctggctgggctctggctctaccagcttgctgcctgcctgccgtgtctcgtctgcttctacaactacggagcacctgtttgcaacggccaacggacggaaggaatgttttttttttttgtttggcttggattccatccatcctctccggcctgttcgtgtgtacgccttgtgctaggctaggctccacacacctggacattctactctcgatcgttcgcggtcgcggggccctcttctgttctgttgcgttaattgcggccgctttgctttcaattacttaatatctgttttaatttcttcgccacttgacatggttatgagtatgacagattaatatatgctatcttttttgtaagaaaaaccgttaatatatgctagctacgactgcatatatatgacagattatatacgtagtatatacttgtggttcgcaataacgaccagctagcttagctagcggatcaatcatacgacgttacgttacattatactagtacgtgatgatcaaagaatcatgcatgtcaagctcatatgtgctttgtatctactaccttacacttgctctgcttctttaaccggaaaagctgtatggctgctgaatgatttttgctcggaaaactaactatgccttacgctttcccttgctctgcttctttaattgggtcggagtgtgtgtacgtatatatgccgatatatatgatcgatatgatgcatccagccgcgcgctgtagaccaaactagctcgatcggattcaccctccgatcgggcgattgatcatgcaccaacagctaattataaggaaacaaaacagagataattagttatatactactccctccttcccaaaatgtttaacgttgactttttttaaatatgtttgactgttcgtattattaaaaacttttatgaaatgtgtaaaactatttgtatacataaaagtatatttaacaataaatcaaataatataaaaagaattaataattacttaaattttttaataagacaaacagtcaaatatttttaaaaaatagttaacggcgccaaatattttgggacagagagtagtatttagttactcctacctatacgttgttgttgatttcgagaggcgccgaccagccgctgatcgatcgagctacgtagctatctaggaattaatatacgacgaaagacaagttaccccatactgtatatgattatatatgaaatcaaatcaatcaattaactaattaattaaatgaagatgatgtgtatataaagacctacgtgtccggatgtatatataagtattccagtaagcaacatgcatgcatatcatccatataatgaaatcatgaatgaagatgtgtgcccctggcaccgtccatacgtaatactcgtacaattaacatagggtagtagcagtacatgcagtagcttatcttgtttattatctggacacacgatcgagtcatatatatatgtgcatccgaatgcgtgtggataacagctacctccaaatcccaatcacagtcacaatcagaatcgcatgtctttgatcgagtaggatcgatcacaacgaatggatatgtacgcatgcatcacctccatcccctgtctctcccgctctctttgaccattgcatatatatatatatcttcttcttttcttacatacatatataaataaaagaataaagattatatatatatatatatatagtaaatttgtttggtgctccatggtgtccgggcaccattgttgaaattgagtatatacccaattcaaatgagtatgaaactttttcaattacttaggtattaacattaactactttactaactagttcaaagcatgtttgtactgaatttgaacttgtttttgttagattttgattctaggtatatagcatccatacatataattagttaggtatgtaatcatggattgtgaaataaagttaaatttgagttgttttgttgataggtatagatatgaatcgaattattataactaggtatatactcacaatttaaaaattttgaaaaatttgagtgatttgtacattagataccatggtgcccgggcaccatggagcaccaaacaaatttaatatatatatatatatatatatatatatatatatatatatatatatatatatatatatatatatatatatatatatatatatatggagagagtgcatgcttgactgtcaacctagctatctagctacggatattatttagcctttgattgatatgatatataagaaaagccatatctagagtatttacactcgatcgagtatgtagctagggccgagtttagttacaaaatttttctttaaacttttaacttttctattacattaaaatttttctacacacacaaaattttaacttttccgtcacatcatttcaattttaatcaaacttttaattttaacgtaaactaaacaaatcctaacatcctagatagcgagccttgccaaatgacgtgtgtgcgcgcgggtggaattagctactgggggcggggcggggccggccgtcatacgaacgtggaagcgccagctagcacttgaattgcttgcttcctttaatttgtttgttttgttttgttttaggagcagaggaagttgaagtattttgtttgtttaattatggtgagagttaattttactttgggccatgatttattattaaagtttcactttagactaccctttgtccaatctttttactttaaactagataactttatctttattgcacaataaaccaccccaagcaacatcttcaatacttcaatgacttcaaggaaattgttacctacgtgccaacaaattttcatatatatatacataccatatatttgtcgaaagagacgctagacatcactagcgaaaagagttagggtggtccattatgtaataaagaaaaagttacctaatccaaagtaaaaagattatgtacagggtggttcaaagtaaaactttaacaataaaacatggcccaaagtgcaaatcactctgatgataatgactcttactatagtggaatggactaccgataccgaaagctaccagcacaacgtaggagtgcgtggtgtgcatcgcggccattaattatgtaagctatttagagtatgaccaattgttaccttcaattctaaatccaacccttttgacataggaggtcagcaccaaccttttagcgctcatctcaagcacaccttaacaaaataatatagacgttgttctctcattttcgtaatcttaagatatctcaagcataccttaataaatttgtagttgtctatattagaatatgtcacatctatattagagttgtatttatattaaaacgaaggaaatccatatattatagtagcagaccaataagatggtctagtggtttggggtagctgggcaactttattataggtcaagggtttgacaagggtagcaagagaaacattaattttataccactgtaatacaacaactactttcaaccttaatggaacaagtagatatatagtactccctccggtttcattttaattgttgttttagacaatgatacggtctacaaaatatacctttaacattatttttctattataatatacacaataaataaatgcatgtttatttttattatagtattttgaaagacaaatctatatatgttgttctactttctttaaactatatatttttgagacccggagggagtattaattaactaattaacacatggcgttgacctcctgctgacttagaaaatgtgcgagctcgatcggtacatatacgaagtatatatctcatgctggtattacgtacgtggcgttgatatatagtagtgccatcggacatgcatgatacggtcgtggtttattttgaaataagtttattatttagttttgaagatggcaatttggcgaaagctagttccggggagtaactactgtacatgaatttgggggcagacacatgttaggatagagataggaaggaaaaggaatagagcacgcacgcggcaggaggtgattgggagtgcaacgtcgtggtcggcgcgcggcgtctgcagggtcaaaaggcctggatgatgaagccgcgcgcaacgtgtacccgtacgcacgcgccatgcgggagcgggacgacgactcgatcgaatgacggacgttatgcttattccggtgaaagaaatgcgtgtcacacgcattccggtgacttgattttaagcaagcaatcaagctagctagcgccaccccgcggagtcaaccgtacgtggatccatgcatccatcgattcatgcttaattatatatatgctcctgcgtgcgagggccttaaagcgcatcaaatcaaatgactagctaatgcggtaatgccttcaacttcaaatggagtacctgcctatttacgtacgttgcacaatcaagcaaccacatccactttaattttctctatctctcttgagcctctgtttccttcctttacttgctgtcaaaaaagtggcatcacccccacctcacaatgcaagcaatgctgctgtaacatgatcaacgacagcatatatattgcgctacttgctgttaacgttaatgattcgactctacatagtaacgatggaagtacaggcggggaaacgaattagacacagttttcgtgttccttccccccggcggggtgggtgtcccttaattaaataacacgatgcaagtactacaagcgtaacacaacacacttgagcctaacgaatcaatttaattatctccatgtgtttacaaaaagagccacacagttcgctcttaatttactcccttttgttgaaggggaagttaatttacttggtgagatttgagcaaatccacaaacttgaaggtggttggcagccgaataatatgcgtttagttgttataggggctgtttagattgatgctattttcagccatacaaagttgacaaaaatttgttaccaaatttggtaaatatataaaaaatgctgtcaaaattttggcaatattgccaacttgatagggtttattttggctgcaatctgaacaggcctatggaaggaaggtaaaagaaagagggaccgacgatatatagatttcttaatagaagtggtgagtaggagtaataaacaatggagtgataatctctatctctatctctactattataaaaattgaaatgtttatgcggtccatcatccgtgtttgaggttcgtcatccgtatttgaagtcggttttctttggttttaatctatatctcttctctactattacaaaaactgaagatgtttttgcgggtattttgatacatcatccgtgtttgagtcgggtttttaaattcatttgcttttggaaatacaaaaggaatcatataaaaatctctttaaacaaacttgtatgctaacttgagatgaatgtcgaactcctaattgcagctcatgtttttctagaaaaaaaatccaagcgaattcccacggtggattaacagttataagattaaaatagcattcatccgttgcaacgcacggacattttcgttcacttttggtaatatagaagaaatcatataagaaatctatttaaaaaactcgcatgctagtcgtgggaagaaaactcgtgaaggaaggagaagattttgcaaagagataagaattgggcgtacacgtgggcggggcagatcgatcttagatacatacagattgaaaaagaaaaaaaagaaaagaagaaggagaggttgagggagggaaggaagctaggaaaaagggaaatactcctaaggaacgcggcggccgtttcccgaaccgtcgcgggcgttccctagttggactgggcggttccatcccagacgcaacgcgcagcggtcgtaggagtaggtgttttttttttgttttgcagttgccttctctcgaggccggggggctcggctatatatcctcctcctccccctcagttccgcacaaacacaaattaacctcctcctcttcttcttcttccgctctctagctttgctttgcttgcttcatcaaaccccacacacgcacacaacaacaacaagagtaatcaaagtagaagaagatggtttcggccttgttgcggacgatcctggtgacgggcggcgccggctacatcggcagccacaccgtcctccagcttctccaactcggcttccgcgttgtcgtcctcgacaacctcgacaacgcctccgagctcgccatcctccgcgtcagggaactcgccggacacaacgccaacaacctcgacttccgcaaggtcttccttccttccttccttccttacttaattctctctctctctctctctacattagattctgattttgcggttccttttattaatttaacaaaacaaaacaaccattcccatctcgataagcggcgcgcggcgatatatcataacttgtctttttgattagattgaaatgaaatcaattggattggattaatcatctcatctagtcaacatattactagttacttatatctgtattcgggcgacacaaatccaaatagtaactactcctcttcctccttagtaatggaaagttagagttcctacaaatatttttgtttgaattggagttgtagtcgttcgttttcatggggaggcggtcaattgaattgaattgaattgagttggtggagtagtagtggaaatgggaaaaaaaaacccaaggagggagggagggaggcgttggaaggcgccggacgcgttgttcccgcccccctgcttcatttctgttttgatttttcatggccaagcacacaacgcatgcaccacccaccccacatacgttccttctactttctttccacccatatataaaaagatcctttacaatccacatctcaatctcaaatataaataggattattaatactaataagctcattcccctggtgcattgcatactcataaaatttcttgcttaaaggactcaaaatctatcttagactaatataacatataaattattatgcaggttgacctccgcgacaagcaagcgttggaccaaatcttctcctctcaaaggttggttagtcttccttgctccttcaatttgcacttaagtacctacctttaatttgttttcatttttggttagcagcgtgacaccgtaaatttcagcataatatatatacaaactatagctattaaactatttcagcataatttcatcggtcggtcggtcggtcggtcgtttattccatgaatcaaatcaaatcgatcattgtcaaaataattactcctcatcatgtattacaagtattctggacctagctagctgctcagccagcctgccaggtcaagaatctggtgcttggccagtttaatttgcagccgtctatcacgcacggtagctgtcacgctcatagtaccaaccaacgaaccgaaccttccttgtggaattaatgcattactatatatcacaggtgacagtccatcccttttgtacccaaccgcgtagtatactggagtactaataagcaatactatgatgaatgaaatgaagagtagtagtaggtattattatctgttttggcgaagatttgagacggacggacgctggtctgcttggctgcaggtttgaggctgtcatccattttgccgggctgaaagctgttggcgagagcgtgcagaagcccctgctttactacgacaacaacctcatcggcaccatcactctcctgcaggtcatggccgcacatggctgcaccaaggtacagcccccgcaccatttcatttatttttctcccattgttttgctttgcctatatgtatatgcgtgcctcttgctggctttattggttggctggcctggctcttctttgcattgctgggggtcacaggatataccttatgcctttttgcattgctggggaacacaggaacatataccacagattacctacctatcacaaccactctgtgtctgtgtgtgttgtttgccatgcatgatgcacgggaatataaccctcccctcttaaaattgctgcctgcctggtcccactcccagccaagatttttttttttgttctcttcctactgccctctgatttttcttcttcctttcatcttgttttggttggttggttggttctgagcttactctggaggcggcatcgcaacagatttatacttacttaatccactaaaagtaaacatatatgctttagtttttaataatggacataatcataagctattttgctccggccagctggtgttctcatcatccgcaactgtctacgggtggcccaaggaggtgccctgcactgaagaatccccactttgtgcaatgaacccctacggcagaacaaaggtactccagttttttctcttctgttatactatattcagttcaatcatcatgcctaggatcaatcaatcaataaatcctaattaagccaaacaacatatatatgatatgatatgattgcagctggtaatcgaagacatgtgccgggatctgcatgcctcagacccaaactggaagatcatactgctccgatacttcaaccctgttggagctcacccaagcgggtacattggtgaggacccctgcggcatcccaaacaacctcatgcccttcgtccagcaggtcgctgttggcaggaggccggcccttaccgtctatggaaccgactacaacaccaaggatggaactggggtatgtatatgcattattcattcattctcaacaatcagtcgtatatgatttactaattaattttattccttgccggcaggttcgtgactatatccatgttgttgatctagcggatggtcatatcgccgcgttaaggaagctctatgaagattctgatagaataggtatatatgaaccctctcttgttgtgcatccatccacgggacgggacacatgaaaacatcatcatctcataaattaataatttatgtggctatattcttccaggatgtgaggtgtacaatctgggcactggaaaggggacatctgtgctggaaatggttgcagcattcgagaaagcttctggaaaggtaaactaacaggacaagtgtacttcctcttaattactataataatcattaattcccaacttgtcctttgcttttgttgatcatatgatgtcgtcctaacaataataatgccaacttgaacagaaaatcccgcttgtatttgctggacgaaggcctggagatgccgagatcgtttacgctcaaactgccaaagctgagaaggaactgaaatggaagtaagtatcaggatatatatatatatatagcatctcacatcatttcatctgtactgtaatgaaatgaaatattaaaatcatcatgtactctcttcacaccagggcaaaatacggggtagaggagatgtgcagggacctgtggaattgggcgagcaagaacccctacgggtatggatcgccggacagtagcaactgatccagctgaatataggcgtccaatcctccagtagcagcagcagcagcatgacttctatacatatatatatataatcataaagaatgaagaaacaaagaattcggacttgttgagttactactactactactactaatcccatctgatggaccgcattgtatagggggcttgtaggggtccagcagcttcatcatcagtctccttaggaggcctctaatataatctccatatttatggtagaaataaattttgcccaccgtggaagaactatataatagaatcatgatgatttgttgattcattgtcgcgtcgattcgtgcaaagacgtgtatgtatgtgcacgcccatcttcttcaagtcacattgcacaagttgaattgggccttaaaagtacctaaagttgatcttgggtgtttttccgtcaggacatacctttatgatttccgtatccatcccaacaagataaacgggccagccagaccatctccgaatcttcgatccgtttgtgtctctgcaggcccatgtaaaatacaaagcttgcgatataagttcactttaggtcactcctgttgacgttgaatctgaattccatccttgacctactacaccagaagatatagagtacccaaactatttttttctggtgccatgtcagctaaagcagcctataatactatcttaggactatatatgtaccggttttaaaaaatgagtgatgtactatatctagtatggtggttcaaggatgtgattcaaactgaacgtcaagataagagacctaaagtgaacttattccaaaccttacttacagggcttgctacagacacaataggcccaactttactacatttgcaacatacatgacaactagccacaaaactgtaaagtgataagtgaagcacaaacaaaaccacaaataccggtcatactcatatcacgatcttaccagataccttgtggtccgatcaccattagagatgataatgctatggaatacgttgtctatagagtagatatatatgatctgaatttaagaggaggggatccctattaagcgaaaatggagggtggtctagggactacttggaccaccccccttggaattgcctatgggtatggttagctattggctgagctaattagttgcacataaaacgaaatgggtaattgatgcatgattaattgaatgttaactataaataataaattcatttgattgtttcaataaatttttattatagatccaagtttttgcactctagtggtttaaagaaacgtgctcctaaaaatgaaaaggtagcccgaaccgaatagttatttggaactcagccttggctcatgtagataacctttcgaaccggctatgagacggagattatacccgcgtcaatctgaattattggccttgaggcaacttttgccattcatatcatcactaaagttaggagcataaatatgtacatcatctacttagttaatttgtgatttgggatgaatgatcttgtacaacttttacatcgtatctatacacgggaggttcgatcggtggcaacgaacgtgttgatcgataaagaagggcgccttgtgtgttgtgtgtaatcttctctctaaaaacaagctactaaaacagtaaaaagaaattgcactgtataaataaataaataaataaataaataaataaataaaattcaaactcaatattgtttttaacaaattaagaaacatatatatgcaaaagaaaaaaaactgaaatacgtatatatatgctactccagaaggaaattaaaagtaaatcgatctggcactagctagaaagaaatgaagaaatgacaggtagctagctagtgtgcaggaacgcgtgtgggtggaggaatggaatggaatgggttaggttagcggcacctctcccttccagttgcccggcgggtcgtaggagcaggtgatgaagacgccgccggcgacgcactcggagcggccgcagccgacgagcttggtgtcgttccagacgatctgggtgaagtggccgcacatctgccccgggttgcagctctgcccgcgccagtcgtagacggaggactcgccggcccagctcttgacggcgtccgtggcgcgccagccccacccggtcccccagaacacgttctccccgtacggcgactccggcgagtgcatcatcacgcagtcgaaccgcctcgccgccgaccaccgccgcgcgtacctggccagcttgttgctccacttcagcggctgcagcccgtactgggcgcgcaccttgttgtgagcatccaggaactcgtgcgccatgtacttgtacgtcccgcgcccgccggtgaacgactgccccggccccaccggcgccgccgcctccggaccctcctcctgatcatcgccgccctccccctcgccctcatcgtaattgttgttgttattgctatcatcatagtacggcttctgattctggttctggttctggtcctggttctgattctggttgccgatgccgatgccgccgccgatacccacgccgacgttgacgcgaaatgacgcagccggccggatcaacaagatgaggtacaccaccaccaccagcgccaccaccacgacgcctggacctgcagatgcggccatcatgtatgtactctcctctcctctcctctcctcagctcagcttcctaattacatacacatatatatatgcaatcagcagcaaccaattagctagctaggaatattatgtgttattagctagctagctagtatgcacagattatgcattccattcatcatcgatcttctagcttgtctacccagcctgcaaccttaatttggccggctatctgctattattaatctgcaaggacatcggaactccgatcgatcatatccatcgcttactcccatccacgcatgcatctttatttctcaccccacgcgcccgggaaatgagctccgtcgatcatcgtctaaactctatttcttaccattcaatttcctccaccattgagggctagctatagctactagctagcgagcggctgcagcggacgagacgatcgaacaagttaactagaagaatacggagtagagtaatacctacctagctagctgttgtactcattttcttttggggaactaacctaataattaattcaactgtgtgttgtgtagagtgtcaccaatcactttgatatggcaagttactaaccaagatggtaacaagataaaagctggttgcctctagtctagaccaagttagataatttgggaataaatagccaaaaaaaaggattttcgagacaaacatatacaaataactttgtgtgaaggtgtacgatttatagtgcaaattgataaacatggataaactaggacacaaactaggtgaaagataaagcggaacacatctatatacctatatataattagaaaaatacgtaaggattccgcacattttttttatccatcccttcctccctcgtgcacgtcgccctccctcccgacatccccccatctctttcatccctccctcccaccctcccactcgcctccgcttccacctccctccctctcggcaccccctctctccctcgctgcatgcgctccccctcctcccgtggcccctctcctccctagcacccctcctccccatcaccccgtcctcccagcgtccctcttctcccaatgatccctccctcctacgctttcaagaaaaaaacataacccccttgtccaggaacacgtttgacgcactcacctcgccatattcaccacaagagctcgccattactgtttctctctctgtccggaccacgtcgtcgttgggtgtgctcccgctgttctggttttcttcgttgccaactgccagcatccatggacgtgccacattgtgggacaagtccgaccaccttactcgtcgatgtttggtaaacgaagcaccgtcgctcatcttctcttttgtttcttgtttggctagggaagacgatgaatagtgttagtcattttttcttcatttttctttctttcaatgcgttcaaagaaaatggaatcccctcatctgagaatgcattttgacacactcatccgatcatgttcaccactagagctcgccgttgttgtttctctctgtcggaaccacgtcgttgtcggtcgcgtttctgttgttctggttttctttattgccaacctccatcatatatggatgagtcatattgtgcaagatgtcctaccaccttccttagcatcatttggtcgcccgagcaccaacgcctatcttccctactcttttgtttctcgcctttgggaagggaagacgatgacctattggccactatttcttcttggtctagctcaaccatgctcttggacgactcacgtaatattgagactatatgaatatgaataggaccggaaaaattctaatttatgtctatgaaacaagcacctgttttgttgttcagaattattggatcggattttcatctaagaactgaaataagttttttttttcaattctagctaatttaagttgtttttccatttaggatattagttttagcactatttaattcattaaaaaatattgtaacctatatttttcctttgtattaaattatttatagccaaatgaaaaaaatggagatttagttacattttttttgagttattgttccggtcaaacctatgtgtagtttgatgttattatttttatgattatatttcctttcgttatttataccaaattgtgatatagggtttataattttaatttatgttatttagaatccgttgtaacacatggacattatgatagtgattaaaatacgactcaaacggttgattatagggggtatccaattgaatcggtaaaagtccttataaaaaggttgctattacataaaccgtgtctttccacatcttattagctaggcttaagttgtgttttagagaaggcaaagaagaagattgagaaaatacgtgaaacaaggtgagtcattctcgtatgactaattgggtattaattatttaaactttaaaaagtagattgatatgatttttaaaacattttttctatatttttttttcagaaaatgcaccatttaaaggttcaaaatgggtgtgcgtgcaagacgatagattttttctcccctttatggttgtctcaaatccaacctatcagttattctctccatcctaaagtaaacttatttttcacctatcccacgtataccaatataaaatccaaagactagagtacttctgctttatcaaattccaatacaactattgtctactttatccactcccagtgtatttatcctttactttcacaaacttcgacacgatgattacttagaaatgaatttattttaggaaaattttcaaaaaaaattattttaggaaaaactggaagagccaaaaaaaattattctgagatggaaggagcagctagactagaaataccttaggcctaaggacaaaaatccgtttataatgtactccctggttgttgggttgcatcaccattatctgtccacattttactggccaagtggtcagctttgcatgctttctgttgcactacacagccaacgatgggtccgtccatcatctagccatagacgatagttgcatcacgcacatgatcgatagtactattcgtcctcatcttcattgtctcatctttcagtagtggactggtatactcgctctgagtgcatgtagtatatgtatctcatcgatcaaaacgacacgacgactgcatgtacatgtgcaagtctgccctagatctgcactattatggccctgcttgacctactttgggtttatatatagggttaattagttccacgccattataaattcttcagcttagaaatatgccactaaaatttatttatttgtagcgataccattacaattttatagcaaattggtatatgccactacttacctcttcattgcattcataaacatatttagaccattttgccctcctttttcatctccctgtcttctttcccctctctcatgtcctaatcaggggtgggcagaaaaagaccaaaccgaaaagactgagaccgagattgaaaagaccgagactaataaattcggtcataggcagtgaaagaccgaattttgttcggtcaattcggttagtctcctcggttaaccgaatagaccgaaaaaaccgaattatcaaaaaaatgtctaaatgcaacctacaatccactatgtttaatagaattaaactctaattttcacatccctacttcttataggcatacaacctaataagagtctttactcataagtgcttacgaattttttttgtgatttttgtgttgaaaatttccatagtttgtttgcatatatgaaaacgttgttgaatttcagtaatgaccgagaccgaatttatcggtcctaacatttttcgctaaaattcggtcttcacttttcaaataccgaaagaccgaagaccgagaccgaaattttcagttagactgaatgcccacctctagtcctaatgtccagtgaacctcggacctccaccggcctcaaacacttcctctaggcgtttctttaccctgtcgccgaggaagacgagcagacgcttgcccgccggagtaggccgccatgctggagctccttcgtgggccaccggagcagctgtgcctgagccgtcgtgcgtggatccgtcgaggccgtgtccgggcgtcgccctcatgccgtcgtgttttgtcctctgctcgtcctcatcgtcgtttgcttgttgtcctcacgctgaatcctctgctcgtcctcctcggcacgcgggcgagcgggcaaatgagcacttgaagggaggatagaggccggaggaggaggagctccggtggagacatgggcttcactggacatgagagagagaagatatgggaaggaagaaaggggaagaggaagaagatgagggcagaatggtccaaaatttttcgtgaatgcactaatctcaaattacatcaaaattataatggcatcgttacaaatagacgaattataatgatatatttttaaactagagaatttataatggcatggatctaattaaccctatatacaattatacatacgataatccatcgatcatcatgcgttaaaaaagagagaacatgtcctaatatgatcgtgtaaataattagcatctactcctagctagcgagttagctatctcgctcttgcatgtatatttatatatagtagtagtagtatttatatatcatggaagtgctcgtgtacaaattaaattaacgagctttttcgaagaaataagacaaataattccaaaaggagaacaaaacaagatagaagaaagaagaaggcgacttacacgccggagaaggagaattgctagctggcgaacagtcaacaggtcgcggtccaaaacgaacaaattaataagctgtaaagagatggagaccagctagctagcaatcagcttcccagccacggatattaatttatcgcaggtgtattagctttctacgcgatttaatgttatatattttgactatttaaatctattataaacaactacataactaatactttcagatacaaatataatgaaactatatatgcatggcaataagtgccactattgatagttcaattgttaatgaaaaattaaatgtcgattttcttaaaaacgaaggaactatatacataccatacatcctaagaaaaagacaaatagtaagacatgcccacaaattatcattcttaaatttctttccagagtaaatttcataaaatcctaccttttatcattcaaattacacaaaaccacagagattttgacatgtgacatataacaccaggtattatagccttaaagttttcacaaaaccaccttgttaaccaaaattgccatattcctatattaaatttttttaaaaaactttatttacatttatatgatggataaataactcacaaatttgataggtgattgtagaactgaaaagtatagacgctcaaagtcaaaacaattaatagtgttgtttttgtgaatgataaggacatcctccactattacccgctaacaaagacacaaaagtcgggcggcgactatgtgagcctttgaataatcccaccttgcttagcttgggaggaggaaaccaccttaaaagggagagccacctgtcaggattatggataccatatacctaatagtagttgactaaatctcggtaagacccaccacataccatgtcttatacgaaaactgacctcggatatggagggagttccggataaggaaagacaaccggagttctacatggaaacgacaaggattactcgaagataaggattactcggattgtattcatattggtttccctagttctactctgacaaggggacacctatgggtataaatataagatcccctaggaggagaggagagacgaaacaatagatcaacatacaagccaacatacgccaagacaagccgccggatatcaacatcggagataggcctagtagtccccatacggtacctaagatacgactaccgtcaggaggatctagtgttgtctctgatctcgtcgggcacggattcgaggaggaagactactctgttgtcgactacgggatggttttatggctgccaagtcgacaacagatagataggctaccccaaatattgtactggtgtgattatggtaaataagagcaacgaccggcttcggccaacaggagtagggctattacctgacaattcaggggcctgaacctgtataaaaatcatcgtccccatctcttttacctcaatctcgcatatatcctagtaccaacgatccccatactatgcaaataccatagtcgtgacatcaaacgtcgacaccacccttcccctcttggactagtcttttagggagattaggcctttccccgagtgggtgtgcctaagaactgttggggtccgggcaaccttaagttattgggcctcggttgaccccacctgggccagattgttatgatgaggacatcctccactattacccgctggcaaagacacaaaagtcgggcggcgaccgtgtgagcctctctgaataatcccaacttgcttagcttgggaggaggaagctaccttaaaaggggagagccactcttcccctattggaccagtctttttgggagattgggtctttccctaagtgggtgtgcctaagaatcctccactattacccgccggcaaagacgcaaaagtccaagtgggtgtgcctaagaatcctccactattattcgctggcaaagacgcaaaagtccgagtgggttgtgcctaagaatcctccactattacccgctggcaaagacgcaaaagtcgggcggcgaccgtgtgagccactgaataatcccgccttgcttagcttgggaggaggaagcccttcccctattggactagtcttttagggagattgggcctttccccgagtgggtgtgcctaacaatcctccactattacccactggcaaagacgcaaaagtcgagcggcgaccatgtgagcctctgaataatcccaccttgtttagcttgggagaaggaagccaccttaaaagggagagccacccttccctattggattagtcttttagggagattggacctttcctcaaatgggtgtgcctaagaactgtttgggtccaagcaaccttaaattattaggtctcagccgaccccacctagaccggattgttattagtgaatcataatacatagagttaggtgtcatgtgtcatagggttatgtgtcaagtgtcagaatttctatgtgttttgtgtcatgtgtcagaatttctatgtgtttttacaacttactctctctatcccataaaaaacaaacctaatacgtgatatgaaacatcctagtactacaaaatctggacatacttatatactaatatatcacatcccgtaataggtttatttttacgtagggttaggtgaaatttactcttgtttttgaaatagtagtaattaattatttgtgctttatagggggtgtgaatggtcaaactctaaattttacacacatttataagtataaatacaaaataatagaaagtctagcgtagtaattaagttaagtggaatgtggatggcagttttaatttctcgcagagccgggtttcatactttcatgtgaatgatgatcgagttgttttttgaggcagtaatccgctatttattgccgtgtgggagaagagaaaggagagatggacggacaaaagtcccgtttaccgtaggagaggaccgtaaaaccgacgttgatgcgagcaattcacgttggttttttcctgacgtggagaagagagatcgaagagaaaagtagtcctgcgtactactccagctccggacatcagtgacggaaaaacacgactcgtcaaatatgagtcatctccaataaaccaaaaatatcctgattaatatatggctactggatagaacccataaccgatcacagttgatatatgatgagacataaccatggctataacatgtcacgtgtgacatatagtattatgaaccatcatatatagatgagaccactcatctttgacgggtctttaactaccacacgtgacacatcacagataaagttatctctgacgggtgctagttatgatccgtcagtgatgagtgaaaatttaaattttaaattttgcaaaaaatctcgagttgggacatgctctataaaagttgtagctctcgacgagatatatacaactttataactaacaacatttccattataattttgagttttttcaaagagtggtgctcttgtgaaaatgatttgaaccattcgttattaaggttaaagtagtaatttactaatatgtgattagggctaactttttcatttagtttttctctggctaaattgatctatggtcattccatgtgttgacaccactcatattccataaaaaaaggaaaaagtttggtcaatgctaaatgacaattataactctctgcacctaattgttttaacaaaaatacccctccatgtttctaatattgctaaccatggtgatagtacaattagatctgaatcttcgatcaaataagatcaatgatttagattgtcttctactactaagtagagagcacggtaatgggactctttttcaaatgacctggatgaaaacatgctttatatcaaagatatagagctcaaccaaatttacaatattataattgacaatattttcatttacaatattataattgacaatattttcatttgagatagtttacatactcaaatatccattataaggtgagatctattttgaaaaaaaataattctttaaacaacatcggatgaagatattctttacgtaaaagctgaacatgttgagaactataaatgtttagttgataatattttcatttaaagtcatttagagtattaaatatatgttaaatgatttggacacaaatagaaaaaaaataataacactgattgagtagtcaacatgtgatgaggatgagatttggtaagggtgctctttgtggaggcggaggtcttgagtttgaaactcataatacgcatgcatgtctatattacacaaaaaaatgtggatatgtaggttgtgatgtgtgaccttgtataggatggctagtaaaatctaaaatatttttttttactttttgttgctttaaaattaagagattgtcattcttgctttgtcggtgatgagtcgtaagagatgagtcattagcaacaggcggaagttacgacgacacgccactaatgacttatctgtgacggatgataagttatgacctgttacagatgacttaaatacccgtcagagatgagttatctgcaacaaatgttcactcgtcaccagtgatattttgtctttgctggaactagatccaaaaacttgcaaggggttgttgtattcttgctttctcttctataatgaaattggtagagctcctgccctttccttaaaaaaaagattttgtcatcactaaccatttatctatgatggggtttggacctgccagtgatgacctaatctgatgtagtgacgttaaattgttgtcgacagtaagaaaggaaaccgaggagttacggacgacgacttgtagctaagttttgataaacacacacacgccatgtatgctctaaattgtgtttgtgtcggtcacaacgtatatacatgtaccccattttgttccaagttccaacatcacgagttcatgacggattagtcacccttgttggtggatcaatataatctcgactgtacatgatatttcatacttttcttagaattaatcaattttagtctcatatgtctctaagagtattttggatatttttctctatctcttctctatctctactattataaaattgaagatgtttccactgtcggtcacttgtgtttgagtcggttttaattttatgttttggttttaatttatatatcttctctatctctactactataaaaattaaaaaaattttgctggtattttggtacgttatctgtgtatgagtcgatttttaagttcgtttgcttttgataatacagaaggaatcatataagaaatctgttaaaaaaacttgcatgctaaactgagacgatcagactcctaactgcagctcatgattatataaaaatatatgtgcg

SEQ ID NO: 67928 - DNA, 10625 bp, Oryza sativa
gggcgtgagagggagttacgcgcgcgagagagagggtgccaaggtgggctcggggaggagcgcggagggaaggggggactcatctgggccactcgattatttgtagatgaatactgatagttggatttgatgaatgagtaatgtaggtgtaagaatgagttggtgcaataaagttttgttttgtttaagaggaattttactatccttgaggagtctcaaggtaccaccaggtatctacctccttaatcaattgatatccaccgttaattcacaaaggttaatttagggacaaaatttattattaacaaggatagcttagtaattgaccaatcaccggttctccatccactgccaagcgttcacgatttcctttccacgatttcagtgcttaaccataatcaattccaatcccaattgaacgagctcggaggcaaggagcaggggctgcgcgcgcgacggcggcgaccagcaagcacgtgcgaggcggcgaccggctagcgcgagcaatggctatgaccagcgtgcggcggcggtgatgtcgactggctgccgcatacgtcggctacgatgggcgggcgagacgggcgcgtgcggcggcggagacggcgaccgactgccgcgttagtttgctgtgactggagggcgcataattcagcagcgacctcagcgtgtgtgcagcggctgagaccggtgggcgcgtgcggcctcggtgagcggcgggcgcgtacggcggtgacaagacatatcggtaaaagtattacataaacgtttaactacataaagaagcacaacgttcttcctcctctgctgcatgaatgcagcttatcttgaaacggataggagtaggatacagatctaaaaaaaagacgattttgtccttagccatacaaatcaattataaaactcaattaccattttaacctttcaccttacatactttgcccactcttttaatacctttcttctagtaacttctctcttggagcgttagatcattagagatcaacgatcctaattaattccaagtatagaagaagatctcaccatttaaatataaccgtctatttaaaaagggtaggattggaatatgtaattgccagctcctgcttgcaacaccatcgtctcaaatcattcgctatatgttgcgccacagttatagatggccaaatgagccacccagcccgacacggcccaataggggtcggggcaccatgctgagccagtccgaaggcacggacagcccatcgtgctttctttaaaataaatctatttcccctccctcttttttgggttgtgacatatatatatatatatatgtatatatatatatataattttctaataatctactcgaacgcccatgtgttctccttgcggatttcctcctcctccggcgtgaagtcgttcttgatcccaaactccttcctgatctgctccggcgacttgcctttgatcaggttcgccgtgtgctggcagcacaaatccagcaagctcttgatgttcaggaaattggacgccaggagcaagccgtacagcatgttcttgtccacgtcgatcatgaactcggcgtcgaagctcttcagctccttctcctcgtcctccgcggcggcggcgtgcttgacgcagtattcgatgaccttggcgaggaccttggaggcgacgttggggagaggcaccccgttcgtcgtgcagtcgttctcgatcatgttggagacgagctgcgacaggctcgccgccgccgacggcacgttaaagtgctcgccgtcggagctgattaagaggatcgtgtcgtcggcaacctccttcttgtctgccgccattgatctcgctactttgaaacacggacggacgaaactcgcggattgcaaagctcaactgtttcttgtctttcttggaacgtaaacgttgggtgtgcttggatcatggcgagagaggaggtggtgtgtttttattgcgtgaaaccgcgcaaaaacaactcggattcggtcatgtggagtcgaaatccaatccgaattcaattgattttcggtgatttccgcgttagtttggtgtacgtacgtcgtcgagactcgagagatttttaactggactgatcttcggaaccttcttccatagtctaattagactccttttggaaacgagtactctaattatttctcgatattaattaatttacaattattacagtagtaaaatgagattaaaatacgactcctactcggagtttaattatctcacgctgctttatgcaataaatacaatcacgccgcgaggttctatctgattaacaccaaactttccaagccatcgaccaaataatactacttcaggattagattatcgtcagaagttcatcaacaatggcggcagcagcagcggaggccacgaccgatggcggcggcaagatgatcatcctgatcagcgccgacgggaaacgcttcgaggtgacggaggcggtggcgagccaatcgcagctgatatccaacatgatcgaggacgattgcacggagaacggggtgcgtctccccaacgtcgacggcgacatcctcaccatggtcgtcgactactgcaacatgcacgccggcgacgccgccgccgccggcgacaccatgaaagcatcaagcacggaggaggagctgaagaagttcgacgccgagttggtgcaagccctcgagaatccggtgctgttcaagctgatcttggcggccaatttcttgaacatcaagagcttgctggacatgacgtgccagcgcgtggcggacatgatgtccggcaagacgccggagcagatgagggagacgttttcgatcgagaacgacttcacgccggaggaggaggcggcgattcgccaggagaacgcctgggccttcgacgactagctgtagctgcctacatcatcaaatttaatctaagcagaatttaggcatatatatatatgagattttcttagttttatgatttaggtgttttatgctaagtaattaatcgcttagatgttttgcttattatagtactgagacttcctccggtgcttgggagttatggtgtccgttgattacttgccagttgccatctaacggtctgtgataaaaggtatgtctcagaaggtataattaaaaaaatgagcaaggtattaacttgatgattaggtggaaggttagattgataactttagtttcatacagattagagggtggggctttaatcagtaaaagaattaggatcgataagccctgcttgctgataagaacagctttcttcagcaagtaccatacggacgaaacgccaccaccactgatgatccacaatgaccatgaattttgtatacatacacagattcaacaaactggttgatcgagccatacttgtctttgtgtatggacgaaagaggattatatttgtttctttggagtctaaatttagatgaggacctgaagaatcaattagggaaaggggattttggacaagtgttaggatttatgatctcatgtactaaaacgcaaaaaaaaattgaattacctagaaacgatgcgaacgacagaatcggagataagtaataacttgatgcaaaaaaagagatagacggttacatgtaaaaggagttaattatcggtgtttattaatgttttctattcctaagttgcccttaacagatcaacggtgggtgattaagtagtaagggaggtaccagaaagtagtaagggaggtacctctggtacctctcaagcaccttaaaagctctctatagtactatgtacatttgtaatcttttcgaatcctaatttatagagatcttcttctgtgcttggaattaattaggatcgtttatcactaatgatctaacgctctaagagagaagtatcaggaaaaatgtattaaaagtgtggaccaggtatggaaggtgaaaggttaaaatggtaattgagtattataattgatttttacggttaagggccaaaacgtctaattttcaataggcaaaatttgcctcagaacactcaaaaaacgtgtaattggctgggagacaccacgaaaacgtgacacggctgatagacactacaaaaaatgtgtaattagctctaggacaccggtcgcattattttattatttctgggtcaaaagaggtgagatatttttctaaattcctggattgccccttctctttccttccttttctcccactctttccttcttttcaccttcttgttgatttcgccgagaacggcatagcagcctcaaagccgcggtggggcgaggtcggcgcggcgtggtgcggcaacatcggcggccagggcggtcgatggcatggcacgaccatggaggcgcggtgtccagctagatcgatggcgggtaggcgacgacagtgccggtgtagcggggcgcggctgagcggcagcaccaagcgcaggcggggaggctacgatgggtcttggcatcacgacttgggtcccggcgtcaccactgctcaccggagaaagcggaatcgaccatggcgatggcggcgggttcagatcggcgccgatgaagaaggggtgtgatctccttctccggcgcaccatttttcggggtccttgaggggagatagagaggaggatgaggcggagatgctggcgcgacagcttggcccggcttggtccagataagcgggaacggcgatgatgtcgctgcggcggtgcacagagcgcgctccagagctctggtgggcacgacagcgttcccgtcgattggctgcacgaatcgagaggttgtcaaagcgagatttgatcggcatggagagaagataatagaacatgaattagataggaatggagacagctcgttggtgatcggcggcgccctccttctcggcggtcgacaacaaaagagagatagagagggagagctggagctctcttcctcggatggcgatgcagcagggacgagatggcgatgcgtcgaactcagccggcgccgatctctctctcggctgtctctggtcgatctctctcccgtcgcacgcccaacacgacgagatgaggaggctattctccaggttcggcaagatctagagggagaagaagataagggcaaaactgtcattttacgttgtttctctctcatcaattgaacaaatattatactataatgtgtccagtgtcctgcagcaaattaccacatttttttagtgtcctcgggcaaattcttgttttcgtggtgtcccatagctaattacatattttttgagtgtcctgtagcaaattttgccttcaatatatgtatatccttcctatatatgttctgttctgtattccatccattcgtatcgctgcttggttcgaggcgtcggtggaggtgacttaggcgctgaggcatagggggagagacggaggcagacgggcaccccttacagcgtcgacgaccgtgagctcggctcacaggatcgctagctcgcggcagccgcccgcgccatcgccgctttggagctctcctcgtcgaagccggacgcacccaccgatcgcagccgctgcacgcgccctggggttgccgccgccgtacacgccctacggtcacagctgactaatgtggcagccggtcgccatcgcagccgccgcacgcgcccgtagcgcccgccagtccaagccgacacacacggcagccggtcatcgtcgcgccgccgcatgcacctgttgcgcccgctggtctccattaccgccaccgcatgcgcttgttgcgcccatagcgcccgcccgtcgccgactcgccgtcaccaccgccacacgcgcccatcacgcccgctggtcacagccgccgcgcacgctcccgccggtcgacgccgtcacacaagctgccactgccactaattaagatacccctgttaatataattttttttcctaaattaccctttatgaattaacggtagatatcaattgattaaggaggtacctaaggtaccttccaagtaccgtaaaagatctctaatttataatatgcaacaaagttagttttgttttgtttgagaggagttaccatccttgaggaggtaccagaatgtgtaattgccagttcgtgctcacaacaccatcgtctcaaatcattctctctgcgttgcgccacaattatagttggccaaatggcccgcccggcccggcatggcctaggccaagatttgtcgggctggcacggttcgacctacacaccaggtcgtaccgtgccggcccacgtgctccacctatggcccaggcacccaataagggtcgggccgtgctgggccggcccgaaggcacgggcagcccatcgtgctttctttgaaataagtctatttccctccctcctctttgggttgtgacatatatatagctaaaataagtctattttacgtccctactctttgagtcgtgccatataatacgtcgatttgtcttcctattctctgtgccctgtcttacatatggtcgaaagtaagtctatttcacctccttgaacttcatgtcgtgctaggccggcccaccatgatgaggcataggcccaggcacagcccaacagctgggccgtgccggcacgggcctgacagcaatcgggccttgccgtgcctggtccgtgccatcgagtcaaaacctcgtgccttgggccaaaggtgggtaaattgaactattttgatatttagagagtgttggatacccggttttagagtttgctatgaattttagacctagacaggacttgaagggtgtaaaatggattcatccctatttttttattacatatatatagaaatattaataaatatataattttatttatgctatttttagactaaaactaatatagttctccttatttctaacacatactttacatcatgatattcatagtccaagtctttaaaactttgacaatagtctttgttcaagatgacaagtattatgaacccctctagaagtacaaatttattgatactctttcttcctaccttctactcatttgttttctgcgagtaaacttcccgaatggctagatgtacaacacgttttttcgcaaaaaaaaatagtaaaattaattttaaaaaaatcatattaattcatttttatgtttttctttaggaccaattgcatatttgccactcgattgaaccggtattgtgaatatgccattaaaaaaattgcaattgcaaatttgccactaaaaatgatttgaaccctacctacctgccattggattgacggcatgagctaacatcgttaaaaggtataaacattatagcatctgaggcaacaaacaaaagacaagaaacatttggctaaggctccatagcatatcaaatggatgctaactgaatttaattctccttcccattccctctaatgctaacttaagtggcaaatttgcaattcatgtttttctaatggctattccgagttagggggtggaaagtagtgatatatttgcaattctcccttttctttaagctaagacttaattattcatgcgctaatgagccaccttgttttacgtgcgcgggaaagaagcttccagcccctaccactaaacacacggcctaatactggcaccttccatcatggtttactagcctgtgatgtcgcgcattcgcgtgactctatgcctcctgttacatggtacttaggagtggcaatatgtttttatgggtttctcatcgctcgtaaaaaatataggtcagaatgactaatattatgctcatacaatagatagcttaatatttattacaaattttgtatctgagtgagtcattgttttataggttttcacgttgcatgaccccttattttgaataagcgcacactatttatagcctatgctgaaatattttgtaggtttttaaggaatgaatttgatttcattttatattcatgtgaaaaacattaaacctatattcgggcgatatgattgtgcatgttcttgcagcaatttttgcctcaaatatgttaacaattaattgttagaaacaaaattaatcgtatgaacgcacatttgtatatgttcttaaatagctgaatcttgacatgtgaatatttaattaggatgagggtttatttgtaaaataatttattttattacatgagcaattcataaattatttgcatcctatgcctattctctagcttttttccccttccctctttctttcctcttctagtagctttatctccggaagcctctttaattattatttttatcatccatctaatccaacggtccagattcatttattctcaattcatcaaatgatgtcactcatcctcaattcattttgagtttcacttttcattagttaagatatcgatagctttagtgttggcatcttcttgcttgatgcaacaatactactattacttaagtaatcatgcacatgcaacacatgtaataaccactatgatttaaaacaagcatattgcccatgtaatgcaagatttccgtcatattttatgtaattcagaatccataataaaaaaggtaaatcattcatgatactatattgaaatttaatgtaccaacaatacacataagtctctatataaaaatacatacaacatacaaaaggatgaggatcaatggtctccgaactagcactttacacattgttgatgcaaaaaaaaaataaaaccctggcctaagagatttgcttaactctagtgaaaaagcttgccttcagacctaaggcgtgccaattggtttaatactgcaaccaacaagaaacaagataaacagttaaatttataaacgatagccaatcggctggagggctgatgacatatcgtctttaacctagccgatgcaacctggtttgaatcagctgtaaggtgtagcaataaaattaagaccctaaattcatgtcatcagctgtaaagattaacattacataatctatgaatcatcattacttgaaataacagtgattgggatagatagaacttaatcgagacagtataaatcacttgtatccgaagttatatgaaataaagattatacgagttcatgtcatagctgatgaaagaatttaagcatgtatcggctatagcttcaatacaaccttatactggaatattactctaatataaatatattgaacaaatatcaatctaatgttttttttgcggggaaatatcaatctaatgttagattaattataacaagaccgatgataagcataatatatttagatgattaagattccaatataagggcagatataacttgtaaagcaatacaaagcaaagcaaaacaattatatcatgtaagatcggtggaaactccgattctatccttaattacaatcataaagtagcctagagattatggttctaaacatgacttagtaggtcgaacccaattgatgcaacactaagtgtatagagaaacataatatctagacaatcaagatgatgattgtttttcaggatggtggatatgttatactaatctaagccaacaaagtaatctagccgttatcgggaaaaccctagaaagtgatcgaccaatataagtacaaagtattgtcaatctagattatataacatatatgataactcgacattttacatgagcaagattagagtgtcataatgatgtaagcacaaatcccgaaaatgctaaccaccataacaagttttacctcttgtcgaagatcgtaatcgatgcagcccaactcaaaagcaagaactcgtcgaaaagtaaagtaatgaaaaggtggcgatgcgccgagagtatatatttatacccaaatacataactcatccataacggacacgactcacacttcctattacaactctaaccgacgaacaagtcccttaggtggactcttaataaggaaaatacttaatatcctaattaatggatacaatttcctatctcggactctatccttgcccagcaatatcattgatgctcttcattcaaatccgacattgattatgagaccaatcttgccaatatcggttgtatcgactcaccgtgttcaactcgatatcagcctatacagacttccagccgatgcaaactctgcttccagaaatatcgcatctcttccaaatctaattcagtgtttatctccaaatccaatccatatattaccaaatttggtcgttaactcatatcttccaaactatgttgatgatggccatagaaatcgctaagtggggaacaaaaatcttcatttaccggcccaccaccgtcatttgactttttcatattataagtaatttgactttttcctagtcaagtttgactaagcttatagaacaaaatagcaacatctaaaatatcgaatttgtttcatttaatgtaatattgaatatattttgacaatatgtttttttgttgaaaatactaatatatttttctattaacttggtcaaacttagattgtgttttcgagacaagaagttttttggtagagtcttggaaaattctataggtcacatatttcatctatttgagtttaacttttctatggttggttcttgtgggctcctaagtgtgaaaaaaatatcaaaaacataaaataaaaataaaaaagttgcacgtctctcttctacactagagaggagaggaaaaatatggcatgggtagagggtgggggggggggcggcgccagcctcattggcg

SEQ ID NO: 67929 - DNA, 5114 bp, Oryza sativa
  unsure (1)..(5114): unsure at all n locations
tgaattgctgattggcatctgtcaactgcttgaaaagcgatgcgttttcgccccggagctggtcaacctgatgaacgagcacacgaattttgaaatctgaataaacccatagaccatcactcaaaattacagtaccaattggcacaatattttgttactcaatctgatatatggatggcgctgtttgaatttttaacattagcaaaggcgcaacgggtacaaatcaactcagtttacctgcgtctcgagatcagctaagtgagcttgctttctcttccttgatcgacgagcagactcccggttggaaaccatcctgtaatttgaagccagcaaccgtttcatgcaagttctttgtcaaatattccttctgaaaagtaatgtttacttctactactagcgaatacgcccataattttcatgccgtgacagacataatgcttgacataatcgctgatgttcttggtgtaccttctcattctcttaacgtccagtgggtttgtgctttgttcgcatggaccgccctctatatccaacagcgactcactgtcagaatctgaaccacttgtgcctcccagagtttggctctccttcatgttcagagtggtagctgacgtgggacttgctgctgctgatcacagaaaattgaacaaatagtgagcaagaacaattaaagaactgagcattgtttgtgcctcatcattaaatgcaattttgatgcagtaacagcacttgtactgtactactgtccatgcatgtccattgctgaaatctccatgtgttgaaaactccaggttgcatgtgttttttcagtgtgcagtacagtagcaaatcattacatacatggatgagtgactgtttttggtgtgcaaactgcagtcttattaactgatgaaaattgtggaagaggacgtgtgttaggccataccacagattgatgattgcgactcaattgtgtagactgcaggatgccgtgcgttgaggctctgggactggggccatatgtgattgggaatgaccccagtgatggtgctctgcttgaaagaaaaacaaaagcataattaatcgagtaatcaatcatgcatatcaagaatcaagtacaatttaagataagcaaccaaagcttgtatgtatatgctgctacttataattagttgtcagtatgtactagtactaacaatcatcttcattacctaaataaattacttatcatcaattctcaataacaagtttttttttttcgaggatgttctcgataacaacttaatcaaccctgtcatgtaaactctcctgttaggctgttaacctgaaaaatgatttctcctcttcccttcccatgcttagaattcaggactccctcttatcatgctattcaaatattttttcgtgaaacatgaaacatcgtttgtttgaagtttgaagactaaaattgtgtgtggtgtgtgagcgtgtgtctcttctatatgatctaaaagaaacatccttcattttttttcctctctttttttttcttgttctctgctttcccgctgtatttactcccctccaacttaatacaatgatacgcaaaagcttatgcttattcgcgccaaaaaaaaaagagttttgaactagcaaaaaaaactggcaaacagtcttcaatttgaaaggtgttgcaggaggtgaacagtagcgattaaaaatttgcaggcaacaaattctagtcaagcataatatggaccgtgctactaccaatagaacaagaatcttagccgctctttaattaagtacacgaattaataatactccacccgttttgaaatgtttgacaccgttgactttttagcacattttgcccgttcgtcttattcaaaaacttctgtaatatataaaactataggcctacatgaaaaatatatttaaaaataaatcagataataggaaacgaattaataattacttaaatttattttttaaataaaacgaacggttaaacatgtgntaaaaagtcaacggcgtcaaacatttcgaaacggagggagcaagtagtactccactcttttaatcaagcacaagcatgatcaacaaaataatcactcaccgtcaccgagtccgcgaagccgaagctggagaggtcggcggcggagaacatggcgaacggcggcgggtgcgggccgccgccgggcttctggtcggcggcggcgtcggcgtcgtcctcccccctctcgccgtggaagaacgcctcgaagttcagctccgacgggcacttcttcatctcctcgtgtggcctctgctgctgctgctgattctttcagcggtggtgaactggtggtggtggcgtcggagtcggatgcttttagagatgccccagcgaggcagatcaccgagggaggagaaggagaagaaggagaagggaaagctcctctttttcgccccccacaaagctgagctgcccacccgtgcgcggctggagcggtgtcagtccggcgtggaaagaggctagagtatcatccttgcccctctttcccccgcatatttaccaccccctgccattgggggtccttctccacgtgtactccactcgcaagcggtacttgttaggaaggtacgctgtaggtggtctcttcctacctccccggcggccggctccggtgccggccgtcagatctccgatgccgcacacgacagggaggaggcggcggcagcacgaccactgccacatgaggaggaggaggaggatgatttggcggctgtgacgtgcggcaccgaccattgcaacgaggagagactgcgtgcaaccgtgcgaggaggtagcggaagcgtgctccgcgagggagccacgtggattctaagatttattgaatcataattcacatattcaacagagaaatattagtaaaattttacagattgctaatattttaaatctgcttcgcgattgctctagtgagcttcttcaacaactcgtgcggccttgttgaataacaacaaataacgagcaatcatgcctctgagattaataaaaaaggcagcagcagcaagcttccaggatcgatcaatcagttggcaagacagcgaacgacggcggcgtcctggttctgggcttggaaccttggcaatctccttccccacctctcctcctacctccaaatcctttgcttagcttctagagtcttttagccccttgtatccttccaccttccacctcaaaaccttccactattgtaatagaaatcagtggcttcttgtattggattcgcactgctacttctgagtttgctattgttccaagcgagataactgggatcctaacaatctggtatcagagccaccattcccccaccaaattccaccatgagtgaccaagagtgcttggaggccaatcataggctagaggagaagatcgatctgattttgaagaagttgaatgagatagaagctaacaggagcaagttcttcgaggagatgagcgcctccatcaaggcgaccactactgtcctcacggctgcatcacatcctccactccaggcaccaccttcttcgacgcccaccacctgtttgatgaagtgctccaacgacgatcgtccttgggcgacgtcgagctcaggccacatcgacaaggagactgctccgacagttgccctagaccttggggatggcgaggacaaggttcatgacccctgcatcgtcaccaaggactcatccaaggtcacgcccaccatgtgttcgatgaaatgctccagccccgatactaagcccgatctcaccatggttgcggaggttacctacgccagcgcagccactgcctctatggagttggtaactgctcaggaaaccattggtgccatgtacagcgacacctctgaccattccaaggtgatgcacaccaagtgtttgacggttgtcctcgatgccattggtgacaccggtcaagctatggttgtgttccagacctggacagatgcatttaaggacgatccaacctccgttcagttcatggactttttctcatcaagtatgatggctaacatcaagtggaacacaccaatgcccactaagtgttcggtacagtgccttgggcatggcagcatggcattgatgcctacaaacccttttgatgttaatccatggccacctcctactctagaaaaatatagaagtcaagcagttgtgcatatgttgttatttgagacactattcaatgaggagctaaggttggagagaattgaattgaagccatggccacctccaacctacgatggagtaattagtggatgggattcacagcctatggctggtccaaaattcaaactctattgggcaagagtacgtcgtttgccaccttggccgccacctatcgaagtaagttgtcttgcattggtgtgtcatgacaatgtaatgattttcactgagctgaaggatattaatttgcattggggtgagctgaaaccatggcccccaccaagtcaaacaaacttcaaaaatattatggttcagcccgagcaatgcaagtattggaaaattagagtagaaatgagtatatttgctaggaaggagaagtggaatttacttaatcagaaaagttgcacaatggttgcaatatctagcttgaaggagcatgtcaatgggcaagaacagatctggtgtagaccttggaatcctagtgactacaaggtctcccctgacataattatgttgattacttcgtccgtactgcacccctatcatttggaccatattgttagccttacatatcctgaaggtttggacactctagttagtcataaggtggttcagtttgggagggctgatactgcatgcagtcatcaaaatagacatacaattgttaggacaacagggacatttgttaggcctgagcttggtactgggaatggtacacacatattacttgtttcagaggcagaagctggatatgtgtccataaggaatttgcttgaactgacaaggaatgctaggcagtggcataattccatggttgagtatttgtcatggtttgtggatgcatggatggttgccaaacatgcaagtaattttggttggtatcttagttgggcttcccaaattaaaaatatggtgaagaatttgttgcgacaggcaaatagggccagcaattttga

SEQ ID NO: 67930 - DNA, 21217 bp, Oryza sativa
  unsure (1)..(21217): unsure at all n locations
tgagtatttgtcatggtttgtggatgcatggatggttgccaaacatgcaagtaattttggttggtatcttagttgggcttcccaaattaaaaatatggtgaagaatttgttgcgacaggcaaatagggccagcaattttgacacttctatacttgagatgaacacacatgttcagaaacattcagcttatactcaagtgcatagcagagctgaggtagttactgttaaacctgaaacaaaggagctattgaacgctgaactctagtcctttgctatgcttgtcagcaacaagattgaggacaatgattttgtattgctgcttctgaaacatctcacttccttaagattgatagctaagattgcattgatcatgccatgggatctagctgaaagcgaaggacaaatttataaagcttttgggacagtacaagtgtgcaatataaatcaagagtggagctttgcaagttcaaaagtttatttgatatcgacttgcggacaagtcgaatttcaaggagaggggattgttaggatccgtgggctgtacgtgggccaattcagctgctacgcttacaaaggcccaatcatgtctatgagattaatacaaaaaaggcagcagcaacaagcttccaagatcgatcaatcagttggcaagacggcgaacggcgacagcgtcctggttctgggcttggaaccttggcgatctccttccccacctgcagctcctcctacctccaaatcctttgcttagcttctagagtcttttagccccttgtatccttccaccttctacctcaaaaccttccactattgtaatagaaatcagtggcttcttatattggattcgcactgctacttctgagtttgctattgttccaagcgagagaactgggatcctaacataatcttgaccatttagagtcctaggttagggtcataatgacaagagggtcagaaaagggggaagatagagggggggggggagtcgttggttctattgggatgactgtgggtgttggaggactgacggtgggatgcaccatcggcgccgtggggacggaggagaacgatgggtcagcgtcggtggtaagggctaaacaaagcagttggtttggagctaggtggtgacagattatgcggtggagtacttaatggagacgtgaattaggggagggggggaggggctcgccggtgttgtttgtgccttctgcccaccaatgatgcttggtggcggcatcagtgctcgaggaagtgtgcgggggcaagctcgcgtcacacttgtgctgcgtgcggctagggaagaaggagaatgggaggaaaatgataagatcatattgttacgtacgaatcttaaagcatatagttgtccaaaatacgaaagacatgagctacgattttatgtcataagatatactcatctctagctcattcagtagtatagattaatgccctccgtttcacaatgtaagactttttaacattgcccatatttatatatatgctaatgaatctagacattattatatatatagatttattagcatctatatgaatgtagataatgctaaaaagttttacactgtgaaacagaggaaagtacaattttaagctgatgatgcgttcttaattagaaaaccactagttgactagttgtaacgaggctatatataggaattgaagatggattctcgtgcagaccagatttcggcccatccacgtccaatgttaggtggtaaaagttcaattttcgtccttcaactctatatcgagttttattcgtgtcccttgtctaaaaaaaatctaccttactgagtggtttcgataatagttttatcacatatgatacagtataggtttaactggacccaggtatatgtgaaatcctccctttcttctacacctttgaatgacgcgagtgacagcaaagtgtatggatgtgacgatagtgctaccatatattgcatcctgtgtcgccattatcacacacgaacgataactatatattgcatcctgtgtcgccattatcacacacgaaccagaacgcaagtgtgacaagggctccatggtctccgtcccatgctttgccttattctatgtcctcgtcttgacactagacaaccttatcgacgagattgaccgcttggagggcctcttctcttcgcctcatcgaacaattcctctgtttgcacatttttaccacaatcagccacccagttccctgatcccctcacctattctcattgaaaataaaactaaacaaaactgacatattacatattatattcaaaacatttaatgggtagcatcaaaattccaacaaaaatatgaattattggattagtaagagcaagtctaataatacagccaattgccggtgacagtagtatccaggtcatcaaaaaccttcataagagccgtcaaatacaataacagtataataggatggtccaccatattatctaagagaataattaactctgacaaaagcacaccaaaccttctctctctaccttgtctccgtcgcgccagccaccacacaccatccatttatttctgatatcttttgtgtactctcccatcttcttccttgtttttttatgaacacaagcagcaggccaagcttgctcttgagcttatcgtgggccgtctcccgagtccttacacgtggatgctgtgtcagcccgcggcaccacctatcgccgccatggtggcatgtcctcgagctcctctagtcatcttcatgacaaccttgagcttcacgggtaagctaagaagcggtcgcaagtgagtccgcccgctggaggtctggagcaagctaagcaatggtgtgacggtagcgagcaagcaaggagatgacgacgatcccgcgacaatctttagctccttctctcctcatcaacgccttcatatgggaagttgtgctgtagtcgggtgataggatagtcgccggctcacattctctctcactccctctcccttccaacccatcaccacattcgacgtggtctccttttcgccagtccacggtgtcttattatacctgctctaatatttgataaggtaatgatgtgatttaaaaaaaaaacaaaattcagttgcaaatgcacaggcattcgtagaccaatcctaccacgccgaccaaacaccaccttccccgccactagcttatcctcctcgtcttcccttccatcccccaacccaacccaccaccgcctcgccgcggtcgccggcgagaggcgccgcgctgcgcgcgtcgagaggatcgcctcctcctcctcctcctcctccggcagccatgtcctccatccacttcttcccggccacctcccaggccgccgccccgtcgcgccgccccctcaccaaaccctccccaaaaccccccgccgccaccgccgcgtaccaccgcggcggagacaacgagccggtgctcttcccgcgcctcttcctcaggaggcgtgcccggccccgcccggcgcccgccgaggcgcccccggtggcccccgacggcagcagcagcggcggcgggggaggaggaggggagggngggcggggcggaggggaccacnaggaggatgaggggacgaggaaggggcttgtgccggagtggctcaacgtcacgaacgacgacgccaagacggtgctggccgccatcgccatctcgctcgctttccgcttctttgtcgccgagccgcgcttcatcccctcgctctccatggttttccccccccccccaccttcgacgtcggcgaccgcattgtcgccgagaaggtccgtctgctcttccttgacttctttcctttttgtttttgtcaacagaggattcagattttacttaaatgtgctgattactgagttccgggtgcacacatttgcctaatgtttctgataaaatgtgtgccttttgaatttcgacttgggtaagtaatcaatacagcacaatcgtagaaatttgttcacgtacttgttacttgttggtttgcttcctggttgcgtagcatatgatgatcactgccaaattttgtttagacgataacctggtataagcattggtaaaacaaaatccccaacatactagaattccgcattgacatcagcaaataggcatatggacacatgacacatgttcacattatcatgctcacctctgcaggcaatggctgatcttttgcatattgttttgtccagccatcagtcaaacagtcatatatagcttgagttagctataaaaattatgaatgagctgttttaaatgggtttcacagcacttctaagtgtaacagggaagcaggcgtagacagtccgattgttggttaacattttaggacatattttttttttcatttttgtgttaaattataagaaatgatcatcgtctagttagatagcatgccttaatatgttctatgcctcctgttggcagtaaaaagttctgaaatgaggctatttattttgtaaaaaactgccttcacaagacttgttcataatctcaatagactttgatcatattggggatatttggagtaatatacgataacctacataagtatagaaaacaatgacaatattccacataaaaaagagagcatgacaatatgcaccctttgaattgcattaatctttctacataatccttagtccaaagtatgtgcttgttgtcattaacagaactagcacggtggcccgcgcagattgcgcggctagcatcactatattttctctcatataatagcatatatgttttctcattatattatttaaatatattaaaatgacaacataattttaaattttgcagtaactttacaaaactaataatgtgtaatattcatattgtattttatatacgtgttagttattaattatttttaatatcaaattttagttatttgtaaattatatatattcctatatggactctagacttgtcttttaatatttcttttttttttaattctgaattttctgtaaattgtatttctatatagactctatgctcttcttccaatattatttattttatttctgaatttttattatttctaattgtatttctatgtggactctaaactcatctttcaatattctttaatttttaatttcgaatttcagttacttctaaattgtattcctatattgactttaaactcttcttcccatgtttttcttaatttcgaattttagttatttgtaaattgtatttttatacggactctaaactctacttttaattttattatgtttatttcaaattttagtttgttttaaattcctatatggactctatactctacttctaatattccttaattttaattccgaatttcagttatttcctaattgtatttttatatggactctatactctacttttaatattccttaattttaattcggaatttcagttatttcctaattgtatttttatatggactctatactctacttttaatattccttatttttaattccgaattttagttatttcctaattgtatttctatatggactctagtctcctcttctaatatttcttattttttaattcctttcaactatttctaaattgtatttataaatggactctagtctcctcttctaatattccttatttttttaatttcgaatttcagctatttctaaattgtatttctatatggactctgccttttctttttctccgattaatgtgagaatttctaggccatgagagcgagtgtggaggctcctttttctattcctttaataatataatagatgtcacaattctctcaaacagttcctagtacatcttgggcacagggtttgacctatcggaacactgatttgtatcgggggtcaccgaagttctgaaatttcggaaatattgcggaaattttggacgatttttttttaaaaaaatgaattcaaatttaaaaattgtgggcgaaatttccaaaaaaagaacaaaaacagatagcaacactcgctctgtttggcagccatacaagcagcagcagctgcatcacaaatttgcggcaattcttaactactgcagctgtggcaaccaagctggaaaaataccaagctgaaaatgcacaaggaaatataccaatctcgtcctagaaccaataagcccaaccattcttccatcaacttctagaatatgagatgcacatgaacagaactagctggttgttgaagaatatactgagaacaaacaaatgtgaagaagagggataaccaagctggttgttgagcaccatcaccttcaccggcaggttctcgacgtggatcatggcgagcnnnnnnnnnnnnnnnnnnnnnnnnnnnnnnnnntcgatgtcgaccaccgcggcaccggcggcggccggcaggccgaagcccattgcgcctagcctggcggatgagagccactgcctgggtctcctgtaggtctagtactatgtcgcccacatctggtgctgcccgacgcccggctggagcggctgcaggcgacggctaggggcgccggtggtgggctgcgtcggggcggcgaggcggcgaccggcgtcgaggcggcgcctggcgacttggcgagatggtgatttttttcgatctgggtgtggtgtggcgcaatgaggggaggcggagggggggagagaacggcgatttagggttaggggagaaaatcgcgtcaaattttttttggccgaaatatttgaccagagctcacttacaatcgggacccaccgaaacgcccgaaatttccgaaatttcggttccaaaatttccaacgccgcttcggcataatactgctttgttttatccaactaccttttctagttgtgatgattgattagtccattattaatattttaactacgatgaatcaggataccaaattcattgtggttgttgcttattttcatttgctgaattccaacctttagtgtctttataagttccaaaatttgtttaaatttgcaagatggtatgatggaccactattaaaggtcacctgcatgggtgtataacttcaccctatatattgttattcatgttgagtttgtttatatttctgtcaaaagatgtctttttatatcttactaagcaatgtattcacatcatatcataaatttaccatatgaatgcttttcaggttacatactactttagaaagccatgtataaatgacatagtaatcttcaaaagtccaccagtgctgcaggtacttgcatattagctaaaagtgtggtgttttgggaatttggatgatgtttgctgtttttcttgatatcactgtgaatgtttctgttcaggaggtcggttatactgacaatgatgttttcatcaaacgaattgttgccagggagggagatgttgttgaggttgctttcaaactgagaaacttctttttcatgtgtataactatatcttgtaatcttcacttaattagtttctttttctgtctatgaattccttcctgcagtctttgtgtgtgttaatttcaacaccatgaaattctttgaaattttttaggtagtccaaggagtgtactaaaattgggaaacgtttactccatactgtttaagcattggagaaatcattatgtctattatgtgatcacaaaatagatttgtgatctttccatcttcctgtgctcactttgtgccatgagctgcttcatggtctcttccacatggcatgatactccacgtcagctgcaccaggctcaaaggcaaggcccgctatggcaactcctcagccacatggcagttctactttggggatggtggcgtcagtcttgcaggaacggcattgatgtttgagatgctgagtgtggatgtgaatgctggaacagtctcactcccacttgcagtggctagggcggtgatgctgtcactgatgatgagtcttgatatcttgttcttgtatgttagcctacaatgagtctgaggtcttatattcttctatgttagcctcctcgctgccactttctgccctcttctcctgcattgttgttcttcagcactgttcttccagatcagttgttttgagctagaatttgcgacaggatgacatgtctcatggaactttagtacttgtgaagtataacataagcaatagaaaaatccttaccctatgaattgtttggagtgacctacttactgtgctcaagtattaatttaggttctttctttctttctttcttttgaaacactgtgacatcctcaaacaacaaaatacttaattttcttttcatcttattgcaggttcataaaggaaaactagttgtcaatggtgaagttagaaatgaagagttcattcttgagccaccttcttatgacatgaacccagtggtaagatattactgagccacccatgaatgatacatgagctcaataatgtaacaaccaaccaaatatagtttgaaccacattccccagttaaggctgatgagcaataagaggattaagaaaacacaaatggtttattagttttgattcactgacactacatatgtggatgtgtcagtggaatgaatggagacatttgaagaaacaatcttgattagatcccttactgttactgatttttaaatactttatctgcattaataatcagacgtatatcatgacgaattacatataaaaacttgcattttgcgtgtggtatacctccaagtaagctgaagacataaaatttctatagaatctattgaatagtgctcactagccacacctaggtggatatagatatggttaccactatttatagatacattattgtgtatggtttcttgtgttgtgtgctgtgtgcatattctgtacatatgcatgaacatgaagttgtcaacaacacttcatacttgatttatgtttcaatccttgtagaagaaaaatgaacatgattcttttctgggttatatttttgtgtttgttgatactatgtttttcatgacagcaagtacctgagaactcagtttttgtaatgggagataaccgaaacaacagttatgattcacatgtgtggtaatactctctgctgattttcccatgttacttactattaacttgttttgtatcttaattgaattggcctgtacaatactgctattattttcctcaggggccctcttccttctaagaacatattggggagatccattttccggtattggcctcctggccgaatagggagcactactactgattgcctcatccctgagacaaatccaagctcgcttattgatgtcaaactggcaaagtagaagttcaggcattgattattgcagtgtgaagtttgcgcttcatgtaagctcctattctttaatattccctctctcctggaaattcggaggaatatttgacagcaggccacgtagaaattagaaaggagaacacatttggttctccttgatgtcacaaagaatgctagcaactagcatgagcatagaaaccattttgtttcaaggtttctgcgactctcgctctttgttgtatattaagactgtaaggatgttgccttagtgattcgcatcaaatgattcttcttgtacatcacgttttgtagcaccacgtgtgtatcatcctcatacagtgcttgacaaaagatgtgtaacgcgttgagccggcagttcacttcattgccttacatgttgctaatgctgacagattcttcagaattcaagttactgccatccttttggtctgtatgaacaattgctcccccgtgtcggtgtactcatggatggcatataaatatttaggtttaaagaagtggattgaaaaatatatattggttatcaacaatacaatttcccaaactatatatgatgattctatgagcagggatcctgcatatttttcagacgggagaaatctgaaatctgtgcaacctatatatatatcaatccatccacgcggcacgtcccttcaatatcaacacggtggcgtgcacaatacacagtcgcacagaagaataacaaacaaattggtgggtgttagtttccctctactgactgaaatcgcttgcttgctttagtttagtcgcgttggcatggaagtaaaacccatatttagtcagattagattccctcctcacgcagcaattggcaaatgcttggttggttcgcaaacgcactactaagagtgaataaacagtcactgcaacatggcccagcagcaaattaagcaggataaggccatcatttcgatccaaaccggccaaccaagcaagaaaaccagcaacacgtctcgatgtcatcacatgtacatgatctccagcgatatagagcgcgcgcggcgacgagtcacgactgcaatttgcgacgcaagaaacctcctccctttagatcgcggcaacacatacgttatctctgacaaacaaccgtgaaaagaataatggccgtttcggtagatcgatctccaattgacgatcgaattgggaagaagcacctctaaccttactgctccctctgatgtggtgttcactgatatatagactcacaagctatggaaccgatatgccaaccactcaaaaacagagaaaagtaaattagagattcatgagctgtgaaaaataattaagggccgttttctagctgtcctattcatggatatgatcaattggtaagtgcctgcaggcacctagccagagactatcccgccgtattatttcgaccaaattctccaagcaaacatgggaagatagatacgtactcctacgcgtgtgccgtggccgtacgtacgtgtgcctgcatcttcaccgcaagtcatgcacatgcgcatgtgcttcatcctagcctacgttgctgttcccgctcgccacacactttcgcctttctgacttacacgcgcgtatatatacacgcagcacgtctgcaccggccgtttcaccattcctcgaacaccatcatccacaaacacacaagtacatctcgatcgaagctagctagactagagcacgcacacgtacgatctcgtccatggcgggcgtcgctcgcatgctcgcggccgtggtctgcgcgatcatgccggcggcggcgatggcggccggcggcgtgggcgcgctggagccgagcgggtgggtgagggcgcacgcgacgttctacggcggcgcggacgcgtcgggaaccatgggcggggcgtgcgggtacggcaacctgtacgcgcaggggtacggcacgaggacggcggcgctcagcacggcgctgttcaacgacggcctcgcctgcgggcagtgctacaagctcgtctgcgaccgcaagacggaccggacgtggtgcaagccgggcgtctccgtcaccatcaccgccaccaacttctgcccgcccaactgggacctccccagcgacagcggcggctggtgcaacccgccgcgcccccacttcgacatggcccagcccgcctgggagaagatcggcatctaccgcggcggcatcatccccgtcatctaccaaaggtaaacaacacaatcacatatgtctagtggtcgttgcagtgacctgaatagcactctaaggttctaagttcagatcttcataggagtgaatttcagattatgttgtttgagggactgagtttccgattcaagacgatttgagaggctggataaaaaataccattctctaaaaaaaaattatcaccttcgacatcgcaacatcgatcaagcattgatgattgattctactgggtggcggagtcaaaaaaaaaaacattcacatataaggctgagctaatgaaagttcaaatattttcacaaccacatagtattttttaagattataatgagagctatggatctaggcattaggctcgagtcctggctgccccatgcctgatgcggcctcaaatttgtactaccaccgtaaaaatcactttatttttgatgtttttgtgtagggttccttgcatgaagaagggcggggtgcggttcaccatcaacgggcacgactacttccagctggtgctgctgaccaacgtcggggcggccggctcgatcaaggccatggacgtgaagggctccaagtcgccggactggatggccatggcgcacaactggggcgcccagtggcactcgctggcctacctcaccggccagggcctctccttccgggtcaccatcaccgatggccagacgctcgtcttccccaacgtcgttcgccccggatggaggttcggccaaacgttcgcgagcaacatacagttcaagtgagccacctgatcgatcgaagcttctatataggcgcagctagcatcgtcgtgcatatgcgtgaaggatttaatttggcgtccaaactttatatatacttcttttccaaaatgatcgatcactctctcaatttggatgctgatgggggttgatttactatggtattgtgtaattaattaccagcctgaaaccaacattttcattgggcttttgtatgtatgtgcgatgtacataaagagttcgatctaaatgattcttatggaagtatgattatcacgcgatttgagtaaactccaaatttggtgtttagttgagtagaccataagttggattcccttgaggagataattacaaggttcttaattagtgtgttaaatttgtaacaccttctggtatatagctattttggttcaaaatccgtaaaaagatctcagataataaaattgtcgaacgatcaacttgttggaaagtttttgtaggcagtggcgagttacattggggtccagtagatcgtgtatagtagttgtgcttgcttgttaatactacctccgtctaaaaaaataaataaatcaaatttaacttacgaatatggactgatgcttattgagattcacagcgaaagaaatcaattttaacttatggatatgttacaaccgtgcgcgtaagtaaggtcgatctacacgcgatgactatactttgtttaagatattcgcaacgggaaatataatcttgaagctagctaccttgtgcgaaagattattagtcaaaacggtgaagtacatttgtgggtttccagcgtcaatgcacctagctagaggcagctatatgtatatagcttgaacagtaagcgttagactctgcagctaattcaagcaatggcgttgagaattcgttccccacaacatccctcacatgcatatgaagctactacgtacttgggatttcgtactaacggttcagttttctctcgttgaccttcctggcgtacaaaatttgtcctcgctttgcgtcaatataatccgcctcgacgaatgcaagacgagaagcccacgtccgtgcgcgctgtcagcccagcccaatttgccttatcccttttcctcttcttgccggcccagtccacttcctcttccgttgaaaaacgagatttgaaggaagagacgtctctctattgtgttgaggattgaacatgggactttagtattactactacactataaagtgtatctggcttcgtcttccatttgtcttatcgcgataaccgaattgagctagatcgagcgtaggcgatcgaggtgcccggttccggcaaacgatcaagcttggggaccaacatgatggatgggagttgggtaacgagaagactcgctgtcgccgatactgaaacccgctacggcggcgccaccgtgcgtcgtcgacttggctaattgcaacatccacaagaagcaacctgtcacaacaagtactacaagtctctacctgatgagcccggcaaggtgcaccgctgcagctacctcctggtgctccgcgcgcgcggcgagctgctgctgtccagcgtcctacaagctacaggacgccggctgcaccggccacgagcgcccctctcggtgtcggtgcacgtacgctttccattgcgacacagccttgcacgcgctcgatcacgatccggacgacgacgaggcgccgccgccgagcatgcatgggagagaggagagacgacatgctcggtgaccacgtcctcttcctgggttacccgtgcagcttctaactaaacgttaggcaataaacgataaaagaataatagatcaatcataaaagacacaagatttaacgtggaaaacccttccaaagcaggagagaaaaaaccacgagcgccagccaacaaaatatcttcactatatcggggtgagattacaacaccgaacgacggcttaaaagaggtatatatatgatggtggaaccctaaaagggatgacgatccgcttcgctctggctcaagcctccggcgacaggcctccgctgcgctccagcagaagctagcctttattatgtgtaaatgaatttggaccacaactcaacagcttcgccgcggacgccgtgcggtttggctgggacgcgcgcccaacggcagcgttgacttcgttgttaggtcggagttagtgtaggaagaaatagaaggggtttaaataaactagataaactacttccccttcccatttacatatagtaaaagattttagtaggggcttcatgagagctctcatggtcctcgccccagtattagaggctcgagaccctgccacattcatgctagatccgcccttgggtcagaccgtcggagccttgccgtgtgtataggtacaacttcacgtggatgcatggcggcagtggcggcacgtgacactggtggacatgctgcccgccgaatggaacgacaagagatgcacgtggttctttgctgagcccgacattaatgcgaagaagaagaagaagaagaagaagaagaagaagaagaagaagaagaagctccagcaagccggcaacgccgagacctgtggatctacgttgtcgatctatccccgaaggtggatacgaaaagcacaaaataaatttcctaagaggctaggactaccttaggcaactctcgcaatttcctaagactaaccacaaaataaattacttttaattgaaaaaccatatcatatcatttgtgtgtagcactagcaacttttgttcgaatggtcagaccgttgctgacgttttatataaaaaaaagggtatcctattttaaggagaaaacgagaccaaactttacaatgcatagttgggaaaaagtgaaattaaaccacaactacaacaaactctccaactacgacggcaacaaaaagggacagccaaacacaacactcaacaaacgttgctcaacatgtgaacaacaaggggccaatcaacaagctagaacaaaacaaaactcctacactggtcggcgtcagatgcggccctagaagtgaaggcatgttggatctggggcatccacaccttggtccggcaactcaccggctcggctggtgatgatggcggctccatttattggaggatgtcgacaactgtggtgcaagaaagtaggccacctccatacgctgtgatgggctagggcggctccaaacacacctgcgagcgagcgcaaccgatagtgggattgctctaacatttgtagctcggtgaagaccaaggtgaaaacttgaacgatgatgcctgtgggcgtcgtttctttcttggaagcattttatgtgtctccccgtccagttgtgttttgattctctgggttaaaatctagcacaattcttgaatcggcgatgaagacgcattctggcatcatgtccttcttgaagtcatcatggaaagaaatccatggtagtccctagttttaccttgcattgcatgaagaatggcatttgggaagtctgagctgcaatgttgaggcattcgacgagcttggcaacgatgactcgaagctttgcttggtttcattcagggtttgtctgttgtcctttgggaagtcagtgctgctgcgcgattgcaagcttggcaacaatgacccacatcagaccacgtcagtcgtgtttcgctcttgtgtggggtagcaagcttttcagtttgcatggcttgtcggtcttgctcacccgtgcacaagcaagactggtgatcgtgaagtcggagctacgacatcgacgaggtgcgacgtgtgacaacgatgacatgagtccttttgagttatgcttcggcatgggtcgaggcgttgtcctgacttgttcttgacgaaggtgttggagtcacctgatcacgtgggtgatggtgtaatgacgagcactagcagcttaaacctgccatacttgagccacacacatgtgacatatggtattcgtaccccatcacagaccaagtcatttgtgaagggcaataaaacacaataggtgagtcatgtgaggttggaatttccacccggttgatcataggggttaactcttagggaccctgtttagatgggactaaaacttttaagtccctatcacatcggatgtttggacactaattataaatattaaacgtaaactattaataaaacccatctataatcttggactaattcgtgagacgaatctattgagcctaattaatccatgattagtctatgtgatgctacagtaaacattctctaattatggtttaattaggcttaaaaaatctatctcgcgaattagttttcatttatgtaattagttttggaagtagtctatatttaatactctaaattagtgtttaaatacagagactaaagttaagtccctagatcaaaacaccacctcataaattcttgcggaatgtgacattggatctataaattttctttttaacataaaaaatttcactatgatttgtgataggtattttatacggaccatcattgtcatatatcactgatgggtctcacctctattacgattactaggatcctaccatcacactccctccgtttaaaaaaaggcaaactctggctgtgtagatatgatgcatgtccagatacatagttagagtatactttttttttttttgacagagagagtacaattgtcgtagtgcctattaaagccttagagggtaataaatagcgtttttcgcatcgagcaggcccatgcatgatgcttgtagagtcgtagttgagtctgagcccgactttgcgatgaggctggccatgtgcacccatatcacccggttctccctaatcagatttatcgattacgagtttattatagactagaaaaagtgcccatgcgttgcaaagggaagaaaattaaggaaaatctccttggcggatccgaccgtttggagcagagggacgcaagctgccgtctgtctcgaaggcccgtccatctcgaaggtggagcaaggagagcggagccgataggtggcactaaagatgacatatgtttttatgatctcgggtgtgttaggtcttggatacgactcatatgttccgcttgttattgtgctcttttttgaggatttttgttctgtcacaccctcattttcgtttaagggatttgtaaattatttctaaaatttatattaaatttcattaatttacaagtgaagtttaatgtgagaaataaaatttcctaattaaaacatgtctatatttaatcatttttaaattatatatccatgattaattatactcttaggaattttcctattattaattttaataatacaaagaacattttagtaattatttaaacaattactccttccatctatttttgatagttatatttcatcttggcacaatgatcaaggataagtaattctacttatcatccatttaaacatgccactagttattcctctttttttttcgaacacgcaaaaggattacacgttaatatattagaggaatagagtttttgttacacaacgcaatcggccaaaccggcctatgccagagaaggaagaaaacaaagccaaaaacaaggaagaaaaagaaaaattcgtacgacgggtaacgctactccaaacaacgagagggggcagagccacgctacactcccaacaagtccccaaaggaagcaacgcccgctaatgaccacgcagccgaccctccgaaaggactctagaactactgagaccgaagagagcgcagagtcaaacatcctagagttacgttccttccacagctgccaagagaccaggaggaccagggggtcgaagctggcacggaggtgatcaggtaaacaagccctagaagatggctaccagtcctggagccagctgccacggggttgggggggggggagagcaatccacccaagaggtgacagcacccgtaactagactcgacgagcgaacacgcagtcgaggaggatgtggtttgccgtctcaagctcttgagcgcaaaaggggcaagccgagtggctattgatgccacgcttctagaggagatcagccgttcaacagcactgctgaaatgcaaaccagaggaagaatttgtatttagtagggcccttcacgtgccagagaagattgacacaagcaaagaagtgctggccaaggaagaatgcctggtacaccgaacgcgccgagtagtgctggtcactcgtccaacaccagacaagacgattcccgacacccgacgaaagctgaatgtgaagcaccatgtcccagacaagaagaaactaggagatgaccgggacagtgagggcgctgtggatgtcaaaaatccaagtgttgttcgccaggccagaagcaactgtgcacgaaccacacggccactgatctggagctaaggaggcaaccgagcggccattgatccagtgggcagaccagaaaagaatcgactcaccatcaccctgcacgaagaaggtggatgcctgaaacatgtcagaaacggcttgcttggctggggcctttaggccgtcctagtaaggatgccctgagcgctggagccaaagccaacaaactcgcagggcaaaccctaccaacctgaggtcagcaattcctaacccaccgaaagctttgggatgatagacattcgttctagacactcggcactgcccaccatgaaccgagtccgtgcccgtccacaagaaggtgcaacgcttcttgtcaatggccttgatcacccaggttggaagaccgatcgccatggacacatggactggtaaggaggagagaacagactggaccagcacagagcggccagccagagtggcgagtcgtcccttccagggtggaagacgatgggaaactttatccacaagcggttgcagggttgccttcggcaacttgtgaacggacagcggaatgctgaaataggagcagggaaaaaccgaatcttgtgtggaagaatgaagagtcgtgcattaaatcctcataaacaagcgattcattgatatttacatttctcgatgcgcatgtagccaatcttgtgtggaagaatggagagtcacgtattaaatccgagaaagtcattaatatgatacgtggttggattgaaatatgtctatcaaaagtaaattttttagatttggaaatatgcctatcaaaaatagatggaagggagtattaatgattaaatggtctagataaatattttgttaaatactttgagtgtccaattattttcatgttttttttgaaattatttaagcattggaagtgtttttgaaaattcaaagatcatttcagtgattaacattgacgacgggtgaggagacgcgatggcgcatgtcgaaaagagctacgtccacgtacgctagctctctggagaatcgagggtccagagtcggactgcttgcacgtatccatgccccagccgcaagcaatataatcggacaaatactactacgtctctatctctatttctactattaagatgtttttactggtggtttagtaagtcatccgtatccgaatctaattgccatatgctatcttcgattcaaaaactactgacgtgatccgtgggaagcagtgccatgtccacgtccgattcccacgtacatcgccatcgaatccaaatatgctcccgttgcctttttttttttcttaagcatgtccaaagcaccccctccgattcggttttaccattgccacgagcccacgatcaagcgagatggacttggctctgtactccgtatagattggagagatgtgcgcctggttagattggaaggaaataccgatggtgatggcctgcatgtgcatggctgcatagttgcttttttgcctaatctataactaatataaatattcgtattttttcgtttgtcacatctaattttcgtccgtgttttcgtccatacacaatccgattcggttagcaatagccacggaaaaaaactacaaaaaaaatcggtcgtcgccgaaccgccgtcgccgccgcagggacgcctagccgccggcggatcccctcctgctggatccggcggagggaagagcgccgccgctgctaggacgccgacgggccaccgccgcctcccctcccgctcgatccgccgccggtggtgggggagggcgccaccgccgctgccggtggtggggaagggcgccgccaccgctcgtgggaggaggggcgccgtcgccgctgctcggggggaagggcgccgccgccaccgccactcggggaaaggtcgagagagagggagagagcatcgggagcgcggaggggagggtggcgaaaagagagaagggagggaaggaaatgggctagggttttttcggcggctgaggagagggaggggggtttgattccccgatctcgacgctcggctgtccgatcaaaaccctagagatcggacggccggcgtcggccgggctgaaattggccctgagggatcgagagcgaggccacttttctggcccaagcctaggttgcggcctggagaggggaagtgcgcccgcgtgtttgcaaaagccatgggccgactagcaagggctggaaagaagtctattttaggtccctcgggccgaagaaaaagagaagttcattttagtacttttttttccagaagcatttacgattatagttattgaatgtgtttatttctgagcaaacctaaaaggaaggattttctttctttttccaattaaataattgttaaataatatttgtattattaaaattagcaattaagctctgaaaattccaaagagcgtaactaattctagagaatttaataaaattaaatttaactatgtcattttatttctcaacttgctttacttgtaaatttatttaattatacacttacctaattaacaataccaaatatttcagcgaatttgtagtttaattaattgcatatttttttatctgtacgcttcccgttgcaacgcacgggcacttttgctagtccctcataaagtataatttatactactaggatactacagggaaacggttttaacagctcgtggatgtccactagtttattgcatatcatttaaatagttatgaaaaaaattaaaaaaatatgaataagatagatcaata

SEQ ID NO: 67931 - DNA, 1290 bp, Oryza sativa
tcggtgacttgaatcgggattggaaatttgaggtggaggatttcgatttcgatgagagggaacaacgggatttgaattgagatattggcacaacttagactcgcacacaaagaacgaaaattttcgcaattaggattttgccgaattagtttttaacgcctcacgaaaagcggagcgttacagactatatgtaacggaattgctaactttggacataaaatccgtaaaataaaatttggaggaaggcacactatattattctctttaccgaaattctgtaacaagagtgcttgacacagggtcagtaaacatgtccttttatactattccctccgtttcaggttaacattttgactttgataaatttgatcaagtttatagaaaaagtagtaacattttcaacccaagaaaaaatattatgaaaatatattcaattattgatttgatgaaactaatttaatattataaatattattatatttgtctataaattttattaaatttgaaacagtttgactttgaccagtcaaagtcttataaactgaaatggatagagtactactctaatcggtgtctaagcaaaagagtggcacctacgggcacggccatggctgtgcaatattgtgatgtccaagatcgtttgattaaccaggaatattcgtcttaatttagctactcttcatatctgccttaatgatgagtcaactctaaaaattagtttccatccaattaaccactacacgccgttggtcgagcgcgattgatgttgctggccaggtgcagtatcacctgtaagtttcaaggaacagatgacatcgtttcttagacaagggagtaccccgaacattgaatactttctgcaaattaataattgagccgtccatttcaccattagaagtaaagcaaaccaagagaggtatcttctgaaattaaatcaattttatgccaagcagatcagtagtttggacaatacgtgtcttttttctaagataatggacaatacgtgtctgcgtgttcgtaacttcatttacaaatcttccgattaacccataagccatgctgcggctgcacgggcacatgcacgcatggcgatccttgtagaattaatccgaacaggctatatatatctagaccaatcatcccacgaatcatctcacaatcatcagaaccaaattcacagctaaatcgcacgcacaccacagtctacagcatctctgctttgcagctgcagcttaatttcagagctagcgagctacaactttcagcaaacgcctactgaccacgacgaca

SEQ ID NO: 67932 - DNA, 558 bp, Oryza sativa
gaattttcctattattaattttaataatacaaagaacattttagtaattatttaaacaattactccttccatctatttttgatagttatatttcatcttggcacaatgatcaaggataagtaattctacttatcatccatttaaacatgccactagttattcctctttttttttcgaacacgcaaaaggattacacgttaatatattagaggaatagagtttttgttacacaacgcaatcggccaaaccggcctatgccagagaaggaagaaaacaaagccaaaaacaaggaagaaaaagaaaaattcgtacgacgggtaacgctactccaaacaacgagagggggcagagccacgctacactcccaacaagtccccaaaggaagcaacgcccgctaatgaccacgcagccgaccctccgaaaggactctagaactactgagaccgaagagagcgcagagtcaaacattctagagttacgttccttccacagctgccaagagaccaggaggaccaggggggtcgaagctggcacggaggtgatcaggtaaacaagccc

SEQ ID NO: 67933 - DNA, 7189 bp, Oryza sativa
agaggggaggagatcgagaggagatggcgcgcggctctcggggtagtctttactcccgttggtataaacaaccgggacactaagaagtcccggttgtttataccaaccgggagtaaaaataatcgtgatctgtcttgaacccgacaactttttgaaccgggactaaaaatgatttttagttccggttggtattatcaaccgggactaaagatcaaaagtacccctcaacttttcaacgggactaaagatgctttttagtcccggtttttattagaaccagaactattgtagaatttggctgaccgaccaaagatggtttctccaccagtgtaaccaaccctgtacatatgtgtgccacgtacgtactgcaccgagttagccatcatggacagctcaaccacccaggcaagttcctgtgcacggatcgagttggccgccatcgccacgatttaattactccaatttgtaactgttaaaatacatttttagatacgtaccacaaagtatttcattattcggatcctaaattgccatgacacccctccaagattctacgtgacgtttatgtgacatatataccatatgaacgataaagtaacatgccacgtaaacatcctagtcctaaattttctttttcttctatttcctcccctctgcattttccttgtcttgttttttttttctctggccgagctgtcgacgaggaggggggcccgccacgcggtgagacgcgagggacgaagcagtgcgagcgtaccggaagtggatcgcttgcagaggagaagcgacgaggacaaggttggcggctgatctcgtgaacggggaatctcgacgtacgacacaacggcgggagatcgggaggctagcttagctgtggcagcgcgggagacgcgggagcttgacgaggcaacgccgccgccatgcgtggagctcggcctccatatatatatatatatgccgctcgattcgggcgtcacgtacgtacgccgatgacgccgcggagaggaacgcgaatgcatgcgcatgctgcaggagcaaattaacgttgcgtacgctcgcgtacatgcatgcgccgcccgcgcccgcccggccggatcggaccgcgtctgccaagagggactgagggagtgcgccgctcagaaagattacaagtagcaagttgaatatatgccttgattctccaagatttctcttggagatttcttgtccgccaaactttttcttctttacttctttgtcgccgatgccagcgcaagcaatccaaattggcgcatgattgcgatcgattgttgccgcgcggaaatatacatttccattaatttttatcgtaaaatatattgaaggcgcttctccatctgtctattagccaatcacgggcgttccccggccttttcctaggtttgaagaaagaagaaatgagaaagctcattaccatataattaattaagtattaactattataaaattagaaaatggattttttttaaaaaacaacttttatatataaaaaagcttcgcaaaagacacaccatttaatatttaaaaaaacatgctaacagagaaaagagcatgttaaagaaaataacaggaccacaattatctatcatttaatttatctgcctacttctcatataaatcaataacactaattttatttcagttctttaatttactttatagaaaaactccagaaaatgcttatattttggtttagtactcctatatttttgtttatgttcatgtgcaaccaatttttgtatatcggtaaaattcagacatggaaccaatatttccactcttccttcttcttcatctcctctaacttccatagaggtgaggaagaaattatggaggaaaacaatggcagatgggatccataagttgatttggccagccaatggggtcaaagctgcattaaaagtaagacggaatcgcctcccaaaccactaaaggaggaacaaacgtacaatggtcaaagctgcacttaattagacgtatggctaattaagtacggacaaacgtacaatgctcgctggttgtgtctctgcttacctggatcgaccgatcgagctaacatcgccgatggacactggttaagaatgataccaggtgaaacggtaaatgcgtcaatccgatccagcagacatggtcaacgtcaacccagcacagacagacagacttggtatatatcctcgaccatcttgaaatccctatagagaactcgtcatcgtcctcacataaaccgatctgttggcgagttcgatcatccgagatcttcatctcactttttggaaaagaccgaaatttcatgattcttagagctttcttgcaggaattatttaaacttataactgaatctgaataaataattttgaccaaattcacagaaaattagaaaaattcgagaacttcttttaacacttaacttgagatagtggctagattgcccggggtgggttttgatactgatctcaccttcttttatcacttaacttgtgacaaatttaactatcatatattctatgaaaggtttatcaaattattatcatatatcatctattctgtggaatctattctatggaaggtttactaaattattgtcatatataatctgtagcacggctgcctacctacttttactttttttttccctccaattattctaggacgtcacgactatagttggccataaggcccgaggcccgacggcctagcccagggcatgagattttgacccagcccacgcaccgcatggcccaatccctgttgggcccgtgtcagcacgacccggctattgggtcgtgccgaggcctatgccttggcacagtgggtcggcccggcacagcacaaagtttagggaggtgaaatagacttattttcagccatatgtatagagggcacacagaatagggaggacaaatagatgtattatatgcatggcacagcccaaagagtagggacgtaaaatagacatattttagctatatatatgtcacaacccaaagatgagggaggggaaatagacttatttcaaagaaagcacgatgagctgcctgtgccttggccgtgcctgggccataggtggagcacgtgggccggcacggcacggcacggctcggcgtgtaggtcgggccgtgccgcgcggcctgacaaatcttggcccgagcatgatcaggcctaggccgtgttgggccgggcagcccatttggccatttatagtcacgactcacaaccagacattttcaatcctgaactttcttaaccggacgaattaccctctcgtttaacaacaaggttgttttagtccttggtgacgcagatgaggcaatgtattaaccatgtgaaaatcagtcaacaacttaataacataaatattcttaaaattagggtggcctagctgtcatactcacagccccgtttcttccgcctctctctctctctcaacctcaacctcaacagaagtaggtaggatgtaacgataacctccacgagatacggaaggaatgtcgcaacgccctccagagttggccaaggaaggtggcagccatgtcctctaggagtcggaacagaaaggtggcagtaccactaccacccgtgacgcgccgcattgagttaggggaggagaggatatcgatggggtagaaggggcggcgctatgtgagatggtggcaggagggggttgaggtggtggtctataggaggaaggcgaaggcggcaacgaggggctaccaacgccgtggtgttggcgataaaaattatgtagaagcaaggtggtggggggaggcgcgcgccgatggggaggaagcgcatgatagtgctattgacctaccaaccggtgttgtttgtctacgggctcccattttctcactatttttccgttcgatgcaaattcaacgctacagaatgggctgaaaaattcaaatttattatttataaaaaaatgatacgcttacacactactggatacgtttacacactagctagacagtacaatactacatctttattttagatatataatagatagggcatcatgacatgcagatatctatcgcgttagtagggcctttcgttcttcatgttaccacgcgggaagtagttgcaagcgatgatggtgccgatgccgttggtattgcaggcgacgcgggcgcagccgacgtacgccgtgcgcctccacaccacctgcgtgtagtgcgtgcagccgagctcgcccgccgagcagtagttgctgtcgtagtagtactttgccttctcggcgagccagtagctcatggcgtcggccggcgtcccggtggtgccggcgccgtagctccaccacaggttctcgccgtagggccccgggatgtgctgcgtctggcagtagcgcgcgtgctgcagggcctgcgccgccagcgcgtcgttccacgccacccgcccgacgcccaccgccgcgcgggcgctgttgtggaggttgacgaaggccgccttctcgtcttccgagaattgttgcgccgtcgtggtcgtggccatgataatcatggcgaaagccgccatgaccaccaccatcatctttgctgatgctgatctctccattcagtttttcagctcctcgctgattcacgaattgttgctgcaacaagctattaagctatatacctctcgctagctagctagactccagtatgagattaacgcatgcaattaggcagtatttataggcggatcgatatgatacacagggtgatctcaacacgtacggctaataattaagtactataacatatgatgctctctggtacgtagtctctcagcaaaaatacctcgagctgacatggaccgatgcacactggttaggaatatgatgatataccaggtgaaacggtaaacgcgcgcgtcaatccgatccagccagcagacaaggtaattaaacgtcaattctcagcagacagacttggtatatatcctcggccattttgaaatccctatgtgtagaactcgtcatcgtcctcacatacaccgatccgtgttgccgacttggatcatccgatcggatgatcgttggtcacccacggtttacacgtacttttcagagaaagaacgaaatttggtcagcaaaatttcgtaattttcgggattttcataacatttttcacgaaattctttcctttaattgaatttaaataaattttgatcaaattaaaaaaaatagtgatttctgcagaccttttcgtgcatgcgggcccgccaaccgcatggtaaaactggttctagccgtatgcaaaaaccttctattgtatgaaagttttattaaattattaccatatatcatctattctgtggaatatattctatgaaaggattaataaattatttatatatataatcgatagcacggctgcctacctatttttgcttttttttccctccaattattctgggacgtcacaactcacaaccaaacgttttcaaccatgaactttcttaactagacgaattacctccacgttcaacaacaaggttgttttagtccttgttgacacagatgtgatgatgtattaaccatgtgaaaatcggtcaacaacttaattacataaatatttctaaaattagggtggcctagctgtcatactcatagccccgtttcttccgtctctctctctctctcaacaacagtaggtaggatggggaaactattctaatccctcgaggggatgttcctcatttgcttaaaaaccatctaaacggttatgaaaaattctgaaaaaatttgacaacattcatacaacacatatagacaactacacaaaatcttaagtgcaaacttaactcacacgtcgagatataaaaaaattcaaattcagcgtatgaatagtagcatactgtttatatctaaatttgtcttttttgtttctcgatgtgtagatcaaatttgaacttgaattttgatggactaataggtatcattatactctacattgtcatttttctttcagaatttttcacaactatttgcattgaatttagaagaaaaatgtatacgaggggatatccccctcgagggattagaatccacttctggtaggatgtgacggtaacctccacgagctaggggaggaatgccacagcgccctccagagttggttgaggaaggcggcggccatgtcctctaggagtcggtacaggaaggtggtagcaccactaccacccgtgatacgccgcattgagctagggaaggagagtaaatcgatagggttagaggggtggcgccttgtgaggtgggggaggagtgggtggtcgagtgcggcagcagcgacggcaagaggggtttgaggtggtggtctgggaggtaggcgaggggtgcaatgaggggctacaaccgtccacctctgtggtgtcggcgacagcggattctgcatgagcaagagggacgcgccgatggggaggaagcggatcgatgatagtgctacgggtccatcaattggtgctatttgtctacgggctcccattttcccatcattttgtcgtttgatgcaaaataaacgctccacagaatggaccgaaggattcaaaattttcaagcaattacttttaacttcaacatgcacttttcctgggcaattaatttagcaaatccgtacttatttatttattatttatgtaaaaaaatacatacgtttacacactactggatacacacacgtagagaatactacatcattattttacataatagatagggcaacatgacatgtgcagatatctatctatctagtagggcctctcgttgtatatgttgccacccgggtagtagttgcaagcgatgatggtgccgatgccgttgttggtgttgcaggcgacgcgggcgcagccgacgtacgccgtgcgcctccacaccacctgcgtgtagtggcggcactcgcggccgccgcagctgttgctgctgtagtcgtagtacggcttctcccccacccagtagctcatcgcgtcggccggcgtcccggtggtgccggcgccgtagctccaccacaggttctcgccgtagggccccgggatgtgctgcgtctggcagtagcgcgcgtgctgcagggcctgcgccgccagcgcgtcgttccacgccaccggcccgacgcccaccgccgcccgggcgttgttgtggagctggacgaagaccgccttctcgtttgccgagaattcttgggccgtcgtggtg

SEQ ID NO: 67934 - DNA, 17908 bp, Oryza sativa
ctaataattaagtactatacaaacatatgatgctctctggtagtctctccatctgcaaaaacctcgagctgacatcgaccgatgcacactggttaggaatatgatgataccaggtgaaacggtcaatccgatccagcagacaaggtaaactaacgtcaattcagcagacagacttgcatggtatatatcctcggccattttgaaatctctatgtatcgtacgtacgtcatcgtcctgacataaaccaatctgcttatgttgccaagttggatatgatcatcgattcgatcggatgatcaccgaatttcggtggtcacccacggtttacacttttcatgaaagaccgcattttggtggtcaccaaaagttcatgatttttgggattttcataacatctttcacgaaattctttgaaattttaactgaatttcaattaattttgaccaaattcacaagaaaatccaataaattcaggctagatagttgcttgccgagcgattcgaaattacaaaaggtctgaaccgaaacctaaataactgaaatcaccctgttttaacacttgtggcaaatttaattactatcatcgatgaaaggtttatttttgtacaagattacaaatctctttagttttcagtataacagatatctggtaaccttgagctcgtaagtgccagatctagacaccgagagggcttatactggtctgcaacaggttttggcaaaatgtggggtagtgatggcaacgggtactgcccaatattctgttcaggtgaagataactatcgatttttaacttgacacacacgatccgagccctgcaatcgctgcaccaagtatcatttggttatcaaccgtaccgaaactcgattaacctcgccgagaaggctaatccctgcacgcgaatcgaataacacaagtaaaaacaagaaagacaatagttcaattgcagataaatgattaatcaagaactcgaagttgaggttccacaaaccgatgaacggcgaaattgtaatggccgaaataatctaagcaaaaccacactctaaactatgattgtgttaacaccaaaatttgatacggttctttagagaattcagttaaggaaagaaatcgattggtagatggaagtttctcaagatcaagctgaattcgagaaatcatgaagaccatggtaaggcagtttcatatagttaatatatctcttaaataggcaaaattagttattttccttttcttgttaggagtcttgtctcatgtctgatctcttgtatcaactcaagggtataaatatatacacccgggtctttgtaaattatccacaaaacaatacaattatatttcgctgcatcgtcaaccattcgatgagttcttttttccgagtagggctgcattggttaaattcgatctccagcgagaaagtaaatttcgcttgtataataagcgaggaagaaaaaaatgcacctttgtttgatgaatatatgttgtaaccatggtcatattcctggtggtgatgatgacctcatcaggtagtacaacattgacggacacaatgcataagcgaactctccaaacaaaaacctttttgatcagactccagtagaaacacttcagaaaatcaggcatcccacatatggaatccaaactatgtatgaagtggtccatgtatatatatggcacgtgattttaattacgtattaacttttaaagttaatttgtttacggctggatggattgtcaaacccaatacactgtctagctaattaatctcttgtaagacaaactgcctagctagttaattactatgggcaccaggactatataactgtaatcttcaatgtttccgatgaatgacgttggaggttgaaattatcaaatgggatacacacgttctcttttggaacctgcagtggttagcaggttatatgatctgctatttttctttctgaaagtgatgtatcaatcaagttgcaattactttcgggttattcaactactctgatatatatataaaacaataaagtacacatcgatcggtgggcggtaattaatcaaaagaatgtgaaaatcaaatctgaagtcatggtgtattgcgtgtgagtagataaagggatgcgttgcattgttcaaatttgagacttcagattgatccaccgaatgacgattttaggtggccggcccattttatcatagaaagtgagtcgatcggtacaagagaagagataaaaaggagatggatttttatctctcgagaatatttcctcgtttcttacatccataaaaaccacaaaacatttttaaaaaactggcaatacatgctagctcgttcaaattcttagaagttgaatttgaacatgttttttctaagagttatatatctcatattaatatatcttgttatttttttaatcttttatgactattgaggtgacatgcaataatcccctcgagggatcaacaaattaagctggaagcggtattgttctataaagcctctacgaaaataggattgtcctcggtgatttcttaagacgtctatctgagataatttatcaaagctttattcgtttctcgattgtggttccttgaaaggaccacatatatgttagaatgattttctctaggctgcccatagacacatgtggaaatccggccctaagtaacaagtgggtttcgtacgattgtgtaaatagggcaccattcacatgcaaaaatagttgtgtacaattgcaagtagggtagagaaggaagatacaaaataatctattaagaaggtatataatgtctcgatacaaaacaatgttgtattataattttatctaccatatactctaacacggtgtttaacactgtataacttgcttgatatattattgcatggcttgagttcgaaaataaaaatcatgcaaagcagtagaaggaaattccaatatcataaatactattgcccgggatacagtctagggacaggataccttaatagtgaaccattatattccatcgatgtagatccgtttatccaccgtctttctctcaaccaatcgttctgtccttctccttcctccctcctcatactcccccattcacatcgatcctttctccgatcgccggaggaccaatcactcttcctacaccagatcgagaggccctagtgagagtatggatgccgacgaggtcacacggatcaatcagaattggtgaggtcaataaagtgtgaggctattgcggtggtgaggtcactgttgtcatcgttgaggagaaagaagagggaagacacggggcggagggggacaaggtctgaggcaccggtgatacggcggaggcggtcattctaggcatggagttgacaaagcggacagggggtggtcacaaggtacttctcatcacctctttgatgctcatctgtattgtctaccggtatgccatcctcggctgatgccatgtattgggcatgatatctcggggtatcacggatgttacctgctggtattaggcttggtttctaggtaccagggtttggtacccaagtatcagctagtacacataggtaccaggtaccaaggctaccaagtttcatgtatcagttagagcaagtataatagtacttcctcaatcggtgataacaacagccacatcatccttgtattacatggagggagaaaacatgaaaacaaacggagcgagtgcttgttgaagcgtcgggtgatagcacgataatttaggcggtatgaaatattttgtatgctttgtgggcatttggttcaattcgtttcatttaattaattatgatatgcatatcgctgacactaatgtcagtctatgatataatgtttccaaccgtgtctgcacgcacgtataaagccaagttggtcatttatcaaacatattagattggtttattaaaatgcttatattttaggacagacgaaatagtaacaaaatcctttatttatcatagtaagtacgaataatttacaatatatattttacagcgacgtcgtttattccatatacatatctgatgatgcgtacatgcatatatgtagacatatataggcgcgcgcacacacacaatccggctacatagatatatatctgactaaattaagtactcacttaattatatatagttactagaaaatatatatatagtctgctagtaagggcgctgatcgggccagttgccgggcggggaatagttgcagctgatgatgacgccgccgccgttgctgcaggcggcgctcgcgcagccgatcgacgtcgtgctccgccacaccacctgcgtgtagtggccgcactccagcagcgcccccctcgtgcacgtgttgctgctgtacacgtagtccgccttctcctccatccatttgctgaccgcggccgccgccgtcgccgcgctgctgccggcggcggccgggccgtacaggttctcgccgtagcccaggtcctcgctgttggagtgcgcgaggctgcaggtggtggcggcggcgagctgcgccacgtagctctccgcgaacgcctgcagcgtcgtgctccacgccacgtcggggaggccggcgccctcgccgcgccgggcggcgttgtgggcgtcgaggaagtcctgcggcgagctctgcgccgccgccgtgctggccgccatggccagcgtcgccgccgccagcagcacgagggcaaaggctttctgcgccatgctaattaagctaagcgctatatgagtagctgctaatgtgtgtgttgtacttcgatgtgtgttgcttgctgagggtatttatagctgaatcaggagagctagcttagctcatcgattgcatcaattgcatgcaataccatggctgattgcactaccaatatactccctctgtttcaaaatatttgacaccgttgactttttagtatgtgtttgacaattcgtcttattcaaaaaaatttaggtcatatcatttgattcattgttaaatatactttcatgtacacatatagttttacacatttcatattttttttaataaggtgaacggtcaaacacgtgctaaaaagtcaacggtgtcaaacattttgaaacgggggaagagagtatatatttgggacgtggcaatgaactttccaattattttcctgatcgatctttacttttagagtagcagtgtgcccaacgtactactcacgaacatacgacgacgatatgatgctaatacgacaggggttagaaagactttgacttggtcttgcactctcacgttttgctttgattataattaattggtcaattctagcaaactggtggccatggatggatccaaattactttaataccatggcgcgcgttacctccatatactttctttagctgggcaggtgaatcaacttgatgtttacttttctgtacgtcatacatatcgatatcacactatctggaaaaaaaatcttgcatgtcaagtattgttgataatgatgggtagcaaagcacagcctttttctacacatgattccactgggaaaaaaaatcaggcaacctatgtaaatttattgaatttagtggtatatttatatagtatatacctccaatcataagttaaagaatataagttgttcaagacttcttaagatcaaaatgagaaacatctagaggtcttctggctagctccacaaggtggtgagctagctaactgacggagcgtggggctcctcaccggaagaccgcgcaggcccccctttgccggttcggccgggggcgctaagtgaagttcttaaccctcgatctgtggaatgttcgcgagagagcaaatgcacaagacacgggcgatgtagacaggttcgggccgctgagaagcgtaataccctactcctgtgttctggtggatctgtgtgtgaaggggttacagagaaccggagagcaagagagttcgaactctagaactcctcttcctttttctctcctctacgtctcaggtacattcagagtcgtctcccagtccccccctcctttggtgggcaaggtcctccttttatatctcaaggggataccacatgcaccacttctacctactcttcttttgggtggggacccaccctatcttgaccaaaacttggctcgcgccttcgcctagaagctaaatcacagcttgtccttgagtgaggcccagcgccgtcacttgcctgacacaggggataaccctgtcattccttcattaatgggtggagatttgcaatggccgctgtccgaatgaccctccgatgggatgggtcatacctacctccactccgccggaagcagatgcaacgtgggagcacggttgtctgccgatgacgtgactggcgtcagaccagtcacagaccggtcattcttgtccaccgcgtgtcagtttagcatgccgcacgtctgcccttcttcatacaatgacttccttgccatggttgcgatgaagcctggaatgaatctggctgggactgacgtgctaactccaggagttagcacgccggctccggctagggacgagtgcctggaggctctcatcattccgacgggacggggcgaggcgtgtgacaggccgcctgttgccacctaacccgcgatctgaccggtctgtgaccggtcacacaccgcgactggtcacggaccggataaatgcgcgctgcgccgcattaaatgcggcgtgatgcgctcgtccaacccgctataaatgcggttaggtgagcgccgctgtgctcacctaacccacacacgtgacgccaacaccacagggggtcggggcgccgcagccctcggggccgaaacgggagcggcccgacccctcggggagacagtgggaggggtggccacgtcaccctcgggcccgacccccccgagggggtcaggccacgtgggtgaccgcggctgcccaagcctctagtcacgatacccccggtcccatgtcaccgacactaacctatgttcgaagcctcaccccttctaattatttgatattaggtcattccctaatatttgtggtttttttgttaagatcaaaatgtcatccaaatagtcatatacacttttgacaaatttaacagcatatgtatgagtatcatttcacaaatatacaagtctaaattcaacacatattgtatgttgaaaacataacagattaaactctaaatagtataaactccaaatagtatagttgtatttcaagctagctaggtactccctccgtttcgaaatgtttgacgccgttgactttttagcacatgtttgaccgttcgtcttatttaaaaaatttaagtaattattaattctttcatatcatttgattcattgttaaatatatttttatgtacgcatataattttacatatttcacaaaagtttttataattaaaagctttcgacgccattaattaacagagaagctcgatccagcagatgagtttctcaagctaatatgtggtgtgctgagtacttgttgcttgctgaggtatttatagcagctaaatcatgagagctagtatagcttagctcgattacgagagaggatggaaagactttagacttggtcctgcactgtcacgttgcttctagtagatgttaattaattccactaaatataattaagtggtcaattgtcgcaaacttgccatgcttgtattcacactgtgccttatagtctttggcacacagctgcatactttcttcatctgggcaggtagtgaatgcaacttgatgtttatttttcttgcttatttatgtatcctatagccaatagctcaacatacaaaaaataaaggagctattggatcatttctatgcttaatcacaaccatccattttgtagcttctttcaagattaaaattagagtaaatttcacaaaactacaggtattttgcataatttatcacaaaactacggatttaagagcttgtttcacaaaactacagatttagtgtcttcgtttatcaaaaaactacaggtattttgtacaatctatcacaaaactacagatttaagaacctgtttcacacaaatatagatttagtgtattcgtttatcacagtgctacacatttaatgtcttcgtttatcacaaaactacagatttagtgtccccattctcacaaaactacacgttttaacaatgctaaaaggtgtagttttgtgagaatggggacactagatttgtagttttgtgataaataaagatattaaacctgtagttttgtgaaacaagttcttaaatctgtagttttgtgatatattattcaaagtacctgtagttttgtgataaacaaagacattaaatctgtagttttgtgaaactagttctaaaatatatagttttgtgatagattgtgcaaagtatctgtagttttatgaaatttactcttaaaattaagatcatatatcctatatatatatgcccagctgggggcacaagacatatcgttgaggacagaggcaatattaatatttggcacgttgcaatatgaactttccaatgattttcctgatctttttctctcgtgtagccgcattacctaactcacgaagacgtacgtacggtattatagtacgtacagcatgcgagagagaggttggaaagactttgacttggtcttgtactgttttatacctcttgtagttcttaatcctaactactaaatataactagagttaattataagtggtcaattgtagcaaactagccatatatgcatgcatggatccacactactttagtctagcttggcacacgttactttagtcaattagtctttagcaacttgatgtttaattttctggcctatgcatgtatccatgtcacaatattatctggaaaaagaacatcgggcatgtcaagtattgataaataatactagtaggtagcaaagcatgcacaacccttttacacacgagtgtgtccgcaagctaggacaaaaatcaggaaaattatgtattttcccatgcagcgcgtctagctctccgcatgggaaaatgatcttttcaggcggaccgcccgcgcgcccgtctgtgaagatcgctgttggggtgcaagcgaagccgtcgtcgttcgtctgggaactggaaaaatatgtttttaagtagtaatagttattgtagttacttatgtacggtgttatagtacgtacacctctgatcataaaagaatataatagtactattcgtaattctttaacagtagtatacaaaacgtttgtaagtatggtccgtaacttgttttcgcggcatttattccaaccacctgtgactatgtacaaccaagggcatgtaaaaatcaaggatttgcgcggatgaatttcgaactgcacataaaagttgattttcatagacgtctcatttaaagaacacaccgtgaaaatgaattttcagtttttattttaaaaaacccaaaaaaatattttgtattcttattgcttgtgcttggactataggaaatgttacaatatatggataggatcgtatagtacatcccatgaattttttttaacactggtggagaaggggtttttactctcagttcgtaaccccctgtagtctcggttttccaaccaggactacaaatctgaaactaaagatcgctatctttagtccgggtgaaaaaattgggagtaaaaatccatttttagtccctgttgataacaccaaccgggactaaaaagactaatctggttgctctttattattttattttcttcattgtttttaatatatattgatttcacccccatcccgtcgccaaaatcccaaatcaataattctcaaattgcctccaaatccacaatcgatcatctcaaatactcaaatacatcacaaaatctcaaaaaaaaattacatcacaacttctacaaaattatcaaatattcacatcacacacaaatcaaatacatcacacaacaatctcagatccaatcaaatacatcatacaacaatcttagattctaaaaaaaaaagaaaaaaatccgccgcctcgccggccggccggcccgctgtgccccgccgccctcgtgccggctgccgccgcctcaccgcgcgccgcgccagccgggcctccgcgcccgaccgccctcagcctgttagagagaagaaggagaggaagataaggttgtggagagaagttaaaaggagaggaggagataaggttgaggagaggagataaggttgaagagaggaggagagaggagttaaaggagagaaggagatacctcgatccgatcgcgcatgcctctccgatctccgcgtcgatcttttttcccggttggtgctatctttagtcccgattggtaacaccaaccaggagtaaagcatatgggaatcttttttcccgattggtgttaccaaccgggactaaagatagattttagtccggttggtaacatcaaccgatactaaagattgaaaagtacctggagttttcaaaccgggactaaagatgtttttaatcctggtttttaatacaaccgggactattgtgaaatctggtcgactgaccaaagataatttctccatcagtgtaagaacaatagtatcccatgtataaatatgattatttccatataatatatttataccagtccgtaagacttcatataatcgaatcaaatatatgcagtaaccttaggtgatgaaaatcaaacacccctttatttagtactccctccgttcctaaatatttgacgctattaatttttttaaacatgtttaaccattcgttttattcaaaaacttttgtgaaatatgtaaaactatatgtatacataaaagtatatttagtaatgaatcaaatgataggaaaagaattaacaattacttgatttttttaataagatgaacggttaaaaatgtttaaaaaaagtcaacggcatcaaatatttagagacggtgggagtaatttgtaataaaaatacacaccggatacatatatttgtatctgtatagatatactcaatacgcttgcatcatgatgtacttattccatccgacacacacttatatacgcatgcagatatgcatacatacatacgaacatacatatataatatagttcgcacatatatgcgcatatatatctatagatcgattacgtacaaacaatatataagtatagtagcaaaatatatataccatagcatatacgtaatacgttacgtacgtatacgtatacggtagctagtacggcctctggttttggacgttgccggcggggaagtaggtgcagatgaagaagacgcctcggttggcgttgcaggcgacggcggcgcatccgacggcggtggtgtcgcgccacacgacctgcgtgtagtggccgcacatggcgccgccgacgcagctgttgctggcgtagtcgtaggagcccttctccgccacccactggtcgacggagctcgccgccgtccacgcctgcacggaggggttccacgacaggttctcgccgtactgatagttgttgcgatcggagtgccgcagcgcgcagtcgccggcgcgctggttcgcgtagccctgcgcgtacgccgccaggttgtcgtcccacgacagcgccgggacgccgacggcgctccgggcggcgttgtggatgttgacgatgtcggtcgccgtggtctgggcctgcgccgtcgatgtggtggccagaaccaccgccatggccgccatcaccactgcaaagctcgctcctctctccattgcaagctcgcagttgatttgattggcagtgtacgttcgatcgactgcgcaattagagtagaactagagctatagctagctagtagaggtgatgattaatacatgcaatttcggcagtatttatagacgggctggctctcgatcgagccatggacttaattaagcacatggcaaagaagaaacggtaaacgttgatacggcggactggtccctaattattaagagaaagaaatgggagaagagctgaagaggtgataagaccagaaagtcatgaacaaagcactcatgggaaagtggataatatgcgtggcaaaacttgttactacagaccaaattctcttacccagaatgtctgaaaattcttcaaatcgggtgcccgcgcctccgcgccgaaaaaaatggggcaccgcgcctccgtccaccacgcgccccaccacacgcactgttgcaataaatctgccacatattacggaaacactctattaacaggaatccgtttcatttttttttcaccaataatgtttcaacaagtatattcgtattgttacactatgtatagatcaaatgttgcagagaattgaaacatcctttcgctatttgctgaaacattatttttatatgcggtgaaatagcttcaaaaaccgttgtttcatgcgctgtagcaaaatgttttatgaggtgatttggttgtatttaagctttttaaacgattggaccattttcaatcaacgtagtgaaacaattccgatcgactgcgcaattagagtacaactagagctatagctagctagcagaggtgatgattaatacatgcaatttcagcagtatttatagacggactggctctcgatcgagccatggacttaattaattaagcacatggcaaagaagaaacggtaaacgccgatacggcggactggtccctaattattaagagaaagagatgggagaagaggtgagagaagacctgaaagtcatgaacaaagcactcatgggaaacaaagtggataatgtggcaaaacttgttagtgcctctgtttcagattataagtcatttgcttcaagtttaactaagtttatgaataaaatagtaatattttcaacccaatacaaatatattatgaaaataaatttaattatcaatttaataaaactaattaatttagtgttgcacatattactatatttatctacaacttaatcaaacttaaattagtttgattttcaccaaagtcaaaacgacttataaaacggatggagtactacagaccaaatacttacatgagaaaactcttacccaaaaagtctaaaaataggagtgggatgatggagaagtttatactccgtatatctttggtggagtcgatcagctaggaaaggatgtgtcgggtgctggatacttttggcgcttcctttggacgcttttcttgttgttttgctctttgtcgttccataaacagtactatcttcgttttctctagttaaaattgtctaagtttgattaagcttatagaaaaatataataatatttttaacacaaaataaacatattatcaaaacatattcaatgatagatttaatgaacctaatttggtgttttagacgttgatgaattttacaaatttgtgattgaactctaaaaaaatttctatctttgatcactatttttttttcataaaaagtaaagttacacgtgcactggctagtagatgggtggaaccattcaaatttccaatgcatatgcgtccattggaatatgggtaaccatgctttcctgccgcgttttcttcctttctagctaccctgtgacgttcatcagcaagtacatggccggatcgacttaatttgatccgcttgattattttgattagaaatcgatttcccactgaccaattcttacacgtacgtctatctagttgagaaatcatagcatgtcgatattattttatcaaaattgcggggaaatattactttgtctcttataagggaatatgtccccaagcttgttgcttaaataataaatgtcaatccaaataataatcatatattttgttgaaaaataattaacaatatagatcaatatctggtatcacttcacaaactttcacgtttacatttgatgtatgcatactagtcaaacaaacaaattaaactctaaattgtacgtatgtactactacctccgtcctaaaataattgtaattttaggttgtttggcatatattaaggtttgagaagaaagactataatgtccatctttaaaaggtgtatagataaaagtgaaagggtggttgagggtataatagggagaaatttaaatgggaagtgattaatgagacaattactactctattgtgacaactattttaggacaaatttgaatcctagaaatacaattattataggacagaggtagtagctagtagttatttttcaaggtatatggtaatatcaagcagtaaattagtaatgagcactctaatattttacccctcggccatatagctaaagctttttttttcttagctataaaattaggttttcacttaggccccgtttaaatctgcttaaaaggatggattaaattttggattaaagtggcatacttttcaaactaataaacggtgtgtttcgtgcgaaaactttatatatgaaagttcttctaaaatatcagattaatccatttttcaagtttgtaataattaaaacttaattattacaaacttgaataccatccattttatagctactattcatcattatacctccatatactttctttagctgggcaggtgattcaacttgatgtttaattttttttctggcatatatatcgatatcacactatctggaaaaaaaaatctggcatgccaagtattgatgataataatgggtagcaaagcacacccctttcttacacatgattccactaggaaaaaaatcaaccaacctatgtacgtaaatttattgaagttagtggtatatttatatagtatacctccaatcataagttaaaagaatataatgttgttcaggacttcttaagatcaaaatatcatccaaatagtcatacacttttgaaaaatttaacaatatatgtatgatatcacttcacagagatatacaagtctaaattcatcgcatattgtatgttgaaacataataggtagattaaactccaaatagtgtagttgtatttcaagctagctaggtgtatgttaacggttttgctagagtagtgtcaacagaaattagaggaggaagctttcaaattttcaaccgccaccggatatgcatcaaagattcgtaacatgagaggagaaaaatcgtgtgttttttctctgtgcgcgtggtatgaattaatctcgagacgctcgacttgaacgatagctatgctaaccacttgtacctatgcgcttttatgataggtatatactagtataagttataatgtaattacattataattatactattgttacatttgaaaatttttcactaaaaaactttttaatggtatataagtactcccatatgttaatatcatcaaataataaattcatttccacatgtcgtagctcaagagagtggtatatatcaaaatgaatttttcaacttttgatatttgtaaagcccctgcgaacaaaatgggattatcctcaggcagatccttaagagtccgcctatgataatgtttatttggtaagccttttccccattttcacatacggtttaaatatctaaccctatgtatatgacgacgtttcttgatacattaattattgcatagctagtgatcgaggtcgagaataaaatccatacaaaagtactccctctgtttcataacgtaattaagactttttagtattctccatattcatatagatatgtctagatttattaacatctatatgaattaatgtgagtaatgccagaaagttttatatattataaaacagaggaagtagtagaaaggaatttcaacataacaaatcctttatttatcatgtactccttaagtacgaataacgtactgtattctgtatgttttacatatagatatctgatgcgcgcctaacgtacatgcatctactccagtattaattctactagctagtacgggcgctcgttggggacgttgccgggcgggaaatagttgcagctgatgaggacatcgccgttgttgcagacggcgcggccgcagccgatcgacgtcgtgctccgccacacgatctgcgtgtagtggccgcagtcgagcagcgcccctttggtgcaggtgttgctgctgtacacgtaggacgccttctcctccatccacaagccaaccgcgtccgccgccgaccacgccttcccggcggggccccagtagaggttctcgccgtagccgctgcccgacgtgtgccggagatcgcacgcgccgccggcggcggcgctcgccaccacgctctccgcgaacgcctccagggtcgcgttccacgccacgtcggggaggtccacgccctcgccgcgccgggcggcgttgtgggcgtcgaggaagtcctgcggcgagctctgcgccgccgccgttccggcctccatggcgagcgtcgccgccgccagtagcaccaggacaaagcctactttccgcgccattattgcagatcgatccaatgcagaagagtttctcaaggtagctaaagcgattgtgctgtgctagctgatcgatatgtgttgctcgctgatcaggtatttatagtcgttatatcacaagtagctcatctattagctcgaagattgcatgcaataccatggctaattaattgcactgtttgtatttggcacgtggcccaaatgaactttccaattaatttccacatctttttcaagtagcacgtacgtacgatattcgatgctactaattactccatccgtcccataatataagagattttgagtttttgtttacactgtttgactactcgtcttatttaaaaaaatttagaattatttttttacttactttattatccaaagtactttaaacataacttttcgttttttatatttgcacaaattttttgaataagacgagtggtgaaacggtgcaagaaaaactcaaaatcctatatattatgggacgaagggagtatatatctagattatgcttatgttaaacttgatcatattatagtagtataatcctgtccgtacgttttacaacgtacgcgcagcatgcgagcgagctagggaggttgaaaagactttagacttggtcttgcagtgtcacgttgcttctagtagtttttccttccaccaattgtatgtggtcaattaattgtagcaaactggccatatgcatggatccacactagtttaatattatctcccacgttacctggatatactttccttagcagctgggacaggtgaaccaacttgtttaattattctctgtcatatatatctttttttaaaaaacttctgtcatatatataccaagttttagtgaaactagttttgcatatacaccaaactagtttcgttaaaactaaactttaatctattttgataatttgtctgttatgtattgaatttttttctatatttttatataaacgtagtcaaaattaaaagaaatttgactagaatcaaaacgacttgtaatataaaacgcaggggatagctagctatgctagagacaaataaatcttcataatattgctagcttgctctccctctagatctggcaaagggagggcaccacggccaggccgcgccatgcgaccgagccgccgcctcctacctctagcacctccgccaaaccgctgagagagaggggggggggggagggagagctgagagagcggtgtgagagacgaggagataagatcgaggaagaggaggtgttggccttatcacctcgtgggttgtggggccggccaactatctgcctgaggaccggctcggtttgatttttaggtgccggttcttgactatgaactggcatctattctttttaccacaaagatgccgggtagcgcccgttccgtcgtggcgcctagcgggaaaattatctcctaaaaaccctaattgcgaaagttgtttctttgattgttgtctagtgcccgtgccatctcatgatctcaatccccgctctatcgtcgagttcaattccgaatccaatccctccaaatcaaattcctccgcaaaagtccattttgcctcccccaaggtcgatgggccgattttccctcggcccatcttc

SEQ ID NO: 67935 - DNA, 1729 bp, Oryza sativa
cttcaaatatctgataaacgatgcttggagtatgtcaaaccaaaatatgcaagttccagaaagactacatataatatctcccagaacttcatatctgtaaattttctttgccacctgaatcatgaagcctttgatcttatagaaaactgtgcattcagtaactacatgtagtaatagaatgacagtatggttttggacagaaaagaaatcaacatgaaaattctctggtcaattttcaagataaccagatggtttatagacttctacctaggacttctactccatgttatgaacaacttcagtttgtcactgttccaagccaagtcactggctgcacgatattcctatttcctagtcacctgctgtttcagttggtactgaacccgttaaaaattgtgacagactgaagcaattggctaatcactaggaagtcagacctcctaatcagttgccaggtccaaaaacaggttttactattttcaatatttgagaattgagaactatgccacgcatggcaagtactgctcttggagtttcgcatactcaccatattatagtaaatcgatatcaaagtgccaactttgatattcagctgttttccatagttagctaacaaataaaaggcatgcatgcaagggcagctaggtcatgtgtgcttcatgctgtgctaacctcatgcaattagaaggtttggagtagttcaccactacctagctttcggtagctcacgtttgatttaaaaaaacaatgcatcggattaatgaagtacttaaaaaaatagaacatattaaaattacaaaatgaaaacaaaataatgtcttttgagtggaatccttaccggtatactcaatacagcaccttgcgagttggtcaacactggtagcattcgtcttgcaggtgctggaatagatctcaggatttgaagagatttcattgctgacaattgcaaatatctagagtgctgcacgagtttagcatcctccaacttgtcacagagagcatttgaataattcttattctcttccaaagaatggatcttacaaacttcagcaaggaacaaccaatcggtatcgaacatatgcctaatagcaagacttccatcctgatttaccatacaatactggcaagtatgcttttgactgtcatgcaagcacattccattcacaacaacctccgaggttctccatgtaatcaagaacctgcccataaagtggcatgtttcaccaggccagagatttagaacttctaaataaggaaagcttgttttctccaagtactgttcttgtccatgctcttttgttgtaatgaatttttggtgttcatctgtttgcaaataattgagcttttctaatgtacaatcacctattagcttgagatcctttgccttattcagcacatcagttgaaaatttagagctcggaaaaggtgtgtttgggcagttctgtcgaaattgatcagagtatatgcgtgcttcagtgactatctggttgatctcggatactggtggtggttgctttacataggaacacttataggacatatgaacagaagatgactccatcagatcaacagaacaacagacaagtacttttgtacctttggaccttggaactgcacaaaggtaacaaccagctacactcagggcagcctgcatgagattcaagcagaactgaatgaaccatgaaggatcttattttgctaaagtacagaattacccaatagtactttt

SEQ ID NO: 67936 - DNA, 1185 bp, Oryza sativa
attgtgcctatgtgctacgtaagaattactagttcgctatcgtcatcatcagatggctatgtcgatgaatctaagagagatcaatgacttatttcaagcatagaaaaatatatgtatgtatatgtaagcatctttgatctggaaaggaagtataaaatgtccatattaattttcaattcagactttggaccagacttgggtgaactttgaacaggtccttagggcttgttttcatttcaagttgattgggcttccaatcaacaacagtaatatttaccaaaaaaattacacacaagagaaataaaaacttaaggatgtaagcagtacacatgcacatcaactagaaggaaccttgcaggggatggtacggatgtagtctatgagcaattgagcagatctaccacggagtggcctatgcctttgtgaaacaaactacaatggagaaaaaaatgaatcaatgtcccgtggcaataaggtgtctaagatcttcaaacttcagaatatttttttctcccaaaagacgtacctgtaatacatatgctaaatatcgtgaaagaaaaagatcatcaacgttatgtgggtcaagtttttccaggtcaatgacagcatatccatgctgcagaatgataaatgaattttacgggggaaaagagttagtatataaattttagtaatggcatgatataggagacatcgaattacagaaaaagggtatacctccattattgttaaagacttctttaaaaccatactgcaggcattatctataaatgctcgtgtcaaccggcacgcatagatcagtttgtgaagctctgactgaaaggtacctgtagataagcaaaatttgtcagctgaatgtgcattcgttcatcgctcatcataaggtgatagcgtttgcaaatttacaactgcagacaagctggccagagctgatgtagcttcacacataccaattggagctaggacttgccacaaataacttcggccacgaattggcaacatgtgaaacagtgaaaatgttgtcatttgctacaaattctgtgacctacttccacaagtgaatttaactaaatacaatctcttgagctagatacccatgaattctgggccactgatagtctgacacactttttatttactattaaataaatagaccttgtgtacagaccacacctagacagaaac

SEQ ID NO: 67937 - DNA, 12048 bp, Oryza sativa
ttctgttctaagtttatgaagcactaataaaatgctacaactgttttgttcatttgttgtgtcaatataggtgagaccatgttttggtagtttacataaaagatttgcccatagtagatagatctcaaagcagattcggtgccaggtataacttgtcaatgctatattttaatctcagaattattatgaagagataaagaaatgcttattatgtaaaaggaaaatatggcgtgcggcctagttccgtaataacatataaggaccgattccttggagaatcttatccaagcatcttataatgtgaccatatgaatatttgattcccctggctaggttatataacaataattgtgtgtttgtcttgggacacttgtgcaagggaggaagatagcccttgaattcctagaattggttttgggcccccccttgagtaatagcccaaagtcttgtgtatatgttgactagatgtgtatatatattgggtacattgtggatgggaaaaataggtatagacctagccaacaaaattggagaggctttaggatgttgctgggctttaacgggactagtcatagtcatttttgttgatgagcctatgtgtttatacctcctaggttctccatgtttatcttgggcttgtagggacaaagcaaaaaaatgaagatttttttaaaaaaacttttaaaatttttaattttgaaaataagtcctttcaacacataattcctagatccgaaccttttggccacgccagccgaatttgcatggcaaaaccacaagacaacactgtcacaccggtctggctagcgtggcaacgttatttggtcatactagtctagttggtgtgccattgttttttggtcacattggtctggctggcgtgtcaatgatatttggccatgccacccttgctggcatggtaggacaaaattgtcacgcccattgtgtgtggcgtgtcagtattgttttgccatgccagacggggtggcatggccaaaaggttcaagttctagtaataaattttggaagggtctatttttaaaatttaaaagtaaaaaagtttaaaacataaaaaaaatcaaaatggcatgtccggtataacaataaagatgaaaccagcagatctaacatggaaagtgtatgttccaaacttgtcaactaattgtatatatataaccgatttccatgttagaggtatatcatatatttgttacatatatgcatatagaatggtggtcagtgtgtaaaatatggcatgccccactcctaggaaacactatttcacgcatatattacctattgttgtactagaaggttatcctcaaaccggtacagcaccaaacaaataaggaataccagcctgttagcggcaaaatttagtaactactgttagtcaagatcgggtcaatggagtgactaatgatgtaattatatttgattcagttggaaagtgtatcaagtttagagttattttattttagcctccgtattaggaaacgtttctttttagcttcattttctatagatggagtcttgagccaatcaaattttgtttgaatcggacttgtttatttttctgtaaggtagccgatcaagttatgtccgagtaggacttcttctagctggaactaaaaataacaatgccacactagctagaccagcatgaccaaataacgctgccgcgctagccagactgttgtgacagtgttattttgcggttttgctaaggcaatttggctggcgtggccaaaaggttcggttcttggaattacgtgttgaaagggtttattttcataattgaaaattttaaaagtttaaaaaataaaaaaatctgcctttttttctctttatccctacaagcccaaaatgaacatggaggacctaggaggtataaacacataggctcatcgagacaaacgactacgattagtcccgttaaagcccagcaacatcctaaagcctctccaattttgttgcctaggtctatacctattttccccatccacaatgtacccaatatatatacacatctagtcaatatatatgcaagacttcgggtactcaagggggcccctaaaaaaattctaggtattcaagggctatcgtcttccttccttacacaagtgtcccagacaaacacacaactattgtcatataacttagccaggggaatcaaatattcatatggtcacattataagatgcttggataagattctccaaggaatcggtccttatatgttattacgtaactaggccacatgccatattttccttttttttaggggaaacacgccatattttccttttagataataagcatttctttttctgtttataataattccgagattaaaatatagcattaacaagttatactttgcatcaaatcttctttgagatgtatctggtatgggcaaatctttttggggcatttgcaaatttgccaccggtttttttaattttgcaaggatgccactcgaatgatagttctagtggtatttttgcaattttctagtgacagtctcgtaataacgattcaaaggagtggtaaatttggaattgccccaatctttttatgtaaactgccataacacggtctcatctatattgatagaacaaatgaatcgaggaaaattttgctataggacatcgcgactttacggttttagctgtaggacactgcacgaagtgagttttgggggaaagcactctgtaaatgtggaaattagctcgtggagaccgcgcgcattggaatattcatttttagttggataggagggagaaattgcatgaaagtactaaaatacccctgagcccacaagtcagctctttcatctctctatttgtatctctctagcactgaagggcgtcgatagtgtagagcggcatccctcctcctcccgacgcgactcctggtgagagatcgctcctgcggccgcctcgagggagtgagctagataggggtcccgatctcgtcggccgcatcggtggtggtggggtggggtccatccatggcgctggcctggatctaggcgggttgaccacggatcccgtcgagctttctccctggtagggcggcgatagtgtcttcgtcgtcggatgggtcgtcttctaaatcgtttctcatcagtgttgggaatgtcgctttggggttgtcgaattggggactgcggatcatgcatttggttcaagtgtttatgagtccacagttgattgcttagtagcggcagcccatgcaggtaatgtgattttgagtttcatggaccaggtggtcaaggtgctctgcctcctcccatccttgtgcaggcggcagacctcccggtagtacaacatgctagttgagacgcttctgtgtgagagagatagacagagagagatgcaagacttggcatttgggaccaggggtattttaatattttcatgtggtttctctcaccaattcaattaaagatgaatattcgaataggcgcgttgtccacgagctaatttccatctttacgtagtgtcttttcccaaaagtcacttcgcgtagtgtcctacagctaaaatcgcgaagtcacgatgtcctgtagcaaaaattgcatgaataaaacagttgtagcattttattagtgcttcataaacttagaacagaaccgccacaaagtttcacatacttgtggcattttatttttttttgatacacctatactatttcattagtacatcactctgaggcctcgttctccgactcatttgagaagcctaggtaggtctgttgttgatatctaggagtgaaggcaccgagctcttctcccctattattcttaaggcttcgtgcttgctccctcgatatgcggtaagcattagcgatcacatccactggcatggcacggaatattgagttcttccctgcaaggtggctcaccatggagtttgcattggtcttgaatgaaatgtattggcatccttcatgctctgctttcttcaagacaacgtagtgttgcggaatgatcagcaattgacctggacgtagaacgccattgaataccgtctttccaaggttactaacgacctgaactcgagcatgcccttgaacgatatacaccaggctatgggcattaacgttccaaaacggagagagaatagcattctgtagagagtagagaacaatattatatataaatggtggcacagataaaactatttttatagaaatataggggggagagagatggagagtgaacaaaactccactttgataaatacctggtatagatttactctagtagcactcaattgtacaaggttaagaatggggaacttctgactgttgagacgtgtgatccttccagcacgtgggttgtaagtatcagcatggctaggattttcgatgttcaaccttgccttgattgtgcagaagttctcatctaaaccgttgcaacgcgtagatggttgttgttcttcactgtactgaacttggtattgagcttgtgcttgttcctgctgttgtgcttgttcctgttgttgtgcaaaagcaggtctcaacagtttaaggccattctttacccgtatgatctctcctctttggtcgttttggccttgtagcctctttgctaccaatgcattgacgcctaaggcctcacttagtagctcattgttgaaaccgctaaatatgttttgcccagagtgttgctcgattgagcgaccatacatttgttgctccctgttgttgttacccgccaataagaactcctaaaatttttatcagtgggaatcaatgataaagttttgccacatgaactgcaacatattcatatatatgacaatgagaaacaaaaatggtgaagaaatttagttaccttctgccttggttcaagctgattagcgttgttgtttaagtcgaagacatatagagcaacaactggtgcatcgccttcattgtagaaccaatgcgcaacaccagctggcagtgcaacgatatctccttgtctaaattggtggatcttttggtgctcatccctaaatttttggctctggctttggccttcaggcaagaattgttggaattgttgttggtaggttgctgggcagccggggaaagttaatcccatagaacctctccctgaaagttagaaatgtccatgtcaggtggatataacctaaaacgacattattgtaacatggagaatcataatttgtacccatatgaacaatgtattccgctatacaaaccttggatgatgtagaccatgccaggagtattgctgtatcgaggtaccagaaggccttgaggctcaatgacacgtcggatgacaaatgtacctgtgcactggaattgttcattcttctcatcaaagtactctgtaaccccggcttctgacctcactctccgaagtggttcaaatgcttgtagtctatcaaatctacactccctaaaacctccttgccgagggttgtgccatggatttacgttcggaccaaatagctgggccatagagccatggcataggagaagaacacaaaagtagatagataaccgagagaaagctatggtcgccatagctatttgaggatgttattggaaacttgggctggttgatgtgagttcaatgacagggaagccaacttatatagtgaagaaaagaatcttcagatatgacgtagggatagagtttgttgacatgtatagataatatctagcctataatgcgaaaagtataatagaaaaaaggtagctttgcaatgttgagatatacacactatgactcatggatgacatgtcttgcgctttaggggtaatacaaacaatgcttgttggtaaatgtatatccaaagccttaagatgttcctttgccttatggataaatttccttttgtgcaataaagtttctctagtatgttatcattttgtgcggtatgtcatagatgataagttaggcgctccttaaatttgttggtttgttgtcagttttgcgtggcacactatgcttgataagttagcggaacttttaaaataagaaacttgtaagcttgttgtcattttctttgacatactatcctctcccatatgtaaagtaaacaaattgatgaaatatatggaggttagatgattttgcatatccaactagtacttccaagtttataccaaaaaatagaaaatgttggatttaatttttaaaaaagtagaagcaatggacttatgtatcttttcttttttttatcattatattttctggcgtgcatttattaggcagtttattactgtgacataaatttatttaactcgccggtaataaaatatgccatatgtttgttagtcctcactgtcgaccatatcatacaagacattaatcaaatcgtcttgtctaaaatgaccacaatgtccctgcgtggtgtggactatgatttcttttcattcatggttagaactactgccggtccatgaaaggttaaactataaaatgccatctgaaaaaaaaaaggtaaacagacaagtactcgccctcgcaattaaattgttcaataataatagaaatggaaggatttgtcgtgtgtgtgtacatatatacaagaaaatatcaggaaagcatgtatgttattttacacaccgaaagaataaacgcacaacgaaacttatatacaatcatatgtttgctaggcaaccagagatgttactcccaaaagaaacgctccggtatcaattcaggcttctcctctcacttgaactgcagcttgcttgcaaatgtctggccaaacttccatcctggtggcacgacgttggtgaagacgagcgtttggtcatctgtgttggtgaccctaaaggatagaccttgaccggtgaggtaggccagtgagtgccattgggcgccccagttacgtgccatcggcatccaatccgctgtgttggaacccataacctccatggacttgattgaccctgccgccgcgacgttggtcaccagtactagctggaagtagtcgtgaccgttaatggtgaaccgcaggccacccttcttcacgcaaggaaccctgtagaaatcatcgcaagagtaggatattttcatatggaagcagcggtcaggatatgcactgttctctccataatgtccaaaataattggagtatttgtattggtacctttgatagatgaccggtatgatgcctgcgctgtagacgccgatcttctcccaggccggctgtgccatgtcaaagtgcggccgtggtgggttgcaccagccaccattatcactgggaaggttccagttgggcgggcagaaattggtggcggtgatggtaacggtgacgccgggcttgcaccactgcggcgccctcttgcggtcgcaggcgatcttgtagcactgcccgcacgacgcgccgtcgttgaacagcgccgtgctcagcgccgcgttccgcgtgccgtacccctgcgagtacaggttgccgtatccgcacgccccgcccatggtgcccgacgcgtccgcgccgccgtagaacgtcgcgtgcgccttctgccactgggtcggcgcagccaccgggtttgtgggcgtcgtcgtcgctgtgttggccgcggccgtcgatgcactggcgactgcgagcagcaccaacacgaacgctcgagctggggccatgtctgtcgtcatgatcggataactctgtaactaggcccttgagacttgatgaccgagttaattatctggagctatctatctctgaaagcaacactgctctgttgctttgtgttgatcttctatgtgatgtctgtttgcttggtgatctcctgatgattggatgggtatatatagccatcgctcggtcattgttggattgctgcattagtggctaatgaaatcccaataatgaagtagtgtgaactctggaaagccacgggacgaagctagcgcgcggcgacgcgcatgtgcatgcatcgccggccggcgcagccgcagtactactataacttgctcgccaattaatccgaaaaattttcggtttttccctgattggcgcagaatgacgcaaaacacaagcgcggcgacgtccaggctcccgcaatcgcaagcaagcgcatgaaggcaacgttcaacggcggcgccatgaagaatggggtggcgtgtgttgtgtgtggccggcgatcgagtgaggcatctctgaagtctgaactgaagcatctcgagtgttttggactcgtttcttttcctggtgacgttatgaggtgtttttttttccggggagacgttttgatgaggtgttgatcagaattcatcaccttgttagaatgtcaacaagaacaattgacggaagaaacaaataatcgttttaaaagttgacaaaatcatcgagggaaaaaacgttttcaattagacaaaacaattgacgaaattccgttgtcaagtaaacaaaacaatccacggaaaagacaatctatctatgatatactgaaaatctattaaaattcctacaaacacactaaaaccgtcacgtgtattcctagtttcgtacaaatacttctaaactgtcacatgacactttaacaaaccagtggacctgatatttttatctattagaatttttttttaaaaaaaaccaaaacaagtagtcacgtatttgatggggcccacccttccaccgggcgtactcacgtacgtgcttcctccctccccctcctatccaatctccttttttaaattattaacatttttgaacattaacaaatcttagataaccacaattttcctatagttatttgtgttctttaacaattaaaaaaattaaaaaaattaaggtgttctttaacctataagaaatatttaatttttatcatatccaaaactttacatatcactttaaactgttatgtaaaatagggaaaatttgataatgctgattatatgatcaattcgccaaatatgcataaataaattaagttagatctattatctctattattaaaaaattgaatatgtttttgccggtactttggtacgttatccgtgcacgagtcggtttttaagtttgttctttttggaaatacggatccatatttgagtcggtttttaagttcgtttacttttgtaaatatagaacaaatcgtataataaatctctttaaaaaaactcacgtgctaactcgaactcctaattacaactcaatatatagggcttttcttacgtatcacttctatgtccacttttcttatgtatcaactagttgggtggcccgcgcaattgcgcggctagcacctaaaaaaaatcatatatttttcagtatgattttacttaaaatttattaaatagctattacgttgtcttaagactttgaaaagccaaatcttatcatccctgtatttctaattatatagttttttaaaagtcacaccagctactaccccttacttctgtcatatttcttttatttgcttgcttgatctaccactatttctattcattctccttaaaacctttaaaaatcagatcttatagtttttataatttctagaagtcccatcaaacgctgtcattatactcctctacaggtcatcaactgtcttttctctatattgtcattgggattttacaaatcgaacataattatcgttcgggttcattttttactttctaaagtcccgctaaaccgtcagcggctttgccattgttttcctttatggcacgcccgctgcctcacttctttatcgtcattgagattttaaaatcgaatatgattatcattatgttttttttacttttagaagttccaaacctttaaaaattagacctcgtagtttttagagtttatagtcttgttggtttcattttttataatttttagaagtcccgttaaacgatgtcactatactcctctatggcccatctgccgcctactctctattgtcattgggattctaaaaatcgaacataactatcgttagaatttattttttattttctagaagtcccgccaaccgtcggtggctctcctatatatcccgcccgctgcttctcctttttattatcattgagattttaaaaatcgaatatgattagcattggtttttttttttactttctagaagtcccggcaaccgccttgatcgattgcttcacggcctacccgtcgtccttcatttcaatcgttattaggattctatttggtgttttattaacagttattgcatgtcgtatcaaccaccaccactctactcctttataggcgtgttacttaattaatctcgtcatgtgttttagatggtattttctttcaatagtcttgattttttatcaccaattttagttatttataaatggtattcctagtatttttctttttttaatttcagaatttattttatttttcgtattgtgttcttttgatatttttattttttattttcaattttagttgcttccaaattgtattcctactttaactctctttttaattcgcctaatttcggattttattttattttttatctcgaattttaattaatctactattaggttgttttatgtactcttatttgcagcgctgcttatatttaatttcgaatttaagttaattttaaattgcattccgaactcttcttttgtttttttctaattttgattttttttaattttttattccgaattttaattaatcttgtattggattcttatatatactcttattttaatatttcttatttttaattccgaatttcagttatttttaaattgtattcctactcaaactccccttttttctttttataatttctaaatttattttttattcctaattttaattaatcacgtattgggttcttatatggactcctctttcaatattgcatatttttaattccgaatttcagctatttttgattttatttctatttggactcttctttttttttctccgattaatgtgggaatttctagcctctacagcaaacgtggttatgtatttttggcttggttatatatttattggcatgaaaatactgatacaattcggaaacggcagagtttgattaggattgttttgtctttcaatgtttctaaaagtggtgttaacacgcgtattcccaaaatattgtccgtttccaatatgattatgtttttcttttcttttgttttttttttgtttttgaccgattgtacattacgtttccagtagattaggttttcccttttttgtttgtttgtttcttttttttgacagattgtccgattccgtttccagtagtatgattaggttttccttttcttttttgtttttgactgattgtccgattcgagtttcttcatacgccttatttctttctttcttcagtttttaactaatcctaatctagttctattttttttcttattttttagattaatgtgagaatttctaggccatgagagcgaacgtagaggcttctttttctattattttaaagatataactagcatggtggcccgcgcagattgtgcggctagcatcattatattttctctcatattatatcatatatgttttctcattatattattcaaatatattaaaatgacaacataattttaaattttgcaataactttacaaaactactaatgtgtaatattcatattgtattttatatacgtgttagttattaattatttttaatatcaaatcctatatggactctagtctcgtcttttaatatattttttagttccgaattttctgtaaattgtatttctatatagactctatactcttgtttcaatattattctatttatttttatttctaaattttaattatttctaattgtatttctatgtggactctaaactcatctttcaatattctttaatttttaatttcgaatttcagttatctctaaattgtattcctatattgactttaaactcttcttcccatgtttttctaaatttcgaattttagttatttgtaaattgtatttttatacggactctaaactctacttttaattttattatgtttattccaaattttagttagttttaaattcctatagggactctatactctacttcaaatattgcttattttttaattccaaatttcta

SEQ ID NO: 67938 - DNA, 12256 bp, Oryza sativa
acatcatagcatgtcgatattaatttatcaaattgcggagaaatattaataactttgtctcttataggaatatgtccccagcttgttgcttaactaaatgtcaatccaaataataatcatatattttgttgaaaaataattaacaatatagatcaatatctagtatcacttcacaaactttcaaacaaacaaattgaactctaaatagtacgtacgtactagtagttatttttcaaggtatatggtaatgtcaagaagtaaattagtaatgagcactctaatattttacccctcggccatatagctaaagctatttttttcttagctacaaaattaggttttcccttactttgcatacactatgagcttccttgatgcttttattgggatcgatttacatggacaccctatagtttttttttcaccacttttctttttttttcaccatatagtttttttaagtttatatacctaaagtttatacttatagggtttacacatcttttataggtcaaaagtttatataccgattcaaatttgaatttaaatttaaatacatttaaagatgaacttgaatctgatatataaacttttgacttacaaattttaggtcaacaaactttaagtatgtaaactttagatgtgtaaacttaataggtataaacttcgggggtataaacttagtaaaacagaaaagtaaagtggtgccaaaaaaaaaataccgcgtagggcagaggaaccgatcgccccaagcaatcaatcgtgccataggagtttcgcaccctatcctcacgggcttcaagtctagcctgatgaaggcattagatgggcgtcatcgccagcccatctatgtaggcttgaaatattagctcatacatgcatgtttgtgggctgtaattcgttggaccagatgaagcctattcaaacttagccccaattggtagtttcccaccataggtcagcccagatgttcaattctttttggtagagcttaaaattgtgagaattaacagatttgttctcagttcatgagaatatgaaaaagttagttttccaaatttttgttatagttcattttctgaattatatatctactacaaattcttataatgtgaatgacaatctaaattgtttagggagagttaaagattctgagagaagttgcagctgctaaaagcttttcccaaatagacacctagggcctgtttgggggagcttccagctgctgcagcttttcccagaatcagaaactcccccccaaacagtatagcttttggtacagattctgagaagctatagttgcatggtagagctccaacttctaaatttaactccagtagttgggtctgaagtggagttgtggagctgactaaacacagctccacatctctagttcattttatgagagcgctccacccagcttcgctgctattaggtggagctgaaactgtttggctgagctccagttttaggagaggtggagctggtgatggaactatgccaaataggcccagaattcagaaaatgaacaagaaattagaagctgggaaaccaacttttacagatcctcaaaagttgtctactaaccagctgcttctaagaatcaattcttaattagtttcccctggacaggccactaggactgttccaccacagcaccacccagtctctgattgtatggtcgtcctttcaaattacatgcagacaatggaattaattttctcatttattttcttcttttattcgaacgacaacgtacatatatatataataagatccccgtaattattatttcgcacatttatatcatactccatacatagttaaagtaaatactgtattaataacttattaagcagagagagtgaggccacgctcgaaggggcgctctccctggaagttgccggcggggttgtagttgcaggtgatgaagacgccgccgttgtcgcagtccacgcgggcgcagccgatcgccgtcgtgcggctccacatcacctgcgtgtagtggaggcacgagtcccacgaccccaggcagctgttgctgtcgtagtcgtacagatccttctcccccacccagctgttgacggcgtccgctgccgtccactcgctgccggagcctccgaagaggttctcgccgtagccggccttctcccagctgccggagtggatgagcgcgcagtcgccggcgcgctccgccgcgtagttctccgcgtacgccgccacggcgtcgtcccagaccacctcgccgacgccctccacgcgtcgcgccgcgttgtggaggtccacgaagtcctgcggcgagttctgcgccaccgccggcgtggtcgccatggccagaacgacggcaatggctgccgcaagtgctactcccgatatctttggtgtctccatatgcaacactactacacaatttgctctcttaatcgattccgattgtgtgtgtgttcgttgaatgctgatgcgatattactcgcgatcgatcaaggtatatatttatagccagatgagctcccaagatgtcagcaaaataaatcgattattaatcctacaatttgcatggcaacttggcaagtagccatgatgcttggctctgctcggcgagagcggattaattaggataaaataaaactctcctggcctcactctcatttctttttattaattgattaattgttaatgattttgtgtttggtacatgcatgaatgcatgcgacgtgttctttttcttttctcctattttttttgggggttgccgtcgttgaatcgtagtcattggaggacgcagcacgttgctcatgtgctcgacggctaaggcgattatatcgatccgacgaggcatgtcttatctttgattggtggactagttccttaattgattgatcaactgatcagtttggcatataggctgtattattagtattttatatacatacaatattatttggtgcaacttgttgtgaagatatatataatttcagtgtttcaacaactaaattttaaatatttaatcagttgtaaatgatgatttttatgccatcagaaaacccaaccttaatttagtttatggaacaaaccacaatggttactgaataacatttctacatttagaaacaaagtccacctaagcattcgtgatcggatcaagggatccatccaaatcatgtggggtatgggtcaatatttggtgggaaatttctccatctccatgctgtctgaaagaattctataaggccaagtagccaactttaaataattcatgcataccagcaggtgcagagtttttcgattcctagtgggtgtgggtcaccctaggaaagaaaaacgaaagatcaatattcaagaacggaagagatatgtcagcaaattaagcacatcctcgttgcgtgtttgctaagccttcattattccaaacaaccactaggatcaatataataagagtaaattgcatattggaccacctttcctcagtatttttttataatatatattaaacctagcctttacttcaatcacagctacaacctcttattatatggttcttgacacaaagtccaaatagaatagaatgaaattttagtacggcctaccatccgcagaccgatggtcagacagaaagggtaaaccaaatcctagaagacatgctacgtgcgtgtgccctggatttcgaaggcacttgggatcgttgtttgccgtatgctgagttctcatacaacaacagctatcaggccagcattcagatgtcgccgaacgaggcaatgttcggaagaaagtgccgcactcccttatgctggaatgaggtgggcgaagcgctgatattcggtcctgacatactcaagtcagcagaagaacaagttaagctgatacgagaacgtttgaagacagcacagaaccgtcagaagaattacgctgacaatcgaaggcatgaccttgagttcgaaaaaggagatcatgtatacctgcgggtatcacccctccgtggtatgaggaggtttgggatgtccggcaagttagcaccccgctacatcggcccctacctcataaccgccagacgtggcgaagtggcttatcagcttgagttacctgaaggtctcgcagatgtgcacaacgtgttccacgtatcccagctaaagaaatgtcttcgagttccagaagagcaagtccccctgggtaatatcgagctggaaaagaatctgacgtacaaggaaagaccgatcaaggttcttgaagaggcaaaacgtcagactcgaaggaagaccatcaagttctacaaggtccaatggagcaatcattctgaagatgaggcaacctgggagcgagaagatcttctccgcgccgagttcccggagctgctcccttaggtgctgaatctcggggtcgagattcttgttaggggagttggtctgtagcgcccgttccgtcgtggcgcctagcgggaaaattatctcctaaaaaccctaattgcgaaagttgtttctttgattgttgtctagtgcccgtgccatctcatgatctcaatccccgctctatcgtcgagttcaattccgaatccaatccctccaaatcaaattcctccgtaaaagtccattttgcctcccccagggtcgatgggccgattttccctcggcccatcttcccctctcccccggcccatcttcccctctcccccggcccatctccatctctcccccggccccctctctcccgggcgctctctctctctctctctcctttcctccgctccgcccgcgcgccgcgcgcgcgtgcgcgagggtcgtgccgagcgcccctccccctccgctctgcctgcgcgcgtgagccgcccgcgccgagccgagtcttccctctctgctccctcgctgccgcttcccgcgcgccgtgttcacgtgcgcgcgcccgcgtggtttcccgcccgagccgcgtcgtctgcgccgtccgcgtcgcccggtcccgctgcccagccgcgccgcccgttgcttcccgcgcgcgcgtgccgagtggccgaccgcctggtcgccgccgccgtcaccctctgccgcgccagcccgcgcctgtcgcccgtgtcgtcgcgccgctccaaaccatcccaccgtcatcgccgtcgtcaccgcccggcccccgccactccgcgcgcaagccgccaaggaaaggaggccgcgcccctcctctctctgccgcgtcgcccccgctcccctccccctttttcccgaatcggcaaaggggcaagccccctttctccccctccttttcctcttttcctcctctttttcccctctcgccggcgtcacctcctgtcgccgctttggacgctagccggagcgccagctcgccggcttgaccgcccatgtcggttcccctctctcaaaccgacattgccgcccatttaaacccgtcttccccctcccttcctttcctctcccattcgcctcctcaccgttgccgccgctcccgtgctctgcctcgcctccgccgtccatcgccaagcgccgggagagccggtgcgttcgtggacgcggaaggggactccgggcgcgccctcttcttcctcttcctcggtccgaggccggagagatcactcccgcgccgtcggcctctcgtcactgcgccccgtcccgcacggtagtgtctctctccgttcttcctcctcgctccatctccttcccctagctttcggtagtagcttgagtagactccccgtagttagccggtgccgccccgaccgttgccgtcgctcgccgtgtgctcgccgccgtcgccgcccgagctccgtagcacccgctcgtcgccggcctcgctcggcgtagttccgcccaatccgacgctagcgtcgagttcccgaagccgcgtagatgctctcaccgccgggaatcggcctctcgtgacctcgttgccgttttcctcctctcccgccgccggttgccgccgccgcaatccgccgccgtcgagcaacctccggcgaatccgagccgttggctcgtctcccctcgtcccgtgcaaccgcccggtgtgctcgcttttgcctgtatcaccgtggttcgctccgccgctcgccgccgccacccgccgtccattcgcggccgggtcgtcgtctacctcccgccagcccacgtggccgccacgtaggcgccacgtcggcgccagctcagcctagaccggatcgagccgaccccggtcagtccctccccgtgcgcgcgttccaccgcgagccgtgaggctgcgcgtgggcccgccgcacctgcgtccaccgcagaccgcgcgcatgcaccgcgtcccttccccgcccgcgcgtgtgcgtcgcgtgctctctccgcacggtgagccgagccgctgacaagcgggtcccacccgggaccgcgcgtggtaagcccggtccaccggctctctctctcctccctcccgcgcgcgtgcgagtttgggccgccttgggccggccggcccatttagctcggccggaccgctccatttctcttgggccgcgccctagccgtccgagaaaagtctatattccctccctcccttcttttctttttcttttccaaaaaggatttaattaaatccttttcctttagatcaaaaattcaataatcttagaaattcaatatcttcccaaccgtaaatccgtttgactccgttcaacttccaaaattccgcaaatctcgagatctatctaatggcccgcttagaggtcattaatagggcttaattttcgccgtttgttgagttgttccgtttcgcgtgtagttccggagcccgaagacccgcagtgcgaggatttcgaggatcaagctccagatctcgagcaaggcaagccacctttgaacatcttgagcctatatttgaaatttaattatgttgcttgcaaaatattatgcattgataggatcacacttaatctgtttgtcccgtctgcaaggcagattggcggacctacctaatttgtcgcatttgatccttcctttgttaattgctataccatgtccccttgtaaccacccagttgcgcctcgatactcgtgcactctgtgcaagtatcgacggtcgccctcaaacttaaaatctgagtaacaacttgggtaaaactggagttttacaaaagacttggaaaacccgacacctgggtcggtgcttgcgaactaaatgaatttccaaaaccgcggaccggggaacgtaccgggtgtacggtttcccgctcttgcacttaaggaccgtttccttggaaatttcatccgaacataagacaagtacgaccacatgggtggaatgggacgcccctggctgagtaaattgctaatcgggggagccttgatgccgagagacatgtggattcgccggggtggtgtcggagaggacccctgggcttcctggcacagtatggtctgggacctaacctgttgttggtctgggacccctctcgtcggcatatggtaaacctgtgtcggctttcgaaatgccttgtcatgaaagcttggaggtctcccgacgtggctgatccccacgggctggatgatccgggttagtaatgtcatgtgggtaaagtgtaccccctctgcagaggtcattaaactgttcgaacacccgtgcccacggtcatgggcggatgtgaggtgattcctagcgtagttttgtttgactactgcttgtgaaattgctgttgtgaaaaggggttcgatgtttgaaaaatctgcagctgatgggatcagctagcccgggtggccgtttgaaaagttgttggcccgggtggccgtttgaaaagctgttggccgggtgccaaccgtgttgcaatcctaaagattgatacattgcacatactccgaccggacgagacgcattgtctcatccgtgtcgtttgagaagcacttagttgttttcagaaaagagttcaaataaaatcaattgcaaaaacagcagccttcccttgaagcctgcattaaacacttatttcccctggcttgctgagtactcccgtactcacccttgctctatataaataatctccccccagttgctgaagaagatgaagtggatcctgctgacgaggagttcttccaggagcaagtcggctacgatgagttttagggtttcggcctagttcccaagtcgtgcctgtgttgattggtccaagtcctggcttccgttttccttttgtaatgcagttgtgagctcgggatctgtccgcagcccaacatgactatacctctactctataataaagagacctctgttgctgtgatattctgtctccctatgataccagcactgttttctgggactggtatcgattaacaggttaaattggagcgtcacgggctagttccggtcgggactagttcggggcgtgacatccggttcttacaaagattctgtgtcaactactccgatgggatgggtactaaaaggtgctggatattcaataaaaactagcacctatttgaggaaaaaggtgccggtcttttgaaatttggcatgtggacggacgcgtgggtgggcacgtgagtaggaaagacgctatagctaggtgtcgattttaccacttccggtggcctttagcgccgacatctatttaatgttttgtagtagtgttcatcgaaaagaatccttctgttgaggtatctttcccttttcgtggtgtcctagatttgttggagcagggattggtcgcatggtttgtggtgattaatttgttcttttctaggtgctgtctgcgtaatgtactctctgctgatttttttttctctttcggtttggtttgttcttcgtgttgttgtttgcagcaagaatcggcggttgcacacactggtggagaaaccgtttggagtcccgattagtaaccccgtctccttgcaagaagtcggggtttctgatcctcgccccgaacatctctctactgttggagctcatttccatgtaccgttcatggaatttgtacatctgtgtcggtagggactccagctgttcaggtttgacaagcggtttaccgagttcaaacttgtatgccacttccgccttcgggattggtgcgcctccaaccaactgatccacagatagactagtgtctgcaatgaaatccgttatgccaaaatcttcgccggtcaccaacggctcgacctcttggtttggttgttctccaagctgagggactggtttggacttcttgtgataggctctctgaagtgttcggtcatagtccgatatctgtaacgcctccttgtttgttttggacattcccttgaagaagttcttcacgctcgggtcaataggtatcttcttttcagtactccgaggcttgagttgcctcttcacctccctgccgcataagcatcaagctcctcttgactgcaatcgtatggtggctccttgtttttggtggcgtcgactttcgccttcttcgttgcccttgtgcgggcaggcggtggagcttggcaagaccttgtcttgggaggtgcaggcggacacggtggaggcggaggagccggaggagatggtgcagcaggaggtggcggaggagccggaggagatggtgcaggaggacgtggcggaggaaccggaggagatggtgcaggaggagatggcggagccggaggagatggtgcacaagacgccgcttgtcgcccaggaaggatgatgtaccgcttgcgccatagtatgatggcgtggcttgtgtctcgtagatgcgtctcaccgtcccctcctgggtagtccaactcgaggtcctcgtacgcggcttccaccagctcaacttcgaccctcgagtatcctgctggaatcggcctgcagtggtaagtcccggaagggtccgttgggatggccattcccgacgccaccttcacgtgatgagaggttatctattagtaatcaacctaagcagcaacttgcggaatgtacaagtcaaaaatcatcaaactacgagcataccttgattgataagttcttgaagggaatatgcaactcacatggtgtccgctgcgtgatctcatcaacagggcaggtggttgcgtcctaggtttgcacggcgtccatgctctgtgatccgacctgccccgttgaggcgcagctgctacgattgcctgatgtgctgaccattacaggatgaatgtacggctggggatcctgggaccgatgtgcggccatacgttcatccaccttccttgccacctcctcttgcatgctgagctcgtagctcaataccctgtactcaagatctgcaatcttcgcctcggtatctctcttgctcctcatccgactcctgtacgtgtggatgtcctccttaaatccaatcttctagggaatcacgcctttccctcgtgtttgtcctggatgctcgggagtctgtagggcgagtgacagctcatccttctctctgtcgggtcggaatgtgccctgagaagaggccaccactgcgtccgttagtcgactggcagcctcgcatatctgatcgctgaagacaagggagccatcaactgggttaagcgttccaccgtgagcatagtaccagaacttcgatcgatccggccatttagcggtggccggttcgatacccccctcaagcaagctagcctccatctcctcccacttcggcttcgcgacgctatatccgcctgaccccaagtggtgatggtacttcttcttggcggcattttccttgtttctggccatcatctcttgcccttgttgccctgtcttgtaagcaacgaactcgtcccaatgatcccttagctttgggaatacgtcgaagttcggtgttagtcccttcaggatgtatttcttgtagagatctcccttgaagctctagaactgttctgccattttcttcagagtccactatttcactaagttatccgtacccgcgggtagcgtgaacgtctcgagcaatgtggtccacaacatctctttctctgagtccgggacaaagctgtcatcatccccgcgtgcccttgttctgcgccagtacaccgtgctgacaggcacgttgtccctcacaacccaaccgctgtggcgtacaaaattcctggctgcttctgccggggcactaggtcggccgtcttcgtccacctcagttatgatgtgccgaccctctatcttcttcgcggcacctcgttgtccgcgtgccctcttctgtccagcagagggttgacttccattagcctcctccgcatcgttcccctctgcatccctctccacgttaccctcctcgttccaatactggctgcttccctctgcgattgtttcgtatagtatctgttcctcatcgcgatcagccatctgtgcatacaaaaaatatttgttaggtatataggatgtatttgctaaccgtaatattgaaactctgctaattttatattaaatctctaataatcttatattaaatggctactaatctcatattaaaattgtaataatcatttatatatgctaagtctaacaatcttatattaaatctctaacaatcttatatttaatctctaataatcttatattaaaattgtaagtcatatatatatatatatgctaagtctaataatcttatattaaattgctactaatctcatattaaaattgtaataatcatttatatatgctaagtctaacaatcttatattaaatctctaacaatcttatatttaatctctaataatcttatatttgaattgtaatagtcatatatgctaagtataacaatctcatattaaatcgctactaatcttaattatattaaatcgataacaatcttatattaaaagtgtaataatcatgtatgctaagtgtaacaatcttatattaaatatctaacaatcacttaattacatcacttgcctgcgcgaattccttcgatggctagctaccacttcggcttgagggacgacgccgacgtcttctctgcaacattaccaggaaaatgtattagtctaaacgtcttctctgcaacattaccagtaaatcgtattagtagaaacgcgttcgttctcacacatttagtacaagtgcattcatgttcgtaagcgtttcgtgcacgttcgttcgcgttttgtaatcgtattgttcacgttcgttcgcgttcgttaacgtttcgttacgttcgtccgcgttcgttaacgtttcgtgcacgttcgttcgcgttcgttaacgtttcgttcacgttcgttaacgtttcgttcacgttcgttcgcgttcgttaacgtttcgttacgtttgttcgcgttcgttaacgtttcgtccacgttcgttcagcgcccgttcaaaggtcgtccacgtatcgttcacgt

SEQ ID NO: 67939 - DNA, 9089 bp, Oryza sativa
ggccgcgtcgatcgaagtcggtcgtcggccggccgtggagatcgatcagagagagagatcgagatcgagatcaagagagagagagaggcagcggcggctctcacccaagagatgcggcggcggcgtctgcggcggaggcggcgaggaccaccaagcgacggcgagaaacgacggcggtgtcggcgcggggttgccctaggcacggtggcggcgaaggagaggccgatcaagatcgaaaaacggctaagtgttggtggagaagacgagggcgcaccgggaatatatatacccccggatctttagtcccggttgttctcaggaaccgggactaaagatcttttcccgctatttccaaattctttttaaacccggttagggttaggaaccgggaataaagataatagcagttgtgtcttcaatttcattgcatatgtgtttctaaaatagtaaataatgcattacaattatttaaagtcgaacaattaatgataaaaccttcgaaaaattattgttgtacgtagtagaatacgtggataatatataataagcacatgaatgatttaaaattgttaaaaattctaattaacataatagcacatgcatgatttaaaattaatacaaaatctaatatcatatataactagcatatcatgatattaaattgataaaaattctaattaacatatgtaaataccacatgcatgatttaaaacctttagaaattctaataatcatatatatgtagcatatggatgattttaatttgattaaaattctaataatcatacataattaacaaaaaatctaataatcatatataactagcatatggatgatttcaatttgataaaaattctaataatcatacgtattttacatatgccatacaacaattgattagtatagatattcggtacatccaacatagtttacatcgtgtacagaacaattacggcaatacatcggcggtgacggttgaccggacgtactttctcctcactattgttcattccttgtgatcgctacgtgagtaaggggtgtcttcatttgataggaggatgctagggtcaattgtcatcgtgaaaggggttgcccatcaaactgatcgtaatcctcgtcagtcttgtcctctaatccgacgatttttctttttcctgggagaaccacgtggcgcttcggctcgtcagtcactttgccctttttttctttgctagacatgtccttgacgtaaaaaacttgggttacatcattggcaaggacaaaaggttcgtccgagtatccaaccttgttaaggtcaaccgttgtcatcccactgtcatcaatcgttacgcctccaccagtcaacctaacccattggcaccggaacaaagggaccttgagaggtccatagtcaagttcccatatgtcctcgatggcaccgtaatacgtgccagttgtaccatcgtgtcccatggcatcgatacgaacagcactgttctggttcgtgctcttcatgtcttgggccctcgtgtagaatgtgtacccattgatttcatatacctggaatgtcgcgatcgagccagatggtcccctcgccaggaaggccagttgttggttaatcgtctcattacccatgagatgttgtcgcagccatgtggagaaagtatcaatgtgatgccttgtaatccatgcatcggacttaccgatgtttttggtgcaaactagagccaagtgctcctcgatgtagagagccaccaatgaagattgttgcagaaccgtgaaatgggctttacggaataaattgttgtctaacgtcattattgctttctttccgagagtcccctttccccgtagtctcccttcatggcgtgattcaggtatcccgattgggcgaaggtcttcgataaattctacgcagaattcgatgacctcctctgttccataccccttggcgatgcttgcctctggacgagcacggttacgaacatacttcttcagaacgcccatgtacctctcgaaaggaaacatgttgtgtaggtacacaggaccgagaataccgatctctttgacaaggtgacaaagcagatgcgtcattatattgaaaaatgaaggtggaaatatcaactcaaagctgacaagacattgcaccacatcattttgcagggcttctaatctatgaggatcgatgaccttctgcgaaattgcgttcatgaaagcacatagctttgttattattgcccggacattgtctgggaggataccccttattacaactggtagcagctgtgtcatcaacacgtgacagtcatgagactttaggtttgtgaacttcttctccttcgtgcttattattcgctttatattcgtggagtatccagacggtaccttgatgctctccaagcattcaaacgtactttccttctctgccttgctaagagtgtagctggctagactcaagtaatggcttcctttctcctttggttctgggtgaaggtcaccgcgttgttccatatgctttagatcattacgtgcttccagtgtatctttcgactttccatatacacctaggaagccaagaaggtttacgcaaagattgttagtgaggtgcatcacgtcgattgcgtggcggacgtccaagaattcccaataggataactcccaaaatatagagttctttttccacatcgccgcgtgaccatcttcgctctctataggctggctgccacgcccctttccaaacactactttaagatctttaaccatagcaaacactgtttttccgctgcgatgtttaggcttcgtacggtggtccgccttatgttcaaagtgcttgcctttcttccgaaccggatggtttgctgcaaggaatcgacgatgacccatgtacacaaccttcctacagtacttaagatacgtactttctgtttcatccatacagtgagtgcaagccttgtaccccttgttggactgcccggataggttgctaagtgcaggccaatcgttgatggttacgaacagcagcgctcgtaggttaaactccttctgtttgtcctcatcccacacggggacaccttccttcttccacaacagtttaagatcttcgaccagtggtcttaggtacacatcgatgtcgttaccaggttgcttgggcccttgaattataatcggcatcattatgtacttcctcttcatgcatagccacggggggaggttgtagatacatatcgtaacgggccaagtgctgtggccgctgctcatctctccaaaaggattcatgccatccgtacttaaaccaaactgtatgtttcgtgcgtcctttccaaagtctttaaattttctatcgatgtttcgccactgcaaaccatcggcggggtgtctcagcatcccgtcctgttgacgctcttcagcgtgccaccgcatcattctagcgttccccttgttcctgaacaaacgccttagccgtgatattatagggaaataccacatcaccttagcaggaattctcttcttcgttagctgcccgtcaacttctcctggatcatctcgtctaatcttttatcgtagtgctttgcaaacagggcatgcttctaggttctcgtactcctcaccgcgatatagaatacaatcattcggacatgcgtgaatcttctgaactttcagtcctagagggcacactatcttcttagcctcgtacgttgtctcgggcaacttgtttccctccggaagaatgttcttaacgagtttcaataaatcgccaaatgccttgtcactaacaccattttttgccttccattgcaagaactccagagtggtatccaactttttgtgcccctgctcgcaacctgggtacaacgacgttctatggtcctctaacatcttgtccaatttatgggcccccttttcactttcgcaatcctccatggcgtcctgcaacatctgaccaagatcatccgcaatgttgttaccatcagcatccctttcctcctcgcccgtttgatttcattcaaatccagcgtactgagcaaagtccggaatattgtcgtcttccacttcatcttcttccatttcaacaccttgctctccgtgggatgtccaacaattatagcttggcatgaaccccgactcaaacaagtggaaatgaatagtcctgcatgcagaatactccttctgattcttacacttattgcatggacaacaaataaaacccttttgcatgttagcttcggccactctcaaaaaataatgcacgccgtcaataaactctttggaccaccggtcagcgtacatccattgccgatccatctacataacatgaaaaaaaatcgtacacacataattattcgtacaataatgacagtcatacaataattataaaataattacaaactctttcaacagtcacacaataatgacatatcattattcctacaaatattatgaaatattacaccgaataattatatatttactatttataaagttttaaactaatattaatgtgttgtacttattttaatttgtcattttactttgttttctattattcaagattaactttcactatattttccttctcaacttttttataaaaccttctttagcaaataaactaaatttctatatattctttattctccacacaaattttctctctcatcaaataacaacaaaattttggtcacaaaaatgtgtgcaaaacatagctccaaatgtaatatgaaaaaaaaaacattggaggatgaagttgctaaccttttaggcacctctgatttgtatataatcaccaaaataaatttactagaaattttggcatgacctcccctcttttttgaagaaattttgaagcttgctcgggctgaaggaggaagaagacatttatataggggtgagactttagtcccggttggtgttatgaaccggggctaaagatcgctgtgatctttagttacgatctttagtcccggttggtgttattaaccgggactaaagatcccgggggacctgacaggcccttacagcatttgaaccgggactaaagttacgatctttagtcccggttggtgtagatcaaatatgcccgttaccctttttaaccgggactaaagatgatctttagtcccggtttttgttgcaaccgggactattgtggaattagcccgaccgacgaaagatggtttctccaccagtggcagttgcactgccaagattgttacacctttgctgataatagccgaggacaatctcgtcggcatccatggcggccagcagctcgaaggagatagtggacgcggtggagaagtggatggcgttccccatctccaccgccgccggcttggagatcgttgccgaggagggctctagcggaagcagcgcccagcagcagcaggcttggcgtccggtggcggcggcgtggtgcgacaacggcggcacgtcggggacgggagcggcatgcaagtcgtcagtggacggcggcgcgcggcggcggccgcgcgtcgtaagactggctgccgcgtgggtgtcgctggaggtcaaggacgcgctgtccagcctgcagcagacgttcgtcgtctccgacgcgacgcgcccggactgccccatcatctacgccaccgaggggttcttcaccatgaccggctactccctcaagggagataaggcgcaagggcatttcggtccaaccacattaaaaaagggctcctgaaccgccacgtcagcatggcaagtttcatttagacggcacggtgctcatcgataaatatctatggttatgtagtgtctttcccccaaagctttgtttttcggtgtccctaggctaaaaccacacaactgcgatgccgcgtagaaaaatttgccttacttattatagtaagtacgaatatggtactgtatatgttatacatacatgaacgtgattaatttattcatataaatatatatctgatgcgtacattcatgtagtagtaagtatagtgtactagtaagggcgctgatcggggaagttgccgggcgggaaatagttgcagctgatgatgacaccgccgccgttgctgcaggcggcgcgcgcgcagccgatcgacgtcgtgctccgccacaccacctgcgtgtagtggccgcagtcgagcagcgcccccctcgtgcacgtgttgctgctgtacacgtagtccgccttctcctccatccacaagccgaccgcgtccgccgccgtcgacgcgctgccggcgccgcccatgtacaggttctcgccgtagcccagctgcacgctgttcgagtggtcgaggctgcaggtggcggcgagcaccgccacgtagctctccgcgaacgcctgcagcgtcgtgttccacaccacgtcggggaggccgacgccctcgccgcggcgggcgtcgttgtgggcgtcgacgaagtcctgcggcgagctctgcgccgccgccgtgctggccgccatggccagcgtcgccgccgccagcagcacgagtgcaaaggctttcgacgccattaattaacagagaagctcgatccagcagatgagtttctcaagctaattaattaatgtcttgtgctgagacttgttgcttgctgaggtatttatagcagttaaatcatgagagctatagctaagctcgattacgagagatcgaggttggaaagacactttagacttggtcctgcactgtcacgttgcttctagtagatgttaattacttccactaaatataattaagtggtcaattgtcgcaaactttccatgcatgtattcacactgtactttaatagtctttggcacacagctcagctgcatactttcttcatctgggcaggtagtgaatgcaacttgatgtttatttttctggcttatttatatatcctatagccaatagctcaacatgcattaaaccacataattttaaaaaaagagagccatatattggatcattcctatgcttaatccattttgtagctactattcatcactaattagtaaataacttagcattcagtgatttacttagctagcgtagaacgttattactgtaaagaagttacaccatcacttgacaacacattggatgacacttctatagttcatatcagcgtgtatatataatctttctcgtatgtacgtattgaaattttacaactgcattgcacacaccaatattccgtctgcactgcacggggtatcatctagtattctagtgtgtgtgcatatgtatccatatcacattatccgaaaatgtgtctttcaaagttgtgatggctcccaaccaatgatggatcataaccgggctacctcggccatagctcaaggcctaagtacaggctcatataaagctatgcacactacgccgaatcaggtcatctctgacggtattcaaaccgtcacctttgacgtgttttggtcctagtcagagattagtggtcgctgatgactttactcacatttgacggaggacgttcgtcagaggtaaccgtcaccatttttttccacaacactccacgaaccggttgagggcttaacccaaagctaggttcatcccttttctaactctaatgcaatacttaaagttacaacaacaatagtgggccctattcataacctggttgagaaatatcaatatacacacacacatagagtaaagatacccttaattagaaataaagcttcgagtaacactgacatagccgatgacaaggtggataccgtgacagatatggtttctagagaatatttttctttttcttatctaaagaattaaagaaatggtaaaaaggtagtttctttcaagattaaaattaaggatcataccataatatatgcccagctggaggcacaagatataacgttgagcatgcacagaggcaatattaatatttggcacgttgcaatgaactttccaatgattttccttggccttttcctctcgtgtagccgcatattaattacctaactcacgaagacgtacgtacggttctactactacgtgttatagtacgtacgtacagcatgcgagagacgttggaaagactttgactggtcttgtactgtcacacgtttacctctagtatagttttttgagtaaaatacagtagcggcccttaaacttgcgggcggatatcatctaggtccattaacttgtaaatcgtgtaattaggccactaaacttgctaaatgtaccatcgccggtccaaaatgtcatttgaccgtggtcgcgccgacgtggcatgccatgtgcacagctgagctggcccgcaccgtgccttttctcacgcgcaccgtgtgtgtcaccggccacacttgtttttttttcatcgaggcccctctgtttttctcattttctttcgtcatccactgctgcttcgtcttccccggagtgccctagcgcagagtgcagcggagatcgtgaggggggtgatcgccggagaaatagggttccaacggaagcgcaaagaggcgagatcgattggctgttgcggcctcccgccgaccataatcgcggggaggaggcatgattttccgcctggaaggggaagggcctccgttgtacagtgagtataacttcaaaatttcgttcgtccattaatctgcagggttagcatgcactgattgatgttggtagatagatacaaaggaataaggcgtttgttatgcaaaaaagatgttatttttccctgtaggatgattatcctgacattgttctcgagtaggctagaacatgagagtaatacagctaattaggattgcaatgcaggtcctgatgatggtaaattcaccgctgaggtacaccatggtggtttttttgttggtcaaagtagcaacagggcatatgtagatcaaacaataaattggattgaccactgtgaagcaggaacatgggatattgtttgtttggatgaatttttagctatgcttgggtatgatatgactccagattttaaggcttattggttgctccctggaaggactcttgaagatggccttagggttatatctactagggctgactttgaagtgatgaaatcagttgtgcacaaggttaagaattttattatctactttgatcagggtgacacaattgcaggtgtagattgggatgatgtagtagctaatccta

SEQ ID NO: 67940 - DNA, 6251 bp, Oryza sativa
tttatatatctgctctcatttttaaattatttatcgttttatatttgtaccaagttaaacatttctaatgttgaccataaatttatattgttaaacaccataaggtttttttattcaccgtgggaaatatttttactagtttatttattgttaaattttatataaattgatgacaggacaaagctaaatctaaaaagataaagtaattccaaaccgaagaagaatatttggttgctactggcatcaatccgaacataggtgcgtgtttgcaattgcacccatttgccatggcggacaaggattttctatacttggtacaatggtattcattatttgcatacgacttagaacggtcaaagaaaatttacattaattgaaatcttataattctaaagacaaacctgtaaagctaaatttaatttacaattagagaaacaattaataaaatcagatggtgaaaagtacttgttgaacataaataaattttgtaatttttttcttcatatcgtagacaaaaattagacttgtgtggtatcttatatcatcataatttatcttgtcaaattttatgaaatttttatataattgcttaaaccacaatgcatacatatacctagacgtagaaaaatattttgtgcagttttttccattgacgctgtttttctcgtaaggtggtttcaacagttttgtctataaaagtaaattttcctatagaaacacttgcatatatttgctatatttcgggcacctaaaatttactccctctgttctatattataaattgtttgacttatttcttagtaaaacttaattaaatttgatcaagtttatagaaaaatatagttgtagtttcaacacaaaacaagcatatatattatcaaaatatattaattgttatatctaatgaaactaatttgatattctagatattactaaatttttctataaacttcgttaaacttaatcaagtttgactaaaaaaagtcaaacgatttataatatgaaatatagaactagagggagtacatattactaaacctaaaattacagtgttgtgcttgtgcattatgcaattttagggttttttttagcaagagagggcaggccgccctcctccgttttctattaccagaaacgtgaagtttatcacagcaggagtttgacacaagctaaaacactcaaccttttgcagcaggggatggagcatccatgaacacagacccttacatggtctctgccaaactttccagaattgctcagcgaaatagcaaaatgagtcatctccaggagcttgtatctctctcttttctcgagtggcacggctacaaatagacgaattataatggtatttatctgaatagacatttataatagcacggatcaaattaacccttttatccttacagtcttcccgtgtttaggcaccacctatacattgatacgaaacttcatcggccacccgtcttaatagcagcattactcattgcaacctttattttaactgcagttttttttgttatatattattatgctttatttttatccaagtttatttttttataaaggaaagcttttattaatatcagacgattacattaagttgatagaaccatacttatggcctttgcataatccaaaacacacacaattttgtagatttttatgagttatatgtttgtttcatttaattttgtaaatttattattacaatactttattgtttaaccattgatgagaaacattgtattttcatctaacggatcataaaaatgactaaaattttcaaaaaaaaaaagaatcaggcacccgagatctagacacacccaaacttccacctataaactaagaaaacattcattagggaaaatttttatataagtttcactaacaaattgtaaagccttagtcctatttttttaaaaaaaaaatggctcggctcggtttggctggattagaaaacgagctcgtaactgaaatgagccgagcctcaatgagctcacaagtctcccagtctcccagacctgatgtactgacctagtaaatcggatgttccccttttatttatgatttgataagtttacgttgaagttgataacgagagtagtaaaaaataatttaaagatatttttaaatacaagtaaccacccgttcatatggatatgaacataagtatatacatccataaatcaaatataaacaataaaaatcagatgtgcaacagtgaaccaagcaccaaagcacacaattcaacaatctttacaattaatgtatctttacatttgcacacaatgcaaatgttcatcaccaatcagtcgcaggccgtagaaacccaaatctttccgggaattaaattacttgaactgcagtttgcttgcaaatgtttgcccgaacttccatccagagggcacaatgttcctaaagactagtgtctggccatccatgttcgtcaccctgaaggagagcatctgcccggtgagatacgacagcgagtgccagtttgcaccccagttcctcaccattggcatccagtcggttgagttggagcccatgatgtccatcgacttgatcgaaccagtggttgcaacatttgtcacgagcacaagattaaagtagtcatgcccattgatggtaaaccgcaccccacccttcttcacacacggaaccctgaaaatatcaccaaatatgttacaacttaaaatatgccataggtgctatatgtcaaaaacaatatgtttttttttctcagtttaaattatatacctttggtacatgaccgggatgatgccagcacggtagatgccaatcttctcccaagcaggctgcgccatgtcaaagtgcggccgcggcgggttgcaccagccgccgttgtcgctggggaggttccagttgggcgggcagaagttggtggcggtgacggtgacggtgaccctcgggcttgcaccactggggcgccctcttgcggtcgcaggcgatcttgtagcactgcccgcacgacgcgccgtcgttgaacagcgccgtgctcagcgccgcgttccgcgtcccgtacccctgcgagtacaggtcgacgtagccgcacgccccgcccatggtgcccgacgcgtccgccccgccgtagaacgtcgcgtgcgccttcagccacacgggcggagtttcatcggtagacggagacggagccatcggtgtcggtggcgacggcgcatcctgggccgcggccatcaacgcgctgccgactgcaactgcgagcaacaccaaggcgagtgctcgagctggagccatatccgccatggacgttatcaataggcgctgaaagattgtagctctgaaagctgcagctgcaagatggttgtgtgatttagctatatatgtcacttttggttctaatgattaactaatcaactgatctgagatgattgtgagatgattaggtccctagatatatatagcctttttttttcggattaattcaacaaggactaccgatgacaccttgagttaattaacgacgcttgtggcgtgcagccgtgcatatgcatgtgcgtgcccgtgcagccgcagcgtggcttgcggtttaatccaacgatttgtgtaagcgcagacacgtattatggcccaaactatatattattctcttatctgtgtactttttcgtcgatctttgcttgaacttttgcttgattatattcgattagaggactatctcttaatttgcttgacttcagattgtgaaatggacggcttaattatttgcagagattattcatgttccggtacttccttgtttaagaaagggatggcgtctgttcctttaatagtacgggtgattctgcatctggccagcaattgtaatcgtgtccaaccgcgtgcaatggataattcgccggaaaagtattttttattgtcgggatgacaaaagaaaggccatccgaacaatattaggatcgaagaaaaaagagttacaagaaacactatcatcaaggctatcgagctttattgtgtaccaaagtatgtgtataggaactactcgtctaccacacaaacacatgccactaaaaggggagcctaccacaaaaccagccgccgctatgcgtggccggtcatcatcgggcctacaacgactatagagaaaaaacaacacctacacgaagactgtgacataaggaagctgtcaggtgcagaaattgaatttgaacttgtatgtttgtgaagtgatatattacatgttaatacatcttcttaatttttttaaatttttttataactatttaagtgacatgaaaaaaacgaggggatatcccttcgagggatcaatatagtttccacacactacccaactttacaaaacttcaagcaaaacaacttgtcaaagacaccccaatttcttcaggatcatttcttttcatttatctaccagagcgcaatctccctcctttagcaaaattctccatctttgcatcaaggatacgccacctgcaatggagatttttaccaaaatattttcaaacacctattctttcttagttaaccacatagaccagcacaaagcatcaacaaaaaaaaaaacacccacaatttggacttaaatttgtgtttgaacacataaatgcacccacacagctccctagggatgttatctaactccagtgcttccctaacagtacataagataaattagcaattggacagttaaacatgatatgcttagttgtttcccttttcatacacaatttgcacttctcatcaccccctttccatttcctatagaccaactgcatagcagatggatggtacccactgaatacatgaaatgtttgattttcagcggaatcttgcttttccacacatccatcatctccacacctttaacaccccccatcccccacccacaaattttatcaacctacactcttgacaccatcatgggacgattttgacaacaaagcctcttctgcctacatttgttcctcttgggactggggaggaaggattgacaagttattattcatctgaccccagatgtggtaggctcacttgtccgcctggttcacacggctgtgtgacaattttgtggagttgtatgatttttcctgttattagagttgatgggattgaattggactaaggtaagagccggtggatggtaaaacggatgttttcctattaattatgaactatagtttttaattggaaaaagtacgaattacccccccgaactatcgcggtcgtccgaattacccccctgaaccacaaaatcggacattcttcacccctccaactatgcaaaccggacgaattaccccccttgacccaatccacagtggttttggtttacgtggcgtacacgtggcaatccagtcagcattccatttaaaaaaattgtgtgggacccacgtgtcatacattcatactctctctctctctatttctctctctctcttaccgtctcatggcgggcgaagcggagggcggctagtgggggctgccggtccgcgccggcgccaggtgaggtgccggtgggcgagcttcccggctgacacgccgtggaggtaggcgtgcccttgcgccgcgtcttgcgccagcttcaacctcgtctgccactccagtggaacacgcgccggtcctcggttctctgaaagaatccattgccatcgtcatcgtgtagacattgatgagaagaagccatgagaggagtcaggagagagaggttacggaccattgaggaggctgtggaggctgccattggggacgtagtcgaagacgaggaggagctcgtcggccgacgcgtagaaggcgcaaaggctgacgacgttggcgtgccgccacgtgcccatcttccgcgcgagctcccgcttccgccgctcgtcctcccgggtcgtgccttccctccgccgcatcctgttcatcaccaccacctcgccagccttgccctcctcgacgacgccggcgtcgtccacgatgacgtcgtcgcctcccatggccacgtggtacgtcgtagccgtcgcgcccttgcccagtatctccgcggcgccccgcatgagcgtgcacacgtcgaactccacgcagcagcagcagaagcgcaccgtctcctcccgcgccatcgaggtggtgcgtgagctggcgcgcggcctctccggcttcttgttccttcagccacagtacgccgcagctagagtgccgcggcgaccagcgatgccactggtgcgcccaccgccgccatgatcatcaccaccatccaccggtcattgctcctcctc

SEQ ID NO: 67941 - DNA, 2292 bp, Oryza sativa
gaccaaaaccaccgtggattgggttgaggggggtaattcgtccggtttacatagttggggtgaagaatgtccggttttatggtttagggggtaattcggacgaccacgatagttcgggagggtaatttgtactttttcctttttaatttatgttttaagttcggttcaagttgatatgagagagtagtacaaattgatttgaagatattttgattcaatgaagaggatgaacatctcttgatatacatgtgcaagtacccacccctacatatggatatgaacataagtatatacatcaataaatcagatatatataaacaatggaaatcagttgtgcaaccgtgaacaatcgagcaccgaagcacaatccaacactctttacagtgtatatatacacaacgcaaatatccatgacaaatcagtcacaggccatagaaacccaatcttgaatttttgggaattggttacttgaattgcagcttgcttgtaaatgtttgcccaaatttccatccagatggcacaatgttcttgaagacaagcgtctggccatccatgttagtcaccctgaaggagagcgtctgccctgtgagatacgatagtgagtgccagtttgcaccccagtttctcaccattggcatccagtcggttgagttggatcccatgatgtccattgacttgatcgaaccagtggttgcaacgtttgtcacgagcacaagattgaagtagtcgtgcccgttaatggtaaaccgcaccccacccttctttatgcatggaaccctgaaaacattacaaaaaattgttacaaatctgttctatcgtcatgtcataggtacaatatgtccgaaaatgatatttttgttttgctgtcaaattatattttatgtacctttggtagataaccgggatgatgcccgcgctgtagatgccaatcttctcccacgccggctgcgccatgtcgaagtgcggccgcggcgggttgcaccagccaccattgtcgctgggcaggtcccagttgggcgggcagaagttggtggcggtgatggtgaccgtgacgccgggcttgcaccactgcggcgccctcttccggtcgcaggcgatcttgtagcactgcccgcacgacgcgccgtcgttgaacagcgccgtgctcagcgccgcgttccgcgtgccgtacccctgcgagtacaggtcgccatacccgcacccgcctcccatggtgcccgacgcgtcggcgccgccgtagaacgtcgcgtgcgccttctgccacacgggcggagccgcgtcgtcggccgtggtcagctgagtgcagccgacggccgcgattgcgaaaaacaccaacgcgaaagctcgaggcgatgaagccatgtctgtcgtcgtgatcagtaggcgctgaaagatgtagctctgcaagcagatccgctgtagactgtgtggtgtgcgtttgattcagctgtggatttggttctgatgattgtgagatgatgatgggatgattggtctagataaatatatataggctacagcctctttggattaattcaacaaggatcaccttaagttaatgaatcgtgtagcgtgccatgtgcccgtgcagccgcagcatagcttacgggttaattaatcggtagatttttatacgaagttacgaacacgcagacacgtattgtccaaactattgatttccttgacacaaacttgatttaatttgagaggatatatcttggatttgctttacttccaatggtgaaatggacggcttaattatttgcagagattattccatgttcggtgtactcccttgtcgaagtaaggatgtcgtctcttccttgaatcttactgctgaaatgcacctggccaacagcatcagtcgcgcccaacggcgtgtaatggtataataataaattaataatattcgttggtatagaacttttagagttgagtcaccattaaggcagacgaggaattcctggttaatcaaacgacctttgcacatactagtacgtagtacgcattttgacatcacaatattgcacttgccatggcgtgccgcgtgcctgtaggtgtcactttttctgagacaccggtaacaggagtactgtaaaaaggaaatttaactatttgcgggttactctccattcgccagtctaatatttgttcgtacaaatttaccacaagggacaggggaaatatttcacacttttggtaaagcgacacactatggcctatataactcttgatcacgagttaagttaaatttccccgaaattaagaactggctctgtatcaagtatctgt

SEQ ID NO: 67942 - DNA, 4967 bp, Oryza sativa
ttcgttggtatagaacttttagagttgagtcaccattaaggcagacgaggaattcctggttaatcaaacgacctttgcacatactagtacgtagtacgcattttgacatcacaatattgcacttgccatggcgtgccgcgtgcctgtaggtgtcactttttctgagacaccggtaacaggagtactgtaaaaaggaaatttaactatttgcgggttactctccattcgccagtctaatatttgttcgtacaaatttaccacaagggacaggggaaatatttcacacttttggtaaagcgacacactatggcctatataactcttgatcacgagttaagttaaatttccccgaaattctgtactggctctgtatcaagtatctgttgtaaacaaaatttcagtaaagagaacaatacattgtgccttcctcctatcactactacataaaggcaaatagaggtcaacagtgtagatgccggaagtactaaaaccggcacacatataaacattttcacacctccacgggctgaaaatacattaaagaaaccaagacctttaagcaactataagtgccggttctggagaagaaccgacacctatacaattgataccggtgtttttaaaagggaatctttaatatattataggtgtccaaccgacacttgtaatatattaaaaaaccgacatctaggaaaaccgagccgagccgggagctaggttcctctttttttagcacaaagggggtgagagggggcttatctactctccccgccccctctcgccatccctctttctctccaccttaagcctatcccctcctcctctcctcctctgcccccttccctttcgatcggctgagtcgatagtgacagcaagcaaaaatggatccggcagtgtcggtggcggcgtgagcgacggcgtcggaagcgggtggatgcggtgtcggcgagggttctcgcagcggatgtggcttcagcggccgttcccatgacggatcaggcatcggcaggagctcccctggcagatcctcctgcacgatggcatggtcgctgtcctcgccacccttacctcacaatgccacagcgctatcgtgccctccacctcttgttccacagcaccgtagggtgggggattttttttatattatttttttggttcggaagtgttggctcgactcgatggcttttttgtgttttgcaaaccgtatacctcaaagatgccagtcacctttgagtcctcatcaatgccgtcttcgtagtgtcggttgggaaatcctactcatcaatatatttcatcttacctcatcatatgagataaatgctttttattacacttaaaatcctttaatggaaattaatctactatattagggaaagtaaccatgtttccattgcttaattactaaatgtctgcttgtgacattccaaaatttgaatctcacatattgcatcagaaaactgaaatggaattgattttattttcaatttgtaatggaatttatatttatgccgccatattttttatgaaaaaatggtcagtatgcatctacattgtgagttcataaattgcatatctaattttagtatattgtcatgtaattcccaaagttacatatgtaagttccttaattacatatataattatggtgtatttataatgtaagtttcaaaattatatatgtaattttagcttcacctacattttaagttgagaaatgctattgttcaaaaatttttggcctcgccattttaatgggcctgtcaacgtgacaagggactggttacggacatgatgagatgggttcggtttaggtcaagcacaaatcgcaaaattaaaccaattgaacgattagaaatctgactgtaatgaggggaaaaaatgccgccacaaatataacgattccgtaaaaatatacacacttgtgggcaataagatttggccaacaggaatcaagttacatccaactgctaaccaacctacaaaagccaccgataacatagtaagctaaaaacaatagcaggacaagcaacaaacaccagccaaagacgatccccgttgtacaaaggggatgatcaggcttctccacgccgttgcaacggccgagggccctgtcgaaaccctcctgcgtcgccatggtcacgaacccaaaccctcgcgatcgccccccgcttgtcgtacgcgaccctcgccggcccgcaccaccttcccgtgctcgctgtacatctctcgcagccggcagctatccacctgcggcgacaggtcgctgacgtggatcctcaggtctcgctgctgatgctgccgccgctgctgatatgccctagcggcggcgtcttcttcctgttcttctgtcaggaccggatcaacaatgcagggcaatggcaagaaacacatgcacctctcgttgttccatccggcgggcagcgtttccaccagcgtcgccgctgccgtgccgccaccggcggcagttcggcggaatacagatcgagcgcgtgcacagctgcatacacatcgaacgcgtgcaccgacaccgagaggcggtcgtcgtcgtcgtcgtcctgcagaacgctggccagcagcagttcgccgcgaagctccaggaggtagctgtgtcggcgcaccttgcggggctcgtcaggtagcggcataggggcgtgcggagaagccagaacagtggctctttgtggatgtaacagttggccaagtccacgctcacggtggcgccgccgtggtaggcgtgatagataatctgtccggagagcgccacctcggcgacaagcggtacacaaggaggctgccgtcgccggagacgacgcagtggaagaagcccttgctgccatcggtccacatccatggatacttcttaacccggccgacgttgatccagccggtcaaagggttgactagcttgtcgttgatgaaccaggaggccgtgccgtcggcgtgggccaccctcctgtcgcggaagcagaggcccggcgcgtggtagctcgtcttggagaagacgcagcggcacgccacgccggcggcggcgtcggcgtcgtcgccggacgacggcgcgggaagccacggcagcaaggcggcggccggcggcggcgaccgcggaatatggcgtaacgattggcgccaatcagagcagacggcgtggaaggcgaccacgttgatggcggtgtggagacggcggccgatgaggcaaaccagctccggtggaggtcggacactgacgtcatgatgtaggtatatacctatcgatcgatctatctctcccccggagggccggaacgtactgcagctcgatcgatctttgatcaagacgtgcacgtgagtacgtacgtaataattaatcgtggtcgtaatattgatcgatctgattatattgctaatcaatcgtcgtcgtaatcgatcaatctgattatattgctcgatcaggccgggtgaagactgaagagtcggactccgactccgactcggggttttcaatttcaaaatttaattttatgtcggggtcaccaaaattttagaaatttctagccgaaattatttgaaaatttgtctgaatttaaatgaatttgaataaaatttgaccaaattcataaaaaattacaaataaaacaaataattcgggtgagatttgagcttgccggtgggggcggagtttctgaaatttcaaacctgctccgaatcaacaagagatcatacacatggagaaaccaactttcgacctattgcattgtgattataatcaatgcacatgcataaaaatcatcaattgtgaaaaaaatattataaagtttcataagaaatgtaatttgaaatatttaataatctcctaaattttcatcatcgcctcctgctcaaaggtgagtcattagcccatccgccattcctcccatgtgtcccgagcatcgtccacattccacatgtgtatagcgtacaaattgccaagcacaaatatacctttgtaataattgtccacttatcctatcttactataaatataaagtactataaagttatctcctactaactccttaagcttaacatacaaagatgccacatcatcatccactaacaagatgccacatcattatctactaatccactaattaacaagatgtcacatcatcatccactaacaatcatcacatttaaacatcatgcaaacatgttatattatctataattctatagtatttataatttaagagcttttaaaatacaagcatgttaaattatcatcccacataattcacataatgtttcaatgtatatatttactatgttttataatatcctacatatttatatagttcattctcacttagtgcttaaatgattaatctcctttttttcctctaactccttaagcttaacatgcaaagatgacacatcatcatccactaacaagatgtcaaatcatcatccactaattaacaagatgccacatcatcatccactaacaatcatcacatttaaacatcatgcaaacatgctatatctttatagtttttataatttaagagcttttcaaatacaaacatgttaaattatcatccaatataattcacataatgtttcaacgtatatctttattatgttttatgatatcctatatacttatatagttcatcctcacttagttagtgcttaaatgattaatctatggtccaaattatctttctcctttttttcctctaattaaatcatatcacatcaattgtttttgcctttagatgattaatctacggtccaaactatctccttacttttcttcttccataaaatcacgccgccttagtttttcgtttgaatcatcattctacacactatttaaatttaaattattataaaccacattaatttacttaatctgatgttatctagctatcttacacgttattttttttgcggggtttcacctagtaatcatatatacttgggtgttttgataaatcgttaaggtcaaactt

SEQ ID NO: 67943 - DNA, 828 bp, Oryza sativa
cgacgaaccaggaggccccgccgtcgtagtgggccaccctcttgtcccggatgccgaggccgggggcgtggtaggtcgtcctggagaagacgcagcggcacgcgccgccggcggcggcggtgtcgtcgtcgggcgtcggccatggcgcgagaagccacgggaggaagctagggcgccgcggcagatagcggagcgcgtcgcgccactccctgcagacggcgtggaagcggacgacgtcgacggcggcgtggaggtggccggcgatgcaggggagcagctccggtgggaggtctgagattaacgtcatgatgtgtatcgatcgatcgatctcccgggaacagcaactcgatctcgatcaaagacgtacacgcgcgtgcctacgtaccaatcgtcctagtatgtaattggtcatactctcatcgtaccaaaatacaagaaactaaacgtaaacgggatggattctaataacttgattggacgtccacctgtttatttattgcatatcaactagatggttacgaaaattttttaaaacaattgataagataaatcaatatgtaatatatcactccacaaacatcaaagttcaaattcaacttctacaagttgtaaaaaaaacaacaaatttaactgtcaacatacatatattaatttgagttttgtttgttatttttgttacaatatgtagaagttgaattttagcttgcatgtttgtggattgatacattacatattacatattacatattacatattgatctatcttattcatatttttttaatttttttcataactatttaaatgatatgcaataaactagtggacat

SEQ ID NO: 67944 - DNA, 552 bp, Oryza sativa
agggggtggtaaatatgcgggggaaagaggggcaaggatgatactctagcctctttccacgccggactgacaccgctccagccgcgcacgggtgggcagctcagctttgtggggggcgaaaaagaggagctttcccttctacttcttctctttctcctccctcggtgatctgcctcgctgggcatctctaaaagcatccgactccgacgccaccaccaccagttcaccaccgctgaaagaatcagcagcagcagcagaggccacacgaggagatgaagaagtgcccgtcggagctgaacttcgaggcgttcttccacggcgagaggggggaggacgacgccgacgccgccgccgaccaaaagcccggcggcggcccgcacccgccgccgttcgccatgttctccgccgccgacctctccagcttcggcttcgcggactcggtgacggtgagtgattattttgttgatcatgcttgtgcttgattaaaagagtggagtactacttgctccctccgtttcgaaatgtttgacgccgttgactttttagcacatg

SEQ ID NO: 67945 - DNA, 735 bp, Oryza sativa
cttttgcctgcaacgaggcttggaggctggtgaccgcggcggacgcatacgatggcgggcgcaggagacggtaacagcgacggccatggcggacaaggcggacgcaaactgcgacgacggcgaactcaggcgatgacagcggccacgatagctacaacggacgaggcggatgcacgcgacgatgactgctgcggtggatgatggcggacgcaagcgacggaaacatatgcagtggaccagggtgccggccatggcggactacaatggataggcgacaacaccgatgacgacggctgcggaggatggggccgaagttcgcggcagatgccgaaaccgacgccgacgatgaggcggacgtcggcggtgacgccggctgtggcggacgctggcgatgacgccggccgccgcgaacaaggcggacgtacggtggacgacggtgatgggtgcggcggcgattgcgatggacatagtcacggaccatcgctacaagcgggccccacaaccttgggccgcgcgtggagcctcgcgctcgcgctccaccgctctttcttccatgaaatcgcaaaatcctagctggagcgtttatcgccggttattgtaccgctcttaaaattttttactccctccgtaaaaaaaagtatgggacactgttaatttataatataaaataaaaggagtatttataataagttttcgatgttttgggaaaacaacatcatataattttaagatgta

SEQ ID NO: 67946 - DNA, 6249 bp, Oryza sativa
ggatgaagaagtgaccaacataaaagttgtagatcttgatgagaggatcaactttattgttgttgcctttttcatttgaaatcatttactatttacaaatgctgttttaatttgtcatattttcaaaatcaatttcaagctgttgggaacaaagttatatatacaaatgaccaaaatgaaagttgtagatcttgataagctctacaattttgttgttgaccatattttgatttgaaatcatttactatccaaaaatgtattatgtctaataaattgaattattatatagtagctatatattttgcactcacaaatataaagacttgatgggaaaaatagaaaaatagtcatcggtgacgggccttagtttaagcccgatagagattagtctatctctatcgggcattatcttagggcccgtcacagatgagtcatccgtgacgggcctgaatgtcatctcaatcgggcattagtatggagcccgtcaccggtgagtcatctgtgacgggccctacggcaatgcccgtttgagatgactcatcactctactataactagggtttctcagatcggatcaaaaatttttctaagtcccgctacagtttcccacctccttagaaccctagcgccgctgtcgtcctccatcgccgagcccgccgccgtcgccaccagcccgcagtcgccgccaccgagcctcctccgccctccattcggaccgtgtcacgcccgaaaattcactagtaatttccgaacttatttgtgcataaaatcctcgtccaggaatcagccgaggtacacaaactgacaatttaatatacagattcatccaattaactaaaacgataaatacttacttaagaggcacttagtcctcaccatgaagaaaactgcagcggaaaataaaatctagcgaagctccggctccactcccacaggcagctcaactggggtataagccaaacgtcttctccttctagatcctttttcttcaactgaggttgattgattattgcaagaatgagcatatgacatactcaacaagccacacagcaaatatgcaagtgcacaaggataccaaaggatggcataatatagtctcatttgcgaaagcagcatttagcaaagagttaagagtagtaaaacagtagagtaattaatcagaaattttaatcaacactgaacagcacacccatgctgcacaggcccaaccatcctgaacaaccatacccggctgtacagatctaactccaaatcaggagctaagcaaattattaccaggtataacatccataattattgtgagaggtgtgagactaatcacgaaaaacattgctcaacccgcccataaccgcgggcacggctattcaaatagttttactctggccagaggtgtaccactgtacccacaagacacagccccacaacatgtcaccatgtgcctcaataccaccacggtacctcggaaaggagctatgacaataccccttgcacaacataatccaccacagcgcacctttcctggatcataatcacccccttataaacaaggcatggactccccagcgacccccgtgggcttatctccgccacttctcagtctggtgctccacaatgaatcatgctatacaaaaggtaaagccgttgcccacgctggcttgtggttggcacggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgcgagctatcattaagccatcattaaataataatgaaacattaattatcccaatagtgtgctaatgtttctaagcatggctaagcaatcatatctaatatctagctgaaccaatatatatagcccaactagtcaagttataataacccaaggtatcaaggaataaagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttggatacttccggcgcactcgtaaaccttcgcaacgacggaaacgacaagctaacacgcaaaacaaagaaaaagactaataaaaaccaaataaacagtacataaaaagtaaacaaacatgtagatcataattttagatgaattatgagacttgaacggcctcattctgacttcaaatgaatttattaagaattttactagattaaatctaattaaagcccatttaaaaaggattaaataaatttaattcaatttatggataattttaatatgtagatctttattttatacaacttttgcaacttgaaccacataaaactgagttacaatgaattagttatgaatttttaaagattaaatcggattaaaacacttatatggattttaattgaattatgacgcaataatgaattattttttaaaaggaaaagggaattattgcgtcagcggctagggtttgcggtggaccgggtgcacggcggcggctcacggaaatgaacgaccgagatcgatcctatccaaaacggacggccgagatcgaacggtccatgactgggccacgacggatggtcccgatgacgtcagcggtgacgtcaccaccggcggcggctcgggcttgcaaactcgccggcgaacgacggcgcggcgacgcgaacggagggcaccagcacgtagagagtgacgcggcgaactcaccgatgaccaaaacgacggcggaagatgaacggacggcggcggcgtcgaggaaaagacggcggcactcttcggcttgacgacggcgacagtgctccggcggtcttcagcgacggcgaaggggtggacgaggacggcgacgcgatggcgaccacgatggcaaccttcccgagcgatggcgacgactggagcgacggcgaagcacggctggagcgacggcgacgactgcggtacgaggtctcacggtgctagggcgcttccgacgacgagagacgaaggcgagggtggcggcgggtagcggcgacaccgggggtccttttaaaggggctagagagcggcgacggaggcccacagtgaccggcgacgagaaggaaaggttagggttcggaggaaaaagaccgatccgattcgacctcgaatccacgaacttccaaagcgaaaaagacgatgattccaaaagagaaaaggtagaggagatcccgaagattgtttcccctcaattgatttcaccggagaaggaaaggcgcggccgaatttggaaggagacgacggcggcgcggcgctagggttcgggcggcggcggcggcgcgaggaagacgaagactgacaggtgggacccacctgtcagcgagagagagagaaagcagagcggcggctcggcggactgggccgactgggccggggaggagagagggagaaggaaagagagacttgggctgactttcggcccaaaaccaaaagaaagattttaaaacctttttctatttaaattattcatgaaatgcaattccatttattaaaaatacttccttggctcaaataaatcccagaaaaatctaggaactatagaatcaagtaaagtatttaacaaaattttatctagcccaattttatattgagatttaacaaattaaaattagatcttctcttttaggcttttaagatcatttctaataattccttttaaacaacaatttataatttaaggatttttaaacaagaaaagctcttaacaatgataattagatcattaatgatcaaataattactgaactgttctttgtatcatttaggaattgagctccgaaaaatccgagaaaatttcagagagtagacttaatcatggagaatttaataaaaattaaatccatccatgctttatatttaggaaattttatttcccacatttaacttcacttgtaaattaatgaacatttaatataaattctaataataatttattaaataatttataaatcctgaaacgaaaatcaggatgtgacagaccgccgccgcctcctcaacgacgacccctaccgagcccggcgacatccttcctcatcgtcgtcgcctcctcctctccgacgcctgacgccgcctccaccgagcacgccgcggcctccaccgaccccggcgacgccctccaccgagcccggcgccgccgccgccaactcctccttcgccgactcctccctcactgagcccgaggccgccgccaccgaggcagccgcctccaccaagcctccgacgcccgacgccgcctccatcgagcatgccgccgcctccaccgagcctgcgacgcccaacgcccgacgccgacccccaggtgagtcctccatcgcgcatgaatgatgaatagatgaatgtggttcgattgatgaatgtgatgaataaatgattagatgaatgtgtttgaatacttgcatgtgtgtggatagatgaatgtggatgaatagatgattagagaggaatgcggatgaatagatgaatagatgaaatattcaatttatttatatgtgatattcaattcattttacatgtggatgaatatatgattagatgaatgtgtttgaatagatgaatgtttatggatagatgaatgtggatgaatagatgattagagatgaatgtggatgaatagatgaatagatgaaatgtttaatttatttttatgtgacattcaattcattttattactgtgagatgtgcaatttagtttatttatgtgactaatagattttagaattttggattcttagccattgaagcactaaatagtgtattttcgttatttagaaaaaagtatacgatgtcttagcaaggcgaaccattgtcgacgacaactagtgggtcctcaagggcacgtactcctaggacagggaacaaaatccctaaggaacggttccgcataacagtggtggacgccgtagggttgccgacatctccaaggaaaatattgagtcgatttaggtctatctgcggggtcatagggaggcagaagttcaatattctgcaagatgacatcaagcacgtgccggccgcagagaaggacattgcttggctaacgttcaaggagagcttcgattatcctgcggagcatgaggaccgtctcaggcgggctgctttcaaggttatgggcaacgcttgaaagaacttcaagactaagctagtcggcgagttcgtctacaacccggcgaatccagatccaagagagaaattttcttggatcacggaacaggtctgggaggaattccatgcgaagaagtcgacccccgagtccagagctagtagcgaggcatatcgcttgctccagaccaagaaccagcatctgcatcggcttggcaccgccggatatgccggtaaggaagaggaatggcagcatgaggatgaagaagcggaggaatcgaacacgccgcttgtgtttggcgatatcccacacccttgggctaggaactgggccagggccaggtaccagaagaaggatgatggcacaatcttcatgccaaatccagaagatcaacgagtgtacgaagctatagtaagtgtctagtcaaactagatgtttgcaaaggttccgatcatgcagtttatttaaccccactaaattgtaatgcagaaggagttggttgccgagcaacaagcctcgcaagaggtctgctctcgaagacgtgaggatgacctcctcacgaaagcgttgggcaacaaggaacaccgtggacggacacggggcattgggtcttctgttccctggaagtatggattaccagactacgcgtggcagtacaagaagcggtcttccaacaaggcggagaaagatgcacgccttgaagccaagatccgggcgtcgataagagctgagctgacatttgaattcgacgaaaagctcgagtcaatgagggccaagattaggcaagagatccgagaagagcaacagaacacccaggccgctgctgttgctgcgcacgaagagttaggaagtcccacccaaaaacacagcagctacgcatcaactgaggtggcggaaaatccaacatcggtggacaagcccggtggcccacataccggtaaaagtttggtccccaaggcatgaaagacttaacgagtccatatgatatataatattctta

SEQ ID NO: 67947 - DNA, 569 bp, Oryza sativa
ctcatcttaaatagagagacatttatgactctctattgaccggttaaaaaggtgggcggactaccacgtgcgcgcgcacgcgttggctgggccaagcccgtggcttccgtcgtccctagctttgatctcttacgtgcaaaagagattgggacgagtagagcctccgaaactctgtccgtctgagttcctgcacgggtaggcgggcaataaagtttttgcggagcgttcttccgtctgagttcctgggtctgagttcctggttcctattcatcaacgccaacatgtcgacagacgacaacgccaacggtgcagctggaggagatgtcagcaatggaggaggcggtgcagggaacggctccatcaacggaggcaactatgcctcacactccagcgaaggaccatttttagagtatgtctctattcccaacacgctaatttctgatatactactattaagcgtaatgtttttataacaatgccatgtgatgaatgtttatgcttattctatattaagcatgatttgtatgttgctcttgattagtattcacactagtttattccctaaaaat

SEQ ID NO: 67948 - DNA, 546 bp, Oryza sativa
cccaaggacgatcgtcgttggagcacttcatcaaacaggtggtgggcgtcgaagaaggtggtgcctggagtggaggatgtgatgcagccgtgaggacagtagtggtcgccttgatggaggcgctcatctcctcgaagaacttgctcctgttagcttctatctcattcaacttcttcaaaatcagatcgatcttctcctctagcctatgattggcctccaagcactcttggtcactcatggtggaatttggtgggggaatggtggctctgataccagattgttaggatcccagttatctcgcttggaacaatagcaaactcagaagtagcagtgcgaatccaatacaagaagccactgatttctattacaatagtggaaggttttgaggtggaaggtggaaggatacaaggggctaaaagactctagaagctaagcaaaggatttggaggtaggaggagaggtggggaaggagattgccaaggttccaagcccagaaccaggacgccgccgtcgttcgctgtcttgccacctgattgatcgatcctg

SEQ ID NO: 67949 - DNA, 1453 bp, Oryza sativa
agcagctgatggttttaattagtgttcatgttatttatagtagacactatagttaatatgtacgataaagaaattttatgtgaactgcgatattttattattttcgtgggtcccacaatcttcttctatctcttctctttctttcttttttccagcttctcttcctttctttaccttctctttgtttcttttgcctgcaacgaggcttggaggctggtgaccgcggcggacgcatacgatggcgggcgcaggagacggtaacagcgacggccatggcggacaaggcggacgcaaactgcgacgacggcgaactcaggcgatgacagcggccacgatagctacaacggacgaggcggatgcacgcgacgatgactgctgcggtggatgatggcggacgcaagcgacggaaacatatgcagtggaccagggtgccggccatggcggactacaatggataggcgacaacaccgatgacgacggctgcggaggatggggccgaagttcgcggcagatgccgaaaccgacgccgacgatgaggcggacgtcggcggtgacgccggctgtggcggacgctggcgatgacgccggccgccgcgaacaaggcggacgtacggtggacgacggtgatgggtgcggcggcgattgcgatggacatagtcacggaccatcgctacaagcgggccccacaaccttgggccgcgcgtggagcctcgcgctcgcgctccaccgttctttcctccatgaaatcgcaaaatcctagctggagcgtttatcgccggttattgtaccgctcttaaaattttttactccctccgtaaaaaaaagtatgggacactgttaatttataatataaaataaaaggagtatttataataagttttcgatgttttgggtaaacaacatcatataattttaagatgtagataatactttattataaaaaaaaatcggacaattttacgatggaggtagtactctattactcttcggacatagacaacgggatccgatcaccggcggctggttgcgaattcagtcgcggtgtggtgggtagcgcagagaatccaagggaggggaggtgtccacgtcgggtgatgcactccggccaagttggcatgatttgtccttgtccgctagctatgtcactccccaccaccttctcaccaaactccttttcatctttgttgccccttgtttacagcaaattaatttacctatgtttagcaaatctgtggcgacggcgcagtgcagaggccggtgtcttggccattcacaaatcacaattacttgaagcacaaagaaaccacactaaattatcgcctttaattgttcagaaacgtagtattcactccagagtaaaattcatttaccatatcccctatcagatgaaaacttttggaccgtttggtcacttacctgaattctccaggctctcaccaagtggatcatggat

SEQ ID NO: 67950 - DNA, 10317 bp, Oryza sativa
cctccacccctctttatatggcacagtgtgacgggggcccaccagccattgggctgggcgcccccgatcagggcgcgggtcaaggcccccttgagccgttgggctcaaggggagggagatccatctaacatcagtgtcaccatgtctatcttgcttttgcagcttgcatctcgtcattttttatgtatttgtatctccattatcatcatatccatgcccttcagattatatgtatggacttaagtaccctgagattagaaaaccagaaatcacaggcacatgtcaagtggaccagagcaaatttatttatttttttacgatactcattcttgtacaactttaaagtgaagttttgagatgtgttttagcaatcaaaaagccatattgtttcacttggaccatttggttgcgttgagttgaaaagattgtggaaggtctctcttgtgcttttgatgtgtacaaaagtattaatgaacatgaagattcttattttttctccttccggttctctttctgccattgcagcccaagggtagcgttttgtggatatggggtgtgtttggttgctcgtatccccctagcctggtccgtctctctcatcctggctgagtttgacctggctaagaggatacatatgcagctgtttagttgtttgcattagtctatctaggttggttgtttgcattagtctatctaggttggtatgagatcttgtttggttactcgtatgagaaatacggtttggaagggatcttttttggttggttgcactgatcgagtgtggttacctctttatttagctgggtaagattacctttacaatatatatataattatattgggtttttagttaacaattaaatattctcttacatatgcaaatgataatattagaagtgcaaaatcattgtcttctctatataaaataaaataagtcatcaactttacgagtttgtgataaaaaaaagaaaaaaaagtagatttttattaaggtagaccgcggtgtactaatctaccattagtagatactacagcgacttctttattacgaaagaaaaaagaaagcgaaaaaacgagagaggaaaaaggaaaggggatcggcgttgcgtcgtcgccttcagcaactctccgctcgccgccgccgatgcgcgcctgtcgctcccctccgcccgccgccggtgcgcccatcttcctgtcgctcccctccccctgctgctcgtcactcctcccatctccccgcgcttcttccctttgcccgtcgctcgctgcatcagatctggatcggaggctggtgacagaaggtgggagacgacggtggccggcgattgaaggtcgggggacggcgggaagaagaggagggatgcagcagcaagacggatccgcctaggggctcgtcgttgtggcccccgtcgagcttcgtcgcctttgagctgttcgctgctgcttcgccatgtccgtagcttcgttgctcgctgggagaatgaggagggggagaggggcagggtggtgaccccatcgcctgcccttgcaggcgcgggtgcggcgctgcacgcgcgggtgcatggcgttgcatcgcgcgggcctggctgagcagcgaagctcaaatcgagcgctcctgctcagcctggctcacggggcttttttgcatccactcggccaggctgggagctacgtgcaggcaaccaaacgaccacatagtgcatccacgcattcgagccaaggactatgcaggcaaccaaacacacctagcatccctcaccctgctgacaacaaagtcaacataagagttcagactacaggtaatttaaaatattatattatcctgatgtttttaatactgtaagatggactgaagttgttggtttcagacctttttttatcttgaatgcatattagattaatttgtgcaacttaatcaactaattaaattatgtttcctctcaaagtttgtcttttggcatttaatattgtttagattgtcacctaacatatattttcaaaatggtaaatagtcccattatcttgtatattttttcccacttgtggtatagataggtcttacatctaaatagaatgttatgggcatgtttctgttgaaagataattcgactaccaaaatggttagtaacttctaacatcgatattcatgtttgaaccaaaagttaaattcaaatagatgtatctcaaagaaatacttgtaccattatggtcgacttgatctcattgccttcttgatattttatggtttcactgcttttgtccctgaagaaagtgtgcgttctcttctgacgcgtttttatgttggcaggggatccagccattgatgtattcaaggatggtttacaggacttgatagtcatgtgccaacatgttagagggacttttgacaatgcagtggtagattttagatcaaaggtacctgctcagcaaatggacatagattcaaagtagaaatgaaatttccgtatgccctctgctccattgttttccatcagaactttgtgtaaccagttcattattggaacgttgattaggtgtgattcttggctataaggcgattttactagaaatctgctttgactgagttgtggaaagtcagtgctctgcttttcaatttttggaaaatcagtctatgtactaaaactagcctgacaatgtgaacagtaaaatgtttccgtggttgttgcttaaatacttgttccaaaatgcattatcatccattcatgtttcaggtaggaacatagagaattaagagaactttgctttcgttatgttctgctgtgaattatcctcaaacaggcattgcacctaatgataaaatgacacagcagttgacaggatttcacaaggaaattgcaaacattctcacatcatggtttggaacactgaacaacgctaatacttcatttgcactagcttattgaataacaatgttacaacacatacggtttctcaaggatgtggcacaatttcaaaacatctgtatgtaccagatgctgactagtgctccacattccattgataaaggcaagactaatccaaatatcgctaacataatgcatgatcacagggaacaggacggtaacaaattagaaccctagcatttcgaaaatggtacaacgatgcgataataaaagcatcaaactacaaagaaaaaccctaaacacctccgactggtcgagcatcaacaatggaagtgagctgaggatgaccgccaggtgcatattccaaaagaataaagatcagatccacagttattagcctttccagtgttattattcaccatagatgggggtacacgattccaggtgcgcctgctcctttcttgatgcagatgacagccacaaagagttatctaggagttgtggcaactttgtgtggaactcacaagattgacgaggactgagtacgaagaggcccagagttggggtctttgtgtttcagagacagattagcaaactgtgaatccaggtctctgctgttacttcgactagggtagtagtaggttgcggctgcttctgttgctgctgctgctgctggtacaatgatctgagacgaccaatttcccgctcaaacatctcctgttgaactgaaaaatcagaggaaaaaatctttagagcacttaataatttgttgtcagcataacttttggtttatttttagcatcagtaaataaattgatatacggtattccgttggactgaaaggcagtgatgatgctaaaataatcctatagttcatcattagggcagaatttttctagtttaggaacatatgaggcttagtttctatcttgtgataagaaaagaagctttaacaatatgttcaggcccttatataatacaatcactggcataccgattatgcaactatccaaacatttataggacttcaaatactcatgtaccagcagtcagaagtcagatattgtatgtttctgccaagttcataagttatagaagtggatatggaattacttgacctttgcacatcttggccaagggtagcatcattcttactaaaggagctaagtagtaggctgtttggttctatatttgaaatcttcggttaaatggtttgtcaactgagtttatactccatgtatagaccaaaaaaacattctacaaatagtttggctaaaagctcaactataggtatttttgtcatgattagtacatcttaaaacttgagaattaaatttcatttcttcctaactgcgaaactttgacacatgctaaaatgatttttactagcacttaagtgcagacaagaacaacaaagtaggtacaccaaatcaaaatggagcatacttacagcgtttaattagttgctcttgagctagactttccagcctttgctttaaggctttgttttccaagtcaagcataatattctgttggctaagaaactccatttcagcagacacatctatcccttctgactgtattgttcaaaaaaaaaatcagtgtcaaatatagaattggagtgttgaagagatagcaggggaaaaaaaggttgtagcaacctcacctgtaatgcctgaacttttctctcaagctctgcaatatattgaagcttccgaacgcgggacctttgagcatattgcctgcaacaaacatggggaaaaatcttcaaaacatatagcatgagaagtatttaatcacgccatatgaggaaacatttaattacgtatgttgtaagtttggagactttgatgggctgtctaagatttacgttgaaggtttgaccatatccaaaatacaatccacagtctatgcacatgcatacacagaaatgaatgcattgttcgtgccatcctgtcccatgaatcatacgcacaaactgcgcacgagtgcaactatacaaaataattgacatccaccaaatgcactgttcactttcatgtgacgcatactgcattctcaaggcttactggttgatagatgaactccacaacaaagcctccaaaagcatattcagattgcatattctaagtgaaggcctgatccttcttgtatgtgttaaagcaaacattatttgatctcttcagattatcatcatcaaatttcacatgtgatatcctacaatatgaacacacttttgaaagcgataatgtgaatgcgacagtatttgaactcactgtttagcgcgcttggtgtccgcctcggattgtgcatgcttcggcggcacgccctccttcctctcaggcccaaccttctgatcatgccccgattcgtccgaggatctcctgtccataccatgatcatgatccctcaacacgctcggcgacccatggtgcccaccaaccttctccttcgccggcatcggtggaccgccgctttgcctgtaattcaccaaattgttcatgccctgctcccatggccggccctggtgcctaccaaacgagcttggcttcgcatagtactcctgcacaccaccccacggcgcggcctgccctcctcctcctcctcctcccatcccttcaaagccattggcgtaagcgccggcggcggcgcctccgtcgaacatcgcaaacgagtcactcgacgaccggcggtggccggcccggccgtgctgccgcaccggcgtctcgggctcgttgagcaggtcgtcgagccacgacggctgctcctcgatgaagctctccgacgacgtgcgctggtggtgcccgtggccgtgcccgtgcctgtggtgcggcgcaccctgcggccgcgcgatcgggccgtggtcgccggcgtacggccccgccgccgccgccgccgtcgggaacgggctgcgcggcggcagcagcgcctgcttgggcagcttcgcgttcgccatcatcatccgctccgacccaaccaatctgaaacaacaaacacctctcctccataagactctaaacccaacatcaactcgagatttgagcgaattcaagcaccgagcaaccacgaactcgcatcgaatcgaagcaggctactcccccaacccaccccccagatctcagcgaccagttcgctcaaagcaaacccccgaattcgagccaaagattcgatccaccccccgagcggaaaaatcaaggcgaaacagcacacggacacagtcaagatccaccaaagcacaagcagcaacacccaaattaacctcagaaacgcggctcccaaaccccgaatcacaacgaaaacagcgcaaaccgagcacggatcaagaaccacagaaccccagccaacgccaagaattgcagcgacaaacaccaaaaaccccccacgagatacccaccaattcggccgccccgaccgccgcaacgaaccccagctacgagtttccgactccccggactcttctccggtggtagccaagctaatctatggaggagctcgagctcgaaggctacgaagaagaagaagaggatagagtagtggagaggaggagaagaagaagaatggagaaatcgtggagagaagggagaatcgaaataaatagtgtccttaaataaaaattacttggatttaaattactagattttaggaggagagatttttcggggcggcgaatttttgggcgaagcgtggccgttggatctgatgatccgacggcacgtgaaggtgatgaggatttattttattttattttatttttcaatgcgatgatatttgggtgggggtggccaacagcccaacactgggacactagtgactcgtgaaatgctaagcgtactactgtagtgtacatgaggagaaattcgggttatccgttgatatgtttacgttggcaattcgcgccaaaaaaaaataacttcttattttcggccgtaaggaatatttaaaatattactataatttaggtgttgtgagtttagtaagtaatagaaagtacaattataattaatattgtctcatccatttcggttatcttgtatgtattaaattacgtctatgtaacaggtataggtacgaccgtttgttcactgagctttgggcagttgacaaatgtaatatttttgccatggtgcctgctatgaaacctagcatataaagccccatgacattgacaatagccaattttcttctctttttcatacctttatgctttcatgcatataaattgttctccttagtgcctaagctattaacattagttgtttcttagatttctactgctaaaaccataatattgaccacaataaaatatattttttatagactatggttggcttattttagtttaccacttacgcctgcaatatttttagagccttattgctctatatatataattattttttatttacaaatatatcgtttcgcattttcctcttatcagccaacgatggggccaaaagtcacaaagattcatctttaccaaaaactctagatcagggggagtggataaagggcgagaaggaaaatatccaagaggtacatagatagcaaatgcagttggtgcatgtggcaaaacaccagctatatgaatggcctttctttatgcagcccatattgggtagtgggggcgagtgagcgagcgagcagagcagaaaacaactaatgccaacagcaggacagctcagggatggatcatccagctgcgaccacaccaccatttgttggctctgtcgtgctgttttgtttttaattaattgattataattaaaccccatctttattctcccccctccttgatctctagcttgttaattctttctcccttgtgaccatctctttggctgacctgattgggtgaaagaaccaaaaagaaaagatcatgcattttttttttggtagggagatcatgcatgttggcaacaaaaaggaggagacataaccctaaaaaaaatgatcccatgattgatgaatgagtatgatgtgcatgcaacgaataattgtatgtggtatagtggcatttctattttattttctttagaatgaattggtgaagataatgtaatagctatccattcatcttatttatgaaatgtcaaatgttatcttgtactatgtggaagaataatatggcatatacataaattgtttacagaaaagaattagctcaattgtatttcttttcagatactcaatagtggatgtggattgggtggaggtatattggcaatagctgtgttgcttggaaggtttggtttggttttcattgtttgctactttgatctttttctctatttttttttcatttcttggctctaaatatttacattatttatgagattggaattatgagggggaaaatgatttttggtaacattattggatcaccttttgctgcccctacactcttgccttttggggtgaccttagctgtgggcaactgaggtaacagccggcagatcatggttgcatacgcaccaagtttattagttgtaaaaagatgacagttacattaccaaatccaaactatacctcttaaactctgccactgaagatttgtgcttgacaacgatgcacttatgtttttcctacctgctattagcttcaggtttttaatgctgccctatgatatggttgtctagttgtaaacctaatcaactgtattcctaggctagctaactgccacatcctcggggaaaagaaaaaaagaaaaaaaaaagaaagagttcattatatgtttgaaatatgttcttaacttttggaccgagtacattataatataggggtaagtatgtgttctttaaaggttatatttatataactttgtgtgcagatgttcatgaaagtctataagagaatgataacgacacacattttaatttatcacacaatttatattttcacgaataactacttcaaatagagttatatatctaaatgcgatgataatttatacgtttagttttatatactggctcattgttgacagggttcattaaaaaaaaatcagatttcgttgcaaaagagatgtgtgacatgtagagcttatcctgcttgagtccagcctgctgctatcatcgacgtgaggacaagttagctagccgttcggttggatgtcacggttggagtatgttggctcatcagtgtcacagtgcaataatctcataacaatatggcaaaatttgctacatgatatttagggatgaaaacggatcgaatacggtcggaaactagctctatcatattcttttttattttttttaattgaaatcggaatcggaaacccgcatatgaaaacggaatcgaatattatcgaatacaaatacgaagcgaatacgaagcgaaacgaatacggtgacgaatattaatcggaatataaaaacctctcactactaaataaacgatttttatgtacgagaccctacgatttttgcaaatagactacaacttgtcgcgtctggaaaaatcaagtagcattttcacatacggctccttaatacacccctatggaaaaattgatttttccatgcgggctcttcagcatatggaccacttaagagtccgtatggaaaaatcgatttttccatactggcgtcttaagaagccatatgcgaaaataaaatttaaaactagtttatctcactcatatgaactctaaattggataattatttttcctaaatgtttctaaaatcatactctatcatgttattaagttcttactgctattattttaaccattttttcttgtgaatttgttttatcaattaaaaatttgaattttaaaacttcaaataatattttgaagcagtaaataatttcagctgaaaaggttatgaatataaaagttgtagaaatcatcaagacatacaacttttattttgatcatttcttcatctgacaaaatggtagtaatattatttacaaaatttatatatctctactatagtttataaaaccaaatgagagatatgaaattttgtgtacaatgttactatcactttgtcggatgaagaaatgacaaaaatagaagttatagatcttgatgaattatacaactttgttgttgatgactttttcagttgaaatcatttagtatttgaaaatgttgtttgaagttatcatattttcaaattcaaattcaaactgttcaaacaaagtcatatagaaaaatgaccaaaataaaagttgttgatcttgataagttatacaactttgtttttgagaattattccattggaaatcatttactacccgaaaaattatttgaatatcttatattttaaaattcaaattttatatagttcaaacaaactcggatggagaaatgaccaaaataaaatttgtagatcttaatgagttggacaactctgtttttgcccaatttttcatatttggtcatttagccttcaaataattcaattcgacatttatttttgccaaagaagggctgcaggaat

SEQ ID NO: 67951 - DNA, 558 bp, Oryza sativa
tgaccacttgctacgcgagagaaagcagacgtcgcggccagaaaccaagtcaaacgaactgaaatttttgaaaatatttggattgttttgaccctgataacacccggctggagctgctcagctcggtctttgcttgctggcggcctaaattccatcaattcgtcccaggacaactggatcgacgggttgacttttcaatggaacacttgtatcaacctggtcgacaggatgtcgttactctactttttcatcaatcatctggtgacaattgactttttgtgtgagtgacagggtgcttgacctggtcgtagcccatagtaggccaactcagaatttttagtgggcttggttggacaagtgggccaaaagttgtagccctatataactaaaacggcccactagttagagccaaacccaatgcaggcaggaggcagccctcccctgaaccaaacatccgagatttttttttaataagttcactttaactcccttaactactcatcgaatctgattcgtattcttaaaccgaccagatatattgtgatgaactactgtacc

SEQ ID NO: 67952 - DNA, 4000 bp, Oryza sativa
tcgtctcgcagtttctaggcgagttatgaaattagttttttcattcgtgtccgaaaaccccttccgacatctggtcaaatattcgatgtgacacccaaaaatttttatttcaccaactaaataggccaataatccctggcttgtgtaccgtcattgatatttatcatggtctctgtgtctaattgacataattgagaattgttttaatcgatctatgcctgcaggtgtacgtgttcaaggcccggtaaaattttacaccatgtcacatcgaatgtttgaacacatgtatagaatattaaatatagacgaaaaaaataactaattacacagattgcgtataaattgcaagatgaatcttttaagcctaattgcgccatgatttgataatgtggtgctacaataatatttgctaatgacagattaattaggcttaataaattcatctcgcggtttataggcggattctgtaatttgttttgttattagactacgtttaatacttcaaatgtgtatctgtacatccgattgtcacgtcaaaactttacacccctaaatctaaacacagcctaagcagaagataggagtaccgaggtcctctttaggaagcttgtagctgcaatttattattagtttttgaagagttgtaacttcttttagaatattcagctttccaaacaatttaaattctcacataaattccaaaaagttgtagttattgaaatataaactatccctctatttcatattataagtttgacttctttttaagttaaattattaaaagtttagctaagtttatagaaaaatatagtaacacttataacatcaaattacttccattacatctaacattaaacatagtttgatagtttatttgtcctgtattaaaaataaggttatatttttttataaattttatcaaacataaataagtttaacttagaaaaaagtcaaaataacttataatataaaacgggtgtagtagaaagcagataaaacgaggttcattctcactaactggtcactgtgttgggaaaaggatcctctgacttactcacaagttgattctcagagctttctcagccctcggctggtcactgtgatgggaagaggatcatctgacttacttccctctgactttgagtcactgacatgtggggccactgactttgagtcaccgagtagagggcccacatgtcagtgataaaagttagagggaagtaagttacagaatcttaattccactatgatagctctagatgttctttttgtttcctataacacaaaggatgtacatatatatatatatttgacgaaacaggtgattacatgaattctatgttccgattaagtagttaactgagcatcacatccagttgacccaaaagaagtgaagccgaagtaaagtgctcagctcaaagaaagaaggtggtgggggcttcgaagagtgaataagttcggcattctcgatctcagggcttgactagttgactatgggcctggttgggatgtttggcagagtttctagctatggcaacttttcctaaaataagaagtttcctagagttaagattctgaaagctgtagttgtaaaacccagaaaataaattagaacattagacggatttgctaattcgcgcatacgtgccgcgggcgcgcactccagcccacccggcccacgcgtacgcgtgcacggtccacgtcgctcacaaagcatgacgggcccgttacggagtaaaatacgattagtgcgaggattagcgtgctgattttttccgagtaattagatcgtaattattatttcggttaaagtttgaaaactttctacacaaatttaaaaactttttaactcatatttaaaactttcaaattaaaatttaaaatttttaagtcattttaaaaagttttcaatccagatttgaaaactttcaacctagatttaaaaactttcaacccagatttgaaaactttcaattcaaatttgaaaacttttagctcaaaatttgaaaattttcaactcaaatttgaaaactttcagcacaaaattttaaaactttcaactcaaaatttgaattttttgaagtcaaattttaaaaactttcaactcaaatttaaaactttcaacccatatttaaaactttcaacctagatttgaaaactttcaactcaaaatttgaaaactttcaactcaaatatgaaaactttcaacaaaaaatttgaaaactttcaagtcaaaattaaaaactttcaactctacatttataaagaggtgtgtgaaagattgaaaaaaaatcggaaagaaacagaaaaaagaaaaacacgatgaaggagaaaaaaaagtgcgaaaaaagaaaaaaaaaggcgcagggacgggcccagctggcgtgcgcgccaaaatttgaaaactttcaacaaaaaatttgaaaaatttcaagtcaaaattaaaaactttcaactctacatttataaagaggtgtgtgaaagattgaaaaaaaatcggagaaacggaaaaaagaaaaaagaaaaacacgatggaggagaaaaaaagtgcgaaaaaagaaaaaaacggcgcagggacgggcccagctaggcccagctggcgtgcgcgccagctaaactgctgacgcgtacgcgcgcgctaagaacccacaacattagaagctgggaagcttaatttttccagagaaacaactactgactaccaaccagctgtttgtgtttctcaggatgttaagtttctcaaatagaccctataggacacaacaattaaggaaccaaatggctgtgatatcaagagagagagagagttgggggatatttatacaaagttaaaagttagacaataattgactataaccacccatgccactggtaatacatggcgtgatttgatttagcacgcgtgagatgggacattattacacgaagcacgtactgaaatttggcgaagcatcactcgagaatgagattgtgatgccgtccaattgtgctgtgtttacttggagtacttttgattagcacgtacccttgtgccgcacaacaccatcgctcacatcatctaggaccaaagaaaattccagtggtcgtgctcactgcagcctgcaggcatcagcatattgaccatatttctctgtcaatttcccggcacaccgtgttgtagttttagcttattcaccagattaataaaacagattatttgtttcatgttttaaaaaatatatttagtaaaagattttttttactgcattgcattaattagaccacttgtgacttgtcttatgtggccccgttcttttccttaactccaaactttatctttctcgttttccattagcatacttttcaaactattaatttttttaaaaaaaaggttctacgtagaagtcgtttaaaaaattaaataaatcaatttttatttttttttataataattaatatttaattaattatgtgctaatgagttttctcgtttcgcatgcagtatagttagagaacgaacagggctttagactatttaacaagtttattcattaaaatacttaatgtatcctcgtaacaaaggagatagtttgtgataataatccattcaataatttaaattaaaggggccagatcatctacgctaacaatttggaattttgcaaaggtaagcttaataagagagaattttaaatttttatactactgttggtagctgttgatagcggtggtgacagttagggcctgtttggcacagctccagctccatccctcctggagctggagctcagccaaacagtttcagctccatcaaaactgggagtggagctggacgtggagctctctcacaaaatgagctggagttgtgaaactgggtttaggcagctccacactccactccagacccaactcctggagttaaatttaggagctctctcacaaaatgagctggagttgtggagctgggtttaggcagttccacactccactccagacccaactcctggagttaaatttagga

SEQ ID NO: 67953 - DNA, 680 bp, Oryza sativa
ctatagggcgaattcgagctcggtacccaattctctcttccactacaaaagagctggtttgccgcacagtttggaagtcagggacaatccgccgatacccatcatttttggacagactaaaactatcatagtaatgtttcatctcagtaaacctctgtacaaccttccttgctctatcagccaactcacttggaactggaactacgccaggtttaatgcggtagtgctcgtcatttaccttcagaataaaacatatattagctaagaaggagatttactaatttaacactaatttctacatgcattttcccatttttcaagacaaaatcatacagacaacttacggtttgtttacacaagttttagattggaacgatcaatgtttttgcagttatatatactaaacagtaaatttagttacttttctgagaggaaagtagtaaactaaataattagtttttcatgtacacacacagatatataaataatcattacatatggactgcattgatgaaataatgactatggttgtgtttagttctctccaaactttcaacttttccgtcacatcaaatgtttggacacatgcatggagcattaaatatggatgaaaaaaaaatcaattgcactgttgcatgtaaattgcgagacgaatcttttgagcgtaattacgctatgat

SEQ ID NO: 67954 - DNA, 2524 bp, Oryza sativa
atacctcctcttcaatcctgaatctggtactgtgtctataatcatttctccatcaatcaaagtcatctcatgtagtcccttggattggaaaagaaataaggttaactttttgcaaaacgaaatgcagtacgaccttttctccagaacaataatgggatcttacttcattaagattcctatggggaaagcgcatttgaactcttctgaagcaaaaattccgatcaatcaagaaacagccatccctcattataagcatcatatatcgggttccatcagctttccatgtagcaaagtagtatcgctgtctgagtagttgcaaattctcactgcggagcgtaaaaaggaatttagaacaagaacatagttagagtgggaatcaaatgaatactaaataaggaccatttgaaacaaaatagtttcatacgagaaaaaggacgctacaaaaaaaaacctctaaatcaaaaccgggcatttctttcctcccctgaaagaacaataattttcttcagcatagcaggcgcgatctcatagtttcaaggcttaactgataaaaaaagagtcgcatttaagttttaatatgtgtacataaaaaaatttgggacaagttacatgaaaagatctgaagaaattaatgacataaaagaaaggctttctgcaatcagaaatctgttgttcatatgtgaaatggagctttctaagagaaggggttgggtgcatatttccaacccatcaagtgcacaaattttacctaccaaccttatattagaggcagagatttaaatttttcataaactactttctacagttttgctttctgcaaagccccaaagaacatcagaaatcaaaacgcacagataacatgtaagagataatggacttaacacagatactaataagttactagtattacaaacaatgcatgaagtccagattactgttagccacctgttaagagagacaggatgtgatccaggaaactgtgcatgccctctcacctgtaacaaaacaaatgctattatagcagcgtgtaagaaacacaagttgtggttggcaacatatgcagaaactattaaagttacagaacataagtaccagttgaaaatagcacaagcattataacagctaaaaaggagactagatgaacagacaacataatttgtatgtgcacatatggatgttcaattgaccatataaaatttatacttacagggggcatttccagcaagcgataacatacgacacgcagagcatcttgctgatcatatggtacagcatctcctagcacatcatcattagtgataactttatcttccacctcattctgcaagatacaagggctcaaaagcaagaaaatagctttgaatattccaagcaagtttgcttcatgacaattaaaaaaaacaatatgagccaggagatatagtaaattacatccaaagtaaagtccaaaaatccaatcaaataataaagtaggtcgtatgaactcaaaactctacctttatgtccataaatgaaaaacctttcgagaattacaaggaatcaggcacttaattctctaccaaattacttggaagtaatttcagatttgaatatctgaaaatgcttacatgtactggtgcaagatcaccattctcatcatcatcatcttgcttggcttcaccatttaaatcaagatcggatgaccttttccattctggtgttgaagggcatgttatcatatgctcaggaacctcatgataaaatgaatacagtgcttcaatgtagtccctcttatatataccaggcggtctcctttttgcaaatatgtttatcgcctagaatgaaaatgaggtcaagaagaacagtagaactaagtcaaacaaacaacattgagaatctagttggcatacctcagcgacgcaggatacttgtgttcgcataaggtaatggataatcatgaaaccagtacgattatgaccatgggtacagtgaacaagaatatatttaggattctttgactgcttctgtcggtcaagaaacatcatcacctgaaataacagaaaaaaatcattccataaatatacattgaatgctgtctgtacatatggttgctaactacatacatctgaatctattgttctatggtacaaaataataaagaaaatcattggttgcagatgaggaaataagtcattaaaaataatgtaacagaaaatatatatataatggtttatatacttcaacgcgtatatcattgaatttggtgagcccaaattgttgttgcagaaaaacctagatcatttaaccactatacaccattcccatgaactgatgatccaaagaaatatgcatacaggtaacaggatctttgataatgaaagatgccaaagtgcaaacaccttttaagttacaaagtaggtataaactaccgtgcgaagaaataagtactccctctgatgcaaactgtaattcgttatatgtattgaccagtggcggagccaccttaaaactgtggggttgcatcatacaccttgatcatgtgaaa

SEQ ID NO: 67955 - DNA, 579 bp, Oryza sativa
aactaatacttgatgaagtacctctgtggttaccagatagagcacatcgctcaccgtgaagtgaagaacagttgttatggttggctctttgttacttggcatttcatcgaacacttgttgagcgtcagtgtaggtggttgctcctaggcttgaaacagcaccaacagaagcctgttaggtagagggggctagctagggagggcgataccttgttgaggatgtgatccacagcagcgctcaattcatcaaccttcgccttaaacctcgccatgaatgccttctgcttatgcagctcaacggactccaccattgatgcttccattgggtaaggtttccactatcttcctcgtctctctacagatcgaaccttaggctagaatcacggtgcgtaaaacaccaacccttcccttgggtctaccaatcaagcagcaagagaaccgatcagaacagctctgataccaaattgttatgacccgagctcgtgagagatcgaatcacacaaactagcagcagaatacactgataacttaagataatttgagaagaaaatgcgggatcgggtgaagaacagaaaggggg

SEQ ID NO: 67956 - DNA, 21591 bp, Oryza sativa
catgtatttctagttatcgtcggtccagattttcaaaacctatgtgtagctacaaattggcttgaggtctcactgtttcagtatttttgtattagttaaatgacatattgttcgggttgttccattagaattttagattgctggcttgtcatatattaataagattatattccactaacaggttttggcgagtctatatgctgtctgtgcaaattagtaatgggttttgtcatgctcaattataatggttttgtcaattgcaaatggctctgttgtcagactaatagattcttttgatttctgaatagttattttatcatgcgcacttttgtttttctaatgcccactcattctgaaggttttatgtgcctacctcaatatctccatacttttttcaaatagtttttctctagcatcccccatttcatcactgcttactcattcgaatgttttgttgtgcatatatagactaaagttgatatactcatttatttatggtttttgtcaatggcgagtgtaggattattgtcaacctcaattaatacttgtacccagttttattggtacatatagttttgtctatacaactttatttcctgatgcttactgaatcaaaggttttgtgtgcttaaagttttcgattgtcgatggaaaatactaggtttttgagcatttgtcagccttgatatctcaaatatttttcctcattagttttgtcagctcagttatgtgagatatgtttcctacaatatttcaatttcaattcacaatatacttagggggtgtttggttcatggccacactttttcacaccacacttgtggctgtcacagtttgttaggcatgtgtttggttcgctgccacagttgtggcttgccacactttttcaatagcatgtcccatatgtcatagactcaattttcttaccaactttgccatactttgtggctagtaatttgtccaccacacttttgtggctgccacaacttgcgtaacgttagctgtggcaaagtgtgaccggcaaccaaacacacccttaatctttgtctccttggcttctgagtattgttttatttcctgggtcaattaacactacctcgtcctggagattttgtgatgcacatttggcatgtttttctcatttgagaatggtacatttgttagccttaatatatcactactaaaaagacttttgcgaacaccacctcatttttttaaggcagacatctgtatgcacaaatatactaaaggcccaatagaaaacctgtgtgtgaaaatccattttcgcaaacgaacctcttaagagatccgtctacgaaaataggtttatttttgttagcggtcctattacgagatccgcatataaaaaatctttcacagcctcattttcactccttttgtttttattaagtcctccctcctcacccagaggcatggcggtggacttcaagcggtgatgtcagtcttcaggaggcgtcgaggagcttaggggtggtggactcaccggcgacagcaacaggaacggtggatctgttgatagcaattggcgatcttaggtagggcctcacggcccgtttagttggagggagttttagaagggattgagagtttagagggataaggctattaagtgttttgtttggttgggagacatgggaattttggtgggataggaatggggaattgaggaaggaactccctccttttcaatacctgggtaggtgcaggtaattgggagggaattcctcctttactttgtgtaagcaaatctcagccatccgtttttattaatgacctaatctccaactaaattacctatcaatttccatcatctctaccaaacaagatattgggattaaaaatcaaattctcatcttaatctcatcatcaattccctcatataaacttccaatcgtctttcctcgagttaccaaacaagccgtcaaggctctgtgcggcagtggcagggtccgtcgacctcgaccgtgacgacaagggcggggctgtggccagggtttgcatgttctagatctgaataggataggattttaagattcttttttttttggggggggggggggaatttccaggcaaatggcttaatatgtccgcttgggaaattaaaaaaagtaggtttgctatcatcggatttattacagttggattatatgaatgcaatgcgatggtaattaacaaaagtcctacgacgatgaacatcattataatattttattatgctaattgatcctatagtgtttataatctactcaggacaacgatgggacttgcagagttcatatatgcccaacctgacatcaagggcaaccaacccaggtaagatacgtatgaccttgctctgttaacccaatacagatatattcatcagatagtttgtagttttctaattcttacggcatggtgggaagaactcggtagtcgatcgatgcagggagacatccagcgtagcaggtgcaaaatgaatccaaaccaagattaccagtcaaatatcatcctgctgtgacagctgatttacattgtccaaaagctgatttatcatacgaattgaaaatagccatcccaccagaaaatcacgatcacaaatagtcgtgtgaccacaaatcaactgacatatcctaaggacgatttaagagggggtatggatgacaaatttgcgaacaccagaacgacagactttctgcttgattgattcagaagcccttgcaacagcaagttgagattgtcatgcacttgaagcaccttctcttgccccctcacttgtagaagcagcatcaattcctttcaaaaatacagggaaaaagaaaagaaattgcatcagttactgcagaaatgcagagagagagagtcacatcagcagggtgatcgatcaacactttgcacttaagccgtattagtaggaacaatacacgaaaatcacatcagcagggtgatcgatcaacacctaatctgctaattacatgagaaaatggtaattttacaacttatactaatccaaaagcaactaactggcatactatttcttacagtctagtagacagtaacaaatcatattatatagccaaagagaaattttatggtacttgaggaaataaccgcatatacttggaggtaccaacttttacactagaaaatgtggtatctcccaataccttatcaagaatagtaaaattactcatagctaaaagatacataattagcatagcagcacacatatgtaagcagctagttagctaaaggatgtataatcaatggagtagcacacatagatatcagcagcagaaacttagctatatatacctggaatgcagaagcttgtgtagggaacaactgaagtgcatttgtcaaacaccttcctggacctccttgaattgagttggaccatatagacagcagcagggtgatcaggcgagtgtgtgcccacaaagatgacatcggtgccctccacggcgccgagcaactgcacactactgggaatccatggagtttggagggcgccatcggggagtagcggctcgagctcaattgcccttcccctgatccactgcgcgactccgttgtcatccacattcctcgaccacaggcgtaatcggagacggaggcacaatttctcgtcctccggctccacctcgacgcatcgcagcacgccgtcgtcacccatggacatcatgaaaatgggggaactgctttcgatcaatggcggcgggcgtggcgggccgtagacgatcgacaaccgccgctgcccgccgccaagccggagctcgaaggcgtgcgtggagctccaggtgaagtagagcgtgtccccgacgaggacgctgcggcacggcaatggcgacctgtcctcgaggtagtagaacacgtcatggtgttcgacggtggtcgtgtcgctccactcccccgtgtcggaggagtagacacgagcggaggtggcaccggggaggtgcgggaggaacgggctagggctgtggctccagatcagggccacgaggaatgggccgccatggcagctgcggtggtcgcaaccacccccgccgccgccggcggcgcagagcaccgcggcgttgaagccgcggccggtgattgcgagtggcgacgacggccgtggcaggcggcggtgctcgttcgtgaagggatcccagacgacgaggtcgtggcctaggctggtggtggcggcggcggcgcggcgtgggcatggcgtggcgaagagggcgcggccgtggcggcagtcgaggacgagccacagcgggaggtcgcggctgccggcggcggcggggcggcgggaggaggcggcgccgttgttgggggtgtagcgggagccgtagcgcatgtccccctctcccatgccgatgcggaggaaaccgacgacggggggagcacggtggaggcggcggcggagtgcgcggtcggcgaggatgcggcgccagaccttgcaggcgagggaggcgcggaggaggcaggcggggtcgtcgggcgggaggcggacgaggatctcgccgacgagctcgtcggagagatcccgcagcgacggcgacggcggcggcatgggttttgggaatggattgcgacggtttggggtatggaattttgctacttttcaacaaaacaaaaaaaataaaatcgatagtacttaacaaagaaagaagaagagatcgatatttaccgaacaaacaaattactagcattaagcccttaacaataggaatgagaatcggtatctccaatcagatcaatactttccatcagtgtatacttccttcgtttcacaatgtaatactttctagcattaaccatatttatttagatgttaatgaatctagacatatgtatgtgtttagattcattaacatctatatgtatgtgaacaatgctagaaaatattacattgtgaaacggatggattattacattcatgctatccttattatcatgacaagcttaattgttaaaactctaattggataattgaggttttgttttagggcagaccgtagaaacagtccagggtgttcttaaaagctactttctccgtttcacaatataagactttctaacattgcccacattcatttagatgctaatgaatctagacatatgtatgtgtttagattccttaacatttataacatttatatgtatgtgagtaatgctagaaaatcttatattataaaacggagggagtaagcgctagtgtaacgtatatgccaaagtcaaaaaaaaaattaaaaaaattaattttggagttggttttaaggttttcttttatcgtattttctatttcaacattaccattttaagtcatttagagcacataggtaaaagttttaactataaattattttcttatcgctaatacgctgattaattggccaaccgatggcagcctacacataacgcttgtgaatttagcgggcttatcggagagttagtaccaaagtctatctgaaaagccgaaaacgctcccttaaagttgtctatttcccatgaattaaaattttaaattggaattcgaatatgaaaccaaatcatcctccaaatcaatccaatattaaagagagtggtttattcctactcgacgcctgggctgatgaaagcctttctctccctcctccagcatggcccagcccataatagcagcacgggccggtttttctattgtgggcttcctccagcagcccacaatagcaccaaaggccctgtacgtcgctgccgacgctgtcatcaccgtgcctgttacttgtatgagaccttaaatttttttaagaaaatgttttggctggaacattaaaatttcacggtagttttgtaagttatgggtagattagggaatgtagtagactgacgctgaaagttttggaaatttagaacttcttttttccaaaaacaagataattagtaaatactaaaactatactaaaccttttggtttcttttttttttaaactaaatcggcaggtagaggctgccaattatactttcaataagcaggagtaaaaacccagacgggttacgagaaaaagaaaacaaaggacgctattgttgtcggccgaacaagttcacagcacgcacaacaactcaacgctacaacccactcaaaatagaccatcgacggagcctaaacacgagtcatcgttgccaagcttgccagagcaaagcagctccgacttcacggcaaacttgtgtcgtcgttgccaagctcatcacagaaacgaccaagcagctccgacttcccatggcgaacatcagccaaagcaatcgtatcaccgcttcctgcttgttgttggcaccaacacacctagagagagactgcaacgtgttatcgttaccgagcttcatcacaccccatcaacaaagcagccgagggttatgtttcgcccccggtcgcccgtgcgtggacgacagggggccgcctgcgccgtctgatctgatttccagttgatttccagttttctctgtttcaaccttttggtttcttccttattatatatttgttgagtcattaagaaagatagtacaaacgcaaatgcttaaaatataggcacacttatatctatgaacgcgcatacatattctacctttataagtatcttaaaggggcaattgcaaatttaccactgctttgaatcgttattgcaaaactgccactagaaaattgcaaaaataccactggaactgtcattcgagtggcatccttgcaaaattgaaaaaaccggtggcaaaaaagacttaatctgtaatcttgatattaatgaagttattactgtgggctacttactctgtcctgaatataagtatgaagtaattattccgtactattaataagtgctctttgcgacaaaagctttgtaagaaaatttgtaggacgtaaatcctttggaagatttccttttctcttttggaacaaaggaatgagccctatgaaattcatatgggattgctaaattagggcccctttgaatcaaaagatttacgtagaaatttaataggattcaaatcttatagaaaattttcatatttagccctttgattcaaaggattgaagctttccaattcctatgaaatggcgcattgtatgtggattttggaggaaatatagcaagagctccaatctcttagaaaatttcctttgagtctatctctctcatctgattcctgtgtttttcttgcgctccaatcaaacggccattcctgtgttttttctatattttgcaatcatctgttttacacttcaatttctatcaaaatcctgtatttttcctattcctccattgttttcaaccttacgattcaaaggggcccttagtgattttgaagaaaatctaacataatcttgaaatcttttcccttggaatcatctttccaaattactatattttttccatgtggaacatccaaccatcgcacaataagcaattcctatatttttcttatttttaggataatgccacccaaattcattattactgcgctttttaaacttatgaattacaaagaagccctaaagctagtcacaatctatgtatgcataccatatttaccatgggactacctattcttactcatgaaatgtctgggaaaattcagtccccactaaaaaatcagatttttttttcttcattgcttcattctgcactaaatattttctctttaaaaaaaaaactttgcagcatcttcactgtcaactacttcctccgttttatattataaggcgtttgactttttcctagtcaaacttgattaagtttgaccaagtttatagtaaaatttacatcttaaatatcaaattaattttattaaatctaaaattaaatatattttgataatatatttattttgtattgaaaatactactatatttttttataaacttaaacgaagagagcagtaatattgaagtgttttgaagatccagattgtttcttccctaccgcctaacaatgaaaacgattaatccgcctaatttttaatggcggaatgcaatagcatatgcataaaaccgatcgaatctatcgaagaaatgcttaactcttgtcacatcctgatttttgtttcaggatttataaattatttaataaattattattagaatttatattaaatgttcattaatttacaagtgaagttaaatgtgggaaataaaatttcctaaatataaagcatggatggatttaattttttattaaattctctatggttaattatactctctggaatattctcggatttttcggagctcaattcctaatttttaatcatacaaagagcatttcagtaattacccacatattaaattaatcattaaatggtctggttttaatatttttaaatactttgggtgtccaagtatgttcaagatttttcttggaattatttgagcataggaagtatttttaacaattcaaagatcatttcattgattaatttaataggaaaagtaataataatcctcttcctagtcttgggccctttccagcccatctccctcttttgtgtgcacggccgtgcagcccaattcggcccagccgagctccccccttctctttctttctttgctttgttttcagccagcccaagacgaaaagtctaatttgcctccctcgacactgtttatcttctgcctctagcagccgaactgagaccgatttggctcggtttttctcctccaaatctgacctttccccttgtgtttttctaaaattagttgaggggaaatattcctcttatcctcctctatatttacccctaaaaattggagctaatcgttgagtatcttatccgaatcgaactcgttttcgagtttatctccgaaaccgagtttttgatttcccggatcgatttcttgcgggaggagtccgatctcttcaatccaaggctataaataggaccccctagtcctcctctttcgtttgccccctctcccgtgatctcccgtgcctcgtagcgccgccgccacgtgctccaccccgccgtcgtcgccggccgagctccatccgcgtcgcgccgccgcctccgtcgtcgccgccggtcgccgtcaccgccgtaaggtgcgccgaggtgtgggcaagctcggccgctctctccccgctgtcgccggtcaccggagccccgtcgccggccgtcgtcgttcgtcgtttggttcgagggtgagtaccgttaggttcgtctcgtcgtcctctacgtgtacatgtcctccaaagtcgcagccgaccatccaatctccggcgaggtcgccatcttggtccggccattgatgaggtcatcatgatgtcatcatcgtttttctttttcctgtttttctaatagattaaatcttcggaaattcataactaaatcatcgtaactcggttttgagtggttcaagttgctaaattcatctaaaatcatgatctacatgtttgtttactttatatgtactgtttatttggtttttattagtctttttcttcgttttgcgtgttagcttgtcgtttccgtcgttgcgaaggttcgtgagtgcgtcgggagtgttcagaagattaattgaagaccgattattgcaaggcaagtcacacagatcctaaacacaatcctttgagcatgttgatcctatatttaaattctctatttatttcaactgtgcatttattttcgaatgtcattggtggtgtgaatctattcctttgttatggcctgtttgcattgattactttattccttgataccttgggttattataacttgactagttgagctttatatattggttcagctagatattagatataattgcttagccatgcttagaaacattagctcactaatgggatgaatcatatatactacattattatttatggttatatttaatggtagctcacgatggttaatcgtgttatgataattaattggtaattaaaatatgattaatggtgggttgtgagcacatggttttgaaggtcgtgctcatggcaattaaggaccggttcgcgagctactgttgtgaaacattaaccgtgccaaccacaagccagcgtgggcaacgactttaccttttgtatagcatggttcattgcggagcaccagactgagaagtggcggagataagcccacgggggtcgctggggagtccatgccttgttttataagggggtgattatgatccaggaatggtgcactgtggtgagttgtgttgtgcagagggtattgccacagcctctattcgggtactttccagtatcgcgacgcatggtagacataatgttgaggctgtgtcttgtgggtacagtggtacacctctggccagagtaaaactattcgaatagccgtgcccgcggttatgggtgggttgagcaatgtttttcgtgattagtctcacacctctcacaataattatggatgttatacctggtaataatttgcttagctcctggtttggagttagatctgtacagccgggtatggttgttcaggatggttgggcctgtgcagcatgggtgtgttgttcagtgttgattaaaatttctgattaattactccactgttttacttctcttaaatgttttgctaaatgctgcttttgcaaatgagcctatattatgccatcctttggtatccttgtgcacttgcatatttgttgtgtggcttgttgagtatgtcatatgctcattcttgcaataatcaatcatcctcagttgaagaaaaaggatctagaaggagaagacgtttggcttataccccagttgagctgcctgtgggagtggagctgaagccatcgctagaccgttattccgctgctgttttcttttcttttgtaagtgtgtaacgttattattatgatggatttgtatattaaattgtcagtttgtgtacctcggttgattgctggacgaggattttatgcataaataacttcggaaattactagtgaatttccgggcgtgacaactcttttaacttttcaaggaatccttaatcagtgtatgcatatacgtctcgataatgaatcatgttaaagttcatttacacatgactgtacttaaagtctgaaaccaaagaaaagaagatcgagatagccaaatcaatctttgcaagacataaacagccatagtacatatataagggttgatatgtctgattcacaccatgtctcttctgtcgcgtatgcgcagataacccttccttcctgcctaacttaagctcttcttcccttctatacactactacacaaagcgttttcccatacggtcaatctgatttttacgtgcaaagcttcggcccgtctggaacaaatcacctaggaaaatcacgattttcgcgtgcagtggcacccgcacacgaaaatcagattttcacgtgcggtcgcttatgccgcccgcacggaaaaacaaaacaccgaaaaataaaataaaatttcaaaaaaaaaaaccctagatcaggtcggcggtggtggcggcgtcgccgctcaccggatccgtggcggggggagggcggccggccgccagattcgtgcggggaaggccgctgctagcccgcccaccggatccgtcgcctgcgcgctcccgtccgctggggagggaaggggacgggaggggagggcagccggttcccacgccggatccgtggcggggaagggcagccagccgccagatccgtgcggggacggcctatgcccgccagatcccgcgcctccaccaccgcgccatcgtcgctggcgccgcaccgccaccgtcgccgccatcgatgccgccgcttccgcctcccttaccgagggcgccagcatcgccgaggaggaagagggagatgggaggatggatggagaggtggtggggagggcgagcgcgtggggagaggataagggtgagcgtgtggggtgggctattttcgtgtgcgggcctgttaagtggcttgcacacgaaaatatatttttctgtgcgggcgacgtcctgatgcccctttttcatttttctgtgcggttgcacttatggaccgcctagaaataaactagtctggtgtccaggaaaatctttagtgtagtagtgatagtgaaggtgtacaattaaaccgttaagtagcggatccagaaatttagatcgttggtgtcataacatatctatcgatgttatagcatgctaattatatttagaatatagtgttacaatatatgcataagcagtttaagcatgggttttaccgaaagttgtcggtgtcgcctgacaccggtggtaacactgtagatccgcccctaaaccctttgctttctcaagtcaataaccaaagaaccaattgttcaggaaaaaagaaagtaatttcctgaataatactcctactttcatccctaaataaacgtaggcaggaatttactaatttcatactggtcgcctaaagctctttaatacttctatgtccttttcttatcatttttagttattcaaccaatagaattttctcctcctcattttctctctctctctctctcttcttattttctcttcatgtttatgaagggtatagtatacagtttttagcttcttctaatatatctttgaatagttaaaactatatatattttacagtgggagtaacatgtacttccttcaaaatgtagctatttctaacacagtagcttgtcttaaaataaagctatttcttcatctacctcctactctcaaccaatcacaagcattcttcttcacatactttctcttttcaaccaatcacacactttctccaatcattctctggttctcacatactttcttaatacacgtgctaaccttaaaaatgtttacattttgagacggaggaagtatgaaattatcaaatgatgaaccttctctttttgactttcgagaagcacattcagaaacaaaggttctctggaacacaaaaaactgagagagttttttagaaattagctcaaagttctttttaaaaaaaacctcggaggcaataagagaaaggagtagctaaatctcagacgcctacaaaatttcaaattccagcatacatttctgagtgtaaaattatagtagtgtgcaaatagccaaatatgcaatttgttacttctttttaactgtaattttgttgttatatagtatggctttactttatattatatcaaagttttactattttccatgtaattttgcaaatgtcatggattgtattttttttcatataattgtactgccatctaagtagagagaaaagtgaccgaattttcctgaaatctacatttcctttaaaaatgtttagctaccagggagaaaaaaaataaactcaatactaaaatgatttttacaagtgggtagaagaagacaaagaggcagcagagaagaattgaagatgctcctaggacagtagcctgtagccacctcatctcctgttttgtttgctttttttttccttttttttagggagcctctcttgttttatttgctctgcattatcatctctttcttacaccagtcgtccattccatccatccatctatacttagctgcacactgcccgaggcaacgccaccacacgcctccccttccatgctcccggtccaccatgagccaacccagaaatttatctccatgtcaaaatataaaagattttcactgaatttcacacatacatttattatattacgatgtgtcacaaccacctaaaatctcttatattttaaaacggaggaagtaaaatataaacaagtttatttttatttctttctatttgtccttaaataaatttatttttaatatttattatatcaaagtttgtaaaagtattaagataaatatattttgataacaagagaaataattacattataatttgataaagtaatggcattctaatttttttaatatgtggaattagttaaaacattaaacttattttgggacgaaacaagtaaaaggaaagtacccatggtccagtgcaacaggttcaccatctgtcctgcagtattcccttgccagtgggctacttgcacagctaccaatgcagtggaccatggaccatggcgcatgcactacgcgtgggtccacggtagactagttccatacgccagcgtgcatgcacggaattccaggacacagccctcgtgcctcctttttatgcaaaaaaaaatagaaaagaaaagaaagtgcagcgatctaaacttatttaattaccaccaccatcagagatcttgagacagggtgatagaaagtcatttgcatcaagttgaccaataattcatcatagcttcacactgtactagcactagtattttatctccatccaataattgagattggtcagttgctgacactgtgtgaacttggggttacataaactcaattacaggtaaaaagtaaaaagaattactcatcaaatgcacctctaattatcttcttttctgttcatctctctcaagactagattaattttaaccacataggaacaacatctaatttcttgagatctacacactgagggttttgtgaagcaggctaggagcggtacagggtcttgagcctctttgctgcctggatgaagcccagaatcacctgcaactcatccaattgctgctttttgtttagcatttggaagagattggagccagaggttaagacttaaaaactgattgtgtaatcacaggttatacaatacaaactgcctatctaaaagatataagtaggtctgtagctacctgagactgaaaatgctgctggaccccatggaagagctgttcctttgatggattggggttcatgcttacctgtgcatagtttttcatcattaagcgcacattagaccatggaatgatggaaatgaaaagataaggtttgctaatcaataaatgggatgatccaggctgcttacaagattgaaatgcttccagtatctccacagcgtaggagttccaagttttgtcaggtttactctctgcaaacaaaatgtaaaatatacttcgatcagaacacccgtcaaaaaaaaaaaaacctttgaacaatggcacatgatgtgcaaaagacagattaaaatcctagcagatttcgtagcaaactgaatgaattgtcaatgaaatcgattccgccatgtccacaataaggcatgcaaaatgcattggctaaacagcagaatggtctatgacaacaacagatcctacctaaccatgggccaagccacgtgatccaagggtcacactggctttaattcttgatggcacggtcagatatctcaaaagtattactcattctgtatacttattgcgatagcgattagtaattaccgttcgcagctttgtactggggtgaaaattgcctcggttgctggattttatacaggaagaccagggccttgtatgccgaactcttggctttgttggtttgtggtactctatgctcgctacttgcgaaaatagaagaaaattgttagttgatcacactactaatagtttaaagcaattggctaaattgcaattatcacagaatggtcttacaatagtccatgtctttgtctcccatgtcggaactgctacagaacgaattgttgccatcaatatcatcatcgtcttcgttaccagttggaggttccaatacactcaaagcattcctttgcagcttcacctctacaccattctttagaacctgcatttgcaacaatatctcaggtccaggtcttgtttttcattatgtcatatcacctctcctttttctttcgagaggatatcacctcaaataatggtgggtatagattatgacggtattattaacacagatgatcttttaaaaacatgtcgagaactgcttgccttgctactttctaaaacaataaaagtcaatactattttgttcattagttaaacaagcattttcaagatagaaaaccacaattgagtaaagtttaagtgggatactaaataattcagcgggagactcaccagccagtgccaacctccaagaccaacagccttcttgacaacaccttgtaggccaaccaagacggactttgttcggttgttcccagtgacgatgaccttcgtgtgccgaggaagcaccgagagctcctcatcgccactctcgtaccgaggcggagacagaacccgggaggagcatagctcagtctccatcatcatgctgattctctgccctgatctctccctgattcaaggtttggcagcaaatcaatcagtacacaacaaactcaatacagtggagtgttctatgattgactatcaacagcaaacaataaatagcactatcaacccagtgccagaaaattttcctagattagcgcaatgttcaagatttattgcacggtgcaagaaccaagtaactctgcatctcaaatctgcaggattggtgaactttgctaaaaacagtgctgctccaaaattaaaaaaagtataccagctattattaggcatagcaggatttcagaaactagctcaacataaaaaaaaaaagcttgaccctgcataaagggaatctgaaattcaaaatcgattcttgagtcctaagttccacaggaaattcatatttatattttttttgcgtacattaatttccatggggggcacgagtgaagcctgaaagcgatttacatgatgtgacacctccatgcaactcgatccggatcagaactgatgcggttgcaaattacaaacagactggagagcattagtgacccccaaccactaaccatgatggtgatgaatcggcagagacactcaccaggacccactaccagctagctagctgcaagaattgctcgttacttgctggagtagcaatcgtgaaagtgatgtgtctaaggaatatgtacaaaagcagtgcatgggattgccaggtagtaaatcagaaatgaaatggtgtaagcaatcaattttggcttaagcaatttgcttagctaggtgcttggcattaattatgggaactggatctactaaaaaattatgtggagtaaccacaagaatttaatagttggggcaggtaaacaatcttgtgttcatgctttcagtaaattcgcatttaaagcggagttatggagattgcagactacagtaatgaacagtacagtacaatctcgtgatgcattttcccccaactaataccctggtgcccgattttaataaaataatttcatatatttttttccagtgcaatctgcactgcaaaaattctgaatcaagtatagattcgaatttactgtaaaatttcacagaacagctcagaaacccgatctaaatcactttagagatcgcctagcttcaagatcttaattaaatgcaggatgaattgggaaatgctacccggtgtattagaagaaaaatcgcatgcaaatccagaattcttcatagtatagaacaaaatgcaatcaaattcttgatatgaacttctgttgactgaagatcacagctgcaacagtgtatttttctatagagacacaggatcctagtagataagcaattaaggatatctgtactcgcgctgcaaagtctactgtaattttgaatttgagaaaggagacgcgaattcaaaatgcgaaagactgtctttttaaagcgcaatccgagctcgaattattcaaaattcagagcaagaagggagattcaaccacgggtttaatactcgcagattcagataatgcaacttcgatttgcgattacggacctaatcacggaatcagaaatcgaatccatcccaatcgagcaccaggaatccaaatcaaatcaaatcaaagctagtacaaaaaccctgcaagcgagcagcgcaaaacccgctgaattccctccgagctcaaaccaccatttactcccaatccatcaaaaccacaattcattccgcccaaaaattcaactccccagaagacaaaccaactaggtaaaatgcggatcaaaaaaggaaaaattcaagagggcaagccgaggggggttttcttggctcacctgctccgatctcgccgcaatggccaccgaatcagcccgggaaacgatcgagccgggcggtgtcgcggatcagggacccgattccgagcccgaattgtgcgccgaggcgacggatcgatgcgcgagagagggaaatccgagcatgaagaagaggagagagaaagtgaaggagaaggagagagagaagagcactgaatgctttccaactgcacagaaaagagcaaacggatgagccggctttaacgcgcaaactcggctcggctcgggcttgatctcggcttggctcggctcggctcgtggagatatggctgcgatctactgtgacgtgggggttgcctggacccaaatataataaatcggtggtgtaccaagcaggatcatgagtagagagactgacgcgtggggccagttaggtcgcagaagtaggtgggaccagaagtcagtgactgtgactcaaacaatggtggtttgtggggatgtttcctaaacgacaagataggggcaaaagaaaaaaaaaagaagaaggcagatgatgatttctatttttatttaaagagtaaatttcataaaattacatatactttacacgatctatcacaaaactatatatttaataacttatttcacaaaactacagattcaatgtttttgtttatcacaaaactacaggtactttgcacaatatatcacaaaactacatatttaagatcttgtttcacaaaactatatatttaatatctttatttatcacaaaactataggtttagtgtcttcattattacaaaactatagattttgctaaaacctatagttttgtgataataaagacactaaatttatagttttatgataaatgaagacactaaatgtgtagttctgtgataaacgaaaacactaaatctatagttttgtgaaacaagttcttaaatctataattttgtaatagattgtacaaagtacctatagttttatgataaacggacatattaaatctgtagttttataaaacaagctcttaaatctgtagttttgtgataaattatgcaaaatacctatagttttgtaaaatttactcttatttaaaaaatgaaataaaataaaatcgcgccgctgcctggtttctctttctcctcgatgccgacgaccacctttctcctccttggccgtcggcgactaccgcccccattccggccggcaccgccgcctctcatctgccatattcctgtcccaatccgcccacacgagctggctgaaaagtggaagcggcgataggcggcggcgagcgagacgagaaagagaacgattttagaggaaatgattcaaaacaatattatcaatccctacgaatatactcccttctcctctgggtttttttttttgaagcgtatgaatgttagagaattttcattttcataagaaacagtttaattcctttaaaattcatgtaaaattcatccaaaccggaaaggtcctaaggctgtgttcaggaggtgagttcacctcccacgcacgtaaaatggagcagtgcattttcttatgattaattaagtgtttactatttttctaaaaaaatgaattaatattattttttaaaacaactcttgtacataattttttttcaaaaaacacatcgtttagcagtttgaaaagtgtgcatgcaaaagacgagggaggtgagttgggaaagttggagaaagaactcaacttgtgtcattttgactttttttattcattttttttaagttgaaccaaatttatagaaaaaatatagctgcattttcaataaaacaacatattgctaaatttgatgttaaaagtgtcttctagtttgaggacaaattccaatttactaatgccttgtattattatctaccttatagttcactaatacagtcttatattcctcatttctaattgataggtcaggattatctcacttaaaatctactcccgtgattttctcatctttctatcctttcggcgtcgctccctcttgccgctagcgtcaccccttctcctgaatcttgatagcggttgccaacagcgccgccccttcgccctcccgtccttgaaggtgaagcagcgtcctgcctcaaactacaccctaaccctgatcccccaaaaccctagctgcaattgcaccatcttcaggtcgtcgttcgatctccgtcacgctgcctcgccctctcaacaacacacattccccgcctgccattctccatcgtgtcaccataaagtcgtcgtcgatccctcgccgtccgatctacggtgcctggttcacatatcacatctaagtgttttgcgtttgctagccttgtaggctcaaggctgccggcggctctaggaagcggaagaaggctgccgctagtggcaagcacaagcacccgccatctgttttctttgtcttcatgtgagtttctcgctccttcgcccaccacactatcaggacgtgcaggcggacgggtgggagcggtcggatttccccatcatctacgagtctggtcctctctcgacgaaacgcatggtatcctaacctcgccttgaaccctaatgctctctgaataatttggttcatggttggtgtgacagccatgaaggcggcggcgggatttagtgcccgcacagtaatctatactccctctgttttataatataagttgtttgacttttttttagtccaattttgttaaatttgatcaaagttatagaaaaatttatcaacatctaaaatatcaaatcaattttattaaatataacgttgaatgtattttgataatatatttgttttgtattgaaaatactactatatattttataaacttagttaaatttagaaaaagtcaaacgagttataatatgaaatggtgggagtattggtttggtgtgatttctgtttgtgtatcggacacatgtgggagatcggggacaaacctaggtgtttgttttggtcggcgtgcgttgtaggcttgcagccctttcgttcttgtagctgcaccgctgtaacaaactaacaattttactactgctgtaacagttttactacgaaaaaaatccgagttgctctgggatgaagttaacttcttcattttcatgtcagccagtgtaattagagaaattgatgctatctgtgtttgcaataatgtccgtgtgattaatggtttgtgcaatttgtctcgtagataacagaacaagaaattatcaaagcatagaactatgaattaggggtcgaagaaaaatgtcatagacatcagatatttaccacctcgatcaaattatccttgttttctccgtccctttccttcaattttttttttgtggtcacaagattcagtggcttcctcgcctgtactatactccaccatcccaaaatacaagaagattttattgagatgtgacacattctaatactattgtcggtgacataggaccgagagtatcatgactagaggcttgggcaggagcaatcacccacgaggcctgaccccctcgggggggtcgggcccgagggtgatgtggccgcccccctctttgtcttcccgaggggtcggaccgctcccgtttcggccccgagggctgaggcgccccgaccccttgaaggttttttgcgccgcgtgtatgggttaggtgagagcagcgagggctcacctaaccgcatttattgcggtttggacggg

SEQ ID NO: 67957 - DNA, 19192 bp, Oryza sativa
cttcatcctagccattacaggcaagatattgtatgaagaagggcgaacatgcagattgttaaactgacacgtggtggacaagaatgaccgatttgtgaccggtctgacactggtcatgtcgccagcagacagccatgttcccacgtcgcgcctgcctccggcggaagtggaggtaggtatgggccgtcccatcagaaggtcattcggacggcaaccatacaaatctccgtccattaatgaagagaagggaagttggagggaaagagaggagaagtccccacacaaaatagagagatggtgcatgtggtatccccttgagttataaaaggaggaccttgcccacttagagggggggggacggatcctgaacgatagaggctggattcggatcccagaacgatcaggggctagctcgcactttgtagcttcttcgtacacagatccaccaaaacacaggagtagggtattacgcttctcagcggcccgaacctgtatacatcgcccgtgtcttgtgtgtttccattctcgcgaaccttccacagaccgagagcttagaacctcacccagggtccccggccgaatcggcaaagggggacctgcgcggtctcccggtgaggagccccacgctccgtcatctggcgcgccaggtagggggctctgcgtgtgtttttctaagctctcgtattctttcgtgtgcgccaagcttttcctgttcagcccaatggctgaaccagcaaaggcgcataacctctctccgagtgttagcggtgacgacggggagccgaacccacgccgtcgagctcgtactccaccgccccctccacgccaaagtcctaggcgggaggaagcgctcgagagggtcgaaagatccgcgacttcgacatccacgggtgatggagaagggcgccgagatggggagcgtcgcctcctcgtctacggcgacggcaacacgccccagggtgcgctccaagctgcgggcgcgctcctacgccacccgcccgtcgtccctgacccggagtctccggcccaacgttggctggacgacgtggccaacttggtcatgacggcgcggcagcgcctagatgctggtgggcggtcctccgccaccaagacctctggtactgctgctaccggctccgcgtcgtcaagacggagggcgcggcgagcggcggccgctgttcgccattcggccgccactccttcgtcagcgcctccgacccgggaagatttgcgtggggggccggatgcccgcatcagtatcgagcgccggcgtaatggccgacgtgctgcccacgcaacggaaggcgcctcctcgtccggagtgtcacatcaacacggacgcggggatcagccctccgtgcccccggttggtggtgtcggctgtagagcctttgtggcgagccttcggaacgtccgttggcccccaaggttccggcccaccatcgccgaaaaatatgacgggagcgtcaaccccgccgagtttctccaggtctacatgaccgggatcgaggccgccgggggtgacgacagggtcatggcgaatttctttcccatggccctgaagggacaggcacggggttggctaatgaacttgccacccgcgtccgtccactcttgggaggatctgtgacaacagttcaccatgaactttcaaggcacatatccgcgcccaggtgaagaagcggacttacatgcagtccagcgaagggatgatgagtcacttcgctcatacatccagcggttctgtcaagtccgcaacaccataccatgcatccctgcacacgcggtgatttacgtgttcagggggggtgtgcggcacaaccgcatgctcgaaaagatcgcctccaaagagccccagactaccgcggagctttttcagctcgcggaccgagtggctcgtaaggaggaggcatggacctggaacccctccgattccggtgtggcagcttcggccgcccccggatccgctgctcagacagggcggcgtgacaggaggaggaagaagaggtcagcccattccgacgacgagggtcatgtcctcgccgtcgagggcgcttcgcgggccacccgaaaggggaggcctgcgagcgacaaaaagagggaggccagcgctcccagcagggagcgcccaaccggcaagtggtgcaccgtccacaatacctcccttcacgacctcgcggactgccgcgcagtcaaaagtttggatgagcggacgaggaagtgggaggaggagaggaggcaggagcgccgagagggcaagtccccggcggttccttccggcaatcggcgaagtgaggccaagcagaaggcccccgccgaggacatcgatgacggcgatgatgacctaggttttcaagagcctggggccaccattgccactgtcgatggaggagcgtgtgctcacgtttctcgccggagcctcaaggccatgaagcgagagcttctggccgcggcccctactcatgaggcgacgcgccgggcgtggtggtcggaggttgccctcaccttcgaccagaccgaccacccaccgtgtgttgcccggggaggacagattgcaatggtggtttcccccactgtttgcaacgtgaagctggggcgtgtcctcattgatgggggagcagccctcaacatcctttcccccgcagcctttgacgctatcaaggtcccggggatggtgctccggccgtcccagccgattatcggtgtgacgccggggcacacttggccgctaggtcatattgacctcccggtcaccttcggtggatccgccaacttccgcacggagcgggtgaactttgatgtggcggacctcagtctgccctacaacgcggtcctagggaggcccgcgttggtgaagttcatggcggcggtccactacgcctacctccagatgaagatgccgggccccggtggccccatctctgtccatggcgacctcaaagtcgcgcttgcttgtatggagcagcgcgcggaccacctcgccgccgcgtccaagcccgagggtggcgacgagaggcttggcacctccgcccccgccgccccgaggcagcagatagtcatatgcgacgaggtcccggtcaaggaggttgccctgagcgacggcccgtccaagaccacacggatcggtggtcttctggacggcaaataggaagacgcgctcgtctccttcctgcgggcaaacgctgacgtcttcgcatggagaccggcggatatgcccggggtccccagggaggtgattgagcaccgtctcgccgtgcggccgggcgcaaggcctgttcggcagaaagtgcggcgccaggccccggaacgtcaagccttcatccgcgaggaggtggcgcgacttctggaggccggattcatacgcgaggtcatccatccggagtggctggcgaacccggtggtcgttcccaaggcgaacggcaagcttcggatgtgcatcgactacaccaacctcaacaaggcatgtcctaaggacccttaccccctgcctcgcatagatcagattgtcgactccaccgcggggtgcgaccttttgtgttttctagatgcatactctggttaccatcagattcgcatggctagggaggatgaggaaaaaactgcattcattacccccataggaacttattgttatacgacaatgcccttcgggttaaagaatgtaggtcctacttttcaacgtactactcgaatttctttgggtagccaaataggacgtaatgttgaggcttatgtcgatgacttggttgtaaagacgcgcaaccaagagaccttactctcggatctagcggaaacttttgagagtctccgctccgcccgcataaaactgaaccccgataagtgcgtgttcggtgtacctgcgggcaagcttcttgggttcttggtctctgcccgaggcatcgaggccaaccccgagaagatacgagctatagagcggatgcgccccccagcaaacttagggatgtgcaatgcgtcaccggttgcatggccgccctaagtcggttcatatcgaggctgggagagaaggcgctacccttatttaagctcctcaaacgctccgggccgtttacttggatggaggaagctgaacgtgccctcactcagttgaaggcgtatctcagctctcccccagttctggtcgccccggagccaaatgaacccttactactctacttagcggcgaccccgcaagtggttagtgcggcgttgcttgtggagcgcgatgaggacaatcctcattccgcgcatccccaccctgtgttggcttggcccgggagagagcagggaagagaggcccccgagccgaacggtggcccaaggcccccgacgaccggagctggccctctgcccgcttgtcagacggtgccaggtgcccccgacccccaggatggcccgggggccactgtgggaaggctgcacctatcgccctctgaccccgaggctaaccctgtgccgactcgacccgggagagagcagggagaagaggcccccgagccgaatggtggcctaaggcccctgacgaccggagttggccctttgcccgcttgtccgacgacgccaggagcccccgacccccaggacggctccgaggccactgtgggaaggccgcccctgtcgtcctccgaccccgaagtcgtcggcacagaagacgagtgcgccccgcgaggccgcttggacaaagagcgccccagggatgtggcccctagtgaagaggatcggccccaccgaaaggtgcagcggcccgtctactttgttagtgaggccctccgggacgccaagacccgataccctcaggcccagaagatgctttacgctattctgatggcttcgaggaaactgcgccattacttccaagcgcatcgggtcacggtggttacgtcttaccccctcggccaaatcttgcataatcgagagggtacaggacgggtggtgaaatgggcaatcgaactttctgagttcgatttgcactttgaaccacgccacgctatcaaagccaggccctcgccgactttgtggcagagtggaccccagctcccgagcccgtctccattcccgaggccagctcgggcccctcgcagctgcctcacaccgcctacagggtgatgcagttcgacggctccctgtctcttcagggcgccggtgcgggggtcacgttgacctcgccgagcggagacgtcctcagatatttggttcgccttgactttcgggcgaccaataatatggcagagtacgagggactccttgcgggactcagggtggcagctggactggggatccgccgcctcctggtgttaggcgactcccagctggtcgttaaccaagtctgtaaggagtaccggtgctctgacccgcagatggacgcttacgtgcgccaagtacggcgtatggagcgccatttcgacgagattgagcttcggcacgtgcccagacgggataacacgattgccgacgaactctcacggctcgcttcctcgcgagcccagaccccaccgggcgcctttgaagaaaggcttgcccagccgtcggcgcgacccgaccccttaggggagacggacgcgcctgaccggcccccgaggcccgtcggagtccaggcctcgggacccgaggggagcgctcccagctcccttagattgattgcttggatcgctgagatccaagcatacctcacagataagactctatccgaggactgcgaagggagtgaacgcgtccagcgcatttccaaacgctacgtgctggtagaagggaccctctatcggcgcgcggctaacggaatcctcctgaagtgcattcctcgggaacaaggcgtcgagcttcttgccgatatccatgaaggcgaatgcggagcccactccgcctcgcgcaccttggttggaaaagcctttcgtcaaggtttctattggcagatagctctcaatgatgcagtcgacctggtccggcgatgcagagcgtgtcaattccacgccaagcaaatccatcagccggcccaggccctgcagatcataccactttcatggccatttgctgtctgggggctcgatatcttgggaccgtttaggcgggccccgggcgggtttgagtatctgtatgtcgcgatcgacaagttcactaagtggcccgaggcttatccggtcatcaagatcgataagcactccgcacttaaattcattaagggcatcacagcccggtttggagtgcctaaccgtattattacggataacggcacccaattcactagtgaactcttcggtgactactgcgaagacatgggcatcaagctctgcttcgcctcacccgcccaccccagaagcaatggccaagtggggcgcgccaatgcggaaatcctcagaggtcttaaaaccaagaccttcaacatcctcaagaagcacagcgattcgtggatcgaggagttgccagcggtgctctgggcgaaccgaaccacaccaagccgagcaaccggggaaacgcctttcttcctcgtctacggcgcggaagcggttctcccatccgagctcaccctgaggtcccctcgggccaccatgtactgcgaagctgatcaagatcagcttcgcagagatgacctcgactatctggaggagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccttaagggggatcgggtgtcaggtttcaggctcgggccaaccccgcacccccctcgggcgtgcagggttggccgggggctaccacatatgcatatttttatttctcttatatatgtatttcaataaaagcattttcgatttcctaaaggctgtatctgtgctgttgtttccttttgaagaatcttgacttgaaataggtcactcgtattcaatcctgccctcgggggctcgggtcggctaaaatcgccaaacggggcccagaaccgagccgtgccccggggcgtggtgaactccgggggggaatcggcaaaaacccacaatcgggccacccataaccctcggtcaccacgctcccggcctggccagtctcgacatgtgtatctccccaggcactaaccccgacccgagccatttgaggactaggacctgggcacgagcccttgttcaagccaagacacaaaaggaccgcggcacagacatcctcgtctcatacacacagcaaatagaattgacacaaaaaatttcctctttatttgattgcagattaaattaagtctatacaaaaaggaggcctgaaggcctcggaagaagaaagaagaaactatttaaagatcggcgggggcctgggggctcactccgatgcacccgggtcgccagcctcgtcgccactgtcgcccgctccaccgtcatcgtcctcctcgtcggagttgagggcgaacgcgagccgaggggccgaaccctcgaagctgtggacgatgtggtcggcggcgtcccggacctgcgcgcgcgcgccgtcctcggtcccgggagggaactcatccagcgtcgtccatggggagaagtcagggtctctggcctggtagctcgccagtacgagctccaccgctcctcgggcgaggtccctcgaggaagacttaatcgtcctctcaagctcctcggggagccgttggagagtcccggccatctccgagaggcgctgggcgaggcccccctggttggcggcgtacttcacagtccgcccgccccagaggcctgcctgccggccggcgtgatctagacgggagacggcgtcccgaagcatgccgggccctacctcgcttgccaagcggagggcctcgacctccccggcggacgagtctagcgcgccctgcagatcggcgatggtgtgttcggcagctgcgaggcgggcggctaaatcgctttcgcccgtggccgccccgtcgctgcgcgccctcgtgtccagctcctttgcctgcgcctcgagttcagcggcccgctggttcagtgcggccctctcggcgcggacaccttccagattgcggcgcgcctgctcctcccgcgctgcctcgcggagggacaggctgtccgccagccgttgcgccgcggcttcggcctcttcgagagctcgctcccgctcggtgagcgcgtcctcgcggaggcggagcgcggactcctcttcggcgcaggcggcctcgtgcgtcgccagcgttgcctcccggatggcaacggcggcctcgcgatccgccaggtccctctccacgacgcaggcacgctcttccagcgccatggcacgggcctcgagggcttcttcgcgccgccgggatgccacctcggtctccgccgcccgctgttctcgggcagcggcagcgtcaaggaccccctgggcggcgtcgagcttcttccctagctccgcctcccagctcccgtattgaaggcggagggtgtcctgcgcctcgttcatcacggtggtggcgatgagggcagccccccgctcctcctccacctccttggcgatctcccccagcaccttccgacgggcttcgagctctgagacgtgccggcggtgtgccttgcggcccacctccaccatggcctccaccgagcgtcgcccctcttcgacacgcgcccatgcggcgtcgagctccgcccgctctgcttgcagggcctccacctgggcacttaacccgtccaacaccgtggtgtttgcgacggccaagtcctgcagaaggggttctgcgctcagtggggcgacggaaggcgtggggaagagccgcctcggagaagatgccgcgcggctcggcccgccgatggatgtgccggactcggggacgtcccccggacccggcttgtcctgagcgtcgcccgagggagtgggcccaagcgatgcccccgcggcctcgtcgcgagctgcctcggaagtcgtcgtcgcctcggcctggtggagtctggcctcctcccgagcagcttcttcagcttggcgagctcggacggccacctaggcagcttcctcggcatcccgaaggcgatccgcggcctcttgccggtcagtttcacgggtcgcctcggaggatgtcgtcgcctcggcctggcggagtccggcctcctcccgagcggcttcctcggtctggcgagcccgggcggcttcccgagcggcctcctcggcttcccgaaggcgatccgcggcttctcgccggtcagattcccgcctccgggcctctgcggtcgccgggtcctcggcctcagactggccggactgggaatggcgggagggacgcgacgggatctcgctgaaacagaagaaagaccagaagacaaacaagatgggtgagtgaaaactcgcgttgagagaatgaatacagccacgatgggcatgggacgaacctgcgagggggtcggttaaacgaccaccttggaggggaaataaggtttccccgggatggttctgtcccccccatcttgcggagccgtttcttcttccgctccccctcgggctgcgacgtcggcgtggccccctctgggcgcctgctgctgacacgcgccgccccgccccctcggggaggagatgggggaggggttcctccctgtttcctcttcccccgggcgtcggcggggcggctgccccccgggcccccgtcgcgaggcccagaagcacgaccccctcccggggtagattgttcccccctgcggctcccgcccgcgccatcgtggcctcgaggagcccgctcctccgacgccccgaccgcctgcatgatggtcaggatggaggcgcgatctggatcgctgcagagggggaggactccttggggaatgagggatgcctccacggagctgagattcagcacccgttggaccactatcttgaagtcctcaggagcccagtcccatctgactccctgatgggtcctcatgtagtcttcggacccggtgtactcccaggcgccccgggcgcgccgctggagcggtgcaatccggcgacgaaggtagtcgccgtacaccatggcccctgtgagcccctgggatcgcaggcccgccaggcggtcgaggacggcgtcatagccatctcccagatctaccggcgcccgccagctggaggcctgcgccgggggctggctcggaagtcggaggcgcacttcgtcggcaaggggggtgtagaaccagtcgctcttccagtcatcccacttcttgcggaggacgcaggggatgtagcggttcagcaccggcccccgcggctggaagtagcagccaccaaccaccgacggcggcgacaccgactgtacggtgaagaaccaccggaacagccgaagggatgggcgcaccccgatgaacatctcgcacaggtgcgcgaagatggccaatgtcattaccgcgttgggggtgaggtgcgccatctggagatcgtaaaactccagaacatccatgaaaaaagaagaaaatggcggaaccagccctgccattgcaaaagggaggaagaagacggaccgccccgggtagtgtggcgctgggcgtccctcgcccagcgtgactatctcccggccggtggcagattccggcatgaagcggcgcggcagcccggcctgcctctcgctcacgatgcgggaaggcggcagcacgctaccatcgagcagagcggagccccgtgccatgacgccggaggaagagatgtttgagagcgagcgcgtgtggcgaaggtagggcacaggaaacgcggagttagggcacaagcggcgaagacaaggggaataatggcgagaggaaggaagcaaatctcttcctcggtgtctttatacccttgtcaacgctgtgcccggctcctcgcttctcgcgcccactatttcgctccctcgtttctcgcgcccacgcttccactaatcccattcgcccgcttgcggcgcatgaggtggatatgcggaagtggcagtcgagatggaacatatcgtgcgcgcgttaattacgctcgccgaccgaagcgccatcaccatatctccaggcaaaacgaaccggctcgtccggattcgcgtgctactcgagtaatgtggcagccttgaagaggccgctcattattgacagtcgaattaccattgccgatgtgcgtgattggcgaccgttgggtttctgcccaactgtggagaccggtcccacctgtcaccaggccttaggaagtggcgtcacgcccgaccgcttccctcgaggagggcgatcgccctggcataacgccgggggctactgtcggtgacatgggaccgggagtatcatgactagaggcttgggcaggagcaatcacccacgaggcctgaccccctcgggggggtcgggcccgagggtgatgtggctgcccccctctttgtcttcccgaggggtcggaccactcccgtttcggccccgagggctgaggcgccccgaccccttgaaggttttttgcgccgcgtgtatgggttaggtgagcgcagcggggctcacctaaccgcatttattacggtttggacgggcgcgtcacgccgcatgtaacgcagtacagcgcgctcgtttatccggtctgtgaccagtcacagaccgatcagatcgtgggttaggtggcgacaggcggtctgacgcacgcctcgccccatcccgtcaggatgagagcctccaagcactcgtccctagccggagccggcgtgttagctcctggaggtggcacgttggacccggtcagatatatgtcaggcttcatcctaaccattacaggcaagatattgtatgaagaagggcgaacatgcagattgttaaactgacacgtggtggacaagaatgaccgatttgtgaccggtctgacactggtcatgtcgccagcagacagccatgttcccacgtcgcgcctgcctccggcggaagtggaggtaggtatgggccgtcccatcagaaggtcattcggacggcaaccatacaaatctccgtccattaatgaagagaagggaagttggagggaaagagaggagaagtccccacacaaaatagagagatggtgcatgtggtatccccttgagttataaaaggaggaccttgcccacttagagggggggggacggatcctgaacgatagaggctggattcggatcccagaacgatcaggggctagctcgcactttgtagcttcttcgtacacagatccaccaaaacacaggagtagggtattacgcttctcagcggcccgaacctgtatacatcgcccgtgtcttgtgtgtttccattctcgcgaaccttccacagaccgagagcttagaacctcacccagggtccccggccgaatcggcaaagggggacctgcgcggtctcccggtgaggagccccacgctccgtcaactataaatttggataattagtatatctacattcaaagtattagaatatgtcccatctaatcaaaactatttatctttcaggacggggagtgtggcagttaagagaaaaaaaacaatacgtgtatatctttttattggcttccaatggctacctggtcgggatgcgtacaagaagacagaaatatgccagacatgttgccaactgaaaaaagtctgcctggtctgcctgctagatcttgaaaatttgtgagaactgagactgttccttctgcaatggggtttaattgttcctgcacatggtttgggcatgattatcatctctttttttaatcatttgctgtactgaaatttggtttgggatttataacatgtgaacaacaatctctttgccactataggatctaacattcatatgttagcagcccaacgatagatcgacactattaatttttatgtccttaatctcaacaagattgtgcctttgagtttcaggataaggcgttccaatatttcttccgctacgtacaagtccctttaaagccattcagaaattatttggttctaatatattttttttacatcaaggcttctattctgttttaccaatttctgaattttggccatagaatgtctcagaaactggcagcatgtcaattctgagcaggttgttaatgccttttacttttagcactcaattactgtagcaaaaatatagagtacaaggaagcaatttgtcatccacattaggagctgtgatattcacatctggtctcacttggattaatacatgcagttaagatgccaatgggcttccaagcaaccacatctacacatgtgtcagcagttgggctacatcttgtcaagataagattagtgcttattgatagtatattgaatggtgtttcttcctcttacttgttctgttgttattcgtccagttccatatgtgaactgcaagtttatttggaaacttttccagccattgggttttaaggcagatgacacaaagctaaagtgtgtaggattggattattagctttatgcctgtatattatgtttttattccaggaatgccagtatcctctcttcctaaatccttaaacaaataaatattttagtgccatatttgacttggatcttttactgtaaatctataaattttagcggactctgcatgagacaggggttacactttcgatttcggcgatttcggtaggactgaaatttacgaaatttcgtgattttcggcacatttcggaacaaagtttcttgaaattttgacagattttaacagtttttgaataaactttgactaacttcaacaaaaatttgagaaaacctgaaaaattcggtcgatatattgatttgccagtggggtccgaaatttcgaaccgaaaatgcaatcactggcatcagatgagaggacaacacaggaaagggatgctataattgaagcttgatttataagaaaatagtagtcaatttgatggagttatatctacaaaagattaggcagaaaaggcattcatattttatttccttctcttcgatgaaataactaactgtaccttatttcagtcgtttacgtatgggtggatcaaagcctgccagatcgtgtaaatcaccctggtaaatctggagcaaccaggttgtgctggattagtggatcgagctgcaagaggagaaaaaacttactacttctcatgaccctccaattgtatttggtatagcttggataatgaattcggaagaaggttctgttatctaattcatctttgtccaggcttgttccagtatgcagctagccatgctcctttgagaattgaagatcttgctgcctacattcagtcaaacaatatggagcttgaaactacacgttgaaattaatgaaaggtttgggcgaggaaaatccatcacatcagacaatgcaagaggatacatgggctaatctatctattaacttattaaagaaatagaaaaaagaacatccatgttcgctctcacagcatagaaattctcatattaatcagagaaaaagaaaaacaaagtccatatagaaatacaatttagaaatacctgaaattcagaattaaaaaataaggaatattggaagaggagactagagtccatatagaaatacaattaagaaataatagaaattcggaattaaaaataaggaataatagaagcagagtatagagtccatatagaaatacaattaagtaataatagaaatttggaattaaaaataaggaataatagaagcagagtatagagtccatatagaaatacaattaagtaataatagaaattcggaattaaaaataaggaatattagaagtagagtatagagtacatataaaaatacaattaagaaataatagaaattcggaattataaataaggaatattaaaagtatagtatagaatccatataagaatttaaaactaagtaaaatttgaaataaacataataaaattaaaagtagagtttagagttcatataaaaatacaatttacaaataactaaaattcgaaattaaaaaaatagggagaaaagtataatttactaagttacttttataatttatataaattatttttagactttattaaatttacgatttactttcgtaaatgtatttacttgaagatcttctctacgctttggttatgaatttacttcacatagtttcttacttcaactcggttataatgtaattacttctaatggtatacatagttacttcttttgcatatctaagttacttataatattttaataaattacttttaaattaataaaatatttgaatatatttaacatgatcttgttttgtcacatatttttagtaaagtacaatgatgcaaatagatcttaaaaatgatactccctccgtcccataatataagggattttgagtttttgcttataatgtttgaccactcgtcttattttaaaaatttgtgcaaatataaaaaataaaaaattgtgcttaaaatactttagataataaagtaagtaaaaaaataaataataattcctaaattttttgaataagacgaatggtcaaacagtgcaagcaaaaacgtaaaatctcttatattatgggacggagggagtatgtgatttaaaaaatataaatcattaaagatgttaagaaaagacatgcaccatagcctaaaggggaatttgtatatttgatagagtggtctccggttaggactaacgtactaccgtgcactacatagttacatctaataaaataatatgttttatgttcaatagctaactatcatatatttttatgatgttttatagcatattcgcgttctttctgagttcgaagttaatggcatccaaaactaaagaaaggtcatcgatgattttcgacaatagaaaaaaaaagcgcaagaaacggaattaatcaaaggcctgagcagatttgatcaacggataggcaagatatagatagatactcctatcaatcagagatctgcggctgtgcgcccgtggacccagctcacatgcctctctcgtgcctgagccgacgagccgcttagccgagccgaagcgccaacctagctcatccctacgagccgagtcgagccaagcctaacataaaaaaggattaagggagtgttcgaagagaaggggattgaggagattgggaagatacgcaaaacgaggtaagccattagctcatgattaattgagtattaactattttaaatttcaaaaatggattaatatgattttttaaagcaactttcctattgaaattttttgcaaaaaacgcaccgtttagtagtttgaaaagcgtgcgcgcggaaaacgagagacaatctctcctatctccacctaacgaacactccctaatactagtggcactaaagttctcggctccgtaccaggtgggccccatgcgaggcgacacgcgtccgttccagctgtcggtcccagccacccacgcatcccccgcacccccactccctccccaccgacacgtgggccactacgtggttcggtcccaccctgtcagtgacacgggtacatagcaccccggtgcgtctggttttcgcgccgggggggggggggacgggtttattgtttggggctcaagtccatgaggcgccctggtcacaagtccgcagccttttctcacgcgtcacgtgtttacccctgcctcactgacagatcggcccgggtgatggcgggacccagtcgtcagtgggtgcgaggtgggttttgtgtggggtgtgcgatccccgcgcgcgtgctccttcccgcgccggttttgatgtttcgcgggtctccgttcgaaacagcgccggattttgctcagctaaatatgccgtcatgtattttcttctatctaccttttcccttttggccttttcttttgggactgacgatgggttgaccatagcataaatgcatcatcattttattcattttagtatgaaaaacatataagtggtgtttttgatattggtggtgtttggataggttaagatgaaaatgaagtcaatactcataaaatgaaaaaaaaatcattaaggctgtgtttagttccacgccaaaattaaaagtttgaaaaaattgatacgatgtgacgaaaaagttgaaagtttaaagaaaaaaaagttaaaatctaaacaggacctaagtaggagtaattgagtgttaattattataaatttgagaaatacatttatttggtacttaaaacaacttttataaagaaagtttttgcaggaaacatatcgtttagcagtttgaaaagtgtgctaacaaaatttgaggtaaaacctatcttaggctgtgtttagatccaggggtaaaaagttttaacatgtcacatcggatatacggacacacatttgaagtattaaacatagactaataacagaataaattacagattccgtgtgtaaactgcaagacgaatttattaagcctaattaatccgtcattagcaaatgtttattatagcaccacattgtcagatcatagagcaattaggcttaaaagattcgtcttgcaatttatacgtaatctgtgtaattagttttttttgcatatatttaatactttatgcagcatccaaacattcgatgtgacagagtaacaaattttgccggaagatctaaacatgccctaggctgtgttgttgtgttcttaggtgaggattggaaaacacataagagagttggtatttggaacacaaaaatagcaaataattcctttcttattcctgtattttatctttcttacttcgtttcaaacaagtctctagactttaaattttgttgtaaaacaaaccaactttatattcttgtctaacatcggtttagaaattttatttcttcgaaacccttatctacccatctaccaatacaacttttgtattaattaaagatattttgtttatttgtgttccttcttaagtcctttattaggatgccaagatttaattttttttaatagagtaggtttcgtatgaaatatgattaagctagttttgattgttttgaatacctggactctctcactatatttaacttcatgaccactccgcttactaagaatgcttacttaaagggacaattgctaatttagcctcgttttgaagcctaattatcaatctgatcttacttttacaagtttactcatttgaccttattttttaaaattgaagttgtcatctgaccctgttttctctacaccgttagggttccatttcatcttggggtgtgtttagttcacgctaaaattgaaagtttagttgaaattgaaatgatgtgatggaaaagttggaagtttatgtgtgtaggaaagttttgatgtgatggaaaatttgaaagtttgaagaaaaagtttgaaactaaaacaaggccttggttaaaatgaccaaaatacccaggagtacacctcaacaccatctccttgactccttcccattctctgtctgccccattcgctcgtgaaccacgtctcgcctccccatccgcgcacagaggcagagagggtggtggcggcgtgtggaggaaacggcagctgcggcgcacgggagcctcgacgtgcgccgcgcggagggtgcggcggcggcgacgcgtggagggagtggcgacggcggcggcgactgcgcgcggagaaagcagcgggcgtcggcgccacgggagctccggcggcacgcgggaacctcgagatgcggcgcgcggtggtggtggcgcacggatgaagctgtggcgacggcgcgcgaagaaagctgtggcgccaacccagtcctccgccccaggcgcttctccttcctggtcctcagccgtgcagctccactcgtctcagcctactccgtgccatcatcttcgtcacgatgccaacaatagaccagctcatggagttgtgcacaaattatgctgttgcacatggatttgtgctttgggatgtctttgttagacatgaattaacttatgttctttatcttttgacaaatattggtcaaatttaacaaaaatatgacaaatctaggtcaaatctttcttgatactccctccatctacttttgatagtcatatttccaaatctgaaaaatttatttttgatagatatatttcaatccaacaacctactttctctgtttcacaatgtaagtcattctaacatttcccacattcatattgatgctaataaatctagacat

SEQ ID NO: 67958 - DNA, 5298 bp, Oryza sativa
gttacatgcaaagccaaaatctgcagttcataaccatttaataactaacttgtcatggcacctttaacatgtgcagaccaaaacatcataataggtatatattgacacattgcacaacttaatcaatatcacatgaagttaaaaacatgtagctcctaattaaaaggtaaaactactttttaggccttggttcagttaatcccttcccaagaggattggaggggattaattccacatctttcaaatctcaatcccctccaatcacttcctcatggggattaactgaacatgcccttagagaataagctcaaacacttgaggaacaaaaagaaaacagctcacaagaaacaaattgcaaacacaatgggataggaaaacaaatgaaatactttaaaaatgtgaaagaattaagcaacagactcctacttggacaaataaacaccagaatcaaatatactgctgatacaaaacatgtagccaaatataggtgttacctcatagacaaaccaattaacagattcattatcaggtacagcatctcttcccttgcatggaatctaaaacagaaatgtgttaacataggaaaggcccttttgatttcaaggatgcagataagcttaagttctctcaccttgacatgcttaataccttgccttgtccattctgcaggtgagtaatatcgagtagtatttgtcaaatcaatcaccaaacctatctgaaaagggataggaaaaaatcggtatagttctgttagcaaaagggggctgactaggaatgtacgcatacgagataatccgtaccatgccaataatatgaacatttcgaacaagaggaggagcagtaagtgcacatgtttcacaaaagaatttcagaattgcaatcttttatttatacaataatatcaattgaaaacagcatcatcttcgcaattaacaaaagggaaataagtacgtagtacaactacaaactataaaaataatcaacaagtcaatacttacttcacgaccagcttttctttgtttattaactacttgtttggaagaatatcttttcccaggaggcaccaagtcattgaatgtttcatcaagaggaaccttggaaggtatgattttgtctattggctcaccaaatgctggacaattcatccaacctgaagtaacatagacaaaagcaagaatagtcaaaatccattttgcgcatgctcatagctagaaattgccatataaagttgataacagttagaaacattttccaacatttcataccatcaggtgcctcttttattcgacctctaccagctctgttataaggtgcataatcgttcctaatctgctgagaatgtaatcttgagccttcatcttgttgctctctctttaattttttgcgtctctcttcacgctcctgcaacaatggcaagattaacataaaaaggtggcatgcaagtttgcatgcttgccattaagaaaaactgaaacagacaatcaccactttccaatcctcaaaatagattatctgaagcatgaccaaaacaaaaggcagaaaatttggatgctatgcaaacaaaggaagcgacataccagtaaaactaggaaaaggaacatatgtaaaccaacattaacaacttccaagttgtttcccatcatctaacgatattaactaagagaacttgctgaagataaaatgtacagtttgcatttcagtaataaataatcagctatcattaggaaccttctagatggaaccaaaaggtaaatgcaggatgagtgtcatgtagtacccttcgcattgtagcaacagcagactcaacatgctcctcctgtgcaaaatcaacctcgacctgttgttcataaggctgttcatcttcctcaggcaatggtgaggcatttaaatccattgagaaggtcattcaacatccactacttcatatatcctcaataacgttttgagatttgcacctaagaacaagtatatacttagatgatcacacatggagaaacaaatattatcaaaatctcaaaatcattaaaagtgagcggaaggcattaacacgattattgaaaagacagcacaagtttcaacctatacaagcttaaggaaagaggactgagggacagcttcattgacaagcattccacacccccaaagaaacaaaccacatcctttataatacaaactactgacgaaaatcttgcatcacataggcactaataacagtgttggttgcaaagttgcaaacagtgtagcctagtatctattcctgtataaagcatgcgatgtcctatgcactgcagattttaaaaagaacaactcttacagctatgctaccagcttgaacatgaaaacagcacaacagtaaatatttcatattgtgacacctacaattcaacaaataacaggaagttgacaatgaacatgcatggccataaagcccacaagaacatgtttgtaaatttcaaacgagattgagtgtcagttcagatgcccctgacttaaaaccttacacaatactagactcaaatttaagatgaaggataggcacacaagatatgaacaatggaaacgaaatcataaagactacgcatactaatgattaccattttaccagtatttcaaatcctgccagtatatgtagaagtatataaatttataaccaaggggggaaatctagttcacaggaaaattagtgctagcatcactaaaccctcagttcaggcatcaagtcagcgcaaagtttgaaaagaacaaaaatggtgacataccaagactgaaaatttggaagggagactcaatcaatagtaagataaccaataatggcaaactttctgtggacaataattttattttttcccttcattttattgtaacaattcatcttatattaactttcttatatagaacagacccaaacttgaaactgaaaatctctgtatggtggaagattacttgacaaacacttgcacaacttcaagatttttggatattacaggtcttgtggcttgcaccagctatgcctctggtaaataaataaacgagaacattcttcattttccatcaaatgctatcatttttccttaattcctgataaatggctcatctcttatacactatcgaatgaaattctgcgtcccttatttgccatcgacgtaatcatactttaaaatcccatcactgaggttcattaatttcaaaccttctttcgaccttagtcactaaaatacaaaaatggcaattttgcccctagtcaacatgtcattgtcccaggctcactattcaacatgctctttctatctatcttttgctttttcttctctgccccccccctttggttccatcagtcgttgcttgctcacaccgaggtaggtaacaccggcagcacatggcgcaggcaagaaggcgaaaccagctactcctctggctcacctaaaaaacctccactacctgacacctgataacagcaggtttctggcatgttttcgtagacgcatgaaatcaggtcagccccaaccttttagtatatatttttcacgcacttcgcttctcagcttatctaattcatcgttgcttcaagcgaattaataataataacttatcatgctcatcaagactcatcatttagacatggaatagcagagcagataggtatccaagtgtgaatagccagttaaggcagagataggaatctgggcacagctggaatggagaccaacctccattctgcattctctgccaccctcaaggtgctcgacctcagccccaacccacatctactgggtgaatccagtgaatggactatcatacaagacaagtacatatgggtatgggcagccctgcatggctgcatcccaagatatagagagggcgggggggctgaactagtggcatataagggataagccaactctcagtggcgaataaggaaacatggtaatattgattgtcacttaaaaagaatttttctcgcaaatataaggtggttttacaataattttgtgattttgagggtccattgttacataaaacagtatcacctccatacaaggtaagttctgtggcagactgcaatatcagactgagaaactgcccatttatttgcatgggtttcagtgacatgtggggccataagcataaactgacatgtggggccataagcataaagtccccacaacacatgaatggccctagaattgctaattctagaaattttaaggggttacatacaaaatcttcaaattcacctgccacccacaaatgaattacagtattattatccaaccgtatggcttatagaaatagatgaagaagataaaaggaggtgatctagcagcatatttcagcatggttgcctatgaagatgacattatatgcctaatcgactaactatgctataaacttgtaagttttgcttttgcttttctctcttataatatccgttgcaacgcatttgacttggctagcaactctaaagttattatttgacttgttaattgcacaccagacattaaaatatctgcattctttcctcacccattttgcaactattaagtaatgtactgaagagatatgcaaatattcaagtccatggcaccgaaaaagtgcatttttcctagcaccttgcaactttaagttatcaactgaagagaaattcaaatgttgaagtccatgaaaccaagatagcaacaataaatgttcattttggggcatttaatttccccagcacaatagcagcataaagaggtaacataattcatgcagtgacagacgacatggtactttcaaggagaaaaaagggtgcatgtaggtttcttgcagctatattaccacctaaaaatgacggaggttcatacctccacagaattaatgtcaagaatggagtgaccaagcgaaaatgggaaaaaaatgtcctggtgtcatctgaaaacccgccccaagccacaagcccacgacacaaaagatgaaattcgagctaaaaaaaaaacaaggacagctcacaccaccgctactaccagttacagcaatagctaaacagctagctagggttctcccaaaaacggggtgaaacgccggccaaaccgcttgctagggggattaccgcgagcacaccaacacacgaaccccccatcccgagaccatacacgcacgtcgcccggcccgtacgacccgtgccgccgcggcccccaattcccacttcccagcccgcgccccccgccacgcacgcgcgcagggggtgaaaccagaccgccgtgggagcgagcgcgagccaaggaccgcagcgaattgggggaggaggaagggggaggg

SEQ ID NO: 67959 - DNA, 1004 bp, Oryza sativa
tgaggggcggcgagggggggagcggcaggttggtgacggggcaggtgaggtggccgccgtcgagccagcgctggatgctgcggcgctcgaaggtgtggccggaggggaggatgacggggtcggtcatgacctccagcgagattgggcagcggaagtcgtccggccaggtcgagccctgctccggcgacacctccatgcgcgttcttggcgtgcgagccgatctgcggcgaggaatggaaagcgtgtgggactcgtgaggaagacgaagaggaggagagtggggaaagtccacttcttccggtggacaggaaacgggatttgctgtggggcggtgagagagggtggggagaccacccggtgggcttaagtaacccactaatctaccctacccccaccccaccccaccccatacggccatacctagaaggcaggtcgattaccgacgtcgtgagtctacatgtggtgtgtccatccaccttaggttgggaagcatgccggctgctggcatcgtgagtctatgtgtggtgagtccaccttaggttaggaggcatgacggttgccggcgtcgtgagtttacctgtagtaagtcgggatgagggaggatgaagcgttaaggttgtgttggaagcggtgggggtagtttcagaagggtttgtttcaatgttgtagtatctgtctgtgttcttgttgctgtcttgtgttttacgagggaatgcgcgtgtcgatcttgtgaaggctggaggatatatcatttttggatttaactaatgctttttggtggtggtgttttttttttggggttcgtttcgacgtcatggtatctatctgttgcagtcttgagctttcatcgtgtgatgaattaaaggatagcgatgttgcttatgtttatcgttgttatgtctatccgctgcagtcttttgtctgagtaacgtgtggcttatttggatttagcagacgatccttgataatgtttgcttttgtctatcttatgatccatacatgct

SEQ ID NO: 67960 - DNA, 8833 bp, Oryza sativa
cggacagtgagcacagaaaacgaaacgatccattagcacgtaattaatttagtattagctatttttttttaaaaatagattaatttgatttttttaagcaacttttgtatagaaacttttgcagaaaactcaccgtttagcagtttaaaaagcgtgcgtgtgaaaaatgagggagagggtttgggaaaaggggatacccaatcccccgcatgcccccaactcacctaattatccaccttcttcctccagcgtgcggactgtggttcggctggcctttggattcttcgagcacttggagcagagaacctccggacaccagccacaatctgaggctcgcatcgatcctcggtaagattaagatacgaatttgtttgtttgttttttcggttttggacaccacttcagttctgtgctgcacttttgctcaagcatataatcatatatttcagtatttcatcaccagtttgttcctttctgtttgacctacaagtacgattactgtgagaagtcggggtttgtactgcttaagaaatgcttaaaaaatatgcttaggttgatttgtttgccgatatgatgtcggtactggtcatggatttgtaggtgcctctcgtcatatttttatctcatgttagaaccacatatttttgctgttctggtagtactattttagataacttttatggtggtttattctagcatttagaacctttatctttcattgtccaatcgatcttctctcgtaatactaccacgtcagctacaaagcagtactccctccgtatatctatatagatataagggattttggttggatgtgacatattctagtataacgaatctggacaaacttcatgtccagattcgttgtattatgatatatgtcacattcaaccacaatctcttatatttaggtaggaatggagggagtatcattttttcttatataggacaaagtagtatcacttttttttctaccgctaatcctatcttactataaagttgatgtctactaacttctaaagctcagcatgtaagtaagtgtgtgtcacatcttcacccactagcaattattttctagagtattctaaattacatgtaagtgtatcacatcatcactcaaaagtaattattatctagagtatcttaaatatcatgtaaacatgacatcgtttataattttgttctatttttagaactcaatatgcaaacaatgttaaatcattatcttcacatcatttttatattacctaaacatatacatattaccatttctataatgtataacatgcattcatgcatccatatatcccgcagcaaaacgcggggtatcgagtaaaactcattaagcaaagcgcgggatattattggttgtaggaaacaacaagtagagaccaccataaaagtggtcgttaatttaatttgtaggccaattctcatctcttgcattgatctgaaatgttatttttttgtgtgatttaaattataggagtgtaccagcatttcacagcagttgggtattggaatgaaaaactgtaaagtacacttaaaatgtttaactttagagatttgctccggtccaacaaaaaaaatacctcgaggtaccggtatctcacagtactaaatcgttttcgatggttggatctagttgggaaggatggacattgttagatccaacgatcgaaaacgatttggtatcgtgaggtaccagtacttcgaggtactttttgttggaccggagcagatctctaaaatttacgatatttgaggttgtcaaggtaaccggccaacatatatagagggtctaatttgaattttaattagaaaaatcatcttattgttggtaccaatactatgaaatttgacaattgctgcggagccaagatagaccgtgacctctacaattctttagcactggtattaggagatatcacaaattattaattactaaaaggtatattacctattatacgtttgttctcaaggacaataaacataaagcttaacattccaaaactcgttacatctatgattgataggatttgatttgttgaccttcctagaaggaaaatcgggtgggttttgagatggctggagtattcgcctccatggctatcgaatgggcgatcgacaagctctattccttgctgccagcatgtctggtatcaacacctgcatcgtcatcgtcttccgcagcgccagctgaaagcgaggaccttgaggttctgaagaggcttgagagaacaatgcacaggatccatgcgacactgcacgatgcagaggaacagtggaacatcagggaggaaacagccaagctgcggctcaaggaactgaagaaggtggcctacgacgcggaggacgtggtggatgagtacgggtacgagatgacacgccataaagtggaggcatttgagcaatctgcaagggctaatcgcagcggcaagcgcaggcgcgaagaggtaaaattttcatcactgcataatctatgccaacaaaaattctatcagatatttatatatgatgtttggaccatgtttatgcatgatatgtttgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgtcctcctagccacttgaagcatgtgtggtggagagaagaggggaaacacgcgcgcgctcgctcgcctcgcctggcagggcgtgcggcgcgcgtgcacgacgtacgacgtcgaatagtccgaaaaattggctcctcacccttgcgcagatgcagccttcttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcagtatatacgcaaaatcaatctagggtttgcctcctactttgtactgcgccgtcgctcgtagactactccatcccgctcgccggcgtgcaccagcgatcgggagagcaggtctccggaacctcagcctttgacgtcctgcaccgggagaaggcggcaataaggtttttgggaagcgcttcgcgcgactgctccctgttcgttcgtgacggctcgccttcctcttcgctcgcgtgtttcgtgccttcgtagacacctgcgaaatgtttcgaccaagcagccggtcttttcgtcacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatctcaacaatccaaaaaccttattataggcactgtgattttactatggctggttttgctgatgcactgaggccggataaattcaccggtgtgcattttaagagatggcagatcagggtcactctgtggctgacagctatgaaatgcttctgggtgagtactggcaaacctgtaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacaggctcatgagatacaaaccatggctaaggaactcgaactccttaagtgtgtcttacccgacaaatttgtggccgggtgcattattgcaaaactacctccatcttggaggagtttcggtactgcattcaaatacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttcgtcatctggctaggaagtgtccacagcgcaaggggatgaaggcacctgcagggcagacttctaagtctgctaatgtgaccattggcaacactggagatggaagcgggtatggtaatttacctactgttttttcagttaatcaatctactaatttgtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtttgactagagacggatttaagttggtttttgagtctaataaagtagtcgtgtctaaacatggatattttattggtaaaggttatgagtgcggaggcctgttccgcttttccctttctgatttctgcaataagtccgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaattgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaagacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccggacatgcatgttggtacaattatggagtctcgtgatgctaccttctttgagagctttttcccaatgaaggatacacatagtggttcgaaccaaccctctgaaataattcccagttcaatcacaccaccagaacaaactgaacatacacatgaacttgtctctgaggaggatgtcagtgaagctcctcgaaggagtaagagacaaaggacggttaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagcttaggcctgacggtactattgaaaagtataaggctcggcttgttgctaagggctatactcagaaagaaggcgaagatttctttgacacttactcacctgttgctagattgaccacaattcgtgtgctactttcccttgcagcctcacatggtcttctcgttcatcaaatggacgttaagacagcttttcttaatggagagctggatgaggagatctatatggatcaacctgatgggtttgtagttgaaggtcaagaaggcaaagtgtgtaaattgttgaagtctttgtatggtctgaaacaagctcctaagcaatggcatgagaaatttgacaaaacattgacatctgcaggctttgcagtcaatgaggcagataaatgtatgtactatcgccatggtgggggtgagggagttattttgtgcttgtatgttgacgacatactgatatttgggacaaaccttgaggtgataaatgaggttaaatcattcttgtctcaaaattttgatatgaaagatttgggagtagctgatgttatcttaaacattaagctaattagaggtgagaatgggattacactcttgcagtcccattatgtggagaagatcttgaatcgctttggctacattgatagtaagccttctccaacatcttatgatcctagcttgttgcttcgcaagaacaagagaattgctaggaatcaactagaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtggaattagggcttcactatactgggtatcctgcggtactggagggttatagtgattctaactggatctctgatgtggatgagatcaaagccactagtggatatgttttcacactgggtggtggtgctgtttcatggaggtcttgcaaacagaccattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccagagttataacgttggattacatccaaacagcgagaaacctggcagatcccttcacgaagggactatcacgaaatgtgataaacaatgcatcgaaggagatgggtttgagacccatgtgagttatactatggtggtaacccagtctatgtgatcggagatcccgtgaattagatcctgggaagaacaaaccattagtaaactagaggagagtatcaatatatataccctctccaagtgaagatgcatgtactctcgtgagctgcaaggcaggttggctatgccttaatgagttctgttggctttaattagcgaagatgttgtcctgcagagcattcttgaaagaactaacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaatgggtctccatcgaacgctggtatataaacagtacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgtcctcctagccacttgaagcatgtgtggtggagagaagaggggaaacacacgcgcgcgctcgctcgcctcgcctggcctggcctggcatggcagcgcgtgcacgacgtacgcgtcgaatggtccgaaaaattggctcgtcacccttgcgcagatgcagcctccttttgcagttttgttttgctgcaaattcggattcgtttttgttttggaaacgttccgaaaaatccggtgcgtgcaaccggcgtggagtccgaataagttacgcgcgacttatccggttcggttacgcgcagtagagatcgtgcgggcgccctgatcaagcgacccttctctatataaaccgacccgccgtcttcacgcagtatatacgcaaaatcaatctagggtttgcctcctactctgtactgcgccgtcgctcgtagactactccatcccgctcgccggcgtgcaccagcgatcgggagagcaggtctccggaacctcagcctttgacgtcctgcaccgggagaaggcggcaataaggtttttgggaagcgcttcgcgcgactgctccctgttcgttcgtgacggctcgccttcctcttcgctcgcgtgtttcgtgccttcgtagacacctgcaaaaagtttcgaccaagaagccggtcttttcgtcacctcggtacgtgttcaatatgttg

SEQ ID NO: 67961 - DNA, 8799 bp, Oryza sativa
tagtaaacgagaaaaaaaatatgtcatgcatataccaacgaaattatgggtttttatcttatttcactttccacaagattaaacaaatacatttactctaaaccaagctaagtcataattagttttatatcgcattaggttatgtcgcaggttccctttgtaagacttcttataactttggatcatgttttgcaaaattctatttgaattttcaattaaacatgaaaattgtatagtatgttgatgtatctcgatagaaagtaatatgttcttagtccatccatctcagaatatagcaacctaggatcggattagacgcatcctagtactacgaatctgaacatagggcatgtctagattcgtagtagcaagatacatcccatccgatcctaggttgctatattttggaacggaaggagtactttacacctaatgcacattgaaagtatgctataaattcggctctgttcttaggctgagtttgaggagaagggcattgagaagattaggaagatacgtaaaacggtctgagctattagtgtatgattaattgagtattaattatttaaaattttaaaaatagattaatatgattttttaaaacaacttccctatagaattttttttaaaaaaacacaccgtttagtagttcggaaagcgtgcgcgccgaaaacgagagaaatctttctctctatcacctactgcgaacgctgccttagttctgttctcttttcgtaattgcaagaaaaataagtaaaaatttaccataatttttctttaaaaattggctctaaaattaaaatgaatttgggttataataatttgtaagaaaccattaagtgcttgttggaataatgtaaaatgataactttgaattctattccatttattttttccacctcatttcatccattcactaccttcatatatttccctataccaatctaacatctgatatgatcatatcacatgatccaaacatagttccaacttccaagaccatatagatcacccaattatcaaaagaatcattagattaattagctgccgtccaaagcgatttggcaaagaaacagagagtatacaattttgctatatatttgtcgataaattttctctcaaaaatttaacagatgtaattacagtacaatcgcagtgtaattacactgtaacttgcatgtaattacactgtaactataatgtaacttgtatgtaactttcaaaaatctctccgtaacatgttatttcggtaaaatagagatcgtgggaacaaatcctttcacatatatatgtgctgtgattttttttcttcctcaccagaataaatcttgtaatagatctaacgatttaaaattatgtgaaacttacatacaagttacactatagttacatgtaagttacagtgtaattacatacaagttacaacgtaattacactatgattatactataattacatctgtcaattttttaaaagaaaatttgtcgataaatatataggtggtcccgagagtatatatatcctcgagacatgagctcctgtcagctcccaatgctgccggtggggccacctcactttgcctcatgtcaaattaccaaactacccctgtccgttccggcagttgttgacttctcctccatcttccgacatctcgctccatctcactgacgggtgggccccacagatgtgctgccccacgcgtcagtcacagagatgtataactgtttattggagaatgggccgtgccggcaactccgggaactgtcccatcgatccgattcgccaaattcaactgctactcgtacgaattcttggtacagatcccacgtaacaattttacacactattaggactaatttacgagacgaatcttttaagattaattgctctaagatttgacaatatggtgctacagtaaatatttactaataatagattaattaggcttaataaattcgtctagctgtttacctgatggattatgtaattagttttttattagcgaccgaaccccccatgcaacaccctatataatgcctaatgtgacacgccaaaattttacaccttatataaaaaacaccctcttacacgaatttaggggtgttaatttctctgcagaaacagtacggctatttggtacggattcaacctaaatttgtgtggttggtttaaggtcgtccatcaggacaatatatcgaattattgatcgagtagtaggttttcttctcttcttgtttttttctcctctgaaacacgtttggttggtaacaatatgctggaaagtccgaggtagcagatgggatactgaccaaacaacacctgcctcgatcacttcctccatcttttgtcaagaactgcatcgtgcttctctctccccgtttcaaaatataagcatttttaagtatagtgtcaaatcaatcaattttaacttttactattaataaaaaaatcaatcatgtaaaattaatattactagatttacattaaacaaactatcatatgtatacaactctttttatttaaaacatcttatttttataaatattgttagtcaaattaacatctcaaatattatatagaagtccaaaatacctatatattttgggacagagtgagtattgtactaggtatgtgtgtaggtctatagatcaaatattttgctctgcgaaattatgataaattgttgggtttatttgtaggacaggtgatagaaactagtcattccgcctactaattaactcattttaacagatctaaatttctcaactcaaacttaatttatactaaaactcttataaatgcttatgttctggaactataagtgggttatttgtcttacttatttcgagcttatttatttatggtgtgggtgtggtacatataatgatattttcaattcggtagcatgagttagtcagtctcgtactgtcaatttctttttcttcagaaaaaaataatgcacggccaaattctatgccacatcttccctcgggcaaaaaaatcttaagaaacttctatttttagataatagaaatgagttgcattctccggcatctgcccatggacacacagccaacaagattcagaaacttccataccacaactaaggcatgaaggatttaaaatttaagagggtgaaagtttataatttataacttaaatatgggttgtcttttcttttctaataataaaaatggtatacatctccagcctctaccattggacacagcctgaagctttgccaaccaacaaaacaccctagttaatcaaaaggacttagctagtaaacttgaccttatcaacaaataaggaggaggtagatctagacagaagaaggatcaacaaattccctataaatagcttagatcaatgagtatatatatggtcaccaaagagtgttagcttgtatgtaatctcaattaattaaccaataaagatatgggaggagtatatgtgttgggagcaaggtcacatggtgattgcaagtactcagatgtatgtagtgaccgtgctcacatggccatgcgtgaattgtgtaagccacgcaactgacttgcttcaacatatatacatataaaccaactatatatataactatatgttctcacatgtatctatggttcctagctagtacactttaattatatccataatatgcttgccacatgtgcttacatgcaaattctccaattcgcaatgtgtacataagataagatcttgaaaattatttaattgattgatttttttgccaataatgtttgattgattatctccatcaattaaagtggccgaaataggtgacctgtgagtgtgttcaaatgtacaaggaccatgcatgcctttgcctatatgaagtagtagactgactataagaaaagaatattaatcatcaaattttcatatcgttctttaatttcaaactgatttcccaatttgtgtgcatgtcgttctttcaattcagaaattaattatttcgatccttgtctgccggcagcccagcaccactagctagcaatatatagttagtggctagattaattagtgctttgatatcttttgatgatctgtttgaacaaaaaatatttataatccattggaatttgttgggaaacgatctcgttgcagtttattatcacaaaagctagcatgcgtgcatgcagtggtgcttctagacaagtagttaaactttcacatgaattgtgcagcaaaactgggaattgcaggtttatttcgttgtctgatgatatgatgcgatcacggggaaatgatgaaaattagctagcatcatcagatgcaattctgacgctgacgcttaacgagaaaaaatagattttattagcattcactgctgcactgtagccatgcgtgagcagaatggaatctatgggtgtactactcgatcacacattttgtgtgtaatccgttgcttaatcatgctctgtatttgcttttgtcacgaaacattaattcacaaaacatttttctcacgaacacgcaatgggattgcacgtcaatatataaacagagtttttattacacaacccaaccagccagacagtcgttacggggaccaggaaaaaaaaagaaagaagcagaaaaaactgctagagtaaaaaactacaaaagaaaaggtgttgctcctatatatagaacggaggatggcggtggagccccattacacttccaacaaaccctcaaaaacagcagtgccggcgaaagaccacaaacgaaagagagtaatcgaaaaccctgaagtttcgctccttctacaactgtcaaagagatcaagaggatagggagtcgaaacacacggtcgaggaggataaagttggcatggacccaattgcagcccaactagacagcccaaaatactttggagcacgggctagatttgttgtcctcaagaatgtgtgcataataataacatggagttaattaaggggtttcattttctcataatcccttcatccgtgattactttccagttgcagcgtacgtaggtattgttcacatactcattaatattgtgattagaaaattcatcttgttcaaatataattaataacaatgtaagctcaataaacctcaaagtacaggggtaactgcgaaagagcatgtaaactagtggttacaaaagtcttagtagcatcttaagtcctgagttcgactccttgggagtaattttttcagaatttaacgactttgtgatttcagtggtaggcgacagataagcgagacacctatggtgacttcgtcaatctctaggatggatttgcaacccgaaataacttcagagtctaactataggtagagatgccaaatcgatgaaaaatgaagaaatcggcgaaggattaaaaaattgatctagaaatgcagagaagagattaagaatctctgatatactgatacaatgattaaaatttcaggctatgtgggtattaagtaggttatgcatctgagtcattttcgcgggaattctagtaccgtgggttgtttaattagcttgcagcggaatcacatgcatcctattttttttatcaaaattcatacacacttgtgccaattttttcatatagtatacatatatatatatatatatatatatatatatatatatatatatcttgaaatctcgaggcaaataagcttgctcaagcaaatatatatacttggacaaatcgctactccctccgtcccaaaataaatatagttttgcattgttcatgtccaacgcttgaccactcgtcttatttaaaatttttttatgattagtattttttgttattattagatgataaaacatgaatattactttatatgtgactattttttatttttaaaaataagatggatagtcaaacattggataaagaaacccacggatgcgcttattcttggagaggggtagtattataatttaattatcaccactatatatacatatatatacattgacaatcattttgtacatgacatttttacacaccatatgtccatttatatcaagatattcgattacaagacatgttcatgcatcaattgtgatgttaattatgacgtatatacactatatacaacagatgcaattccatattgtatctttcaacacacacaagtatattaattacatacaagtagctagagatcgatcaccattatttcctggattcatatatataaatccttagtcctgcagtaagtagaaaataatagtctatatatatgtttgatacagttcgccgtcgctctacttttcgtcatcatcgccggccacccgacgccgccgcgttcagaagaggaacgccgccggcgcaaacgccggcatggacaccgccgtctcgatgtgcctgggctcatacacacacacaatccatggatcatcagaagcttgcaaatcatcaatggcgagatagagagagagagaaatctggagagagattgcatgtaataacgtagctagctacctgtattcatcgctgtgtgcgcgaggaataaccctgtcggcttcgcggtcggcgaaccgtccgtctctggcgtcgacgggacgacgtagtttgactcttacggcgtcgtcggcgccggcggcgctgtactcctcgtagatgtcaccaactaaggggctccgctgcgtcgaaccgccaaggaacctggccctcctccgccgcctcctggcggcggcgcctctgtcgccggcggtctccgccgacagcgcggcggtcggcgcgtcgtcgattggtccagcacggcagccgcagggcacgaacgacaggagcctcatcagcttcctgcgcaccctcccctcaatcttgccctccctctcactctctctagaagctctctactctcttaagctttctctctctagctagctaggctttctctctctagaaagagagagagatgtatgctcctatttacaggaatgcccgagtggccagaggctagctacctggacctggagtgtgtgacatgtaaggggtgggagatttatagggtttgcggatgtggcgaatgactgaaatgtcccggggtcggggtctagttcaagggtataccttcagaaagcgagatgggacgaatgccatgcacggaagggagattgtttttctttttggaggaaactgtgtgtaaaaaagcttagttgtcgatgttgatatctagctaggtgttttcttcatttgcgtggtgcatgtatgcgcacctcgtcaagtggctgatggttaggcgtagaggaagtggtgtatcacgtctttgtaccaagcatatagtacaaatgtgtgtgcattattgtggagattgtaggttcgaatatatatgttagcattgtttctacgaacgtatgtgtgtagaaagcaccagggtttctctgttactctcctttctccaaaatactactaccgtcctaaaatataaacttttgacttgtccagatttatagctaaaaatacttatattttaagacggagagagtagttatctttctaggatttaaaatgtgttttaaaatatttattactatatagtactacttgtctcatcaaacgtcaacatttaaatttctttacgttctaccccagccactttgaataagacgaatcatcaaatgttacatggaaatcaacaacatcacgtcttttgggatggaggtagtaacaaattattcatgagaatttttttcttccacgattgaaattcatttcttcctaatccagcctagatggcatactaacattttctgagagccccttccaaaagccagacctaacaaagaacagcatgatatctatatagaacgatcattttttttaaggataatcatgtgcatgcaatgcaatgtccggttgtttttagtcaccgttagacacatttattatagcaaacatttattagaagataataaacggatactggattattattagttgacagaggcagcagagagaatcgcaagcaacaaaggcgtcgctagcatcacacgttgcgcgacgcgatggcttccctgcgtcgccgggcatctcaccgtcatgtctagtctgcatctacttacccgtgagagcaacccctgtggcaaccattcatggcaagctcaggcctcaagccctccaagactcctcccaatgatcgtatcgtcgtcgacctccatcacctgattggtgctgaagaccgacgaccgatgaatcggatcctgatcatgtggatgatcagaatccgattccttcatcctcgcatttgttacaaaggagggttttccacgtaaatcttcgtggtcaggttaatcgcgacgacaaggactgtagatggagctctacctcaggaactgtagatgcttcggtgtacaagtggtcagatattatgctgccacgagcgatcctgatcatgtggatgatcaaaatccgattcctccatcctcgcattagttatagaggaggattttccacgtaaatctccgtagtcaggttaatctcgacaaggacgatagatggagctccgcctcaggaactatagatgctcagcttgggtgtacaagtggtgagatattgtgctgccacgagcgcgcaatggcgaggcgtcgccgtcggtggtgttaacgatggcggtcgccgcccgacgccgcgacggcggccatgggaacgcgtgaggaggcgccgcccaaagaggggaagcatccattgttacaggtgggcaaatcagcaatggtaagaagaagaggcagtcatgaacagtgtagctgcatcagctggcaccaccaaaaacaactcatgatccaggcaataactccgaaaataatgcacaactgaa

SEQ ID NO: 67962 - DNA, 1313 bp, Oryza sativa
aatcttcaccaaccacgtgcattgaactctagcctaagtatcccgcatgatgtctgaccgtcccggacatcgtcttatccccaagccgactcccgatcgatcactgtaaatactcccccgaggcatcaagtcacctacacatgaatcaaacaaagaaaccatattccgagaccaagctatctccaatttgactcattagtagcaaccaacagtattacatacgtatagaatccatctagaagccataaatatgaaacaaacatgaatatccaaataaacaactcgaaaatgaaaccgacacagtgtcggccggtctgaccgcgcgatacacgccggtctgaccggcaactactgcccggtctgaccggacccaaatcagcagtaccaatagatcacctgttaaaatccaatcatctccaaaaccacttcgcaaataaattccaaatataaaaaccaataatctccaatgccaattgttcatcacagaataataatcaaaaacacctttgattttacaatcttccccttgatgaacacattggcaaacccataaaaaatgttttggtgtttagaaaaataaaaacaaaagtggtaaaaagcacactttgtacaaatgtacacatcgtgctcaaaaatccaaaagaaaacttctctcatttttgaaaagaaagaaattcccccttgaaccaaaaaacatgttctcttctcaaaaactcattgtttctcccccttttgacaatgatttcatcaatcataggaattatattcaataatgttcaagagtttagcatacatatagcaaatcaagtcatgtgttgcaataaaaagaatatgaacccatctataatatagcaagcatgcagtaaagtataatcatgaaccagagattttacaattaagttcaaatcaacaatcaaaattcatgatttcatacgatttataatgcaacatcttaacaagcacataggttgaaaaacaaacactaaacatatatacctattgcatttatcactctttctcaaattagctctagcacaaaacaaccaagagaattttttgttttattttccttgagactttttgctcatattttctctctcaattattccgagtacgtccttgtcgtcaagactgtttccaaggattcggcacccattatttttgctcacatcgaatacgtctttgtcgtcaagactgtttccaaggattcggtattcatttttttctctcagagatatttttattctctttgcacaatgagcaattacaaagctatttgaggaataacaactcaataaagcatatatatataa

SEQ ID NO: 67963 - DNA, 1105 bp, Oryza sativa
atggagtgcgaaagatgtgttcttgggatcctttttctgattattcccttcccgccctgttcttcgtggaggggtgtgtgttcttgaattcagcaatgcgcgactgcgcgtgttcttaggttgtactatgatatatatcggttcttgaattcgcttgtggacgaattcgtcggattgttagtggagcactcacttctgcaccaaaaattgtgcagaagttactttttttttcttgtccatgatggagtctgttagactgcatcggaatggggtacttctggaatttgtttgtgattatatcgattctttgctcactagtaaaatgcaaccttttttgttttgttctaattttgcctgctgcttactgctgcaccaaaagcaaaaggaacggcctttgagtcctgacaagatgtgcttcccattgttgttgtttgtttcatacgcatggtgaaggtatacacttgtttgtgtgacattgtctgtttgttgcttttggatggttcttcatgatgttatcaatcttgtctgaacatccttctgcgatagctgggtggttttgcaaaacagaagtatatatatgttcttttttttcactctatttgtattcatgaattttgcattttgtaggtactactccatgtatggccatgttgcaaagctagcagaggagatcgagaaaggtgcttcttcagttgaaggagttgaggtcaagctatggcaggttgtaccatgaaagtgattttgtgctttacctagagttatgattacccgcatgttttgtttaacatgttgataaaattatcatatgactaggtcccagagactctttctgatgatgtgctcaccaagatgggtgctccttcaaagaaagatgttcccataatcacacccgcagagcttgccgaggctgatggtgtcatctttgggttcccaactagatttggaatgatggctgctcaattcaaagcattcatggatgctaccggtgggctgtggaggacacagcagctcgcaggcaagcccgcgggaattttctactctactggttcccagggtggtggccaagaaactactccgtaagacgcttccaaattatgctgaaatt

SEQ ID NO: 67964 - DNA, 11770 bp, Oryza sativa
aaaccaccaccacaatcccgttttctcgacgaacatccgtactacccgaaccacccggagaaagaaaaaaaaatgctgaaaaaggaaaaggttggggagctcacactatgtagatcttggcggccatatcgaagcagaattctggagattggaatcggtggaaagaagggagctgggattgcgatgtgggaggaaggagggaggacttggggcatttatagctgtggggagaggtcttcgccatgtccatttgggtctaaattaaatctcatttaattcattttttgaggcaaaaagtcatttaattctacccgtataaaaaaactcatttaattccttctctttttttcaccgatgtattttgggttatcaattaggagtactccctcctttcaaaaaatattattaagataagatttagtcaaacttttatgatttattatcgattttgtatcagaataaatctacgtatatatattttaactctacatttaaattttttttgatgtttgggattctaaaagctctatcaaattttgccctaatcgatatttatgatcaaatgaaattacttttactccaaaaaatactttatattgttaaaattgtctttgtttttttaattcccttgtgtttgatataactgtaataaaattacacgatctttaaaaaaaatactctagacgtcgtgtaatatggtaatattgtattttgtagcacgaaaaatgtccatatgtgatttgatcatctgaagaaacaaatggttttttttctcctttttgcaaggattttccaagcaataatatgcaatactatatggcagtactcctacgcaattgtgcacataactttagcttgtctttccaacccagaaaaaaaaactttagcttgtctctaaatacctttataatactatttaccaccgtttgtcacgtttgccatgttgaacaattttatatcaagatcaaaaaaaaagagaaaaagaatcttcattgagatttacgacaagtaaataaagattacgatgacacaccagatgccaaacatttggaaaaaaagttgcattaaaaagcataaaacacgagatgcttggaatataagagcaattggagaaaacttttggaatgaataatcatgttgaaagggaatcatgttacatgataaatagctcaatggtgtgatatgctatgcatttgtctaatgttttacgaagtataaactttttaaagtttagtcaaaggatacaaaatgtgaaaattctcaaaataaaatttaggttaaatacttgctagcaactgtagtaactgatgtgtatagctgttcatttaaactactatgacaaactaataaaatcgtagtagtacaacagtatccataacaattggttgtagtttcttttaaagtaaatatcagaatgaattctattatcaaagaaaataaacatgtaacctgcagcattgcacggatgtaagacattgtcaatatttgtcccttaccgcgcaagggaaaatgaattgcgcctcccttgtacccagattctacaaaataacaatagatatcactacttatttagcaacgaaatgcaaacataaattaaaattgtggtattctgatggttgaagcatgatcgatgggcaagggagaaggatgtgcatgcatgtcaaaacttacataaatttagattttagttggcaacgaccaattaaacagagaaactgaactttgtagctactccctccgtttcacaatgtaagtcatcctaatattttccacattcatattgatcataatatatctagacatatatatccatttagattcattaatatatatatatgaatgtgagaaatgttagaatgttatattgtgaaacggaggaagtagtcagcaaagtcagcatggaactacggccggctggccggcggcgagctgccgcaatccgtgaatccgtgatggccatttcagtcttcagaagacgaatacaaaggcatggagactacacaccggctgcctacttgactttgtcagttacatgagacaaatgtgtatatggagtagtccctgatccgtaagagctacgtataagcatcacctgacttttatttgctaactatgatgccacgtaagtgctacgtacatgttacgtggaacggggactgagtcagcaagcaaacagaggttgatccagacaaagctttaggttaagtcctcttttctatcaatgtaagacatttttttagagaggcaaagggcaagtgctatgatagatgtgactaccacctccaaatttattcatatcattcactcataatctaggaaaagggtatgtggttgcagtgacttgagtaacatcttaaggttctaagttcaaatctccataggagcgaatttcatgttgggttatttgagctccaccctcaagttcccatggtacaagtaccgacagtggaggctcgagccctccaccctcatgatagatctgctcctaccataaaaatgacatgtatcaaataaatagaaggtgtgagacttcgaactcaaaccggctagcccaccaccttatggagctagcccaaaaaccctagaggtttctcgcaacagatccgctcctatcatcaagccatatatgagcacacattagtcgaagctgttatcaaatactgttgatgggcttgatttgaaccggttttagaaggtatgggacgctttatacccgattagttaagggatgtgataaaatccccatggttgaggggcctaaactagactttttccttgttatagataggagtagctctagtcttttccggtccaaatatctggtggtaggacttctaattaggcccaaataatttggtgagcccacttcccatttatatttttatacgtgatatattgttgggtgggaacagatgatttttttttcattttctaagattcttttgagaaaagttagaaatagtcatccgtataacttgttattccactttcctttatatttgccaccaagcactattcatatttaaactttgatcattcatcttattttaaaaataaaattctaaacacgtgaatagatatcatattatcaaagtgtctcatacttaaaaattcattataatataatcattgaaaaattattggtggtccaagttgcaacagcaacagtcaacagtgatatactctctccgtcttataaaaaataaatatagctagtacgggatgtggtacattctagtactgtctcgtagtattaggatatgccccagtagatccgttgttttataggacgaggaagtataaattaacggatgtactaccaggctgataccactaccctaacctggtaatgccaatgtcccccaacactgtcatgaacaatgtgtcataaatcacaagtggatgagtttcctctgcagcaacgctttctgacgttgatcaaagacatgtggactcgcgggatatgcggtccacatgtcagacacttaaaatcagagggtggtactacaaaggatctatttctctcataaatagcttgcaacgtcatggtttttttccatgcggtagaattttccaacggagccattgtatttgttattgaaaaaggttcaggtttagatatgagttggaaagggaaaaatttttttattttacttttatctaagataaggttcggaacaaataattacctgaaatgctcttagtgcattccagatatattacattgcaaaaaaaaaaacgtggtacacatttaagtatgtaaaagagaaatgcagtgcacaattttcaatagcagtacaaatgatgcaattgaatgattaatttacacttgtcatttctgaaaaacaaagcagttgtacgaagtagtagcaaataattcaattgacatcttatgataaaagtagatacatcgctacattgaaaatacatacccccgttctcaaataaaagcatttttagactatccagattaatattattgaggagaaagatttctttttaatcacatcattagttaaattttgaattactcaaattccctttctaagtttctaattggttaaaaacacttggatttttgcgcataaattctaatttatagaaatatatatttttttgaaagtacaagagtgcactacatcacactcctcctgaatgggagagagagagagatgtgattgcttgcattgttagtaggaggtgtgcatcttccttctctgaacatccagcccgacacaaatcgcattagcagtaaattttggcacggagaaaaatcagagcttgtgaagttgagtgaaagaaacactacaattaaaaggcacacgtggacaataatactatacatcagcctcacctaatcacagttggttgacgtttttatcgatcatcactgctttactaatcaactagctgatgactagtcaacaatcagctagcagtcccgtgtcctaagtagattctgttcaatgtctctttgcgcaagttaagagaagaacatttgactacgactgaaaagaaacctgctctgcaaaactatctagaacagtttgtatttatatgggaagatattagtaatttaaccttgaaagtgcttgcattgttgaacacctactaaaggatgcgagaatcaggggcggagctagacaagagtggaggggggtgcaccactatagtagcaatttttttttctcaaactacttcctccgtttcacaatgtaagtcattctagcattttccatattcatattgatgtttagattcataacatcaatatgaatgtggaaaatgctagaataacttacattgtgaaacggagggagtatattattgtaaattataatgttttcgtgtattatcaccatcaacggttcaacataagtaacaatggagtcaggttaataatacggagtagaatacttccttttattttagtcaagaatatttagtgtctaggataatacgttcagtcaaaattgtaagttctgaccatcaaatttcttaaatacttaactaaaaaataaaataaatggtagatttgtctccaaaagtataatcatccttgagctttatcatgcctcatctgctgactttcttttgcattgctagtattaacgagaggtttttttaaagaaattctccataaatgcacatctcatttttagtcatgcaacaatatttagataaaataaaagacaataactatacatactatcctaccatggttacattgcatcacagtatgtatatatattttctctccaacgaaaactattatcacgcaattcaaaactacctatctttcacatgagttcttccaatgaatcaaattaacttgtaaagaattatataaggggacgaaaggatagaggagattgcaaactgcaacgtaactcatgctgtggttatgggccgttcgtgtgcctcctgtggtctgttttctgatgtagggggttcactaagctgggagaaggggggtgcccatgcggtaagtaagggtattaagcactaatttttcttttttcgctagccgagtgcccaggaactccctaggatgtacttagcttcgccctggcgagaatgtgctttttggctgagattttgagggcgttcacagagcacctatatggtgttcaacctcaacaccaaaaaatgaatattcatcgcaacaccctccatctgcgcagcctcctcaagaccacatagccaacttgagccacgggttcctcatcagggtttgcaggtgaggccaacactcgtgctccgcaccatcagagaagagagagggaggagagatacctcgtcggccatcccgcgctctacatcgctgagtttgttgatcaggggaggagggtcgccgggcgctcgccgactcaatggggaaggcggcagggctggagaagctcgccgagcatgctccaccggtgaggaaagacgccttgtttcctccgcccaacgccgccggagaaaggagagcatcatcagagaggggaaaggccgccgacggggagagaggagcggcgccactgcggggcaggtcgcggcccccggcttcacgcggttgctcccgccgtctctccctcctgcgtcaaatccgtgccacgaagcgcttgcccttccttgctcccgccaccagaggttgtcgccgaggtgaggaggtgttggatggatgggcagcgtggaggggattaggtggggagagagattttatattactttcttgattttggatgttaactgcaaattttggaataccatgttaattgaaaaaacataaaagagactaaaatacaaaatgtctgtaagtcccaccatagaaatttttttaaaccacatcttgcatcctttgaagttgctaagcctacatggcagctgaggtctagcaaattgcttggacgcattgccattgcccttagcgaccggtgaaacgatacgaatgattaattgagatctttttcactacctaagttgttttgtaatggacagttcgattgtcactggtatgtgggacccccacgaaacaaatcaacaactgatgaccccacaaattgatcattgagcttgcataacccagacaaatgatagagagaagggggcgtagccccacgaggatggctccaaaagtctccaattgcaatccaatccaatccattgcatggcaaaattcgacacgtggcagtgattaagcaagaacagatcaagatccaaacacattgtgatcgaagtttgccggctagtatacacagtcccaagcttttatcatggaggagatgtgttcttggccaaccacctacaacctccaatttggcagcattccacttggctacaaaaaggttgtgatcatccatgcatgcattcagcatgacaaaggttaattaaattaaaagatggatagcatagcactattagtattagttagtttcaggtcaaactatctgtttggtgagtgactaagaatatggtaaaatgagttaagtgtggctcctcttgtgcttcttttcctactaattcaatgctgtgaatgcttgcaaagaaacagttgaggaaagaattagacacctacctaaaataactgaggcatgaccactaaggtttaagcttttgactcagaactggacactctaaaacaagaagaagacaatacatttcacaaaaccacgtatatttttacaaaaacgatcaaaactataggtttaaaacatcacatcataaaactataggtttagcgttgaacttatcccgaaactaattcaatctaaaatgttaaaaatacagttttaacgataaatttatttaaaattatattttgagaggttaaaacctacagtatcattttcataagctactaagagcaggtacaatagcagactataagcttactataaatatattttaaaaagataaaagaagagagaaaagagcagcgggctacagatctgtagccagctgcagcacagactacaaaacgtaatgtgtatatgacatgtggaaccaggtattaatagtatagtaagcaactattgtatgaattggctgttacattggctatagatggtttggagctagtagccggctatactattaaacttgctctaacaaacgctaaacatatagtttttcggtactatggcttaaggctgtaactttgtgatgaacttgatattataatttgcggttttgtaatattatggattaaagagtacatatatactcacacatatctagatttatagccaaaatatctttatatttagagctagagagagtagttttgttaataatgctagtagtttcatgaaatttactactactactcatcaaagaaataatagacatcaatgcccactgatcagaagaggtagggcacacaggatgaaggaacagactgaagagatggcacttttttttgtgcatgatcacttgagcataaatgcaaagcaatgctggggcctcaagacactgaggcaaactgtagctagagactcattgtatgcacctccttttgacaacatcctctctccgaaaaatcgatctattcgttgcccttgtccccttatgcctcttcttccactgctctcttctttgtttcttgttatcaccatcatcatcatcatcgcctgaatcagattccatgcatctcatgatgttcacatgcatatcagtccatgataattcagaaaacaggtttatactctttctttctcatgaaaaattcagactcagattcatcattcatggaggttttggcacttctcttccatggtcacaatctgttgaagacaattgttatgagtacatagtctttttttttgtttttttttcttgagtgaatggaatagagagatgaacagtcgccgacacggaggccccacacgacagtgacaagaggcgtcgcgggcattttcgacctaacagaaaaacattattgtttgttgttttgtgctgattgcagaagcttttggtgtctgaggatggtgcccacagtggtactagccattatactgaaagatggaccacttgtgttcttatgatgcaatgcaaacctatctcttcctgctactattccagtgttatgatggttttcctccaggagcattcaccattcaggagcagctttggagaaagcttacatgagagagcagttttcagaggaaaaaaaagattacataaaatagattcaaccaaactgatggaaccagccttaacttgatcctttgcaagatcaatgctaatgccacaagctttagttagcttggttgatagtgacagaacagttctttactgaacaatgagcatggttcatcttttccgattgagtgctggattctgaccctagcggtatgacgtttttcgtcaaattttactttttcaaatttgaattctcgaaaaccattcgacatttcacttggaacctacttttgcctcgtgtcgaaacctcaaaatttcgtgggttttgatcggttttcatgggaaaacataaaccctgacaatgagtgcaatgatgaacaacacaggagggagcaggcatacatagatttgccacagtccacaaccaagaagagcaccaaaatcaggaaaggaacaagtgcatttcaggaaacagctgccaatgtgcaatctgaaaaattaggtactccacacctgaaatggaggaggatccagtggatgagtacttctccaatctccatcctacacccccccagatgttgctacaaatgcaaaggactttctggtgatgatatcacatctcacaccattttctcattcagtctatgaacatgaataattgaattgaatacccccattgcacacttctgtactgaaaaagttgccaactaactctgccatatgtgcatggtcaaactgaacatggtactagcagtataatttcaacagctcggtcaaaaatggcgatcactgctactgccaaatcagttcagaaaaaagagtagtacatgaccatgaagaaaagctgctgcacatcacacagttgcatttcatcacctgaagcgattcagggccaggggttagctgatgatttgcatggtttgcaatctgcatgacttaatcctgtccacttaacaaaatctcaaaattagatccctgaaaccatttagcaatcaggccaatggacttttgttggcttagaacaagccatgcttccaaatggacataccaaccacctccaagaaaagtttgtggtcaaggtcaacccttatcttatggttgctaggtttccattcagacattgtcaacatcaaggccacatcaccactagatgatccactaagtttatttttctatgcacttctagataaaccaaggagctgtgcacatagcaaatcaacagaaaaatcgtacctttttgttgcacataaaggctaagtagctagcaattagcaaaagtaagggttgctaaatgctacaaaaacaatcaacaccttcccctgaatgacataggagaaacaaccaacataagctgctaatttcctaagctagttattgatcacatcgaatcttatgaagccccaccaccgctttgtcaccgactaatgagacaaatccgtgtctagaccttttcatacttaatcagatgtagaaattgcaagtttgttgacgttgcagaaactagaccatctaaaaaaaattttagggtgtccttgtcagataaaacaataagcaaagttgcatactagccactcacttgtttagcaactacagtgacacaagcaatctcgtcagtatctcatttcttggctacaaactgattgcatactgtttctccatgcaagagcatctgaaaattttatccaggactgatacagaagaacatataatttagaggagatatgttaccttgtcaaattctattagccacttcaacaaaaaacaggaactacagttagataatctagactaatttaaagtccatgatatcaagggaaatccacgagtatgatgtgagatctccaatggcaatttaatatgggaagcaaattggatgacactccttatttaattttgacgtggaaaacatagatagatgcacgaggtttaagtgcaccacttgaaaaaaaaaaaagaaaacaagcattatgtgatatgtcaaacctcacataacaaaaatatctgatgaagtataaatcaagcaaacacgaccagaagagtttgtgagcaagtgaaaaattgacaacttttgcgcttttctaataaattccacttcttatatcatatagcattacatcacaatccaaaggaggatgataagcagatacacacaatcgaaccctcatatcaacaacacaagattgtagtgaaaaatcataggaatttcacaggagacacttgagagcaaaaaagagatcacttgatcatgagatgtatcatatatcatacgacatttcagattggatgattttgggattcagaattcaatccagaacagaacaccacagaaggtctgggtgaaatgatgagaggaccatgtttttctaagcatatgaacaaaaaaaaaaggaactaaattctacttatttttttttcttcttcttcttcttcctttcgacgctgctaccacatgaaaagagaagggaaatgaacccaaccaaaaagaagagaagagtagaccccaaaaaaaggttcacctttgctgtttctacctttgtacaccgagcccaacaccgattcgaagaggcgccgaatcaaaattcgcacaaatttgatgtttggagtttggatgaaattcatcaaagcttctcgagcgtccgagctaattccaccgcgttcttggcaatcttgcagttgtcgtcgttgacgagagcctcgcagagatggaatgctccgagcttgatcgcctccctcgccaattggttgctctcgccgcagatcaagttgaggacgacgagcgcctgctcgatggcgcgcgcgttgccgctgccggcgacgccgacgagcacggcgacgacgcgggggatcctggacagctcgtggcgcccctcgcgggacttggcgaagaggccgagcacctcggcggcgcgcgcggagcccgcggcggcgaggtcgacgagcgcgggcgccgccccggcgcgcacggcgcggcgcctgttctccggcagcttgcagagctcgtacagcgccgtggcggcctcgcgccgctcccgcgcgccgccgccgcggcggaggaggccgaccagcgccgggacggccgaggggtgcgccccgatggtgcacttgttgacgtccaccgtggcgaggctggtgagcgccgtggcgg

SEQ ID NO: 67965 - DNA, 6979 bp, Oryza sativa
acattggtttctggatagggaggccgacaaaaagtggaggagataaggacgcaatggtgttggacataggccacagctagggttgacaacccaaatatggggttggtgacaaccatgagaaataggaacgatgaagccagcaccaatatggaggagtgtgcggagatgagccatgtgggtggtgacatgcctgatgggcaggtggatcaatggggcaccgagcaagatggagtgatcccacaaggagactcttaggcagcggcacacggagagctcagggctgtgttggtgcttcacaaccattgcctcttcatcagagccgcatcactatatccagttggccaaagacacattgtgtttccatgaatgtggtgagccccagggaccataatagatgggccgtccagcaaaatggcctgtagatttgctccggaggagggcagccgtgatgtaggggcccattagtggtgatgaggtgcgcgtggtggagctaggtattggtgcgcaaaagaaaccgagacttgaaattgccatatttgttagaatagttggggtacgcgtaggagcattgggtaaggggtggcaaaataaaccgagactggaccccaaaaataccaaatgtgatcatcagttcctagcacggtcttaggtttgagaagatagatcccttgttcggtctttttgtttactacaccgggtgtctgaactaccaacattatacttatctcctctttattttgttccttatctagtcataccattctcttcgatctctcattcgccagcgccgtttgtagtctccgggtctttcatccagccgcaccctatctgctatatatatagaagacccctcttctccctcgttatcttccatctcccatctcctcccgcctcagattgccgttgcttgttcaccaaacagcactcccctagctctctgtatggctggcccatggccgccgcctgcctggcgcttactctaggttggtccgtccattcctatcacatgtgctccgggttccacgcatatcgtccagcgtggtcactttcactatggccgaagaaggagaatgaaagatatcaattttttttatcaagtttgattgtcattttcgaaggattgaattacccggatcaatatctcagtcatgactgaatgcccaccactagcgctgcgtgggggtttgggggcgtgccatatagtagtcatactaataagatagtaactataatcaaaatttgacatttatagcccgtacatatgggttattgtctaatgatccataaaagccaagctttcaaaggtacaagcccttacaaaagtttaaaagaaactggtggtggtgatggtgtgatcgactttatgacaagcaatgtcgaaggaaattaaaccaaagcaaatgatacatgtgtagacatgcatggagggcgcatccacaccaagcactacgcaatcacgcatggattgatcccttcaggtgttcttggaggaatccatggaacgaagctcccggatacgtttccgtatccccaggcggtacttcacgatagccatctggacatcctggaggatgtccacggtcaggtcatccacgttgttgcgacggcctgacataaggtcgcagacgatgagcttgatctccaattcacggttcttgcgtcgcagttcctctagcctcgctgttgcggcggcgatctgctgctcgaggatggtcttctcgtcgtccagcatcgttgcctgcacaaaacaagtaatgggatcgatcgacctctaactacctctatgtttggtgtatttgatggagtgatgttgtgagaagaaaaagcaactaaggcgctacttttatagccatatctgggtgacacaaagaaggaagttattaagtgcaaagatttgatatcatatccaaattaaatgcaaataaaagtataatgagtatatacttaaaatactacgtacacccgttgttttttaatttttatcaattttaactggcattgtattacattcacaagtattaagaggtcaactttttcgggctgtaaatatttgacagtgataacgatatttgagagggagcacaaatcgggtgtacggcgctgtttcacggcttatatgaaaatgtgcacttctagataaaaaaatgttgcaaatgattaaaatggtgaaacatagttgcataaagattaaacatttcactcatgcactagaaacatcaggattcaactgttgaaacatcaacagatgcacaagtatcggagtaaaaaaaatgaaagaccataagaatctctactaaaacattccgatcaatcacaaagaaacatataaaacatgtgagctgaaacatcgaaaaatcacaaaatgtaccaatgtagatctctccttggtcgcctgatcagagcttctattgatgaacatgtcagctatgatgtggagacccggtgctccataccttggatgaccataccttccttgtcgttggagtcaacggcaatgaccatctccttctctgtcgcttctttgacatggtggtgccgtcccctcctcctctctgctggtggcctcccagatgtcatggcttccttggcaaatcattgcgcctcacaagcttcttgcttattccgccatgacagctgtcctccccaccaacatcaccgccggcgaccacagaagtggcatgctgttgtcacagtgcctcgcttcagtatatgcagtgtgaggattgagagacactagaagagatgagaaggctcatgtgtgctagctggtgttactgggaactgatgttgaagataggtcctaatgattagtaaatgaatgcgatgtgatgctgccttgtgtgctagccggtaattggtgtaaattgtgatggaaataagagtaaatgaattacaggtagacaagaaaaacaacgctcactgcataagttatatcaggccttgtgtgacataaatagatcaaccatcccacaagtctttgatacctctccttgttcacctgatcaccggattcagcacatagcttatgattttgctcaattggtgtagaagccagccgagaatcgagcataccggtgtcataaagtaaatccaatgcatacttccgttgtgacaagactatccctctaggatatcttgcaatctagatgcctagaaagtattttagttggcctagatccttgacttcaaattccttacttaagttttccttcaatctagttatctccatagaatcatcacctgatgatcatgtcatcaacatacacagcaagcatagttatatggcatccattatggcgatagaataccgtgtgatctccattacactatatataccccataccactaattgcacgcttgaaatgatcaaaccatgcccttggcgattgtttaagaccatacaaagactttttgagtctcaacacctttgctctagtttgtaatgtagcaaaccctggtggaatttccatataaacttcttcctgaaggtctctacatagaaatgcattcttaacatccaactagtagaatggccaatcaaggttggccgcacaagtgatcaaggttctcaccgtgctcatctttgtaataggtgcaaatgtttcatcataatcaattccataagtttgactgtatcatttatccacaagtcttgccttatacctctcaatttttccatctaggttttgcttcacggtgtatacctacttgcaatcgaccactttcttcttgtctgggtagggtacatgatcccatgtcctgtttttctcaagagcttctaactcctctatcatagcttctcacaatcttggatcttggcttctaaccaatctttcgggattgccactgaattcaatgatgccacaaggccttgtaagtaggtgacaataaagagtacaagacatagttagctatgttgttattatcaccaccttcatcttcactttcaaagccatatctttgtggtggttttcccgccgcgcttcttgtcccctttcttatggcaataggtaattcagattctcctcccccttcttcagattcctcttctccttgccctaactcactatacacctgtatgggctttatatgatctaacatttgctcatcaacctcagcatcttgagatcatagccgctcgacttgttgtattactggaagtctacttctctgtgtgtaaacctgtagattctcttcttcacaaggctttctctactccttttcttgaacaggatcacccacacaacaaggaattgaaccaaccacaaccttcgtattcctttattgaataatcctcttcggagcccaacattgttggtatttcttaacctcacagataaaatccgcaagcgcaaaataccgatgtagcacttcacccaggagtattccaaggtatcaatttccacaaggaccatgtgtgtcgactcttcaccaggttcatccaaggatacgaagctaagataggctaagggtagagatgatttactagtgagagatagtgtctacagaaagctcaatttaatcctaacaaggtacatcgggagctggcttcgggcgctggccagcctgctgctcccagatatggctctacaacgtacacggacagggaggactttagtattttgagggctgtcaccacctctacacacacctcaaacctactgtgagatacgaagcaagaatgtgcagatgtgctgggggcttcttttgccggtggcaggtctcgtggatgtgcggatgtggagttggcaggacgacgacttgtgctagcatgaagcaagaatggggcttgacgtccgcggcggtgacttcctcgttctcggccgagtgttctccctcctttcggtttccccccttctttgggcgaacactgttctagttgtggggaacgctaaggggagggcggaggctccggcttgctgtaggagtttgcggcagattgatgatgtttcacgggtggacaagggcctgtctttgccgttggttacggtcaagttatgactgcttgtgagatgtcaaggactatttcgtggccatcaatgtgggggtgcttgtgtgggtgatgtgaagatgctggcgaaagccttgccatgcctttggccggttcgatgacgacggcgcccgcgggcgctgtttcccttcttggaggcgttgtcatggcgttctttcatatccccccccccccaaaatctccaggtgaaaaccttgttccgattttcgaatgagcggtgacggcgttacgcttcgtgtcctccttgtgggtgtcacttcggagaagttccaacgcatcgacgactgttgatggtctttttcagttcaaaagatttcataccttgtgttcggtgaggccttcaccttcttgggtctgcttcattcttgtggtgggtgacatgctcttcggttgtttctgctgatgaagtcgaagctgctcgctaatggggtgcagtgaagcttggcaacatgacatgttgcagtcttttccaaggagttatggtgctggccatgtgaaggaagaggctcctcggtggcttggctgatgtccattgttggatgtcggagctgcttttcgcattggcgactttcgtggcttcagtgtcgctgcagttgtgaagtcggcgctgctgggtcacttgtgtggctagctcagcaatgataacacctcttttgcgatgtgggagcttttgtgtcgcttttgtgtttagcttggcactgacgtcctgtgattgggctccgccgtcgttgttagttgtgtagcggtgggtttcagcctttattcctgtaattaaccgtgcaattgtatggttttcgggcccggttttccttataaactgggtcaattcttttcttctaagtataaaagtggaacaatgttccaccttaggtttcaaaaaactaattgtagcagtactgcttgcttctctgtcccaagcctgctcccttgcttcccacccgaacggcgccgtcgtcagcttgtccttcagctgttacaccatcaccaattcaccattcccctctgagctctgaattctgatacatgaagttactagtggagatttttttggtttggaagcctctcgatccattccattgctctctcagttatacacacacttagggcctgttcactttgctgccattttcaaccttaccaaattttggtaaagttgtcaaaaaagtggctacatttagtttgctaccaaatttttggtaactatataagaaatcatgtcaaaattttggcaagtttgccaaaattttagtaactataccaaaatttgtcaatgccaaaatttggtaaggttttttttggcatcaaggtgaacaggcccttagacatactcagcccaacatcttcaatccaatgcttcatcctaggaaacgtttccagttctcccaatctgtctcatacattaatgttgtactggtggttgttcagtcgaggccctgtttaattctcacgcaaaaacttttcaccctatcacatcgaatatttgacacatgcatagagtattaaatataaaaaaactaattgcatagattgcgtgtaaattatgagacgaatcttttaagcctaattgctccataatttaacaatgtggtgctacagtaaatatttgctaatgacggattaattatacttaataaattcgtctcgcagtttacaggtggaatctgtaatttattttgttattagtatacgtttagtatttcaaatatatatatccgtatatctgatgtgacacccaaaaccttttaccccctaactaaacacagcctaaatacgaagacacaacctaagtatgaagtggtatagtgacaataatccagattcctgtatgagttgacatttattttgtcctacgtacaatttctctaatttgcgagttttcttgctgcactctgcgtatatacaatcccatgtaagggtgtgtttataggcggtaaagtttgggcgtgtcatatcggatatacgaacaca

SEQ ID NO: 67966 - DNA, 10074 bp, Oryza sativa
aaaataatgcacaactgaaaatctcaaatcaaagaaaggaataaaatgtgttcctgaaatgccagattgtgactgtaggtacaccagtgaagacgccggcatcaagaggaaattagtactgcatctagggcacaggtgtaccaatggtgagaaaaaaagacagggagatgcacagttgcaaaaccacatctggcaagaaaaggataattgcaaaatcaaatgaagtacaagaacagagcgcaatatgtaacaagtgcatgcactgttgatcacgaatgaattgcactctgcacagatcagcttcaccgtcgctgtcagcagatcaggattttgatcaaggaaaattcagttgtaccttgtcatgtataaacgtgttattctgagcaacgagtcattatccagtacatgagcagcacatgccaccagctgataagggctacgacaattcaaatgaaagggtgactccaacacaaccagcacctcatgagtcaggacaagcaagacatgggggtcattattagcaaaggtttgaagctgttcgtgtcctgttgcgcgttgatagtaatattgtttggtccatattcagtttgacaagtgcttctccatgcggaaaccatgggatgcaagcaaacgaccactccaacacgataagaatattggatcggaaactctgttcacacctggaacaatatggtatagcgataaactaaatatagaatcaataacttgtcgatccgctgtgagccccacggccagatagagggccccaagattgtatcttcatctactgtgcaccccaggaactggatggagggccccatgatttgtgtggctgtgagttcatttctggttcctgcggtggtgttctgggtctagcatattcagcaaaaataacccatccatcgagaaactgcatagaagcagagatatatcagaaaaaacctgtgcattatgatatactgcagcaaggctctaaaaagaagcccaaaatggtcaatgatattttcaccagttgctttcagagtatctaaccacaccaaataaacgcttcattttattttcactatggtagaaattagtagactgaaaaaataaataaataattgagagctcagccattcaagaaagcataaattatagcatgagggtcatgtgggcaatagttagtgtatcacatacgtaattttcttacattatgtgtgaagtattgctttggtgccacaagaattcaagaatgaattaagaaaaatatggagtatcattgctaatgaggaaacatacagagtaaaatattttagtatctaaatataaagcaaaaataaaaacaagataccagaatgcaaatttgtattaagattctaaagacagtgcagaaccaccagttcacgatttttgttgaagaaatcagtccaagcatgtctgagtacggttcatgatttgccagttgcaacgaagcaacacaagtcacaagtcacagcgataacatgtaagaaaacaatgtaactattatacttgagcattaaaaggttagcgtataccttaaaaattaccacagaaatttatcaagatatccagcatctagcacaatacaagctatatgaaatgagtgcatgaggctgatatctgtgttcttaagaatcttgcacatagtaattctggattattcacacataattatttttaaaataatgaacatttttttttgcatttttgttcttcagagatgagcacaacaagaaagaatgtgtgcaaaatatatcagagttgaattgtggtgagaccttaggtagttagcaaattgtgctaccaatatcataataaaaaaaacttacacatgaacttgaaaagtggtaacacatgccctgtctgcttgtgcaaaacacaaagagtaaacctgagtgaccacgatgctctcaatttcaatctcaggataaaatgtccagaaaaatgtgatgcctatgatgtccaccccatagcatgtccaagttattaaatagtactactatagtattgcacaacgaacatacgctcacagtttctggtcaactaggatgcaaatatctatacttcggtactgtcaaaatgagatacctgaataattctacaacatatttagtttgaaatagtctgttgacaaagggtgcctaagcaggctccctgggctctacctacctctccaacttgtcctgctttctctgaattccacataatcaaatcaattctgtgtatatattaactgcctatgctccaatacaaaactagctttcttactgtttccgcctttccagtggcagccagtgaaattaggcagttcttgtattaaaatttttaaaatgaggcataacaagtagagaggtaaggtcatatattctgcttattgcatcatgggaactgatcattatataaacagtgagagttcaacacaagagaattgaggaaaaaacaacaaatcctaacaacaaaaatgatatgaaagtatgaaacatacctttccatccattccttctattcctttagctgcatcctcaactgtagcataccttacgaagccaaaccccttagagaatccagtgacacgatctgtgacaactcgagctgcaatttgaaatcagattgaaatagaactcagtgtcttgaaatacaaaggatgaaaggaatggctgcattttaagcaaacataccatgtatgacttccccaaactttgcaaaagcttctttaagcccatctgttgttgtacgcttgcttaagcctgcaaacaaggatgctaagatgggagtccagagattgtgtgcaacaaggctcaacatgcaaggaagcatccaaaatggaacaacattattgaactttaaattgtaagacggtaaaacagggaactggtgctagctttaagtaggtccgataataatatggagtacaagctcagaaagcttgcacacattttgtcactacagataaggaatttaggtcagagcaccataagtagacaaaatttaaataatgtttattaagtgattgtccatttcctcagttcccgcagtgaatttccttgtgtcgagcatgtagaatcaagcaagcagcaagtgtggaaaacgccgaagacctgagcttattgggcatggactcaattgttcgtaaaactaattgaatcaagttccatgaacagaaggtggaggggtacgacgtttgctatcataatctgaaccagcaaatccagcaataggtctctttcaacctaggctgatgtacagctggttcatcagtcattccaccggcgtcctagatccgtcctatatcctatatcctccactaagtaacaaactaatatatagaggagcagtcagtataaagttacatctagaaacatcaaaagattatactaacttcacaacatatcagtatccactatatgtcttactaccatatgatcttatctcccctgattttgctcatacgaatcaagcagcccaaatccatcagacattgaattagtactaacaacatatatatacatactagtatactctaatgttgcttttgaccgcccaaaagtgcaaccaccatgagatcctctaaattaagccatcctagatcatccacacgaccgaatcgggtacggcaacgcaacgggagcacttctacggccgccgcccaagaagagggagagagagagagaaagtgaggcgtacctgagatgaagaggttgggggaggggtcggccttcgggggcggggtggccggcttgggcggggagaaggccgagatggagaacatgcgccggaatccggacctcgccgtagccgccgccgccatcgccgccgccggatttcgaaggtgaggtgagaagctagggatttgcttcctctctcttctttggggtttatgggtttaggtcatgggctgaattgactataatgcccttctctgacactagtattagcggcgagattattatgataatgattgaaaatttgtttctgttgggggaaaaaatctcctcagatgaatttgcagtctgacatgatgtgttgcaatttgcggttataacaatttgataatcaagatgagatttagtcaaatgtttgaaatttttaacattgaatacctctcaaaggttatagttaaaaatggcacgagtagattttgtcttgaaaggtagagtagtgtcataatatcatagatttcaaaaattttgtctatgggtttaggtcatggggctggaatgactataatgcccttctattgatagtagtgttaacaacgatattacttaaataattgaaaattttgtttcttttgaaaaaaaatcctcacatgaattcgcaagttaacaacatattttgattagatactccattcgattgtatacatttgacatttaagataaaatttgatcaaacatttaaaactttgacaactgaatacctctcaaatgtttattttttaaaaaagaagtaaaatggtatagtatattgtcttaaaaggtagagtagtatcataatatcataagcttattagattttataaatctgttttgatataatattgatgattaaagttttaaaagtttgactatttttttctcctaagcattaaatatttataaccagaaggagaagcgttttagcaatttttttgtttcttttatttgaaacttgtaaataaaaatctatttgcagctttgaacttttgagataaacggagagctctggactacaaactaggacattttacatgtttaaagcttccgctatctctctcttggacgaaaaccacattcatttcggttacatgtcatctacacgtcactataatttgccatctcatcacagccttggagatcatgtgggctaccatttcaactgaagaatatttaagtactaataaagacagcaatgaagaaggcataaccatattatattgaagtatgacaattcactcatcacatccacacagcaacagcttttcaatctcacttcgattcaatggtcatcccaaattgcaagtctcaggctctgagcagaacaaatgccaatacaaaggccaaaaaatcaacttcagttcaagaaaactcacatggataaggatcaagaaattccacacacaaaccagcaacacaactactaggtagcagggtaacacaagaaaaatatcactagatatttgagacagtaacattcttagatagatcagaatttccgtcttttgtcacattcagaggtcatagtccacccaaaatatcaagaatgatgatgatccacatgatccaaaattccaaatgcagcctgcatgaatcgcttgcacagctctggatgatattttgggttgaggatagatttgtctgtcagagctttcccgtatgcgacgccaagtggtagaattagctagtaagcaagttctttctttccattacgtggatgagtgcctgcaaaactgacctaataaggattttagatcaattacacaacaatctatagctaagggttgtttttttggattgcatttctacctcatgaagaagaggctgactcaggctgagcagtctgcggccttggtctcctgcttgctgggggtccatctcttcgcctttcataccgtctgctttcatatttggatgtcctccgctcttttggttggtaggttgggtaagtgcatggaattatctctccgtttatgtatttatcacctgaattgtgaaaggattgagattttttatttaagaagcaacaactaattgattatgcaaataaccagctgcagacaataatgttgaactaacccccgtagtctttgttcttgacatcgatgtaggaatcaggaagcacccacagaacgccgggtaaacctacaggtaatagaacaatagtttgaaccagggcaatccaaaaatgtttagacttggttaaatactgaggcaaccagtatattagcaaatacccttgaacttctctgatgtttcctcgtcgacagtgcactggaaaccagtgtaggtggttgtgctgaaggcatacatgttcttcttggcttcctccatgctgtgattgcaaacatatgctcagtatcaagaaaatgaactaaaggcagaaaattacaaaactgtaggcctggtttatagtatagcaatgctgatttcagacatagcaccgatgataacttcaccaacgtgcagtgaccagcaaagaatacctaaacaaataatcaaccattccttgtgtttacgcaagaaattttaatccttgtgaatcgtcaagcataaactgtgcaacatatagacatgtctaccaatctactacacacttgtttcttcaacaaattatcatgcaaaatttgcaaccacctatagaatgtaaagcttttttacattttaccaaaaacgtgcgctccaattaaaatttcgactatcataatttacaatcgaaacaaaatttattatgtttgagtgaagcatgaaacaaacatttctctcgagattactctaccgacttagtcagtcagtcagtcagtccttgcaaattggcaaccaaactaggtgagtcaaagagaggtggagatcttgacaatgaggatgagaaattttacataattatacctgccaaggacggtggcgagggtgttgaggtaggtgtcgatcatctgctcccgcgtcggggcggggtccttggggaactccatcacgatcagccagtggttgtagtcgcacccggggagcagtatcgtctccctctgctcgctccccgtccccgcccccgccgccgcggccaccaccggctgcctcgccttcccgcttcctcgcacagccagcgtcgggaacgccgccgccgcggcggtgcgggggaagagcgcggatggtgcggcggcggaggaggatggcttcggcgcgagggcgaaggcgaatgcctgcgcggcggcggcggcggcggtggtcgggaaggaagccatgggaggaggcgcaagagtggggagagggagaggtttacgagtttggggataaggtgggaagaagaagaagagaataaaaagggagaagaagatattttttttgtgagggtttttagcctcctctttagtgggccgggccgggccgggccattttcggcgtggatttatgggctgtaatgtgtgggctcagatgggcttatggaggcccaattgtgacggtgatggaataagtccctcattattagatccaatcggtttttttttggttaaccaatcacttttcgggttttttttcaggcgaggtggctatctgtttttattagcggccagaagaataattaggctaaaaattaggatacattatgagaaataaaacttcttagaagagaagcaaatgaaacactttcattaaaaaattctcgaattaggatacattattagaaaatgaaactttcttagaagagaagcaaatgaaacactttcataaaaaaaattctcggcacttttaaatggcgatttagcttcctgtagcaatgacatgtttgatcatgcaagattactgatatgtaggtcagaggaggataaatactcatcttagaatcttggatcaaaatttacaattataagatcactggtgccacaaaagtgacagaaatataaaacttaaacataaattacagaaatgtagctgttgaattccatctctttttgtgtgtgtgtgtgcgcgctctataaacaatcagcagtgtttcaaaagcaaaatgggtctgcagaaatgtgtcggcaactgagcaaccacacattcaccatgatgaccaagaacaaaaaaagggcagcaacccgaagtgaatggcagaaaacactagagatgatgttcaactttcaagcagtgagaagtcaaaagcatttgacccattcactacaaatcagagatgcaacaaaatgcacattcatttcaggaaaaagaaaaaaaaacatgccgtctctgtcggtgcagaaagtttaagggttcaagggaaagtgtattcatccctcgagcggatatccccttgtatctaaatagtcatcaaagtgcacagcgttcagtagtgaacacttgacactagcagcttcaaaagaaatgcttaacaataagctagtgccatcagctttaccatcctgagtggaggtccattccattctgaaaacttttggtcctgtgcatccagtcaaacacattcagttattggattctgaaaaacaagaaaaaacatattgctgattcctttctttgctgttccaaggatgcaggcttctggtgcctttgtatgtgagattcttgcatttagttgcaggtttgcagctatcatcaacacaagtggctgtgcatgtatggggactttgacatggtgcaccaactcttccttccatctccatctgcttgactcaccatatacatcatagacataaacagtaaattaagctggaagttgcaggattgcatagtgaaggaaatgacaacagaaatgaggtcatgcaggcctccaaatagctaggctacaaaaagagtcactcaatatgcactcaatcatgccaaatcatgcctatagctttcataaaccaaccttcttgcaaaagtaaaggcttctcttgtctttccccttctctggtgggagtctagaaatcttttaaagtttctagtgaatatatggtgctgcactgacagatcttcttttaatttggtacgcaacattcatctttagcggtatggcatggatagaattaaagcttttatggttttattttgtagagtggttttcatgatttcatcatattagtggtttccaaatgatacttctcctatagtcaaatcctggtgaaaatcagctcttcccagcacttttactacagtccttaatcctggttaattcaaacaaaattggcttgacctttaacaacatttttttttaaaaaaaaaactatcatctgactccatttttaggtaagaaatgagtcctccaagggattcaatttctagtaaacattctttttaatctcttaacgcaacacaagttctctgtttgatgcttctagattgtttaacaacaatagtttgttaagaatctatggtaatctatgtcaaacttttcctttggagagctttaatattgaaagaaaaacatgaatcacaagaaatgtcatgtgtcttcaccagaaagggaacaggggacaattgagttcaccaaccatagaacaatttgtagtacctttctaattgaaaagaaaaggcagcttcttctagattgaaaatgaccatgtcctgcttctggttcaacatccagctactccttccatctcatgaaagataagttcgaggcatcaaacgagtgcgctgtggaactttaagggatgatcagattatacagcataacaagatagatgtgactagtgtttaagaacacactatataacatgattgcttcaccaattttctatattaattggtaatgtaagtaattgatctacatacatgcctgaaaattagtaatttaattgtgccactcaaatggtacggaaactagtcacctttcatgtactgaaaatgataggaccaaaagatactcacagaacttaagaaaagtaaccgtccaatttcatcaagcaaatccatggcaaaatattcataaaagaaaacaatatagaagaaatagagcatgtccacatgatgccagcatgtttcatgctagaaagcagtaaagcaggaaaaggtatgggatcacatatatcatggcaaagtattgggcaacaacccaaattacattccaatggcactctgaggtaaaataacaaactatcaactttagagctgaaactttattccatatggatgatcagactcaaacattgtctaggtgatcatgcggaacccttgagtttcttcgcaattccagcaaagtacttcccttggtggaaggcttgttgcagctcaagctcagtggcaacccttgatccatcaccagcgaatgtgccagacccgtacgggcttccgcccttcacttgctccatctcaaacatcccagcaccaaaggtgtaccctactggaacaaagatcatgccatgatgcactagctgagtaattgctgtcaacctacaagatg

SEQ ID NO: 67967 - DNA, 2346 bp, Oryza sativa
ctatataagtaatcatgtcaaaattttggcaagtatgccacaattttagtatctataccaaaatttgtcaatgccaaaatttggtaaggttttttttggcatcaaggtgaacaggcccttagacatactcagcccaacatcttcaatccaatgcttcatcctaggaaacgtttccagttctcccaatctgtctcatacattaatgttgtactggtggttgttcagtcgaggccctgtttaattctcacgcaaaaacttttcaccctatcacatcgaatatttgacacatgcatagagtattaaatataaaaaaactaattgcatagattgcgtgtaaattatgagacgaatcttttaagcctaattgctccataatttaacaatgtggtgctacagtaaatatttgctaatgacggattaattatacttaataaattcgtctcgcagtttacaggtggaatctgtaatttattttgttattagtatacgtttagtatttcaaatatatatatccgtatatctgatgtgacacccaaaaccttttaccccctaactaaacacagcctaaatacgaagacacaacctaagtatgaagtggtatagtgacaataatccagattcctgtatgagttgacatttattttgtcctacgtacaatttctctaatttgcgagttttcttgctgcactctgcgtatatacaatcccatgtaagggtgtgtttataggcggtaaagttttggcgtgtcatatcggatatacgaacacacgtttaaaatattaaacgtagtctaataataaaataaattacagaatctgcctgtaaactgcaagatgaatttattaaactgcgagacgaatttattagtaaatgtttactgtagcaccatattatgaaatcatggagcaattagtcttaaaagatccgtctcgcaatttacacgcgatctgtgtaattagttttttctatatttaacacttcatgtatgtatccaaatattcgatgtgacaggatgaaaaagcttgctaggagatttaaacaggctcttagggcatttacaatgtgagccactcctagagtgtcctcactaactgagaacactcgtaggggaactcagctcgtaatggaggacacccttggatgggctcctaaaaatctaaagcaacttaataaagacattccaacccaaaatgggtatcccaacccacaaagccccatatttatttttactaccctacccctaatctctctctcccgccccctcttttttttcaccgccgcacgggcctatccctctcgccattgcactcgcctctccctctcgccgccaccgccgctcgcctctcccgtcgtcagcggccgcgaggacgacgaggagggccacctctcccgtcgccggcgtccaccgctgcccctctctctccctctctcccatcgccacccatcgctgtcctccccggcatcctctgtctcgcgccgtcgttggtcgggggcgccatatcctgcgccgtagtgggcggatctgggccccccgcggccagatcgaggaggatacggttgcaggcacaacgccggcggtggtgagcggcgcgcggatctagtcgtaactgtcacggatccattgtcgccgtcgcagatccatcgtcgtcgtcgcggatccatcgtcgccgccggaggtcacgtgccgcgccaccggatccatctctcctctctctctctctcgtcgcggggtcatcgccggatgccgtgtgccgtgccgccacccctcttcctccgcccgtcgccgagtcgtcgccgtcgcagggtcgtcgcctacttccaacgacgagggcgaggggtggaacggtaaaatgtggggtgggagcaatgtccacgggacactcacctagccacgccctctacaatgcgtctcctagctcggtgtctcaacaaaaggctggtgaggaacatgaccccagcgaggtgccgcttggcagaagagacgggtccggctgaaaagctacctggaggggaacggccacccattgctgatggcctaagactatctccaacaatactacccataactggagacccattgaacggtatgcgtcacgctgaaagaaaaggtcacgaacctatttctcgccttctccaacagggaacgcaaaagaaaaccagcacgcggactgtttctctctccacctcccgtgaaatcgttgtgccttgcgagccaggcgtttgggtcgatgagagagaacactcaaatttgggtcgcactctgcctggcacccaaaatgggtcctttgtatgggtaatctgttggaccgtgtttttgttccgctagagtggctgaagcatgcattt

SEQ ID NO: 67968 - DNA, 14932 bp, Oryza sativa
  unsure (1)..(14932): unsure at all n locations
caatatgaatgtgggaaatgttagaatgacttacattgtgaaacggagggagtatcatcttaataactttctcggatttaatgcgtgattctctattctttcacacaagattatctatatgggcatcgagaaatgtaaatattaatgaatcgcttgtttacgaggaatgactagtagcatatttaaatagatgataagtagaatatgactattaaaagtagatggagggagtatttcacaaatctttctcgatatgtccaatatacaaaaccagctcaaactaactaaaagctttgataaaataggatcaaatgagcaagggtaaacaaggcattttgtgctatatatagttaacaccgttacctcaccttaacataatagggtcaggctatatcttcgatttttgaaaagaatggttaaataagcaaagttagtaatagagggttaaattggtagttagccttcaaaatagggtcagatgcacaattaccccttacttaaatcgtcaagtttttgtttaaaaaagagttcatttgtaacttgttaggtaccctcgaaagttttatctcttgactactattgtgacatcctagcccaattaagataatgcatgtgtggcatatgtgagctatgtgcacatatttagtactccctccgttttaggttttaagaagttttgactttagacaataaaatcaaattgcttcaactttgaccaagtttatagacaaatatagtaataattacattatcaaattagttttattaaattaataattaaatatatttttataataaatttatcttgggtaaaaaatattactatttttttctataaacttggtcaaacttaaaacagcttgactttgactaaagtcaaagcatcttataacctgaaacagagggagtaccgtcttgctagtttagcatcagtggaaccaacttataagacctattccaaccatatcactctagggttaacccttttacacgaagcaaggacgaaagtgtaagtgggcccgcttgtcagatgggctggctacgcggttctggagggagggttgttacaaatggtatcagagccgaccctcgtgcttgcacgaagcgaggacggaattgtaagtgggcggagtggtatgtgtaagtgggcccacctgcaagatgggttggctatatatgtgcagccgtggatattcgtgtccaacgtttgaccgtccgtcttatttgaacaatgtttgtccaaaatttacatatatctcatctgcttttataaactataacacatatatgtaaattttgtaaacaatgttacttaacactttgtcggatgaagaaatgacaaacataaaagttatagatcttggtgagttatacaacttcattgttgatgactttttttagttgaaatcatttagtatttgaaaatgttgtttgaagttgtcatattttcaaattcaaattcaaactgctcaaaaaaaagttatttaaaaaaatgaccaaaataaaagttataaatcttggtgagttatacaactttgttgttgatgacttttttagtccaatcttcgtaagttatacaactttgttgttgataattttttccatttgaaatcatttagtatttaaaaatgttgtttgaagttgtcatatttttaaatttaaattcaatctattttaaaaaaggtatatagaaaaatgaccaaaataaaagttgtaaatctttataagttatacaactttgttattgagaatttttccatttgaaattatttactacccgaaaaattattttgaataataaaataaagtattatagtgtagtaaattattttgctacaggtcaactcacaaatataaatatttcatatgacaaatggaaaaaaaatactaagtcatctcaatcgagcattagtatagagtccatcacggatgagtcatccctgacgggcctatttgttaccgattgagatatggtcacacaggcctgagttttatgcacatctaacatgtctatgcgaccatatctcaatcgggcaattttttggcccgttacagatcactcatccgtgacgaccaactaatcacagatatgatagagaccgtcatagatggaaggttatgtactagtggtattatctgtactattattatcgatctgtggagaaaatcatcaaattacgcacaaccccatagttgatagatgcataccttagcaaatgaatcaaatttcacatagtgtggatcttcaaatttcacatggccagttttattcgtaagcatatagaggaaagttcaggcatgcattgtaggacatttaacatctcgatcactgtttatttttgcattggaagagtagtgtctagtattagtttcttaatgatgtgaattttatggaaactatgtctagtgttccccttttttttgggngggggggnttttngngnannanaatgnnaccgcnttgtantnttntnanaacccccccgaaatattttnttttnaaaattnaannnaatttnaaaatttgggggggnnggaannaaaaaggggtttttgggaaaaaangcgannanaccgccnnacatttctggaagggtataactctatatgaactaaatttgctgagcttgaaattagacatggtgaaatgcacttgtattaattgcattttgcatataatgtagaaggaaaaaagtagcgaattcggatttactctgatctgtaggtcttggctgcaaacattgcaactaaaattttttaattcacttcatctgcatcaaaaaggttttgctggaaacttatcactgagaattgagactgtcactgctggagaaattataaagttacatagcctcttctcctcgctggcgcaaaagaagccaaggacgctcgtccatgctgtttccgtcaagttcggtatgcaattccttggccccactctcctctcccatttccaatgtctcacgttggatacatcgcctccgctcttgcccccgaaccacataggctgtctttcctgccaccgatcctacacaacgccctcttcattcatacagctctaatggtgctccgaccctacacaacatcctcttcatccatatggctctaatccatctacatctatatctacatcagtgacttgatgaatagaaatagaaagaaaaaagaattttttatcggaattgctaaatgtcattcaacagaaatttaggtatgaaatcttatagattttggacagttggatccacgccaagattcgcgcgtcaacttcttctcctctaattccggtaggcttcccttcttctccggcgccaacgacaccccaaactttggcaaggagcatacgggttagtgtttgggattgcggttatgataggaggggggttggaggagggaggaggggggggggttcctcaggacttagagggatggttgtgggcggttggtggtggacaagagcgggttgcgaggcgccgtcagagccaaagtcacgggattggcagcaggtggagggccggctttggcggcgggagaaaacaacgagactggttaggaggcggcggccagtgatatccgacggtggggagccgctggagacgaggaagatggtggggcaggggcactcagcaccacaaccttgggggaggcctcgccagggccattaacccggcagggtagcagcgactatgcaggaggtggagcactgctcgtcgcgtgcgtgagcgtgaagcggcagcggttggcggactaagaagggaaggaggaaaagtagggtttaggtatgttgcacaaatctcaaaatatcaaatggtcctgaatttggaatatttggggagttttttctttgtcaaaatccacctagaaagtccttttttatagttagactgacattcactttgatgaagtttataggagctagtatgtcatcgatgataatgatttgagaaaagtttagttgctttggacaaggccaatgtttgtgccaccatgagcaataggagtggggtacactggaaagagccacaactatgtccaaatgtacaatgcttatgactggtaagaaaataaagtgggcctcgctgggttccaccaaaagaaagaaaatggcaaaaggtcccgcatggcagccaaatgactacaaataaacaatttaatgcaattttgtattttattagtatgaatagcaaccctatattttattgtcttgtgaccacaccttaagcttaggccaggtgcatcttagcttggtgatacttatggtgtatctccacaatggcaaatgtgcaaaacttagtagcattaaatacttaatgtgaccttttttcaacattgtggatgcccttggagcaggtacaatagcagactataagtaaactataaacacatatcgagaagataaaagaagagagagaaaagcagcgggctataaatttatagccagctgcaacacgaacttcaagatacaatgtgtgtatgatagctggggtctgttggtatttcttaacgacattactagaaatataattcccagcaatgatgcagaaatacttctggtacattattgttacagagttcatctgcaagcgcacggatataccattgtagcattttacccgagagtattccaagggtatcatatttgtttaatcccgtgagaagattataatagagagaactatagtaataatttatatattacttataataatccaaagtctaagcaggggttaatataattcagagagtagagtgacactaagcagaagcattcatactcttatttataattacctaagctaagtggaaagaatatagaaagatcatattcctatacttctattacgcaaacatattatgcatacatcctagttatatcattacttagctaatgccctctttccgatgtcctcttggtgtttcgagaagccacccctgattgcagagtttcttacgacaatccattatgaccattcaaccagggctaaatacagaggagtaccctccccaggaaattaacttaggactatatacacgcgcggaggaaaaccggtactgagctgtcaccatcagcggcccacctcgcttccacaacatataaccccaaataataatatccagtaatataaacaccacgcttaaattaccaaatactactctaatatcgtcgtcatgacatagagtcatcatatacacgatgattatacgcacaccattgcatctcctagataagctagcatcataacaaatatgacttggatatataataaagttggtattcatatactcggaaagtaatacaataccaaagtggtataaggaagaatattctaaataaagtacaagtcttacaaaagaaggaaaagctattagagccgtactcgaattattccgaagactccgaggactgaagattatattctatttctattccactatactctagagactatactaaacttatactaaacttgagagatgaaatgaacttcttgcttgaggtgtgtcttgaaatggagagactgagggggtttatataggctggtaatgacggttggaaaggtcggtaatatccaccaactgtcattgaagatcaatcccagccgtctagccaaaccctgcaaccatcggcgctgcggctggttcggccgaaccctgggctggcccaaccggcccagttcctagcaggcggcctcctctcctgttgctcacttcggacttgtgaattttggtccaattgatcgtgtcatttctgagttcttggtccatccttccataagtctgattcttgacatcgtccgattgattgaccatctatttttatgtcgattctcctctattttatgtttattctttgcaagagattagtaatcctagtgctagtggaatatatattatttaaatacaaatatgcattgcgagcataactagttcttattttagtaatattgacgggcgaaactgatcgctaacgaccgtcaacagggccatgtattagtagtgtattatatgactatatatgatttgaatagtagttagctatactattaaacttgcttttaggagtcttcatcgtctcactcaattggcatctcctcttaggcctagttctttccaaaaacgttatatcgaatctttggatatatacacggaacattaaatatagataaaaataaaaactaattacacggtttgcatgaaaatcgcttgacgaatcttttgagcctaattagtccatgattagctataagtgctacattaacccacatatgctaatgacagcttaattatgctcaaaagattcgtcttatggtttccaagcgagttatgaaattagttttttttatttatgtctaaaaatcccttcggacatccggtcaaacatctgatgtgacacccaaaaattttcttttcgcgaaataaacgcatctttactaaaccatggaccttatccatctacaatttcacatcatatttatttaatgaccgatgaacagaaatagaaaaagaaagtatttttttaagactaacattcgatatttagaaaattataatggcatggttataatttttttttatggttagccctgtttagatgggactaaaacttctaagtccatatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggacttaagttaagtccctggatgtaaaaaccacctaacattcactccgcacctaccgaacacaccggaaagatccaaacccaaaataaacaacgaaactcgcacaaaaaagggaaaaagaatgcgccaccgtggcccaccgccgtgacctcgccgccggcgaggcctcccctgcccatggactccgccggcgtcatcctctccatcctcagcaagctgcagtctctcggcttctgcgcccatctccggatcggcgacgccgcggcctccggccccccctcggacctgttcgacaccgtcctcgccgcgttcctccgcgaggtctacccgggcggccgcgaggtgcgccctctcccggcgaagctcggcgacgggagccgcgtcgacctgctccgcctcttctccgccatccgcgccgccggcggctacgccgcgacgtcgtcgtcccccgccgtctgggcctccgccgccgagtccgtttgcctcgacgccaccctcgccgcgcccgtcaagctaatctaccacaagtacctcgccgccctggaccgctggatccagaggctcgtggaggcgcatggacccttcctggatggcaacgacgggaggaagaagccagagccattcttcgattccaatggaagggagaatgaagaaccactcttggaatgcaatgggggagatctgcagcatccaatcttgaagaggaagagggaggacatggttgggatgttggattgggtcagggagcttgccgagaatggcggtgaggcaggcaccatggctgccggctcggcgaatgggtactactcgttggcgttggcagcgaggaaggcggtgttcgcgaagagggctcgccgctcgagcatgacgatgaatggtgcactcatgcaggttattccaataccttcagtagcactttatcgaaatgtttggcatcattcatgttgtttaatcgtattttgatgtactaactgaattgaggttagcttaactatgatgattcaccgattgtattaaggccttgtttagttggggaaaatttttgggtttggttgtcacatcggatatacggacgcacatatgaagtatgaaacgtagtctaataacaaaacaaattacagattctgccaggaaactgcgagacgaatttattaagcctaattaatccatcattagcaaatgtttactgtagcaccacattgtcaaatcatggcacaattgagcttaaaagattcgtctcgcaatttatacgcaatttgtgtaatttttttttgtctacatttaatactccatgcatgtgtctaaacattcgatgtgacaacgtgaatttttttgttttgggaattaaacagggcctaaatctttttgctcaaatccaattgataatgcttgttgagaatagaccaacttattgacgcatctttgtgatatttggcattttagtgtaatttggagagtacatttgtatttcttagagattacactgatatgattgtttggaagatagtataatgccaacagaaagcctaggcgaaaacattatttccgtcaattcctcccttctgagccatagttagatactcgacataagttgctacctgagtcgggagttggctataattgttgatacatgctaaaatgatcattctaatcgtacctccaatacttgattatttgatatctatttatatgttctatagtaatcttgataagaagatgcataccttttcgctctttgataacttgataccttcacaataataaaatttagaggagtttaaaggttttctttgggttctgattgattcataaattcaattgagtttgtgagaatggttaagtgtctgaatttcaaaggatatgcattgcataaaaaacaaataaatccaagttttttttacatcaaaacgagttgtggaaaacagcaataagcagcactccaaattctattttggaagctttttatgatgggaaaactatcaatgatacttttaaagcttttttagttataatgaaatgaaattgtggaaactcccatagataggcaacttataattcacatgctatatctttcttaggtattcaatcttagctaagcttttcttgaatttctctgcttcttatctttctctggcattcatcactgtggaatttacagaacagtacagaattcagcttgaaccatgtttcgcacaggcaacagcaatactctgggtcgatctgcaatattattaaagataactttgaggaataataatagcattcggctgctatacggaaagttcttttttatgactaactcatactaactaattctctctcctaggcagatggattatatttttgactccacctaagactgatcatatgattccttgtttttgttccagcttctagggtttcctcttgtataatctcatttatatactgtaatcaatgtattcatttatgatcttttagcttaggaattgaggcctatgggggtctcatataattattgctttgaatatttgtgttggtggctgtaatgatttgttcaaacaaaactgtttttgctacaactcactgacacatcgtaatgctgttacaaataatttggggcctatccttttataattttcatggcactgaaacatactctttccttacatcctgctattactagacttctatttctgcaaaaatggtgcagactgcagcgtaatccacagactctgacccctccactaccaactttggttcactattcaatttggggatactgttcagtttagcaacagtacttaggaaccatatttatttttgtagattactgatccaaatgccatcatggatacaaattacagattatatcagattaatgataattatatcctctgaatgttttggtttatggcaaaaccaactcctactgcatagcaaatccttctgcacactctgatttcccaaaagctttgtttgaatcatcatcttggatgatcaagaacttcgatatctactgacaaagaagtataaaggctcttaaatttagtctacattgaccatcatacctaaaactcctagtttatgcataaatccttctgcatcctacaatttccttaaatcttcaaatagaattagattttaattagaatggaaccacaaatttagtttttgtttggtttccaaaggaactacagtatataaatcgatttgtaagccaattctaagggtcaatttgtgtttgctgatttactgtgctgcgctgttgttcttttgtttttagcatggaaatgcagatgtaaaaaatattgtagtttactttgtaaatcaaattaagtttagttaaattttgttatcaaactattaatttctcgaactcattcagtttttggttgccaaaggaaatgcaaaatccgaaatcaccatgacgttgtgattttcgtgcatgatattgtcctagcacctaatataccccttttttgttttctgtcgtttgcaggaaatatttccaatggattgcaagtgctgcatgagttccagcactactggaattgacacacaagaaaaatgcagtaaaaagattcaacttgtcattccacaggctggttcagatattaatgaattgataaatgttgtagaaaacataaatgtgccttcaattggaatggagcaagagaacaacattattggacaagcgaaatatgagagtaggaaacatcataactctgacaactggctttttacgagtcagcagaggaacaaaataccagtgggctctgagttccaagcacaagtaccacaatggactggtgagttgcctgtaagctatgataatgcagaaaccaggaaatggttgggcacaaaggtctggcctctggaaaatggtaacaggaaattatcatatttttgtaaccctgttggaaaaggtagagaaggtgtttgtggctgcaaccttccaggatctgtagaatgtgttaggtttcatgttgcagaaaggaaacttcagctgcgacgtgaacttgattcagctttctatgcatggggatttgatcgtatgggagagaaaatcgcactttcctggacagattaaaagggagcaaatttcaaggctttgcgtgcagcttaatgcccctttttcaggaaggaatttctggaagcgtctccatatgctttttcagtcaaagggtaggaaagaacttgtgagctactattttaattgttttctacttagacggaggtgttatcagaataggatgactccaaataacatagatagtgatgatgaggatgagacagaatttggattcttgggtaaccgccttggtcataatgcaactaagtatgacagttcaagtataccctttgcatcgaaagtacacactgcatggatctcaaccaatagtttctgatcagcattaatgaagatgattgaagtttagtagttcacttctcttgctgttgagtgtcttggataaggtttaaataggcggattggagttttggtgtttaacttctctcattgccaatggtttctgcgcgatataaagaagcttactgaaatttggcaattaatttcttccattgccaatggtttctgatcagatatagagaagccgattgagtttgataatacacttctctctttgcgaaaagtttctgatcagatgaatgctttcatccactgatttcttatgcagacggaaatgtaaatgcttaagtgcaagccaatcatttgaacaagttgcttaccgctgcggaagatttgaccgaagcttgcgattgaagttgggaggcaagttttgatagagtgtagtggcactgatatgtgaacaatcacatggattcattatatccacaaggtgaaaaagagaacagcggtagcatttttaccgatgcttccttgaaggtatcacatgtaccattttctagttttatcctttgtgtaaagtagttttgcatacattgcacagtagtatgattaactgttccttgctctaggctcccttttcgtagtatttatctagactaagggctcctttggatgcacggggagaaaacccctgggaaataatcccccaaggggatcttccctgtgacatatgaactccctccatttcctagggaagttgctcccgtgagggaaaagtcccctacgttcatttggaagactcccacgaggggaaattccacgctccattcctttgaaaatgctagctgctagggtttaaaatgcgtagcatgataaaatataaaactcacgataactaacgagcaggagaagataatcagggtgacaaaataaattcaaaaatttcatagaaaatttggaatatccacagaaaattccaaaaattcagacattcatatggaaaatgcatagcaaatttggtaaaaatccaaaaaattcacaaataatttgaaaaattcaacattcagctaatacaaaatatgaaaaattacaaaaattgaaccttggatgattggaatattttacataggcttacattaaaatgacagataaagcaagctaaaacattagtgtgatgtcttttcaacaactaatgtgcaatcattaacagttggcacacaaatagacacacatgtaagcaaaggttaagtggaaaagatataatccttggaattttcaaataatcatctcggtgcaactggtcttaatctttactcttgtcacttgttgatccccaaaactgcaatttcacaatagataatatgtcaatttttttctcaattaatggttgcaaatcaaaacacaagaaacaacaagggacaaatttcgcgaatcatcgctgaagtgctaatgtattgcatccacaattatgcttctaggattctatacaagaattatgtatccagaattttgagggctattttcatgtactagactaatgtactttctacatgcatactgtattatgttaccagaattctacagtgctactaaggtaagtttttcatgctatgctgcatacaaagtcaaaattcctgaatcatttcccattgcatacaaccagataaataaccaccaaacaattgcaaacggagtttttaatggacacttaacaacattggagataagaagatcattaaaaactgatagtgattcagaattatgtattgcttccagaattctacaccagaattatgcattcataatttagagagctattttgatattttcatgtattccaaaattctatacagtactagtcaagtaagtttttcatgctatgttgcatacaagtaaaacattctgcatcctagggaacttgacatagaaaattctgcatcatagggaacctgacaacaataatatctcaaattctcaatcaaccagaacttaacatgatatttcccattgcaagtatagcagggaccaatacgaaaaatagttcatcatcctctagtaaaaactttctaatttgctcgtttgcagagcccatcacttttctgttagaaaatcagactaaaattacaacaaaaaaataaaacaactgattggtaaaaaaaaagagagcaagattcatcatggcaaacacaaaaggggcaagaaagaattatgcaagacagcataagcaggtctgccactaaaattgacagagcaatactgtacgtaaaaacatctcaatacagccactaattcttcctgcaataagagcaggatgaacaccaaaacaggtttaattgcaacaatttctttgatgtgctatggttcactgtctcatattcagaacacaatttcaattcagccatgttatatactacaattcagtgattgactagcacagacaacagttaaatcagctaaaatacttcaatgaacagcctactaaaaaatcttatctgtacaatgtactttgcaaacaaaaatcatcatgccatatactgtgcaaacaatgaataataacattattagggatacacatgcagatgcagtgcaacacgtacttgtccactactatattagtactcatcatgtctgcatatagctataatagtacccatgagtgctgtgcacaatacactgtagatatgaaatcaactgaatcctgaatttctgatcatctctgatggcatatgcaaaacttatagctaagctgccattaattaattagacatactgttatgtggatcgatctttcggcgtatcgatgaaatgaacaagtcagtgctagctgtatataagctagtaattatatacagcaagacaaatctctgtgatactaaacagcaaaacaaatctagcaagaaggagatagatagtcataatcatctcttgcagtgcgttctcacaatccacagaccagaaactccattgaaccctagcacctgcgtgtacccatccctccacggattcaacgctcaagaacaacataaatctaccgggacaacacagaaccaagcttacagcggggaagaaactaacagagcaagaattctttgcgcgcgtggagaaacaaaccaaatcaagaaacaaaccaaattctttgctaccttggatctgcgcctcaacgcctcctccgccggtgcgtcgcgccaccttggatctccccccggtcctccgccggtgctgtgcgcccgtgctgccgaggcgccgctgcgtcaccgccgcgtttctgtgcctgcgatgcgagagatgagaccgaacggaggcgaaaaccctagaggaggagaacgggaaccctaggaggatgagaggaggggaaagaggagaagggcttatccttctcgccggaggaagagtcccggtggtggcgcgtctcaccggaggaggaggcacggcggcgcccgctcttggtcgctgcttttgcgcgagagagcggcggatcgggagaggaaaatttcctgacctcgagaggtcgggttcctttccctggggtttccccgcggattgggccgggaaatccctgcctcgtgggtttccaaatggaccagaaataaggaataagttcaccggaggtccctcaacttaacagcgatattttttgaggtcccttaaccacaaacccagaaatgtgtacccctaaactcacttaaaccgtttaccggaggt

SEQ ID NO: 67969 - DNA, 2775 bp, Oryza sativa
aaattttttgaataagacgagcggtcaaacatatgctaaaaagtcaacggtgtcaaataaaacgaaacggagagagtatatacgtctgcatgttatcgggcggaaaaccaacaagaagctagctaggctatagctggtcgtctccatgcatgcatatatatgctcgtacgaagacgcatgtacatgcggccgtctgtacccggcgtatatgcgtatgagctacgacgtcaagtgctaccgcgacgtcgtcgaagacgacgagggtcaccgcgcccgcgccgaccaccgtccacgacgccgatggcacaccgagcgtggacacgctcctgctgcagctgcgcgagctgggcgtccgggaggactatgggatcaggccggcgacgctgccgccgccaccactgccgctgtcgcggcacaggaggagcgcgagcgactggggtgcatcgtcagccggcacttcgagccacctatgcacggccactgcgacgcctggccgatgccgccgaacggccgcgccgtgtagcctcgcccacggcgacgacgacggtggagagccgatgatgacggcggccacggcgcgcggttgctccgcccgtagcctccgctccgccgccgcgctctaccgccgggatcacccgccgtccgctccgcccacagcctgccaccgctctgctgccgcactcgccggccgcccgcatccgcgctcggccatcgcggctgcgcccgccgccagcctgaaggagaagagagaggagagaagagaaaaaagaagagaaggagaagaaaagagaagaaaaaatatgtgaagctgacatgtgggccccacgtacttttttaattttttttgctgactaggatgccacgtcagcaaaaccgggcaaaaatactgccgaggtacctccagtgaacggtttgagtaagtttaggggtagacatttctagttttgtgattaagggacctcaaaaaatctcgctgttaagttaagggaccttcggtgaacttattcccagaaataataccagtggcaatttcccccgcgggcctttctcccagggattgggccgggatcccggtggtttcctgggctgctaaaggagccctaagggttagatccttaaaaagctatgagcatgtatgtagaggttagtcttcggaaactatcacttttttaagataatggaagctttattaagactcagtcaaatacaccaagatgatacattccaactgagcccacccccggcctctgcataaaatgcacacaaccaataaaaggacaaaactaaacccccatcacgaaacatagatattagtgactatcaatccatagactagattgccacccatgctcctgggtaaaaacatcccgtgccacctggtccaaatgtcgagatatcaccgcaatagtatcccgtaatcccggtttgtggaggatagcccaggtacgtaaccaccgggttactagagtaataacctgtagaggagaagaccctaacttgttatcaaaaataaccccgtttctggttagccaaatggaccaacaaataggtggtgcacccatcaaaaacagatttttcatttttttaggaacacatgaaagccaacgcccaaacatatgagtaacatttcgaggaggttgaaagttagaggccatatgaataacggaccatacccaacgagatagatgacattggaagaacaaataacgagatagatgacattgaagaccaaatgttgaatggtttcatccttatgacaaaagcaacattttttactacctttccaatttcgcttagctaggttatcttggttagaattactccccgacgtaagtaccaaaggaaaacttttacttttaacggtacattaatcttccaaatacgtctattaatattcgggacgcccatatgaacaagagctatgtaatgtgaattgatcgagaagacccattgggggtgagattccagcgaaattcatcttgctcttgtgtcaacaccaaagtaaggtttaaaagccattttttatgccagccgcttattttgcttccattaaaatttcttctcctaaaaggcttgaaggtttgtttgaagaattgtaatttgcgtttgtttatgcctaactataacagttatagagacaaggatattgatctctcaacgaggcattacccaaccacttatcttcccaaaaccttatttgagagccatccctaatacgaaaagacccaaaccgaaaaaaatcttgtttggccttcataagactatcccaaaaatgtgagtcgcctgctttccaataagcctgagataaaggttgtgatcccaaatatttgttacgtatcaactgttgccacattccgtttgtggtaagcaacttgaatagccacttgctaagtaacgctatattctttacctcgaggtcatgaattcccagcctcccttgatctttgggacgacagatgatgtcccacttagcaagctggtattttttcttatggccatccccttgccaatagaacctagatcgaaggtaatcaagttttttaagtaccccactaggtattgcaaggaacgacatcatatacattgggagactactaagtactgagttaatcagtgttagtcgccctcccaacgaaagaagttttcctttccagctacttaatttcttttcaaatctttcgaccacttctttccattccgcatttcttaacttcctacaatggatcggaatgccaagatatcgaaaaggaaaattaccaacctggcaaccgaaga

SEQ ID NO: 67970 - DNA, 3052 bp, Oryza sativa
gctacctggaggggaacggccacccattgctgatggcctaagactatctccaacaatactacccataactggagacccattgaacggtatgcgtcacgctgaaggaaaaggtcacgaacctatttctcgccttctccaacagggaacgcaaaagaaaaccagcacgcggactgtttctctctccacctcccgtgaaatcgttgtgccttgcgagccaggcgtttgggtcgatgagagagaacactcaaatttgggtcgcactctgcctggcacccaaaatgggtcctttgtatgggtaatctgttggaccgtgtttttgttccgctagagtggctgaagcatgcattttgagtttgggtgccactatgcctagcctgttggagatagtctaatgtcctacaagtgccgttgctttctcctacaatttgacccttccataaaataaaaaggaagaaaaaattatccagtttctactgcaacttcgcaattctgcaacacaaaatatctagctttttttttttttttttttgcgggggacaaaaatatctagctaagctgccgttcttccactaacccaagaaatggccggactgttcgcatcgtcggccgtgaaatgggccatcgacaacctctcctccctgctgccggcggcggcggcggcggggtcgaaccggggcctggacgcgctggaggagctccggatgctggagcggaccatgcggcggatccacgccacgctgcgcgacgcggagcagcgctggaacatccgcgaggagtccgccaagctgcggttggaggagctcaaggagctcgcctacgacgccgaggacgtggtggaggagtacgagtacgaggtgaaccggcgcaaggtggaggcgctcgagcggctcgccgccgttcatggcggcggcggcgccagcaagcgcaagcgcgaggaggtaaattaattaattaattaatcaactagtccggtcgctgcatctgctgacgaaatctattagactatcattagtggggtagtagcacgttgtctgtgctgtgattagtcatagtattttatactgattactagttttagctatactttgcaagtcccattcaggtcccaagtgtctgaaccctgaacaaaccccctgaagaggggataaaagcaaacagaaaactgtaacccctcttccatttttttttcccattagaaagctacaagacaagcactatattagtatattactgaattagctggttcagtactttgtcctagctgaatcaaaaccatcaaatggagttttctagcttggtattggtagtatatcgattcccaatgaagttagcttgaatcctaaacaaatgtgtctataggtagagacatgaaaagaatagtgaactgtcttcacggctgcacccagggttctgggattcgggccaaaaggtccgaatttcgtccattttggtgaggtccgagacacaatttcactcccatttcgtctgaatttggttaaaattgtcaaatttgatgttttgtccgaaatttctgaaattcgtccaattcggtggagcacgatttatatttgcaatcggatcccaaaaccctgtctgcaccatagatgactgaacctccctctttcaattctttttcaaaaaaaaggtacatgaagagcagttctccactgagtctggaatagttccagttccaagtgagttggctgacagaacaaggacagttattcagagattctgtgagatcaaagactactgcgatagttttagtttgtctgataatgatggggacagaaggattgtccctgatatcaatgctatgcggcagactagctcttttgtatttgcacccagaattcttggaagaaagaaagacatggagaatgttatcgcaaaattgctctctggggaaggcagccgtgttggaggttgcatgtctgttttggccattgttggtatgggaggattgggcaaaacaacactagcacagcttgtctacaatgatccaagggtacgccaatctttcgatctttgcgcatgggcttatgtttcagagtgttttgatgttcacaacctaacacgcaagatcatcagttctctaacccagagtaactgtgatcatatacaatctggtgatctacagggagcattggccaacgagataaaggacaagagggttttccttgtctttgatgatgtatggaatgagcgaagcgattactgggagttgttgatcacaccgatgtttgcttctaaatgttgtgacattatagtaaccactcggaatgagacagtggcaaggttggtgcaaacaacacaaatgtacaatatgaactgcttaagtcctgacgagagttggtcattgttcaagcaaacagcatttactgagcaagaaaatatcagtccagcaaaccttgtagagattgctcgaatggtatctgaaaaatgcaaggggttaccattggtaatcaagactgtagggagcatattgcgatttgaaaccaatgaaattaaatggagggatgtcctacaaagtgagttatgggacttggagcagactcagaacgaggttttgccagtgttggagttgagctacaagcacatgccgatagacctgaaacagtgcttcgttgccctttctctatatccaaaatattattatcttgatgaaaacatggtagtttggttatggaaactacttggtttacttcaaggcgatgaaattggaaagttatatttcaatgaattggttcagcgatcattgcttcaaagttctatccatggacagaaagaaggtcatgcatgatcttgtccatgatcttgcatgctttcttgcaggggaagagttctttagacttgaggaagataaacaaactgaagttccacggggcgctcgatacatgtcgataatgccaagatcactatgtaggaagagaattcaaatatcaaatgcctcgcaatctctcagagccatcatagtgataatgggtgatattgatatcgtaaatccggaagtgttgtttacgcactgtaagaagcttcggatcatttacgt

SEQ ID NO: 67971 - DNA, 1219 bp, Oryza sativa
agcgaccactatatattatttctggtatatccatgggactacttggtcgtagtgcgtgatctggcacactacacctagaagacattcacggaatttctagttttgttgaatttgtaagtattgttatacaccgtttaataactattggctcttgtgctcacaattgactcgaataaatattttgtttacatagagcacataggtattacgtagaccataacggactagtcaagaatgccaacagaactaagcttctcgtgaagacacaatggctggtaatgacaagttcgtgaagatacaacgtttgtgagatgcgcaactaacgacaaccccgattagtagtacatgtacaattcgataatttgatattgctaccggttaatataggacgacatattcccaaatggctaggcaattctatataatgcctagtgggaagaactattatcccgtgactcgaccgtacggtataatagatctccccatgtggtcgtgttaagtcaaccgcacaggataatggttcttctcgtgtggttgggccgcctgcacgtgaaaatatgatttttgcagaccttctcgggtgtgagggccggccttttgcgcggcaatatgcctttcggctcgcacgcaaaaactctttctgtagttgtgactgccactgccacccccagaacccttggagcttggggccattgtggggacggaggtggcagaggaggaggccggttgcttgctcaaaagtggtctattcaatgcaatattcataatatagatagatatgaaatattatatagcactcccactatttttttaatacatgacgctgttggcttttagcacgacagttgaccatccttcttattacaaaattttaactaaatatcatttattttgttgtgacatgttttatcattaaataaagggtgaatagccaatacggtccttgaagtttcgcctcggactcaatttaatcctctgtgtttcaaatcatccaaacaagtcctccaaatttattatttaggttaatatagtccttagacccaaaaaaaatgccacataagcatgtcgagtcatcctcgcatgtagcggtatgaataaaatgaccattctacccttatataccatatagaaaagaaagaaaagacacaaaaaaaaaagggcagcctaggcccaacattgttgcggagggtggccgacaaaggaatttacacggtcagtg

SEQ ID NO: 67972 - DNA, 12284 bp, Oryza sativa
agtgcgctagttcatcactataagccgcaatgcttctttctgaatttatttactgctaaaaggcctaaaacatttcttacttttttattacgtgtccatatctcattgagtttattattgtttaagacttgtaaagtatgcgtgttgcctgttcggatcgcgtgttagagcacatggcaggcgctcaaaattaggcagctaatcatccattgtccactagccacttgtgatgtttttgaaataattaatcaataataataatgtgcctagccctgtacatacatgtccagatgttttggctgtcatctcttctgctaactctcccttttgactttacttacttgctgagttcctcatcagttcccttcctctctttccaagcttgcttccatcgtcgacatctcctccttgatccgagtagctcgtgatggccggactacttgcctctctggccataaggaaagcactggagaagctctcctcctacctggcagcgagcctttcggcatcgtcgtcctcgccgacgtctgggagggcaaggcaggagaaggaccacgaggacctgaggatgctggagcggaccatgcgcaggatccacgctactctgcatgacgcggagcagcactggaacatcagggaggagtccaccaagctgcggctcaaggagctcaaggatctcgcctactacgcggaggatgtggtggatgcgtatgagatgaatcgccagaaggtggaggctctcaaggcatttgcaggcgccgccagccacaagcgcaagtaccagcaggtaaacttctgctagcttctgccattaatccgattccggagtggaaagataactaattaatcgacatatatattttcttggaataggaaagcgagggcttgttctgtgattctcatacggttgccattacagacgagttggctatcaaaacaaggaaacttattgagcgatttgacgagatcaagtattattcagacaactttactttgtcggagaatgatggagagatacggcttactcctgatattagtggtttgcagacaagctctgttgtctttgagaatagcattgtgggaagagtgaaagataagaacaacattgtagaaaagttgttgtccaaaagaggtgacaatctagctagtccggtttctgtcatggcaattgttggtatggaaggattaggcaagacaacgctggcccagctagtgtataaccacccagaagtgtgcaagtattttgatgtgcacgcatgggtttgcgtatctgagcagtttgatatcaacaacataacacagagcatcattgtcgcggttacaaaggagaagtgtgatctatcagaacttcctaatctccatgagagactggtagaagaaattaagcaaaagaaagttttgcttgtgttggatgatgtgtggaatgaaagaagagattgttgggatctgctgtgcatgcctatgaacaccacgaagctttgtatgattgtagtgaccacccgcagcgagaaagtcgcaaagcttgtgcagacaatgtcaaacttctataacctagaatgcttgagttttgatgagagctggttgttgttcaggcaagttgctctcactgttaaccaagaaaatgctccaccaaacctggtagagattggaaaggctatagttagaaagtgcaagggctttgcctttagcgatcaagaggataggcagcatgctgcgctatgaaacggatgagcagagctggttggaggtcctagaaaatgtgctctgggacatggaccaaccatggaacgaggtttcgccatccttggagttgagctacaggcatatgcctgtatacctgaaatgatgttttgttgtccttgcacattatccgaaggattgcatacttaatgaacttgaggtgcttcagttgttgaaattagttgatcccttcaaaaaatggcagacatgataatgaggaaaaaaatggcagacatgataatgaggatgagcttgaaagtatttatctcgatgaattggtggagcagtcattccttcaagaaatttatttttgatgttcttgatgacgacgagttgaaatttcctttttctcaaattaactgaaaatagagatgaatcattgtgacactcagtagcttcctacgcttggtgatcttccgtccctcgtgtccctctatttctatggcgagtggcttgtgcacgacactggccggtccaggagttttggagccttgttcctgcaggtgttgggattagcttcattgagacattttgatactctgacgcccaagttgttccgagtgattcggagttagtggtggtgaaatttccacactacaatactatttacatctgcaatgacgctgccaacactagtcttatcctctgaggtttcttccatatatctgtgctcttcgtgtccttgagaactatattactgataggatgccactgtgtatcactgtaatgtattcctgcatggcctaaaactgcatatactacagattggtaggcaccgaaacatagaggtccactgtttgaatcccctctcatcgctagagtgcttgacaatcttatccgatggcaccagatgcatccctattgagcaaagacccctgccttcattcaggaattacatccgtttaagcgttctgggattgaagtacctgcttcccccttgacatgaagatctacaccactccactgccagccagcagggatagctagtcactcctccactaccttcctccctttctgagcagctccacgagctttttgccttggtctactttttgtcccctcatgttcaaaagctaacaaaacacatcgctcaactattcaaccagctaatatttcttatacttcctccgtttcatattataagtgaatgtggacaatgctagaaagtcttataatataaaacagaggaaacggaggaagtagttttacaagtttgatcaaatactgcgaaatgcttagcgtcgagagtccgatcacagtcacagcaggaaaatcaagcatccatgccactcactcattacttctcgtctctctctctctctctctctccctctctaccttatcttaagcaatagtttaagtctctacctcctattttcatgtcatctctatcctcacaacacatggtaacacccccaaaaaatttgtgttcaaatccagaaactaaaatatggaaccaacaaaagatttttgaaaattgcatcacgctaagtcttcctggtttttattgcaatttgtgccggtgccaatatttaaattatttcaaattcaaatcctaaatccttaattacaattcctaaaatggaaaaacaattcttttagcaaagtctggttttcgtccctatgttttttagggaaaacactgtaggggaagcccccacagtttaaaatttatatattaaaacaaagttatttacaccagattaatccaatttacaagcgtatctctctcaaacaaattaagcctatggactaagagggagagttcattcttaaagaaagctctccaggaggcaatagaaggagcaacattattaaaaattaatccattcctcggcttccaaatactccaagcggcatagagcaccttctccacaaagtgtgaggacctgtaagaacttttggcagtatacaacatctcctcaaaattcagagacaaatcccaaaccagtccaaattgtgcccaacactgagaactaaatggacactggaaaaacagatgcaaagtggtttctcttgcatttgccgagcataaaacacaggttaaagcagcattatgaggtgcacaatgtcgtctatccagcatgtcataagtattcaaacgatcaatcaacaggagccagccaaataccttaattttcatggcacatttgcttttccaaatccagttaatagagttaggcacctggatatgcataaagttcatagcataaattttctgtgaagagaagataccatttccccaaacatcggtccaaaggtctctgtcatcattgagctgactcaaatgatcagaggatgacattagcaaatactcctgaaatgcttgctcagacagtggaagcacaaagagctgtgaaagatctttctgggaaacatatgaactgaaatcttccattcctagcaaaagagaaaatcctgggaaaagcagctgacctgaccttattattccacagatcctccaagaataaacaagatttaccatcccccacagtgcagtttgaaatacccctgaaaatatccacaaactacaaaacatccctcctccaaaaagaccctttaggagcatttcatccctatgttgggctcaatccctccccactccctttctttcgtttcctctcctaggccaggccaactctccctccctcctctcctttcctcctagatcaggcgagccaagccgcctgtttagagagaaattttcaaatgatctctccgcccaggaaaataaaaataaaataaatatgaatgtaccagtgtactaagtacacaaagtaaattaatgacaaaggaatcattcattttattataattctcaaagaattacaaaaatacaagttccttggcgaatcatgctccacgacctatcagcgaagcggatctaacttggtgattgtgttgtcctggttccggggttcggaaaatacccgattaattactccaatgagtttaacttgtgacaccttcgattaagctactctagtcttcatcatcaatctttgcttcgcattctctcgtgtatgatgtagatgcgatgaagtgggcgttggtgggcgccacagtagcattcatggacttgtcagtccgtatgccggtggtgttggtgatatcgtctttgtgtacattggtacattttgtgattatccaatgtttgagctcacatgttttatatgtttctttgtgattgatcggaatgtttcagtagagattcttatggtctttcattttttttactctgatacttgtgcatttgttgatgtttcaacagttgaatactgatgcttctagtgcatgagtgaaatgcttaatctttatgcaactatgtttcaccattttaatcctttgcaacattttttttatctagaggtgcagcattttcatataagccgtgaaacagttgaactcttaatacttgtgaatgtaatacaatgccagttaaaattgataagaattacaaaacagcgggagtacgtagtattttaagtatatactcattatacttttatttgcaattaatttggatatgatatcaaatctttgcgcttcataacttccttctttgtcatccaaatgtagctataaaagtagcgccttagttgctttttcttctctcaacatcaccccatcaagtacaccaaacatagaggtagttagaggtcgatcgatcccattacttgctttgtgcaggcaacgatgctggacgacgagaagaccatcctcgagcagcagattgccattggaacagcgaggctggaggaactgcgacgcaccaaccgtgagttggagatcaagctcatcgtctgcgacctcatgttaggccgtcgcaacaacttggatgacctgaccatggacatcctccaggttgtccggatggctattgtgaagtactgcctggaaatacggaaacgtatcaaggagcttcgttccatggatttctccaagcccacatgatcaatgcacgtgtaattgcgtagtgcttagtgtggatgcgccctccatgcatgtctgctcatgtatcatttgctttggtttaatttcctttgacattgcttgtcataaagtcgatcacaccatcaccaccactaatttcttttaaacttttgtgagggcttgtacctttcaaagcttggcttttatggatcattagacaataacctatatgtacaggctataaatgtcaaattttgattatacttactatgttattagtatgactactatacggcacgcccccaaagcctcacccagcgctagtggtgggcactcagtcatgaccgagactttgatccgggtaattcaatcattcaaaaatgacaatcaaacttggtacaaaaaacttgatatcttttattctccttcttcggccatagtgaagtgaccatgttggacgatatgcgtggaacctggagcacatgtgatagggatggacagacgggcctagagtaagcgccatgcaggcggcggccatgggccagccatacagagagctaggggagtgctctttggtggacaggcaacgacaatctgaggcgggaagagatgggagatgaagctgacgagggagaagagggatctatatggcagatagggtagggctggatgaaggaccgttggactacaaacggcgttggcgaatgagagatcgaaggcgatggtatgactatataaggaacaaaataaagaggaggagataaggataatgttgatatatcgggtagttcgggcatccggtgtagtaaacaaaaagactgaacaagggatctatcttctcaaacctaagaccgagctaggaactgatgatcacatttggtttttttggggtccagccttggtttcttttgccaccccttacccaatgctcctacgtgtaccccactattctaatcaatatggcaatgtcaagtctcggtttctttagcgcacccatacccagtgctaccacgagctcctctagtctcctacacaaatatggtaaattttcatatcactacccaatccgcttgtttatataaataaaccaagataaccaaccatatcctttcctccacaatacccactcttgtttcttcagatctagagatcgaataggtgcagcagcaccgacgatgggatattattctccgaagcaaatcaggaggtcatgccaccagccagccattccatcagcactaatgggcccgtacatcacggctgccctcctccggagcaaatctacaggccgtattgctagatgtcccatctgttacggtccctggggctcaccacgagaaagtcgcaaagcttgtgcagacaatgccaaacttctatagcgtagaatgcttgagttttcatgagagctggttgttgttcaatcaagttgctctcactgttaaccaagaaaatgctccaccaaacatggtagagattggaaaggccatagttaaaaagtgtaagggcttgcctttagcgatcaagaggataggcagcatgctgcgctatgaaacgaatgagcagagctggttggaggtcctagaaaatgtgctctgggacatggaccaaccatggaaggtagtttcgtcatccttggagttgaactacaggcatatgactgtatacctggaatgatgttttgctgaccttgcactttattcgaaggattgcgtacttaatgaacttgaggtgcttcagttgttgaaattagctgatcccttcaaaaaatggcagacaagataatgaggtcattcattcaagaaatttatttttgatgttcttgatgatgacgagttgaaattttctttttctcaaattaactgagataaagagttttgctcccatccagcagctctcccggtaccgaatctcagcccttcatcctgcccgatcgaatggtgggaaacacgcggtacctccaggtacatattttctcatgagatggtaccggctgtgctgagagtggtggaagggtatttttgtcttttcgtgtagataagttttctccagctgaactaaccctagttcgattccccttgtgtgtggtagcggcgccagcggcggcaggtgtgtgggcgaccgtgacggcgacttggtggcaggcgcaatggtgccggttccggtgacgaggtggtggtggggtggtggcagtggttggtgcgttggctgccgaagctgtgaggtggcggggaccgcagtggtcccggccgcggtgatgaggtggtggaggcggtggccgatgcgtcggcaaccttgactgcgagatggtggcggccgcggtatcgaggtggtgtcatacccatgcctaatgtgtagtatatccatgttgggtgatgacgagtgggcccatgaaatgggatggatcccacaagtcagtgttatggccatgttataaggcaatctaggtcctgtgcacgagtcagtgaatgaagtgaattgaatctgattccactccttctgttcttcttcctttgccccctttctgttcttcacccgatcccgcaatttcttctcaaattatcttaagttatcagtgtattctgctgctagtttgtgtgattcgatctctcacgagctcgggtcataacaatttggtatcagagctgttctgatcggttctcttgctgcttgattggtagacccaagggaagggttggtgttttacgcaccgtgattctagcctaaggttcgatctgtagagagacgaggaagatagtggaaaccttacccaatggaagcatcaatggtggagtccgttgagctgcataagcagaaggcattcatggcgaggtttaaggcgaaggttgatgaattgagcgctgctgtggatcacatcctcaacaaggtatcgccctccctagctagccccctctacctaacaggcttctgttggtgctgtttcaagcctaggagcaaccacctacactgacgctcaacaagtgttcgatgaaatgccaagtaacaaagagccaaccataacaactgttcttcacttcacggtgagcgatgtgctctatctggtaaccacagaggtacttcatcaagtattagttccttatgatgtggagcatgtgatgattgtgatcgaggcggttacctatgtggaggccgtagtctctttcaagtccatctaagatgtaacacgagctcaacatgcactccatggacgctacatctatgatgggtgttgcttgttagatgtcaagtatgtgcagctatgctccagtgaacagaaggtagcaattcccaccaagtgttcgacgtccacacttgccacctcagccatgcccttgacagaccttgtaggtacagacacgtcacttatcagttacacctcaagtccaataagtgtagctgacgctcagtctagcatcaagtccattgcagccacatcctccaggctgagcaagcgtaaccagcgtgttgttaagtgggtgtcacgaatacgcattgctcgccgtcctgtgcacttggcctggaggagaaaggatatcgtgctcactcatgtcggtggtgtgtcattatttgcagaggcagcagatcaagtgtttcaagaaatatcatgtatgcttgtggatagcaaagcacataaacttgatgaaatggatatgaaagttttttattccagtgaggagttcatcactataattcccataactcacattatagatggaattgcaggcaaggtgcaaaatccaactgcagaaatgaaagtgtgcaatgtgtttacaagaaggttactatgtgccagaaatgttttcagtccttgaaattatgagactaatggagattatttattgttggacaagatactatcctggcaaagaaatggttttagaccttggaacaatgagcagtaggagctacataaggagtgcatatatggaggtttccaagaggggcatgaacatccagttatgcattgttttcgttcttgtgcattgcctcagtgcaaacatatgtttcaacttgtagtttggacaagcaatgggctaatttcagaaggcatgctctggaattcaataattcttaggattaattgcatggaattccaacttctcgactacctgcaaataaaattaaatcgggaagcaaatgtgcaaatttgggattttttttttgagaaagggagggtatctcccccgttttcattaaagaaaacgctcatgattacaacagttccagaaacatcaagttcttacagataagacgagagaaaaaaaaaaggaaaacaaacagttattacaggactaaaacattggcatttcaagcatcaaaacacaggtttccatcgtcgtcttcaaactcctcgccatcagtttagcctgcctccgtttccgggaaatttaactatttgccactcttgtgacatggcaattaacgatttgccacaccctgtcaatgacatgtgggccctcatgtgtctatgacatgtgggcctagtggcaaatcgttaagcaacatccgtaagagtggcaaatagttaaaagcccctctgtttcccatcctattctttgtctgccgcccctccatccaaattttgagtgaaagatctcatttgctacctgccttagtagctgcgccccccactgcatttttcctctgtctccctccttgctctgcaaaatactccaagagtttaaatttgagcaaatggtgtaaattatttctataggatcaacaggcagaattccatcaaagcaggctctgtttcttgctttccaaatggtccacaagactgctgtaacccccaccatgatcaacttcccattccctttgccaaatttcaaaacccacgagctaaacatttcccccacattcctgccaggcttcacattgagagcgcattcaagaacactccaactgaagtgagccatgggacaatctaaaaacagatgttggatggattcactcttgtcacagaattgacatttaatcgagcccttcctccaaccccttttgaacagattatcttttgtaagaatactatttcttagaaccagccaggaaaaaactttcaccctgggtggtgctttgattttccacatttttttagggataattgatcccctgtaatatcaaagctctgtagaaagatttaacagagaaacctttgttagacagtctccaaatcagtctgtctttttcattagttagactaacaaattccagggctctaccaatattagcccattttctctatttaactgcatttaggtctctcctgaatttgattgagcctaaccctctccttttgatctctgccacagtcacattttttgtcaaggttatgttataaagatctggagcagactctttaataggtttacccccccccccacaccaactatcttcccaaaagagggtactctccccattttccaccttcttgtcacaaaatctcaagaacagctctttgatctccattaaaccagaccaaaagtgagaatccccattcttatgtttgatttgagtcagagttttctttttcaaatacttgtttcttagcatgtcttgccacaaaccttctgtgttctccatattccacagccatttccccaacagagctttattcattacatctaaatctaaaatccccagccctccctgatctttagggaggcagatcactggccattgcactagatgatatttcctaataccttgatcttcttgccacaggaatctccttctataaaatcaattttttctctaactccacaaggaagagagtatagagatatcatataaagtgggacactgctaatgctagagttaatcaaagcaaccctccctcctattgccaggagtttcccctaccaacaccccaacttcttttcaattttttcctctacaggtttcctgtaacatcctgaaaattcccaacaataaaaatcactaaaatttcaaactttttttaaaaaaaaaacttttgcatcatgctgattgttatgattcctattgcttgccaaaccgtaaatgatcaccaagaaggtaaagaaaagaactacatttaagcaatagatatgattcatgagaatatatttaatcctacaaataattatgtgcaagatattaaaatcaaataaattaaaagttattattaacctattttataaaatattaaaatatttgaataatataggtgggtgcgataatacgagtacacatgaaatgatgatcattcaaatgaactgagctctctgtatatataatagaaatacgggagtatttaattcgatatgtagatcgattttgcaccaagttcctaattgcatttagggattgaaattttatatattaaacccctccatataaaataaactaacatatagataaattgagctaatgtgctattatgttaataacaggtctcattagaaaattatagaatctttaataaaccttaaaaacaaattggtaaaataaatataaattaaaaataaaagattaggtatggatagtaataaataaaatattatcgcgaccatatttggatcaattaaatttaattgcgatagaataagaatttaccctaattaaaactcaaataaattatataaacaaaatat

SEQ ID NO: 67973 - DNA, 7348 bp, Oryza sativa
  unsure (1)..(7348): unsure at all n locations
gtgctctgatggggcaggctttgggcggggcgctgcgccgcctcgggcgccgccggggcggcgatcccgccgccgcgctgctccgttgcggggtcgtcccctcgtcgtcatcatattctgctccggggacgctgctcccgctgaaacaaccggtgggggattgcgggggctgccgccggagcttcagctcgtccgcttgggtgggttcccgcctgtggcgcagtctgcatcggcgtcagagcgcgggggccgcggccacggccacggcttgggaggcgcaccactcgacgaggtgaggtagagtagctagctagtggctgcttggcgaagggctgcgcattttaattcctcatttcatttctacatttcgttttctggtgctgatgtatttcatatcttgttggtttgcctctgtccaggaagagctccatggcaacagtatcaagtgagcctgacacatctgcttcacagtctgaaatcctacatttcatcaaatccacctttgggacacttgaaggtataccatgcaattgtttagtggagaataaaccaaaaaaaaaaaaaacaaaccaaaatcgttatagaggatgttgcattgttgcaaatggctagcttgtttctgttaagatttgcaatgttgttaatattcatgtgccaaaaaaaatcataaatttccttctagttaccatgttttcccacctgaaccgtttgcattgtttgtgaagaggctgttctgttctaacgtacaagagtgtaatgattttcatcgttatttattatgtttcgtccaagttcttccaaagctgaaatgaacttgcgtctggtacaggaatagtgctagcctttgcttgtagatgcgagtaaatgtgctgctccttattcctgaggattaattccttggtataacctacaatttattgatgcagggcaaaaccattgttggttgaactgcatgaatgacacctggaagaccctcaatcaaggagtataccttatccttttatatgaatcttgtggaacatcagacagccatggaaaactttcatctgcttttcaaagattgaagtatcttcaacagaggtatttatgtaaggcatgctggttttctagcctgacaaaatctggaacttgttttaactcctccccttcttaggtatccacgtctgactgttttcgctatggagtatgggagtgatattagttccctacaaagccaaacagttcatacagtaatgaaggagtactttacttttcctatcttgatgtcagataaagactttacacatgtaaggcacataacctcgaaatcttagtagtactatagaagtttgaaaatgttttcatgatcaataagcgttcgtgaatggtgaatttgtgatgcataaataactgtattccacttttcgttgatgcctttggtgtatttttattgcattttaacctggagatttcacctatatatattctacaaatatgttatgcacatttggtatattcaattttggcagtgttagactcagtttcaagagctctctaatcatgtctctgttaaaattgaagaccttgtgttgcattttcttgtattaaatactttgttgaaacaagaatgtcctttcatgagtgttcagattacaaatggtgcttgctgcttgctatttgaaggttctaaggatcatgccctcttctcaaatttggatgaagagcttgaggttttgatcaagggtaaaaacaaaacatagctggctatatttataatgttataaattatgtcttgtctaaattttctgttctcttgaacttttctgctgtgtttttgtgcttagtttgatgctcatcatttgttaagcctgcaaatctttattgaaagcaggcatggacaatgctgtcttgaaagctgaaccttctgacactgctttagaatcaagagtttcttggcaaaaagaagaggttcctaaagaaccgtatgttggttctgtaagaaatttgttactataccatcctggtacttacttgtcacctttttctggcatataattttctacttaaacatcaatattgcagcctaattctatgaaattgatgacatgttttttcccatttaatccagaagttgtaaatactcaaatagtcaacttaatgtgctgtagcttgcatatcggttgatgaagatggagatcgcattttcatctcagacagtaaccaccatagggtcatcattagcaacagcaatgggactattttagattatgtatgtatgactttctgtttcagttgggtttaaatcttatctgcacagagtgtaggactgcagccatgcaggatgataattgtatttgcccttttcagattggatgctcccctggctttgaggatggtgaatttgaatctgccaagttcttgcgccctgctgcatcattttataatactgctgaagattgtctgtatattgtagattcagaggtaattattcacagtagaatcaattccttttttttctctacatgagaagtatgctcttttcagtagcgatagttttcttgagtactgtgtattcaattatccgtaggtcttgtttgcatattacaccttctacttctttccttgtcctttaccttggataatttacaactacacatgtactaatgcatcgcattcaaaccatactgcctgattcttgttcagaaccacgcagttagaaaagcagatttgggaaggaggatgttagagaccgtttatccagtctccagtaaaagtagcagtggcatctggagttggattgttgataagctaggcttgagacgggaagatgctccaagtgaaaatttcattgcagattcaatagcatttccatggcatttgctaaatattacagaagatgacttcttagtagcagaccgcaagtatgcacaacttctcgccccctacacgttgaccttctttaaatatcaattggattaatttgtctctctcacaatggctatagccatttgcatctaatttaacttattttcaattttctgcaccttttctatgttagattgtcattcgtttgggggttgacatgttgtgcatgtacagtccagtcagatcccagttttagttccatatcgataatggagctcaataatggttctgtggatgcttgctggctattcttttgatcaagtgtgacaagaagatgcttctttcgggaatgcagaacaacattcttcttaagagacttttcttgttcatggtgaacctatagtttttacaagaaatattttaccatctatggctgtgcttaaataaactattgaagtgcttaattcagtaaagctgcactactttcttggtttttaactttttatatggcatgcacacacaatatactgtgcgtcagttataggtggttcctgtttcggacatattatcttgatgatttgctaagaaatgtttcttagttcttatattactgttgtttgcagctttgaagcatcatggatcttgagtgtatcaactggtcaaaaacaggaaattggaagaggtcagtgaattcctttttttggtatgtcagatttaaatttccctagctcattgaagagttaaagtcttgtgaaggtatagctgaagaaatggagtcatatcagcaaataatacatgaaagatgtgctctcctgaaggatatgaacatgaattggtcgtcaagtgctaaagagcattctgatctgttggggaagatcccgttcaaggaacttgtctcgtctgttgcaagatttcagaagtacattatcttctgtgatgcaggttgatctataagctattattgatgttaagacttgattttctgtcaaattatataataaatggttccaatttatttcctttctgtgaagatggtcaaagggttttgaagcatgacttggataccaatggcacctcaaatattcaattttcgaattttggggtccttgggttgccgtattggtttgtttgccatctcgagagagtatcaaccaggtaagctgcttatcctatatttatatgctcaacgtgtttgtgatgacatggaaattgatatgctgatggtagaagcttgagtgtgcactgttttgatattcatttctctttgttttgtaatgaatcggcaggggacattcaattggaaaatttcaagagcatacccgtaaagtaaatgtgctcccaggtaagtgataaattaacagtatctgcctgttactattatccggttgttccatgtgtgccacatgaccatcattgactgcacttatgacagctctaaatctacttgcaagtttatggtcacatgacctttagacccttgttacctcagacagagtggtatcacatttgcttgctttcagcattttttttgtaacttgcggtgccttcaacctcaattgcttttgaattgacagcagtcatgtgctgcaattgcataatacaaaccttccaattctaaaacaaactgcacaaatttgaataatcatgagaaataatgtaagttactcaggtgcataattttaagaggagctttacttattgttttgtctactgatgccacactgtactgctatgtgggattcattcaagatattggtgtaactcgatgtgttcatttcacaggaagatgcaatataaaggtttctgtagatataccagctgatactcaacttgccgcgcctttggtcgagagttgtatttggcgccaagtaaggggatctggtgctgaggtatctggttttgatgaaccatccacaagcacagaaaaggtaaaaggaactccttattttgttcatgaactctgtgatctcttgcatagagtttgaccacagttgaaagaagctaatccttgatccgatgcacatgaactcaggttggtatagcacagcaatggtatgatgagatagacaacctagctttttctgaagttcctgaggaacctacagtgcatgaaggtgatgagaacctttcagatggaagttatcaagaacagagaagagcgcatttcaactgtgttgttaatgtcagtcctgggacatgcgaggttcgtctgtctcctctaaaaaacaatcttctacctttgtggagggaaaatgccttactggtgttatgtcatgataactctcaattactcatgttttcatcacctagaagttcagacacattgttcacacaatgccatgttgcctttgcagctggtggcctttgctgcgttgtacctgaagatcgatagcgcgaaagatgaccacggagaacagaaatcactggtgaagaggatcatccagtgccagcgtcgcgaggatcacgcaggcgttgagctactgatggagagctgcaaggattcgagggacctgacaatcatgaagccggtgcacctgaggctgatgctggagtgtgccgatcatcctgctgggaccaccaacaaggagaccatcagctcagagtccagctttgagataaacatctctttagattagtttccaatgatacgcatagcatgatagagcagcagagtagtttgatttgttcgctagagagagaaattcaacactttcagatagttttgtatctcgatggtcctgttccacatgaaaattttcagttgagaaactggttcatggagcacttaagttttttttttcttttggctcaactttactaccacaagtctgtaataactttctccacttaaatagtctaaaagttcgaatccaaaattttgaattcaacaaaaatcgaaattcgttgcatttggtctcttttgttttgtgccaagacctttgtgcctgcaccgttatacaagtccacctcagctcgatttgaaaaaaaaaaatcggtcagtaatatttcctcttcgttgttgttattcatgtgcatgatgcaaatatatttgatcaaattcagatgttatcttgagcaagctagaaaatttagcatactctgaatatctctcattttctctatgtcatcagtctccaaattctttcaagggtgtctttccaaacttgaactgaaggttagctagctcatagtgttccaaacatgaaacatgtgtgaatttggaaacatcatattcgaactacttactcgcacacccacttatatgtgagtaggtaatctacaaacccacttattaaagatcaaaataagccacttacccgcttattttaacttataaatgagttcgcggattagccacttacactcttaaactgatcttggatcgacccgacgatcaggtgtggtgatgaactgatgatcagctcggtgacaataatttcagcaaaggcatcatatagcacaacaacatctacgatcgctatgatttcaagagacatgagctcactagctcattatctaaaaaatgagctcactagctggctgagcacgatgggattatcatgtgttcattatccaaaaatatttgacttggtattattctaaaaatgtttatattttaggtcggagcgagtactactagtatacctagtatactttctccatcccataaaaaaccatggtactatattttcatttcatactgtatacaccagctcttaaaaaaaaaaactgtacacacctgcctaacgctgacgaaaaagattttgaccactcccaaaaaaaaaccacacaggttttgacctgttccagtgtcactgacttgtgggcccaggagtagccgcggcttgccctcgccgaccttttccttggcgatgggagcacgcgaatcacgacgcacgcacttccttctttccttccttctatttctaccgccgacgcggccgcgagccacggngagcagcggcggagcaccgacgcggcggccatggagaggaccgcggcggaagcagcggctggggggaagggggcgtggagggacggccccgtgacgtacctccacctcctcttntacatcgccatttccggcggccagatcttcttcaacaaaggcaagcccaccaaagcaacccttctatcaggcgacaccatcccctccctttttttctaccccccgcgcttctccggcggattctgcctgcgcgtgcgcgtgatccgccgccggcgtgcccggctgtacggcgcggcgggcggggggttttctgtggcggctcgtttttgtttctggtgctgtacggtgtgcgaaatgggtaggattccggatttctgttcccctctagcttttcatggatggtcaggagggtttagattagtgttaattgttgtctcagtattggcgtcatggatgttctgacaccgcgggatgcgtgtaaacttggtgaaaattggtggattgcatctccgtgtgcggtctagagtgagcgctttcgagattcgaagatggtgt

SEQ ID NO: 67974 - DNA, 1895 bp, Oryza sativa
  unsure (1)..(1895): unsure at all n locations
attctcccccaccccatctcatccttcctctccctctcccctctccactgcgccgccgttctcgtgccgccgcgccgccgttcccgtgctgccgcgttgccgttcccgtgccgccgcgccgccgttcctgcgccgccgttcccgtgccgccgtgccgccgctcctgcgccgccgtgcgccaccgtcgccgccgccgtcgtcgccgctgccgccgccggtgagccgccctccttctccctcgcgtccatcgccgccgccgctcgggtgggagagagccgagagagggagatagagccgagagagggagatagagccgggagagaggagagaaagaaaggaagaggaaaagagaggccgacagagagagaaagagagaagaaaggaaaaagggagagaaagaaaaagaaaggaaaagggaaaagagaaaagaaaagaaaagaaagagagggagagaaaagagagaaaaagaaggaaaggagaaaatagaagggaaattgggggagaaattaggaggatttaggaaataaaaatggtcggggttaataatagattatttttggaaattcctcgagcgtaatagtatttcgatcgaaattccgagttaattataaatatatgtttcttgatcagattagattaaaattggtaacaatttagatataattaataaccatacaattagatgaattcttatagattattatagattatttttggtaatctctataagtcatcggttcatggtagaaattcggattcaattactaggaatcttagccgtgtattatatttaatcgtttagtcatagactaaattaaattgtataatatttctaagatttcgtccgatatttagctcgtaatagaaatttctaacctgttatatggatataatgctcgggatgagtaaattaaaaacttatgacaacaaaatatttatacccgcaaaatagtttaaatcgaaattgggtttgccgtagttcgcagatagtaaagttaataaaaaggaatcgactttcgcattcgacttttactcggatttaagtgaaacttgaacctaaattcatctaaattcataagctttccaatgatatataattcactatttaacaaaatatatttataattataaattaattaatatcaaatgattagataatagttaacctaaatagtgtgccaatgaataaaaatggatattgtacagtagcataattatctttaacctgtattgtatagcttacagtaaaaagcaactactcaaatatatgatccaataataagatattgttgcttacacatatactatacatcccattatagtggtacggtatagtattaatttgcgtgttgcataaattaaattaagagggagagtatgacaaacatgtatattagataaataccagttataaatcttgatctcatataattatagttatagttcaactgtaaattaggattattcattgtaaaattatgtgatgggataatctgtacccataatatgattaacctgaacaactctaacatacaaagcatggataattattaaccttttataatttattgtgacaagtaaaatatgttcataattaaagtaaagcttccatcaataaaataataatacaaatgatgcactataactatttgattgatcctaaatccatctaacaacagaacctctagtaaataaccgtcctatgtagatagatgcatgcttagccataatccttccatagccacttgatagactaaaccactgattagccaaatatatatgtatcccataaatgctatgtaggttaactcctaaataggccacgatgacaatagaaagattaagaaactttagccttagcatgattgggatccattagcanacacgaatagtac

SEQ ID NO: 67975 - DNA, 3155 bp, Oryza sativa
caacatcatgtcaaccatgcgtcgcgatacttaacaagtacccgaatagagattgtgacaataccctctgcataacacaattcaaagcagtacaccattcctggatcataatcacccccttataaaacaaggcatggactccccagcgacccccgtgggcttatctccgccacttctctgtctggtgccccacaatgaaccacactatataaaaggtaaagccattgcccacgatggcttgtggttggcacgattaatgtttcacaaccgaaaatcgtgaaccggaccttaattgtcatgagcacgaccatcaaaaccatgtgctcacaacccaccattatcatgtattagttggcatcttaattaatcaacctatcatgattaaccatcatgagctaccactaaaccatcattaagtaatagtgaatcatttattatcccattcatatgagctagtgtctctatgcatggctaagcatcctaatcattttagccaaaaccatataatgttctagctaatccaattattaaccaagtgaccaagtataggtaatcaataacaaaaggctataacaaaggaaataggtcattcctacccgatgattgtaacaccccaagtaaccacgtacctagagtgccataccaaacatacactcaaaccactaactcccaaaattattagaaatttcggcagagtctcccttgtaaatacggacatccatgacaggcaattataagttaaactaataacaatatcattcccataatacgatccatccttataatccatggggaagaaactattaaaaatctaaaagattattacaagaccaaaccatgatatagtttaagtatcattatggacctaggcaatatagtttgatagtgtgcagataaatatgtatataagagtgctacttcccgcccatgcatgtcggtctcaatatgtacctaaaaccaaataaaacacaagagtgagtataaaaatactcagcaagtacaatatggaactagaaaacacatatacacatcattggcaataaagcatgaacagaaggctttctttctctgataggaaacacaatttcaaacaccaagtcaaagaagatagtagttcccatcccaagcaggcatgaattgaaatagtagtttccatcccgaacaatagtgaatacatcctaacatttgccggcaaaccgagtaagcgtgatcagtgcttacccacacgaacatgaataaagaaccaaattgcactcccatgactacgcatggtacttgaataattgaaaccggaatcaaagaaccaaattgaaatcatattgcacattcatggcaagcagggaacttgaattatttacccagaaccagaatccggaatattgaaacaagaataatgttgtaaacataggataaacatgaaaatctaaatggcttgaacaacaatatgaatataagcggtcacatgtcacatagaaatatatcggaaataaatagatagaacaaacaatccatcaatcacacacttagttcgtcatgcacttgcctccaatgaagggttgatatcatgcacgatctgaaggaccaccacctaatcacaaacaaaacctcagcaaacatattcaaacatgcatataaaacaatgaaaaaggttaacctactgccccatcccatcaaaacgcaataacaaggaacgccgcttgcactataaacaatattgttgcttcaaacctttatatcttgaaatatgaaaaggctatgaccgcaaataaatacattttggaaatctacagaacaaggcctacaactcttatgtggaaatcatatttttattatgccattaaaatggtctaatttgcgcttgaaagcaggcttcacaatctgtccagaatttcagactatccgcactaaaacaatcataactggagttctacatgcccaatcagggtgtactttaccaatatggaaagctaagaaaaatctctacaactttatctataggcgtcttggctgattccactatttatcccgtccaaaaatagttcaatctactactatccagattatgacataaaaataacagttatactcaaaaattcgtatcgtctaaaccacttgagataaattcgcgccctttggtcagaagatagatataaatattatctacaacttcctagttgtacactttcacataaaatatcatttagatctccgaaacttcgaaaaactgaaacactgtaaatctgccaacgtgcagaacagccaattcgaaccacaacaaacaaaactccttctctaaccttccttatccacgaattaaaccgctataaccaccctagatcaactgatatgacaagagaaaaagcctcacctagggtttctttagataacttgtgaggagacaataggggagactctgatctaacccctccttttactcctctccacctcctcgttccgtttttccactttgcttcttgatccaagctataaagatggagatctagggagagcaatttgctgtagaggggagagatgcgaacacaggaggatcaggaggagggaggcgccggccagggagaggggaggcggcactataaggggaggtgggattcggttcccctctctgttttaggggagaactaatgggctgggtttatgggccttctcatgttggcccacttctaaagatattttttcttttgtttatttatattaacatctttattttaacaagtcaacccaactaaaaacctaaatatattttttttaatatacggggtattacattcctcccccttcaatcgaattcgcccactgtagagcttgagaaacagtaaaaatgaaaggaatacacaaaacatacatataaagtagttagtactctcaagcaacttcgaggacatctcctatattcacaacactgcttgcgtctaggtatggtaggtaataattaactagcataagaaagtttagtagccaacaattcaaaaacagctaataaacctactcagacctactagatgggaatattggcttgccaaagaagcacaatgcacatactaaaacacccaattggggcatattcaagaatcattggaacacatcatgaagaatctcactacaaagcaatggaacaaattgtgaaaacaaccttt

SEQ ID NO: 67976 - DNA, 10073 bp, Oryza sativa
ataatctgtacccataatatgattaacctgaacaactctaacatacaaagcatggataattattaaccttttataatttattgtgacaagtaaaatatgttcataattaaagtaaagcttccatcaataaaataataatacaaatgatgcactataactatttgattgatcctaaatccatctaacaacagaacctctagtaaataaccgtcctatgtagatagatgcatgcttagccataatccttccatagccacttgatagactaaaccactgattagccaaatatatatgtatcccataaatgctatgtaggttaactcctaaataggccacgatgacaatagaaagattaagaaactttagccttagcatgattgggatccattagcaaacacgaatagtacattttgttgcgcatatttgattgttgtttgaatattggtttttctcgcgtattatagaccttgtgtatcggtagtcgtgaggcaacgtctgcaacttccaggaggtgaaggttgatcaagattatatcaagaataaggactatcctgagcaaggcaagtcatcactattccttgaacatgttgatcctaattgcgaaattgttttgtttacaaataaaattgcatgcaatcatgaacatcctacttgtgattataccatgccttgattattgttcacctttaaatctttgtaaccatagatacgtacgagtccctagtcaactatgacacttgcttagaaatgctattttagattcatgcatactcatatttatcaaatgctatatgcttgggcaattacctttgggaaggtaattgagatgcggcatgtggagacatgagcgccacattgccatgatattgatgacataatttgtgaaaggaaaataaagtaaaacaattgttttcgactggggcggctggaggatttgggtggtgtccggaaaaggctagtgccgtccctggtcaattaaggaccgagccatgaagttaagcatgaaacgacccccgtacaaccgcatttctcgtatgggtatagacctagcagagtagatagctgagcggaggcagtatccatgcatagtggtttcttgatgtgtgaggcaggggctctacggtggggcagccattggtaggaccgcgaggcgggtgtctacaatggtgtcgccatcggtaggactgccatgtgagattctaaaacataattataacttaatgcatgtgtgagtcttcccttcccgggtgcgccagaactcctctcactgctagaaaccgtgtacgcctagagtgtatgaggatgaaaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgcttgcggttattgagcaccgggacatgtattacacttggctagactctaaattcttaacttgtgtgggatgggatattgcatgatgaattttatgctgatggagccacatcccgagagaagggaaggtggacatcctcagaaaaccatgacgattcaatggcgcgaagctatccttgggatcacaatggatggtggacagaaccgtcgttgtttaaaagtgaacactggtactaaaatttgatcagtctatgctaggttttaggcttgtgaaaagaattgtaaaattagctttatgcaaaagaacctgaagccattccttgaaataccctctgtcatatgcattgttgttgtggtggcttgctgagtacggttggtactcacccttgctatttatatatcttttaggagagtgttgaagagaagcccttgtcggtacgcttgcgtatcccacaagatgatcggagtgctgtcttgttctaggtctcgttccccagtcgactgcctgtggcatgttaaccgggcccttatattattttgtcttccgctgttgttctctgatagttgttggcctacctggccctaatgtaagtatttaactcttttagcctaaattcattcgtgatatgttgtgatccaactatgtatgtgtgtaccaactactgatccagggattggtacggataaacacagaagatttccgatttccaaaatcgagggcctacatttccaatctttgttatggattcttacttgaactatgggaacacccaaatatttcattggcagtctcccaatttggcaagtgaacatttggctgtatgagtcctgtctctcagctgcctctcccaggcaaaaaacttcacttttatgaaagttcacttttatgaaagttcacttttaggccagtcaattgctcaaaaatacacagaatgaatttgaggttttttgcatattccagagaatcctggatcaggcatatggtatcatcggcatattgtaaaatagccaccccctctctcatgacatccattcccaaacccttgattagtccctgttgctctgctcttttgataagaatggttaaaacatcagcagcaatgttaaaaagcaagggtgagagtggatccccctgtctcaaccctttgtgtgttgtaaaatagtgccctatctgatcattcactcttatggccactttcccccctttaaccactttcaagatccaatcagaccatatgtcagggaatcccttggccttcatcattttatacacaaaagaccacttaatgttatcatataacttttaaaaatcaattttgaaaagaattcctgcctgctttttttgatgaattgagttcagaatttcatgcaaagttacaaccccttccattatatatctgttttttatgaaagctgtttgattcaaagcaatcaagacttcaatcacctcagccagcctttccatcaaaatttttgttatgattttgaaactcacatttaaaagacatattggtctgaatttctgtatcattcttgcttctttgcatttagggatcaaagttataataccataatttaatctctcaactccaatttttcttttcatgaaatctgtgattagttccatcaagtcatccttaataagataccaaaaatgtttctaaaattccacaggaaatccatcaggcccaggggccttattgttttccatcccaaaaactacatttttcagttcctccatttctattggtctgattaatctctctttttcagcttcactcaacatagctatgccttccagattcaaagtaaaatcattctctgggggggggaccaaaaagctgtttataaaaatttgttatatatttcattagatcactctgtcctttaatctccccctcttcctgatccagagaataaatcatgttttttcttttccttccattggctttagcatggtaatattttgtgttatcatccccttccaaaaggtttttttctttacatctctgcatccatttcaatctatcctctcttactactttcttcaactcttcctccaaatcccctctctcttttctttccagaatagtcattccatatgcttcacattttttatcaatgtcttctatttttcccataatttcctgttttttccttttgtacatcccttcccagttcatgttccaaccttttagtttctttctcattttttgtagcctccattgccatttatcaatactggatccatttatgtgcaaatttgggataacttcagaactatgtcaatttccggtttctccatctggcagatgttatggcagaaagtaccatggcctccgcctgctcgattttcagttcatccattttggatgattctcaaggtagtagtatgcgtgcagttgcaaatcagttttggcattgcttatatgctctatttcgctggcgtgcttcctctaggctcctgcaatcctgttgtaggctttcccaagaactaatgcataaatgtgcacttgtaagctggactacgcatttacaactaattgcaaaatcttcaaaggatatgtatatgcatatatatatacttgccgacgtgatgtgcttcgtgtggtgaacgcatatatatatatcagaacagtggtcaaaatcttccatgacactagccacttagtcgtgcgttgcacgactttgaattcccgtatgaaagccatctatatatgcatcgtaattatgtcaaaataacctagccgttctcagactaccgagtaggcatgaaattgccgataagtcatctttgttggttgattttatcgacttatgtcgataagggttaggagaggatctaaaccaccggtttccttatcctaacaagaaacaaactaagagacaaatttgttttcttgtgtgatcggtacagaaaacgaattctaaactaattgagataacccccgagccccaccagtgtcgtctatataaagaaagagaaggaaggaggcaaatgacgactgatctctctctaatttcgaaccctaattaattgcccgatcaatcaaggcactggaaggggttcgtgaggcatctctagaagaagaagaaaaggagaacagcaatggcttcaaacataggtcagtagatcaattatttttccgcataagtaagaggtgattgtttgtagactaaagcctaatatcctgtaataagaactccaacattgtggtatcagagctgatctttagtccactcaatccctcataatcacatcatccctgtgattagaagccatccctaaaaaaaggttcaagattgattcggcatgaacaattttgaattagattagattaatttctttaagtcttggttgcatattaagccatgttatactgattggtctcggtcatcagtagaagaagctgtttaattcaagttttctatttaattggttatccatcagtggagattaagagaaggggattgggataaacagattgaaactcccaatttccccgcaccctaagccgaagcaaattaagaaggggataaactagattgaaattcccctaaatttagcaaaaggaaattcccaatttccgcactcaaaattcctagaccgaaactagggtttcggctagtacaaagcaacaagaattaggggataaacaagattgaaactccccatgggtaagcaaagggaataaacaagattgaaatttcccgaaaccccaataagccgcatcaaatcagtctagaattcccaaatcgaagaacccaaattttgggaagaaccctaaatcccacatacccgtatcaaaactcaaatcaaatcaatctaagctagagttttggttcacttacaagaattgcgaaacctcctaagcctaccggagcactccgggaagcggcgtcgctgccttcacctcctcgcagccgcgttgggttctctgcgcgcgccgtcttggagtttacctccaccgtccctcaccggggacaggaagcgtcggcttggcggctgccttcgggttcccccccccccccccccgccgacgaggtctggccgtagcacacggcttggcgccgccctcgggcacgccccccagccagtcgaggtggagccgctgcggcgctcgccgccacatgcgcgcgccacctcgccggaccgccgtcgcaacatcgccgccgattcgctcgctcgctcgccggacgccgaatcgggggagagaaggggagaaatggggattagggttagggtttgacccgttcagcgatttcagcggcgaaggcgaaatcttggccgtctgtttgatcggacggccatcctcgctcccgcgtcgggccgtcgccgtcatgggccgcgccgatctgggccgagtccgcctaagcgccgcgcgcgcacataggtaggccggtcctttttgggccggcttatcgataagaatgcgctttttattttaatttattattaagcccgcgaatttaatttctcagaatttacttagcccattttatgggccagcttaggaagtgatgggccgcattattattttaagcccgccatttatgtcttatttatttccagaaatttatttatgagttttcttagccatataaattgctggaaaattatggtcaattatttgatcacttagaaaattatttctagttaaatggaaccaacgggaagtttggctagaaagaaattaatgatatgatattatatttgaccaacgttaatataatttcatgtcaatatttattaagattattatttccttaagccacttaatttatttctagttgaatggaaatataactagaaagtatttatgatttcatgtcaacatcattatgatggtcatttccttagtatattaattatttatagtcgaatggaaccaacgagaaattcgactagaaagcattaagatgtgaagttatattcaacccactttattatgattgcgtgtcaattataattttttattccttagttattttctaccaaacagtgatataattgaggaattgattttaagattattcataattatttatgaccaatggtgctttgactatgaaattctaagtttattttgcatatgatcgactaagccaatgtaaattttatgcaattggcaatgcttattatttaagatcagttgcaatactgagtaatttatttctagattaatggaccaacgggaagtttatctagaaaaaagatgatttcattaagattattatttccttaattatttctgcccaacggtgatgtaattaaggaaacatctaagtatcgtcaatcattaatttcattttctttgtcatcttggcctttacggtgatatgacttagaattttacttatgccattagtgcattaattcctctgtcactcgtgccttacggtgatatgatcaatgatctctaatctgttactaagcttaattcctttaccatttctgcccaacggtgatatggctaaggattttaatttcatgtcatttactaatggctttatgccctatatcatattacctacttttggtaatttgatttaggatattgattttcagtaattcattattctctgccatttcataatcctttctaccctatggtgtttgattatgaaaattaagatttatttgtatgtgattaattaagccaatggaaattaattgcattactaatgtttaattaataattaatttttcagcattaggacagcttaaggccattcagcttcttgatggatcaaattacattgaatggagaaataatgtgcttattaacttagccatgttggattatgacttagccataagagaggatcctcccgaggaacctcaaccggccgaagaactcaatataattggggaagaatatgataatctcatgtgggcctacaataagaagttagccaactgggagaagtccaacagaatgtgcttaatttatgtcaagggtgccatctctctagaagttattggagaaatcattgactctaatgacattaagacgtatctggcaaacattgaagaaagttttgaatttgcacctgagactcatgccaatacgcttgtaaatgagatgatcactagtcattacgatggcaaaagtggtataaggaagcacatccttgagatgactcatatggcaaatcaactcagatccatggatatgaaaatatctgatggatttttagagcacatcatcatgagatctcttggtcctaactatgatccattcaaaataaaatataacactcagaaagaggagtggaccatacaagaattgatcttacactccgtggaagaggaagagcgccagaaagctggaaagcagaaggttaaagaccggctaaacctcactaatgcctttgataaaggcaaaaattctatcaaggggaatcctctaataagaatagcaagccagagggtgagcagaagcaagaagggatcaaggcctccacttcagctgttcctttaagcacaagtccctactgccacttctgtgcgtcagatggacattggcagagcaattgctcacacttcacagtgtggttagtcaagaaaggtataaatgaaattaaataaatcccttgtgatgaattttcccttaatacttagtgagtttgactcaatgccgctgtgcatgtttctaactcattacaggaaactcgcactgtccaaacggtagcaaagaggggagtgaacactcagagtaactgatggagtgaagatgaaagtgaagggttgttggagacctcacacttagtttctccagcagttgcaataatgtctcatttgttcactctattaagagaaactttactagtttaattatttaaagtcatgtgagaaacgggtcatgtctgttatttttccaaatagaacatgatatattaagtgtgataataaagtgattggtcttgtccttgtgcacgacagtcatatttgttcttttggatgaccatgtgactattataataattgtttgtaatgacaaaagatgagacgtcattgaaattgtgacattgtcattgatgtcacatttctaggggaggttagaacgtctcataagttggagattttctttcccttggattaattttaagtaatttaagctttaagggaagcttcactaagttaagaatttagccaataaataacttttggctatgtttacccataaggctatgtttactcataagcaacctccgatttccttcaagaaatttaagattgaagatactaatgctaaaataaaatgaagttatgagatcggattatggtggtaaacactaaataaagcttgttcacccgatgaagacattaaaaataagcgttcatccaaatggttttcgaaccatgtaagaataaattgagattgatgaacaaaataagacattaaagtgttcatctaaatgttttttcgaaccatgtaataaagaatttagtaaaagtttctaaatgagtcaaaaataggccatttaagtgggttaataaaattaagcctgactctaatggaaattttcgaacaattcaagtgaggtggacagctgcatgaaaattaaaggtgggaaatttcattcaccggtactctatactaacgacattttattgtcaagcaatccatattgatgttagaaactaaggaatttttccatgaattattttggtctgaaggagtactgggcttatatcagtaagtcatacattgacataaattaaagaaataatttgagagaattcagttaaagttagtcaagctgagattaaattctaaagttagactcagctgacagaagcttgagattagttcaaatctggatgcatacagatttggcaatcattttgctgggaatcttggcagtattaattaaatccagactagacggccactggtattaagaaagttttgtattatctgcaaaacaattttaagtaacatgctcatatttctaaagtccaatgatctcagaagtttagagacatttggacacttattttgtgagatgtgtggatatttataaagattattaagttaactaagattaagctatgtccacacataggggagcaataaccatggaaaagctccaaaataatctcttactgcatagtcgacgatgcagttagattttaaagcatgttatgattaatcataagaatatttcccagaaataagagtggtaaatagcgctcataaaccactcaaaaggtgtaaaccacccaaaatatactgtgttataagttgtgcactaattgaacacagttttttattctagtagcgacatgttgtgtgttttctgcctaacacattggtatggttgtgaaagatatgtcccaggatcgaattattaagctaagcatgtgctaatggatccatactctaaaggctcataaattaagattaattaagattatgttctggccagtacatatgtaaattagagccttactaagatcctggatgagggggacttaatttttcaatcagcacccactaagttaagcttgagtttatttgagtactatagtgagctataggtcttgttgtctcagtgacgcataatgttgttgaagacacattgccttggggagctat

SEQ ID NO: 67977 - DNA, 629 bp, Oryza sativa
agaagcagagagcagagagagcaatggcgacggaggaagagctcacccttgaggcgcttgaagcgggtcttgcactgggggcaagcctgcgagccctcgcggcgctcgtagtcgtagcagttgcggcagacggggaaggcgcactcgttgcacgccacgaacggctccccgtcgggcccttccccgacgtcgtcgccgcatatctggcacgccgccttcgcctccgccgccctcctccccccaacccctccccctcctcctccatccctcggatcaccaccagctcgttccggttgtgcgaccccgccaccagccccgcgctcgcctccatcgcaccctcctcgtcggcggcggcggcgatagctggtgcgccgcgtgggggaggaggaggaaatggggggaaggggaggtggtggtataataatggtgtttgttggagagagagcagagcagcctcctccgcgttgctaggtcagcgaagggtgtgtttttttttcttttaaatttttttgtgacaaagattttcacgaggagacagagagaaaggagagtgtcggtgtgtgggagattaaaacgggaaatgtttttgtttagaagagggagagagaaaggaagggggttggtggaat

SEQ ID NO: 67978 - DNA, 718 bp, Oryza sativa
cctgcagccctgtgcatggagagaaagagtgatacatatagcttgatctccatgcaatccttgttatttagatccaccatcaatgaacgtttctatctcaactcatatgaagtctaagaatcacctctcacaaattccactttcatattcacacgaggcaaggcaaataaatgctcatatacattagtttcataattggatttatcattaatcaccaaaaccaaattaatggcacttgaactttcatcgggccgtagctgtggcgaagtgttgcactgttgtggggaggcgaggtgaccttgcgccgttgcggctgttgggatacgcgtaggctacaatagcataaatcaaaattttctatcgcgtaaaccaggaaccatgcaagtattagatcatagatcgttaccactcgacgcactgcgcagcggaagaagacgctgagaagtcgaaggaactctcgcgaagtagcgcgcgtcgatgtaaaggaagtagtcgatcgcaccggctcgaccttctcctcctcgtgcgttctcctcgctgtactcctatgccgatcagcaccgcaaaccagcagagcctttactggtatccacacgtacagggacggaacgccacgcacagatgtgctagcacccgcgcgcggctagggttttgctcggggagggaagtgacagctaaggtttctcacgtgatgcaatgcctccgcctgtcacacccc

SEQ ID NO: 67979 - DNA, 2709 bp, Oryza sativa
ttttcacacgcaaatagtagtaaccttctgccaactacgcattgcatttcgtgtaggcagtcatttacaatcttacatgttttcagctttaaaaaaaaactgtcatctgataggccccttcattgattaaactatacataatagtatgccaactaatcatactactccgtagtagtagtagtatgctagtttgagtatgccaaccatttcatttcatctcgtatttggcaatttgagtatatgccaacttaaaacatacgagtattaccagtttgagtatgccaaccatcctatttcgtatttggcaattttaagtataccaactcaacatactagtattatcattttgagtataccaaacatttcatttcgtatttggcaatttgagtaggccaactcaatacactagtattgccaatttgagtatgccaaacatttcatttcatatttgacaatttgagtatgccaacctaacatattacttcatcatactttttaagctaccaggcctaatatatagctaataaaattaaagccacactttaactatatattagcgattctaatcaactgattcctaagattgatagatgagcacggtctcgatcgactctcgacagcacacgacacgcacatggtgctgaactaagtgtgtaggtattatcttcttctgcctaccatgttgctcctatatatataaggcggacatccatagtggccacacgtctccaaaagactcgggagaagagatctaacagtcaactcgtaaaatactccctacgtttcatattttaaattatttgactttttttagttaaacttgttaaagcctatgtttataaaaaatatattagtattttaacataaaataaacatattataaaaatatgtttgagagtagaaacagccggcgaagcgtgacgatggacgctcgacggcggcggctgtccccggtggtggtcgtagcggcttttcttttcttccccctgttcttcggtaaggctgcgatttccatctctctcttcttcttttctttttccctttttttacattttttgtttggttatgtcctgaaagggagccagccggcggcggcgtacggcgaggcttcaggcgccggcggcatgacggcactgcagaagcacgcggcgttcttcgacaaggacaatgacggcttcgtctccccgaccgagacatacgacggtgagcttcaaaggccttctaaatttctagtactttctcgtttcgcttgtgaactgaacacgatttggttggtcttggtctgcgcgtattttcgcctcattttatcctctcatggttgcatgcatcgcagggttacgcgccctcggacttggagctggcttctccatcttaagcgctgcgttgatcaatggcgtactttcactcaagaccagacctgtacgatcagtatctctctctctctctctctctctctctctctctctctctccggctcaaaaaactatctgaagtttttatcgttttatttactgaatttaaggtgcctcactagtcactacaatgacgtgccgttttgagagttgttatcatcgcttaactactgatgacaaatactccctctgtccctaaaaaacgaatctaaaactgaatatgacatattttagtactatgaatctggacatatgtatgtccacatatatctagatttgtagtattaggatttatcattcagtactaagttgatttttatgggacggagggggtagttgtgtagtgttaggctatcaactcagtagtggcttagtatagttcgtgtgccaattttttttagtatacggatacatatttgaagtattaaacgtagattaataacaaaacaaattacagattccgcctataaactacgaaatgaatttattaagcctaattaatccatcattagcaaatgtttattgtagcatcacattgtaaaatcatagcgtaaaagattcgtctcgtaatttacagtcggactgtgcaattgtttttttttcatccatatttgatgctctatacatgtgtgtaaatatttgatctgatgaaaaagttgaaaatttgaaggaaaaagttagaatctaaacacggccagtattgaaaatctaacccttccatgtacttcactgctactgtcctgatcagacctcaattctggacagccgcttttcttctacagtaatgttctataattattatttttttctctaagatcgttagaacgtctctccatgtactcgttttaggttataagatgttttgactttggttaaaatcaaactgctttaagttttaccaagtttatagaaaaaaatagtaatattttttaccaaagataaatttattataaaaatatatttaattattaatttaataaaactaatttagtaatgtaaattactatgtttgtatataaacttagtcaaacttatagaagtttgactttgaccaaagttaaaatatcttataacctaaaataaaaggagtatgtttttaagtgaaccatttccaatgaatgacacattacatacaaaaaaaaaaggcgtcaaattaatcgttggatcatgttgaattcacgcaggacaatgcaacatcaccacgcttagataatgggaacttataaaacccggcttctacaccaacggggatgtatacagccacagaaaatccgaccaaacaagctgggctgcagga

SEQ ID NO: 67980 - DNA, 9301 bp, Oryza sativa
cctgcaatctatagattgcagactgcttatgatggaagcctgtttgcgaagctggtgaaggcgaggagataggagcaaaaccaggcatgattgttgacagctgacgagagcttctgcattgatcctcctaattaagcatctcagattatgtgccactgtgctatgtgaacggctgactgtgtattcttttactccctctctaccaatatacgagacaaagcttttgccctcctttaaaaaaaagagaacaattgagattatgtccttttttttcttttcgagaatacgaggagacgatttgtaccggattttaaagatgagggaggccctatacttggttgtgtgattgatgcttgatgaggttattcaaccagcagatagaaatcagggatgctaaatagacttattcagcaaatatacgcttggatgggttgttatcgtattacaatccgttggaaaaggcccattaccaccgggaaaactacctcggagcccacgcaaaaattacgacagaaatccgacccacactgcgctcctagtcttccactcttcctcgcttcatccgctctgcgcctctacccctctgatacatgtctgggaggtctttacctgtataccattaagggctcgttcggattataggataggaaaaacttaggataggaaatttataggaataggaaaggaatttaagtgtaaaatagaggaatgaaaaacaaaggaatacaaaagttgagagcattcagatcacaggaaattgattgcctaggatttgcatgcagaaagcgaaaaaaaagagctcgaggtggatggattttcctgtacttttcctgtgaaattagcatcaaaggaaactttcctttggatttcctacaaccagttttcatgatccgaatgacaggaaaggaacaaaatcctatatacagtattcctccaaaaatcctgtgaagttcctctaatccgaataagccctaagaaagatggtgcctgcctctgtgccactaaaaagtttgaaccttcctctatgccatcgtcgaactttatcacgccctccacaccattccgtcgctattctgtgtgagtttaaccgtttggcagctctgacatgtgggcccgggcaggaaatgtcgctcttgcccttttagtgtctgcttcgtttcaaagagaggccaggcggcgtggcggacaagcagccaagcgcggcattgaggcaagcgaccggtgtggcgggcggcaaccagccgagggacggggtggtgtggcggccaaccgacacgagcagcgaggcagcggatgaggaggtgaagaggcccgtcccggaggagaagtcgaagcccgtcatcgtaagtagggtgctggtgcagacctcgatctacacaaaggaagaggtgaatgccatcctgatccagtgcggccggctcagccggagctcgtcatcgtcggggatgcgcctcgtcgtcgaccgtcgatcccatcgtcgtggcgcaggttggggctgacgctggtaggagggtcgtcgtcggggatgcgccggctcctcgccaccatgggggccgccgaggaggccgcggcgtccgcggccgccgccgccgccgtcctggcgctctttgtcggtggcgcccccgtcggcgggatcgatggtctcatgggcctccacctcagtggccgtctcgtcccgcgcttcaaggaggtaggctagcgcgcgcgctctctctctctcaaccctaagggcaacaaagtcatttggttgcgctgttacccgccgttgggacaaaaacggacggaatggtgtggatggcgcgataaagttcgatgatgacataggagaggctcgaactttttagtagcacggagacaatactatcttttttaatggtatataggtaataaaaacctcccagtctggcagtctcctccgccttgggctcgtgtctccgtgcagcgcgccgcctctccccaccgccgccgcctacacacctccccacaccaatacaccatcatcccgtcgccgccaccatgctccgctagttcgctctggcctaaggctgctcggctcctctcgacatccccgtcgcggcagcctcaactgccctcgccactgtcgaggcggcttcagtccatgccaccgccgtatagacggccttgatctgcaatgttcaaacgaggtctcccgcccccgcctcatctgtgataatggcatcggtgtgatgaccacagaggatggtcgctggtcggcatcggcggcatggctggacagcatcggcggcaagactggaagctgcccacgcccaggatacatggtggcatgctgatctatggctctaagaatgaaattggcagtagctttgatttttggtctgcaattcgatgagatgttcttgattttcgattaccaatgttcttgatttccagatgcttgatattatccacccaaacggtatatacgaggggttcttttactttaccggtaattatgagtaacacaaagttaaacttatatttggattacaagggtataaaggtccctatcctgctagagtgtttgtctgtttgataagcaaggaaaaacagggctgaaatgaatgatccatatttaccaaggaaatcctcggaagtcatatgcatttgcgtggggacagaaacttagaaaccgttcaccaaacggtggaaaagcagcggccgtaagaacaacgtggttatggccttttctggcttcctcacacgaacaacctggctcatttgtatttaagccgttgttgttttctcgctgtcacggagcccaatcagtaattgttactctcctcaaacagccagtcaaaatagtaaacctttttccaaccatttaatttcgcgtagccagtcatgcacactatacaaattttacaggtttcctattcagcgagaaaaacccagtcatctgatagacaggttcatcaattgaaacataacaatctgacgagaaatctgtgacagatacagaatgacagcgattctcgccaattgattccattcctaagattaatggatagatgaatggctagattggtgggaggctaccgtaaacatacaagagacacctaagaaggcactccgcactttgatgttgttggtcgcctgggagatatggaacgaaaggaatcgcagaaccttccaacagaatgagctttcagctacctcccttttagccaagaacaagaaagaggccaaaacttgggccttaacaggagcgagaagttttaatagctggctttcttttagttagctcggaccaaaggtcctagctcctttctttttttcttttactttataaagttccccttctctattcaataaaattggcgctcgtccattcgttcaagaaaaaaaattgagcactgtctcgagagtacacggcacgcagcaatgttgtttaagagtgtgggcattatcctcttccaaatcgtggttaaggcctggtgtcaaaaaaaaatcgaggttaaggcagtgtttagttccttcaaactacaaaaaattccgtcaaatcaaatgtttggacatatacatgaagcattaaatgtgaacgaataaaaaactaattgcacagtttgcatgtaaattacgagacgaatcttttaaagcctaattacgtcatgatttgacaatgtaatgctacggtaaatatttactaataatagattaattaggcttaataaattcgtctcgtggtttatagacgaaatctataatttattttgttattagtctacgtttaatacttcaaatatacgtcgatatatatattttggtacacgaagtaaacccggcctaagctggcgagttagggacctgacatatctatcatgttgctcgctatatatagcgcggatatctggacacagaggccacacgccgtcgagactcgagagattcaggaacagaaaccgccgagagagttcgtagcagtcaacgcgcgaggcagggccgagaagaaaccgccggcgacgcacgcgcgatggacgctcggcggaggcggttgtccccggcggtggccgtggcggcggctcttcttttcttccccatgttcttcggtgaggctgcgatttccgtctctttttttttgtttcgttttttcagttttgttttgttgcggcgctgtttgattttgctcgctcgcttctgaatcctgaaagggagccatacgccggcggcggcggcggcgtacggagaggcttcaggcgacgccggcgtgacggcgctgcagaagcacgcggcgttcttcgacaaggacggcgacggcatcgtctccctctccgagacatacgacggtgagctccccatctcgtttcacttgtgattttatttgtgaactgaacacgatttggtctgttcatgccgtgtcgtccttccgaattttcgcctcattttttatcctcatctcggatgcaccgcagggttacgagcactcggactcgggtctggcctctccagcttgagcgccgccttcatcaatggcgtcctttccccaaagaccagacctgtacgcttccctctctctctctttctctcactctggctaaaatgttactatctgaaagtctttatgtttttattactgaatttaaggtgctttattagcctgtaattacttgcagagaattcttgcttgtttacatcactacaatgatatgctgttttgaaagttgtcatcagcgcttaactatctgatcacataattctgtattaggctatcaacttcagaagtattgaaaatctaacccttccttgtacttcaccactactgtcgtaatcaggcctcaattctggataagttcggtatagacagtagggtgtgaattgtgatgtaggcgtgacatattgattaggattagctgctactatccttctttttactgtgatctatagctattttttctctaagattgttagaacgtctttgtacgtatatcgatataagtgatccatttcctatggcatacgaaaagagatgttcaattaatcgttggatcatgttgaattcacgcaggacaatggaacagcaccacgcttatctatctacatagagaacatctacaaggggattcatggaagcgattcaagcgcctatgattctgaaggaaggtaattaagctgcggttgcagactactttctgctttcaccttggctcttcaatttgacccttctcatccaaagatcattcgattcatttcacagactattttcactccggtgtatctatttcagtatgattgctaatatttcaagttttcaggttcgttgctgaaaagtttgaggagatattcgccaagcacgccaagaccgtgcctgatgctctgacatcggacgagatagacgagctgcttcaagcgaaccgcaagcccggtgactacactggatggtagtaattaattttctggctattaccactcaaaatattaatgaactttcatgtgatcttactactgtatatgctgctgttcttgctcgaattgaaatgcagggtcgcagcatcgtcagagtggaagattctgtacaagatcggcaaggacaaggacggccttcttcgcaaggaggccgtgcgagaagtctacgatggaagcctgtttaccaagctggcggcggcaaggataaacgacgaaaaccaagcatgattggtgacagctgatgggatcatctccattgattctcctgattaagcatctcaaatcatgtgccactgtgatatgagaacgattgagatgatgtctgaacacaaaaagatagtcatgcaagatagaagtatgaacaagtgtggacagaatctgcagatggggatggatcgtttagttctgtccttttttgttggtttcttggggatattgaatgtttatattattatacctgcaaatggttggcagtgcaaggctgcaagcaatggcacactatttatacatttggcgtcccttagcccgtagttgcccgtgatgccgtgatgcttgtcttatctgaactctgaaagtctgaatcagttagcagcattatcttcgtgtgtgcttggcaggtcgaagagcttccgttcctttctctacttgcagatcgtgatcgcctggtactgttaacaaatcgcagtgtttctatgctggcaagtcacgcacaaggggaacacattagttgtcaatcatctcatcaggtggagcttctatgcaaaatagttgtttattcagcgaattaggtgggttttctactgttaaatggcgcttagagatgatgaggcaaattaaacaaagtacatttaacccaaaaaaaaaacagtatgcaaaatcctacttgttctgttgtgcaggtgaagccgaagaaagtggtccaggttgaactgtgcaggccagctaatacagtacatatggtccatggactcggataatgtccatatggtccacgaaacgaatggaatttccatggactcggaccagtcaggcccacaattgttgcgctcagcccaaccgcgacatcgcgagacgcaaaaccgccggacgcgtgggcctgcacacggaatctcgcctgatatcaggcccatctcacgcgatccggcctacctggctcgcctcaaccgacgtaaattcccgcacgcgcacatgctgctctaaaaactcttccgctccagaggcttcacagctttctcctcccgtagagccaagccaaccaagcgggagcagcatggctacggccacgtcgacggcgacgagcgtggcggcggcgctcctcctctcgctcctcctggcgcgcgcgcggggcgacgacgactactcggggttcgtgtacgccgggtgctcgcaggggcgctacgcctccggcacgcagtacgcgtcggacgtcgactccgtgctcacctccgtcgccaacagcgcgccctactccccctacgccaacttcacctcgccgacgtcgaactcggtggtcggcgtctaccagtgccgctccgacctcccggcctccgtttgcaccggctgcgtccgctccgccatctccaggctctcctcgctctgcgcctgggccaccggcggcgccgtgcagctgcgggcctgcttcgtgcgctacggcaacgacacgttcctcgggaagcaggacacggccgtgctgttcaagaagtgcggcggctcgccgggggacgccggcggcgccgccatgcgggactcggcgctcggcgcgctcgtggccgccgcggcgcccgccgggggaggctaccgcgccggcgggtccgggggcgtgcaggccatgtcgcagtgcgtgggggacctcggcgccaaggcctgctccgactgcgtctcggccgccgccggccagctcaaggccggctgcggctacgccacggccggcgaggtgtacctcggcaagtgctacgcgcgcttctgggggaacgggggcggtggattcagcagcggcgccgccggggacgcgtacggatctgggcatcgcgtgtccggcaaccggttcgttctctccgtcgccggcggtttcttcacttccttggcctatatatttgtactcatgtagttactgaattacagttgcagtatgatcaatgatcgtgaactagactactagagtgcctgtgtctgtgtgctttatgcgtggtatgtaaccactaatcagcatatctgcatatgtgatgcgatgcaggtttactccttgtgcttgaacaaattaaacttgatgctttctaacttaaatggacttcttatcaagtttgtaactgtaaatttgatattctaaaattgcagtatgtgtagctcctcgttctaaaatgatcaatcatgttgatctgcatttgcagtagagttcctttaattcggtggtgctgttaaagttccacctcgtgcacaaacagaaactcacaaattgacatgcagcatctccctctctgtctgagcgtgtccacaaatgacaaaaccataactctaccgcgctaagtctagtcttgttgaaatttcactggccagctcagatatcataccttcagttgtttaatcgactaatcaccagtatctaacaattcgaacgtgctgtacaccaattagaacactgcagcataccctcctccacatagaccctgaatacctggtctgatcgtctggtgtctgaactgataatgcagtgctcaaaggcatgctactggcaagaagaccaaaagtgctttaattctcctcgcctttatctttgctctgagcttttcttgataggaaacttttgacatggacttgctttatcgttgtgatcactatgaagttttagtagaatatctcaaaggggattcaaatgattcagcttttcgcttgattagcattgaaatggagggatatcgctggtatccctcacattgcgagcagcgtagtgtggtttgctttttgtaagctttaggaggttaagctgccagccctttcactagttactaggcctgttagctactactttggattaagttaatcagtactactactatcccgctgaatgccgtatctgtttaagtttcaccgtacattattgtcacctctccagtataagcttgttgcaaggtcgccagcttgcatgctatgattggatcataccggtggctttttgctggaacgccgcctttccttttgctgtccttgttcttattaccatacatgccttctcttttggtatgcaatgggtcaaaggaatgaacaccaagcactagggctggatggaacaagctagagaaaggactccactccactgtgcttcatgtggagagaagatccagctagatcacatagctttctagccggcgatgccacccctgcatcggtagtggagaaaatttgtttgcaagcaatacactttaactttgttaggatagttcttctccttactttcgccgggagatagttctccatacttgttcaaggaagctagttcactagctgtttcaggctttcagcttggacatgccatttggaccagagataagggggagatagagaggtggggacgctgatatgtgagccctatatgctaactgttgagttaatcggttcgaccagatcaatgagtcatgtcaacaaatattgctgtaaatagtgttctgaaaatcaaattacattaacggttaggagatcaaatattcagtattagagttgagagatacaaatcagattgaacttatatttgagagattcaaatgaacttgctcctttcactctttcagtgcagtgctgcagttcagacagtggtaacgggcccacggcctgacccaacttggccattgacagttttagcccgtactggcctggcccaactgcactt

SEQ ID NO: 67981 - DNA, 9052 bp, Oryza sativa
  unsure (1)..(9052): unsure at all n locations
gtcaaacatgtgagaaaaagtcancggcgtcatctattaaaaaacggaaggagtatattgcaatgcacatacactatgctttttatacagacgtgatccctcctcacaccctatctcgtgcactgcttcggcgcccaacacacgacgtccagcaaaacctttctcccatgaactggtctgtcagccaattaaacttcacctaccctcttcctcttgatccctctcaagcaactcccactagcccacggttttcacccccagcccacatcaagaccgtatgttgagaattgagatgcccttggagagtggagaccgccatagtgagaagtcgagtatgcatggttccactactaaaccctagctcgcctcgatctcctcatgccactcccgagcctctggatccctcccttgtctcctcgtgcatattcatcggttttattttcttttcccacgactgctgagatgactcctcgttgtcggctcttgatttcttttttttttcaggtgttccttcacagatcgtctgcaaagattgcaagggcatctaccatgccaataagaagtgtatgttattattcgtgacatatttatttttatgtaatggcagaaaatactcaaactttatttctttaatttattgcaaagagtatatatgtagtactcaaatttgttaattttgtatatactacttcctccgtttcacaatgtaagtcattctacaatttcccatattcattttgatgatatgtctagattcattaacatcaatatgaatatgagaaatggtacaatgacttacatttacttacattgtgaaacggagggagtagaaaaaataaccgtgtgttgcaatgggagataactagatggaaggagaggacttccctggtaagaggtgggtgcatcggtagttagggataggatctggagttccgttccgtggcattagttggtaatttttgtcagaatctgaaaatattttttttgagagaatagaatctgaaaatatgatgaggagcgtctgatggaacatggaagtagaaagatcatcaagccagccatgggcattggatcgaacactggacaaaaataggcgggcggaaacttgcatgtagagtgcatttggttgtaaattaagagaactgtccatttttgtagataatggaatgaaacatcgatcctggccttttcttaggtacaaccaattattataaaaagtagcacactaaaaaggtgttgtccaaaataaaacaaacacaccaaccaaaattaaaagaagacctaacatgacaaggaaaatattattctagtctattggtgaatccccgttcatggttggcaaaaagttacataaccgttgtcttaagattacgacatgcaacattcaggaattctccatctccctcacacttttgtagttgagcccatagccaaaaccaatatgttgccctgaaaattacctatatataggaaacagatggtgatttgtcaaaaaccctatcatttctacacaaccacagagcccaacataaggccgaggcactaacaagtatcagtttactctttttcttgtccacaccctaaagccaaccataaaaattataatatatgcttctagaaagaaggtataatccaaaagaaaattgaacaactctccaaacaaactttgcataatgacaatccataaacaaatgttgaatagtcttatttttcataaaaaaaacaacatcttaaacacccattccaattccgtcttgctagattatagaggattgcccattggcttgcgtgttgtgcctttcatatcgcgtttattttatgataattatgaaaatagctttaccctagaaagttctcgaatgattagtatgaaaagttttctaaatttagctatatgccacactgttgtcttatccattaacttttttatttttatttatttatggtgataataggaaaacggacatatttatatttgaccaacatgatggatcaattactctactgttccgaaaatggaacggtgcagccacacatgcaggtcatctccatctgaccttcccagcaggctcacggtgcacaccttcgttccatcgctacagagagagaatcagagcacagatgcgctatgaactgagaagaaaaaaagaaacgatgcgataagctggaaagaaaagaacggaagctatttttggtcttttggatcacaaaacctattgtgaaccgcatcccgggtaacgggatagattataatgagttaacgacgagtcgttgcccccaccaatcgtgcggatgtgtctccatgggtctatatctcttcctcccacgcacacgtatcgctctcccatacctttcatgtgtcaactgcactcccccacgcatgcatgcgctcgtattgagtcgccacacaggtatcagatctgatgtggtgtcagattcaatagttaatacttgagataccagatttggttggaatccgtatcagattcgatacttgatacctgaggtaccagatctggttggtacccgtatcagatcgggttggtacccgaggtaccagtctgctaccaaaggtatcagatccgatatttgggatatcagattcggtacttggggtatcagacctgataccatcgtactaaggtggatagtacctggtctgatatccacgaggcatcaagaccagtagttgtatattagacttggtaaaaaaaaaagtatcaaagcgtacctagaggtatcgttttgtaccaaacaagtcattttcttcctctccccaacacaatatggatgtgttctttcacacatttttccaacccacatctctcattttccgcgtgcacacttttcaaactagtaaacagtgtcatttatgcaaaaaaatctttctatatgaaagttgttttataaatcatattaatccatttgtcaaaaaaaatagttaatacttaattaatcatcaaataatatgagcttcgttttgcgtgcagcctctgccgtcgtcgcactcatgtcggcttcttggggacggtaccaatggctggcccagatggcgttgcggtcgacgtggcaagaaaagagctcccggtggcaagtggctatagtggttgtaggcacagagagggtgatagaggacggagggagtagcttgcacgcggtgggtggtggtgcgtggatgactttgtgtagacgaatcaagataaggtgtagagcgttgatcattagtctatcctgttcggacggtataccgtggtctaacagttctccttttggattccatgacgacggaacaaatcacccggcaaataactctttaatttccgtgcgtggctagcaaataaccgttgcaacggattttaaaaaaatgatgttggatagactatcaaagatccatgtccgtccttgtcttaggtgggcaggcaagcccaccacaccacatgcaaggcctacccaggccagaaacccatacgctccaggcttcaacggagagtagacaggcctgcatgattttataagagcaggtacaatagcaggatataagccggctataaccatatatcgagaagaaaagagaagagagagaagaaagcggactataaatttgtagccggctataacacggactccaagatgttatatgtgtatgagaggtgggaccgggtattagtagtgtagtatatttttatagttaactattgtatgaaattagattggctatagatgtcttggagccagtagttggctatactattaaccttgctctaaagcgatacacggaaatacttcgcatcggatacaatatgcggacgaaaaaaacgaaagaaagacgatgtgactatataatcatcttcaatttttataatagataaagattatccgacacatatgatatgtaaggcctggtttagttcctaactttttcttcaaatttctaactttttcatcacatcaaaacttttctacacacaaacttctaacttttctatcacatcgttccaatttcaatcaaattttcaattttgacgtgaactaaacacatcgtacaacaaaatcacaaatattacctagatatatttccatcagaaatattcccaacaaattgtacatctccttccatgctcccaggggtacaattgaccttgttgcacatatcggtcaactactaggatcaagtgatggaaaaagtataaaagaatataatccaaattggataggatttaaatgtgcaaggaaaactaggagtagaagagatgctggctaaaatttttaagggcacaggaggaatcttatatgaaacaaaaacccgaaataatgaagagacgtactcgtccgtgtgtatggtgaaatatgtttgtaaccaaaagaataaaatattgtctgggagtgtatttgtatttcttcttcttgcaaacataagagtaaatttcacaaaaatacatatatatattgatcaagttatcagaaaaactacagatttaagattatgtataaaaaaactacatatttaacataaaatttatcataaaatatagatttaacgatttaataacaaagttgtcacaaaactataggtttagcgtcaatttaattacaaaacatggacttttataactcaatcataatattagtgctaaggatttaaacctaaatctatagttttgtgataattttattattaaatctgtagtttcacagtacttagccttaaacctaaaattttttgataaatttattgttactttcttcgtcccacaaaacctgtcgtttcaccgcataaggattgtcccagaaaaaactgtcgttgttgagagaagtggtgggtcagcctactccgtatgcgtggaactagaaaaaacgaagtgttttttattatttttgtcgctaccgtgaatgattcacgatctaatattctcgccaactgaataagatggacccaataccgttttcgggccctaggctgacacaagtggtatggcgcatgtgggctctgtgtaccggcacctatgaggaatatgggaaaaaaagaaaaaaaagaaaagcatatatggaaaaaaaaggtaaagcctaaaccggcacgcacgaggcatatggaaaaaaaaaagaaaagcatatctgaaaaaaaagaaaaaaaaagaaaagcctcgccgacctccatctcgccttccgcaccccgccgcctaccatgcatctcgccttcctccaccctgccggccgccgccaccgccgctgtaggccatcgtgtgtggccacttcaccacattctccaccaccatcatcccagatcacatcatccccatccaaaaatcaatagcaaactaccacatatatggaacaaagtatcaagaactcaacaagttggacatggaggaggagaaaacagaggaagaactcaagaactcaaaaagagaaaacttgttatacttgggccaccccgccggaagccacctctcccatgccagcctccaccaccaccgcaaccgccgttgctggatccagcggccgccaccagccgcctcctcgtccacgccagtctccaccaccaccgccgccgccaccacctcggcgcgtgtgtgccagcctctgcgtcgtacccaggtcggtcgtcacctcctgagtaggccgccatgtcctccgtcggccgccgccgccacctcgccgtggttttttctctaaaaccgacacctataatattaatattggtgtcggttcagttaaaaaaccggcacctatagaattggtgtcggtttttctttagaaccgacgcctatagtgcttaaaggtgttggttctatattttttcatcgtgtggaggtgagaaaaggctcataggtaccggttttaaatgaactgacacctataaggttagtccctatgagggttttttagtagtgtacgatcatgcactaagaggggggcgtgttcctgattagttgcgaagcctaggtatagattaaattcgacgaggatgtcgaatcttcgagggtgggtgaatgtaacaccctaggaaagaaaagaagagtgaaagctagtgttggcggctgttaaatgccgactctataccgccaacatatgcataaagttcggataataaaatatccaacatagtgataggtgcttaaatctcacatattccatagtgttggtgtatatttatatgcaggtgataaaacccgatgttgggaggaaatttaaaccaaagtgaggagaaatatgtatccatacaaggatgggttgtggacttcatagaaatactagaaaatcagcccaaaacactaaagaatggagagaggaggaccaggagaggagccaggccaaaggccaggccaggggggcccagcccaggtccctggttcggccgaaccctagtgatcaccgttgatcccaagtttttggcatggacgctccagatgcattcctgatggcggttaaggggcacttcggacaattctccttcctataaccgtcatacatatcctataaatagacctcacttcattcacactcacacacacttccaagcttgagctgaattataagaggctctattgtactatatcctatactagaataggaagagagtagagtagaagaagtcggaagaattccggagttgtcggtaatcttctcctatttcttttattctgtttattactctgaattcaatataatattcttctggagtaatcttgatttatcttgtgagaatttatctcttggttagttcctaaatagcatacgggattattgttcactataatcaactgaaatatagtgattgctttggtgagttataaacactaaagtagatattaattgcttagacgtggtgtttaggtaattattatccagtaattgctgcgcatcccacagtacgtttgaggtaggtgtagaggtggtgacagcgctcgagatcacttaagtcctccatgtctgggtacgtagtagagtgacatctgggaacagtgggttgccagtgccgaagtatcacattaggattaaagttaaactttccctagacactgtttctcactagtaaatcctctctatcctggcctatcatttgcttagtgtccttggatgagccggaggaagatctgactatatacgttcccttggattcaatacccttggaatactccgtaggggaagtgctacatcggtatatccgcgcgcttgcagattttatctgtaaccgtatcaaatactaacaagcatttctggtgccattgccggagaacggttgctgatcatttctgaacctagttcatcctcgtagcctttttacttttttttaattctatctctacccctgctatcctagagaagtattcctgtcaaactcttctcgaccaaggagcaacttctttttgagttgtctgctcctcgaggcgaattctatgagccacctccttcatcggggtccatttacataactggctatgaaattcgccccgaactaattagtatggttagggaaaattctttttttggctttgatctagaaaatccctaccatcatctgcgagattttgaaccgcgaacacgaattatttttttattagtacccaaccttactgatggtaaaccgtgagacgaatttattaagcctaattaatatatcattagcaaatgtttattgtagcaccacattgtcgaatcatagagcagttaggcttaaaagattcgtctcaaaaattagtcgcaatctgtataattagttatttttagcctatatttaatacttcatccaggtgttcaaacgttcgatgtgacaggtgttcaaaaacaggccctcattatttagctgcaatagctgtatatttaaaacggatggaggaagtaaataggtagttttttatataccacttagatatgtggttctgtgaaatttacttcaaacaaaatgacaaagaaaagattggagaaaagctttttctattgacttgcctggaattcactacccctttcaaaggagccgcgtccgccaacgcgtcataccgcgtccaacgcggacgttgatgcaacttgaccacttgagtagtgacgagtaaagaactggacccaccctatttgatcgctagctactcgtttttaacaaaattcgaagtaaactaataaaaaagaaagactctgttcctatgcacgttgcaatggggtcataggctagtaatagttatacacaagatgacattcattatatttttttccgcttatttgagaatgtgtggcgtgagtccaagtttttgaattctctctatgtggtttaaatcctacttaaaaaaaatattaccatggtgtccttgtccttgggtagtgtttggctaataggatagagaaataatttcccacacatcaaaaaatatctttaaatcttaatcatttattctctcttccatttaatactaatccttcattcattttccaatcccaatctcaacatcaatttcccattatccaacgcacccttagttctatcggatggatgcatgtcctctacaataactatagagaacagtgattgagtcttgcgatacaatgatttccattatcttggcattgtagcaacattgttctaaaagtaatcgattttatcatcgaacacctcttactgtagcacggtaatgtagcatgctaatttgcagcgttcaatgaagattcaacgtatcaaaacatgagctaatgtaaaataatgtagcacctctgcatttttttacttcaatgaaaaggatcttattccgtactggtgctgaagttgaatgttttatctccatctatctatctatcttctattatatactaaaagtccattaaactttctacaaacgctcctaaacctccacgtggcgctcctacaaacactcctaggccgccacgtggcactatctaatctcaccgttgattttcacttaaattggtgaacccgttaatttagaccattagattagatctattattaaaaaaattgatagtttttcttaaaaaaaatatgcaactggtggctgggaaaaggaaagaaaatgtccatacgcaagtataattgaaaaaaacaaat

SEQ ID NO: 67982 - DNA, 5926 bp, Oryza sativa
aattcatttgaaaattttcctcaaaattcaaaaatcctgaatgcaattttgaaattcaaacatgtgataatgcaaaaaattcaaattattgaaagcaaatatgcggatacataccaattttcctgttggtgaaggtcgcgtcatttaaagtccgacgtgcaagactgtacctcgttccgatttagttcgcggattttccacctgtctccggtggtgatggagcgggcgtctttggcttctccctccacaccttctttggttttggtgcggacggcggcttcttctgagccggctgctctagcttcttggccggtatgggtggttttactgtcgtcttccaataacggttcctgggcatcgttgtttccatctccagaaaattctgcatggatttcaccaggctatccgttttgggtggctctacttcgaccactcaaatattctgtgggttcggcccgtacttgattctgaccatggagcattgctccgtcctcggttaaaactcaaacttttcttccttgccattgatgtggaaaccgatactccccgttccaacgtcaatgttggcttatgcagtgctaaggaatggacgccccaggatgagtggcgtctccttccctgtgtccatgtccagcacaatgaagtcaaccgggatgaagaaatcccgtatcttcactggaacatcctccactatccctgccgggtaacggattgacgaatcagccagctgaaggcgcattggtgttggtgtcaatacgtgaagttaagcttgtcgaagacgtgttttggcatgacgctgacactgattccaaggtcgcacaaggcctggtcgaattgttgtgccccgatcgagcaggtgatcgtaggacactccggatctttctacttctctgggagcttgtggagtatcaggttgctgcattgttccgtcagtttgaccacctccattgtcgggagcggtctcttgttgctgagtatgtctttgagataacgggcgtatgttggcacttgcatggcgtcaaacaacggcacgttgatgtggatcttctggattacttcaacaaaacgagtgaatcgctcgtccactgacggtttcttgctccgttggggaaatggtagcaaacgtgtgtcacagtactcctgcggcactgtcctttctggctgaacttccttgtcagctgagtcattagatggcgcttcttttgatatcccactcgttcctgcagggttaggatacggcggatcacgagtggacttacctcccctcgtcgtgatcgccttgacattttcaatgaaggagtcgggttgccctggaatcctcccagtttcatttgcagggactaaggatgccaactgagctagctgggtttctatcattttgttaaagctcagttgattttgaaaagcggaagcaaagccatctaatttgacatttatgttttctaggaccttgtcattggccgcaagctttttgcttaatgcatcagtggttttagcttgcgcaaaaacaagatcattcaaggagggctggttagaaaaattaccgttgttgttacctccttgttaatatgggcgtggttccacccttgacctccttgtggatgatacccgttgttgttgcccatgtacatcgcctcctcacgggtttccgggcagtcattcccagaatgacccgtgttgccgcagacctcacacgtaacgtgtgagtccaaggccttgacgatgccttgtggccgtttctcgtgctcgtccaacctcttcatgaggaggtctagcttggcagcaagtaactccgtctccttgatggtgtgcatgcctcgctgacgggtctggagtcgttcctcgctccaacccatgttggagaccatcttctctattaaattaacggctccttgaaccgttttagagaagaaagctcctctagctgctgcgtcgaggtgatcgcgggacatctggttgagtctattctaaaagttctgcagaatcagccagtcatccatcccatgatgaggacaggcggccacgtattgccgaagacgttcccatgcttcaggaatggactcatctcttgtctgttggaaactagaaatccgtccacgaagggcattggttttgcccatcaggaagaatttcgagaggaatgccgtcgagcacttatcccaggtattgatagcagcacggttggcatagaaccactgcttcactctcccaagaagggagaacggaaacagttgtatcctgacgacatcgggactgacgcccttgatggtgtacgtgctacagatctccaagaactattgcagatgagcattggcatcctcattaggcttgccactgaacgggctagcctgcgccatcgtgatgaggctggacttcaagtcgaaatccacgtcccctatgttgacctgcggcccaatggccacgttgtcagcagagggagcagcaaactcgcggagagccttgttagccacaatcttgaaggtctgtggggctagtacggctagtttctctgtcggtagagttttttgcggagcagcgactcgcggcgtgacgctctggaagaaagcttctggattttctttgaagttttccggcaagttgaaaccagtcatgcactaccctattttcacaacaaaagtgaaaacaactaaggttagcctgcaaagaaaaatgattatacagaggtaaatataaagtattagttcaagtaatctctattatgaatcttccccgacaacggcgctagaaatgcttgttgatatttcttaatgacattactagaaatataattaccagcaatggcacagaaatacttctggtatattatggttacaaagtttatccgcaagcgcacggatataccattgtagcatttcacccgagagtattccaagggtatcgtatttattttaacccgtgggaagatcatgtagagagaacattgactaataatttatatattacttgtgataatcatattctaagcagggatgacacacaagcattattactcattctcataatatattatttaggctaagtggaaagaaaagataaagaaaatatattcctatacttctaatatacatagtatacatacattctagttaaccaattgtggacccccgtttttataacaggaatcaatcgtgtaaacagtaccatttccctggatcaagtagtttggtacacacgaattcatagctggaatatcaagtgcacatacacgagtgtttaatacgaattattacatcataggcccgcaggcatagccttaaatcatcggaccgagaggtccggaatacatccaaaagcagaaatagataaggcagcggaattcaggcagcggcatgccattgccacaggcaacgaccgtgctaagacctactggacgccatcgtcttcatctccttcctgataataggcatagggatcctccgaggcttcatctcccacttctgataaattttatatttgcaaggatgagtaccaaccgtactcagcaagccaccacagcaacaatgcatatgaaagggggagttcaaaggatggccatagttcttttgcgcaaagcaagttttgtaattcttttcacaagcctaagacctagcattgactgatcaaatttttagtaccagagtttgtatttaaacaacgacggttctgtccaccatccattgtgatcccaaggatagcttcccgccattgattcgtcatggttttctgaggacgtccaccttcccgcctctcaggaagtggctccaacagcataaaattcatcatgcaatatcccatcccacacaagttaagaatttagagtctagccaagtgtaatacatgtcccggtgctcaataaccgcgagcacggctattcgaataggtttggtttactcacactgcagtggatgtacactttacccgcactccgcgactgcccaactcatgagcctcgtcccaacacatgagacgcgtcacggcaaagcttttcgataacctcgcattggcagtacccgctccatgaacttaaatcctcatgcactctaggcgtacacggtttctagcagtgagaggagttctggcgcacccgggaaggaaagactcacacatgcattaagttgtaattatgtttaaattctcacatggtagtcctactgatggcgacaccactgtagacacccgcctcgcggttctaccaatggctgccccaccgtagagcccctacctcacacatcaagaaaccactatgcatggatactgcctccgctcagctatctattccgctaggtctatacccatacgagaagtgcggttgtacgggggtcgtttcatgcttaacttcatggctcggtccttaattgaccagggacggcactagccttttccggacaccacccaagtcctccagccgccccagtcgaaaacagttgttttactttattttcctttcacaaattatgtcatcaatagcatggcaatgtggcgctcatgtctccacatgccgcatctcaattaccttcccaaaggtaattgcccaagcatatagcatttgataaatatgagtatgcatgaatctaaaatagcatttctaagcaagtgtcatagttgactagggactcgtacgtatctatggttacaaagatttaaaggtgaacaataatcaaggcatggcataatcacaagtaggaggttcataattgcatgcaattttatttataaacaaaacaatttcgcaattgggatcaacatgttcaaggaatagtgatgacttgccttgctcgaggtcttgcgggtcttggccttcacctggatccgcggctccctcggtctctatagttacgtgcgaaaattgatttgaattcggttagaattcaaataaaaatccaagtaaatccgaatggaagtcgaacgcgaaagtcaattcctttttattaattttactatccgcgaactatggcaaaccccaattttggtttaaattattttgcggttacaatattttgttgtcgtatgtttttaatttaatctaccctagcattatatccatatattaggttagaaatttcttatcgcgagctaaatgtcgggcggaatcctaaaattatcttataatattatacgacttaatttagtctatgattaaatataatacacggttaacaccctagtaattaaatccgaatcgctaccgttgatcgattatttatagagattacccagaaataatccacaataatttacgagaattcatacatttgtttaattattaattacatctaaattaataccgcgaattgatttcttatggagagtactaaaagttatctataatctataggaatttatcccattatattttcattaatcctatatttaaatgctagtattttaggtatttaattagtaagagtttatctaactatattttcattaatcctacaattaaattctaatatttgcaaatattttaaatttccccctaaatttttctttctctttttctttccctttttcctctcctctcttttcttttctttttctttctctccctttcttttcttttctctcctggcttcctcctcccttcctctccttctctttctcggctctccctctctttctctcggctctctctttttcccacccgagcggtggcggcggcggactcgagggaaacggagggcgactcaccggcggcggcagcggcgatgacggcggcagcgacggcgacgcacggtggcgcgagaacggcggtgcgggcacggaaacggtcggcgcggcagcacgacggcggcggtgcggcggcactacgatggcggcgcgacggcgtggaggagtgggtggtggagacggggagaaggggggggaatagtgaggcttttataggggaagggagagagataagggggaaggaggaggagggaagagg

SEQ ID NO: 67983 - DNA, 8160 bp, Oryza sativa
tgttggttgattttatcgacttatgtcgataagggttaggagaggatctaaaccatcggtttccttatcctaacaagaaacaaactaagagacaaattcattttcttgtgtgatcggtacggaaaacgaattctaaactaattgagataacccccgggccccaccagtgtcgtttatataaagaaagagaaggaaggaggcagatgacgactgatctctctctaatttcaaaccctaattaattgcccgatcaatcaaggcactggaaggggttcgtgaggcatctctagaagaagaagaaaaggagaacagcaatggcttcaaacacaggtcagtagatcaattatttttccgcataagtaagaggtgattgtttgtagactaaagcctaagatcctgtaataagaactccaacaatctttccaatgatgagcgaattaaacttattaagatgagacagaatagatttaccttctggtatgcgaattgtgtaccggcattctttaaggcataatttgttggcaagacttttcttcatgcctactcggtagtctgagtatatgaaagccatgtatataatcatgaaatttcagttgattaagtcatctagacttggaccaagaagatcaatcaacatgatattattgtactccccctccaccccaaacttcagatgaggacttccagctgaaatttgtaaccaaaactcaatattaaaatgagtgaacaaatatatttgaatgaataaaaaatttctggtagagaggatatcagtctctttgttcaccttttggaaatcacatgcaggaattgagcatatattacggaattcttaagccatcagctaaattctaacctgctacggattaagatttatttatttgttgattgactggtaaagagtaaatcaaattctgcacggtatatgatggctgctaaatagtaaatcaaattctgcacagtatacgaagactatgccttgcagtatattaataatagcaattctacggtccttgaggaggtaccatgagataccaaaaatttagtgtaaaatttggtacctcatggtaccttatagtacctaggtacaaagagttaccaaatttacaatagaaaaagtggtacctcatggtacctcctcaaggaccgtaaaattgctcattttttctattatatatccataccaattgaaaagcatttgggtagtaactttctattatctcggtgatgactgaagggttatttattagatttctgtactgttaaactgtatccaaatctgaccagaacattatctttatcctgaaagaatacatacagtcatctttatcctcgatatggcgtttctgatctgctacttgccttcccccacatcgtactgcttaagtccatgacccccatatatatcttcaccattcacggtcgtgctcgtggagtcctcgttccgatcgtggccggcctcgcgctcccatctaattatctcacgatcagaagagaaagaagtgtctcgtttctatcaggattgagatcgtacgaatatagggaaattaccggacagacatggatagatagatacgatcgatggcctatcatgtacagtatatggattgaacggctggcacattgtagttagaggcagagcccgcaacattagtgtaaaatcaaatgtgtttttgattattattctatgataaacaattggcattgaagattgttggttttggtatttggaatttattcacgaagtggttttggagatgattggatttcacaggtgatctacagaatactgctgaattgcggtccggtcaaaccgggctagtgcggccggtcaaacctgaggtatatgcgtggtcagaccggcgcagcccgcggtctgaccggccgacgctatgtcggtttcggtttcggattgtttgtttggatatccgtgattgtttcatgattatggcttctagatggatactatacgtatgtaatactgttgtttgttactaatgagtcaagttggagatagcttggtcttggaatatgatttctttgtttatttcatgtgtaggtgacttgatgccttgggagagtatttgcggtgatggaccgggagttggcttggggataagacgacgtccgtggtggtcagagatcatgcgggatacttaggctagagttgatgcacatggttgatggagattccatatggcatacgatggaggtattgtgtgcgtatgggatgcggagtcgaatttggaaggagtccaaatttggtatgattggttatgtaaagtttgtttcttgtactagatggtttcctaaggtgtttaggacttctagtatgagtttggttcgtggctttaggctgcctacctcgggtataaatagagggagagcgtgaggcttcccggtatcgcttttgagagcaattgagttgagttttgagttagggtttcgagtttagtcgaaatttttgtaaggagtgttgttggtgcactttgtaaacacagagagaatcaataaagtcgtcatctattttaagagttcttcgatttgtgtttcaccgagtttcggcggtctaaccgacgactcatcggtggtcagaccggtgggagaaaggcggtccgaccggcagcggcaacaggcgcggcaagtgatctcggtggtcagaccagagatttaacctcggtcagactggcggctacacttcggtcagaccggcagattaatctcggtcagaccgatctccgtcgaatttgagggtaacttttatttccgctaaaagttttcggtttttgggtataccaaccattcacccccctggttggcttagctcttgtgtttgatcctacaattagatcattgtaggatatacggttctgattatatgatttatctagtttttgatacacaccgcaattggccataccggcctatgccagggaaggggaaaaaaacaaagtcaaaaaacaaggaagagaaaaaggaaaaagaaaaactcgaacgctactccaaacaacggagtgggcagagccacgctacactcccaacaagtccccaaaggaagcaacgcccgctaacgaccacaaccggccctccgacaggatggactcttggaccattgagaccgaagagagcgcggagtcaaacaccctggagttacgttccttccatagctaccacgagaccaggaggaccagggagtcaaagctggcacggaggtgattaggtaaaccagccttggaagatggccaccagtagggatggcaatggggacccgaacccgatacccggcgggtaaaacatctattaggagctgcaaatgggtcaattttcctccccatggggctcctaacggcaaaaaactccccccgtcgggtgagccggattcgggggcgttccctcccagaatttgtttcgtttttagattttttttttaatatttatagaaataatctatcggcgagaaaaattgcaaaaatagaccctgccgcccaccattggggcggcaagctgacgtggcagacggtgggtagaccgcgccgtctgctgccgtcggccaaaattccgattaggcccttgccgcccatacagagggcggcaagggtctaattgcaattttggctgccctccaggagcttgcggctgtactttttgcatctgggtcccttgccgccctaagatgtaaaaagtacagccaaaatatttttctatgtaatgttaataaaaaataaagaagtatttgttggtaaaacttgttaatattgttataaaaatgtattgaagttggttgttgcgcaatttcatatgttaagtgagatattattttgtaccttattcgacgtattagtactcggataattaatataggcctatcgcagtctcggtcgtagaaacattatatggacttaaacaaggagaattatgtaacatgaagaaatagtagtacaatttgaacatgatacaactatttcgattgcggttacatagatgatattagattcgaactaggagggaggtagtgcaatagttgaacacaacgacgatgtagtaatgggacaaggaagcatgacagtagaaatttcaatatgccaagttgtccgataatagctaacccctacgtgaggatccctctcctctctcaaaccgcgctttagtaaccctgtattgctctggtagttcaagctgcacaacacggctaggtggagttagaacccttctggtgtctatccattctctgtattgacatctccttggtggttcctgggaggaaagaatagatgtaaagcgagcaaagttagtcaatgttgtgagaaaataaggattaatgtaatcaaaatattcttaccatgaaatcgtcgtcaagaatatttggacaaacaaagaaccttcgacccaatgttgtaggatttacggaacgaagaacctgacaacgatcaccacacctgcatcttggacgggcttcccatggagggagtgccgtagttagcacccgccagtcgctctgttgttcacgacattgtcgttcataagccgcttttctctttaagtattgctcagtactttcggatgcgaaataccagcgaccttcttgtaaacaagtggttaggtcaagaacgggattttctgtatcgacccactcgatgtatgcgcaagccgtagtgcggatctgccgaatagagtagtgttacgaagaaaaaagcgattgcccatacggaatgaataagcatttgcagataataaaatacctcacggtcatagttagggcacctaaaaaagcaccttcctcgaatatcaagattcctcgaagccattagttggcatcgatcaccgcataggcagagtggacgctggcaccaaggtggtagtaggtatacacaaggatcgctgcgccagtttggatcctcaacaccccggcgtcaagccattgacgaaagccggtaggatttgtagtgaagaagtggggaagagagtactgaatgtgactgagttctgaaaaattgtgaggcctcactcgttaaggcgacttatatatgcgcaaaaaatcgagtgatatccttgacatgtgaacgtggtggggcatggtgggtacgcctgattggcgccgaaagttgcattcttgatcggcgtcgaaagttacgttggtcgtatgcagcaaatggcgggcaaatactcgtagagcacgcgaataaaggaggctgcatcggtgcgggagaaagtagtcgtgcatgcgccgaaaggtatcgtgcatgcgccgaaagatatcgtgcacatataacaacaacgtagtcattacacaagcatacagtactggaaagtgaagcaaataaacaaagagaagactgctctactggccctgccccgcgccgcgaccacgcttggtcctccgggcctgtgctcgcacgtggtcctgggagtaggtgaaacgatccggtggcacagcatgggtagcacgagtgtcaggtggaggagtggcctgcgcctggtcctgcgtctgcaccggcggtgcgcctcccagctgtgaggggccgatgacgtcctctgccgagcctgaagcgaagtcaaagtcagtgatgtcgaagagcacggtggaagacagcaagcggtccgacgaggtcccagcatggtccagtggtggaccctgactcgacgtgccggctgcctgtgacgaagccccagtgtactgctggaactacgctgagtgcgaggtcgacgcagctggctgagacgctgaccctgcagcgtgggagaagtaggcggcctgcgtcatagcgaactgggcgaaggtggggtgctgaatggtgcacgaaaccctgaatcaatcggcaagtgaaacggctcacatatatgtgcgaggcatgtacagaaaaatccttaaaaatacttacctccgtgcggagggggagtcggcctaggaacgtgcgcagctggacggggaccagtcggtacgggtggccgccgtacagctgcgtctgcccgagcaacgtcgtctgcacgacaggtgagcactcggagaatcgagcgcatcgactccaccatccgcgtgtacgtcgtcaggtgctcctctacgggtaccggaatccccgcgtctaaacgttggatcgtcgttgaaccgtcaacgacgacccggttgatgtcgtcgacctgcatggttaatttgttcatacatattcgtaacatttgacgatgagaaagacataaaaacataaaggaatggtgcgatgcagggtactcacacaacgagcgaagtcctggtcgcggtgcctggcgtagaggtctctagtgctcgcaatgtggggctgctgctccaagggagcgaaggtgaccctagtacgggtgcgtggctggtaccagcgtaggtaggcctggtacgcctcctcagtgtgtggctctccctcgtgctccacgacctcctcggttgcgagcaaccagtcctcaacaaaagtcgccaacttggcgggccagtcgccagctaactgctgacccttccgcgtgtacctgcgaattaatgtgtaatattagtgtgaatcgagagatgttacaagttattgtgaacaggtacattttaatgcaataacggaaagcgtagtgaccgatcttaccggtgaacagcagctgggacggtcgtcggaaacggtactggaaagggctgatggaagccgaactgccgcatcacgcggaaaggggcgtgaggctcaacgcagatgtcgaagaccatcggaaccgtagtcatccagtacgcctggtccctggtgtagagtgtgcacagacccaacggcgcacgagcctgggtagccgcggcactgtagggctcccacacgacgtcagtcagcaaaaggcggtcgaactccataacaaactcaggatacgaccgcctaacctggacgtgagcccatcggcgctgcaatacgagacgatcgatttgatgtataatgaactgagcaattaacttaacaaagctagaagatcgatgcaacgtacctgacgacggcaccacagagtacccatcgtagggtagtcgacctctggtcgctcctcgtacagtgactcctcgtacgcgtgctagtccacctccgggcggccgatcgcaatcctctcagctgcccagatagaaagaaagagagggcacccaccaaaggtcgcgctgggatacgtcttcgtgcaagcctcacaaagtccacggtacagagccgcgaacaacgcggaaccccagctccactgaggcacctcgcctaccgcggcgtcggcgatgctcctggcgtagtgcacgagtcccttgtcgaccgcgtgcccgtgaccgccacagaacatcacccagccaaaaagccagagcaagtacgcctccaaacagcggctgtaggagtactcgtcggcctccgcctgtagctgatcgacctgcaagcgttagttaaaatgttaggaaccttaacatgtggaataaatatgtagtacgcttgtcatttcggtacaaaagcactcacggtgaactgaagcagccacctcttcgtaggtccggtgttgcggtggtgtgccaacggctggagcggcaggtgcggtgcgcgctgtactagtgcgaaacgtgccgtcagatcgtcctgccagtccacagccgtggtcactagcccaacagcgtctcccgcgagcggtagccccaacaagtacgatacgtcctgtagggtaagggctacctcaccgcacggcaagtgaaaagtgtgcgtctctggcctccatcggtcgaccaaagctgctaggagggacctgtccacagtccatcgtctggccgggtccgcgtggccggcggcagcctccaccagccgacacatcggtaggaggccggcctcacgcagcctgcaataagaaattaatatgtcattacaaaaaatattacagcgcaactaatttatagtaatatactgttcatacctctcgacgaaggagtcgtgaaccgtgagtagctcaccgcacgtccgtgcccggaacgtcccaagctgagccccctgcaccgcagtaaggtgagaccagtgtcggagatctatcgccgggtccaacagctgaggtgtatcctgacgtgccatctctgaaaaatatagtgtttcgtgttagaacaattcaaaaagtagtaatgtaaaacaaaagatgactcacaagttaatgaaatagtaaaaaaat

SEQ ID NO: 67984 - DNA, 6767 bp, Oryza sativa
ttttaattaaagttaattctcattccatcgtattaaaatttaattgttgttaatatggttgcgataacattttatttatttccaaacccacctaatctttattttaatttatattttaattatttatttagcccacttgatttttagggtttattcctagttaatttcctcccatttgtgatcgatgaaatccgaaatcaaaatccaataaaatcttcgaataaaattggcatgatgcaatttatttaaaaagttttttttttgaagatcagaatttttttttggagtctttgattttgttggtcgaattttcagaatgttacaaacctaccccccttaaataaatctcgtcccgagatttcttaccggttttcgaatagatgtgggtactctgtcctcaagaattcttcgctttcccatgtggcttcatcctcagtgtgattgctccattgtaccttgtacatacgccacactttgctcctagtcctcttttcggcttcatccaatatccggatcgggtgttctggatatgtgagatcattgctgatgtgaatttcttccagcggagcttgctcttctggcactcgtaaacatttctttagctgagatacatggaagactgggtgtacatccgcgatattctctggcaactgtaactgataggcaacttctcctcgcctggcaatgatctggaatggtcccacatatcttggtgccagttttcctttgaccttaaacctttttggtcccctcatcggagaaacctttagataaacgtaatctccttccttaaattccaggtctcttcttcgagtgtcggcgtaattcttttgtcgtgactgtgctactttcagacggtcacggatcaaacgaaccttttcttcggcttcttgaataatgtcaggtccaaataccgcccgttccccagtctcggaccacattagcggggtacgacatcgtcgaccaaacaatgcctcattgggtgacatctttaggcttgcttgaaagctgttgttgtaggagaattcggcgtagggcaaacatctctcccaatccttgctaaaatccagagcacaagccctcagcatgtcttccaggatctggttggttctctctgtctggccatctgtctgtggatgataggccgtgctaaatgcgaggtaactccctagggcttcatggactttctcccagaaatgtgaggtaaactgggtgcctcgatcagatataatcctcttaggtataccatgaagacacactatcctggtcatgtacaactcggctagcttagcactgctatagtttgtcttaacgggaatgaatctcgccgtcttggtaagtcgatccccgatcacccaaatggaatcatatcctgttgcggttttgggcaatccaacaataaaatccatacctatctcatcccatttccattcgggaatcctgagaggttgcaacaaacctgccggcctctggtgttcagccttcaccttctggcatacgtcgcagagtgctacgtattcggccacatctctcttcatgttgggccactagtatccttccttcagatcttggtacatcttcgtacttccggggtgcaatgaatatgccgattcgtgagcttcctttaaaattaatcccctcagtccaccctgttcgggtacgtaaattctctttttataccatagaacatctttttcgtcggttgaaaattcctttgcacgtcctgcagctaagcgttccttcacctctcggacttccttgttgtccttctggacttcttctatttgggttctcagaagaggttgaatgtccagggtgtttatctgtccacggggtactatatgtaggttcagctgagctatttcctccctaagcttagggaccatcccttccattctcagatgattgcaatggctcttacgactcagagcatcggctacaacgtttgctttgcctgggtgatagtgaacctctaaatcatagtccttgattaattctaaccatcgcctttgcctcaagttgagatctgactgggtgaagatatactttagactcttgtggtcagtgtagatatcacaatggtttccaatcagataatgtctccaaatctttagcgcatgaaccacagctgcgagttctaggtcatgggtagggtagttttcctcatgtggtcgtaattgtcgcgacgcataggccacaacttttccgtcctgcatcagtactcctcctagtccttgcctcgacgcatcacaatatataacaaagtctttcctgatgtcgggaagaactaaaataggcgctgaggtcagcttttccttgagttgctcaaagctttcctgacactgttctgaccacacaaacttcttttccttcttgagtagttgtgtcattggtcgggctatcttagagaacccttcaatgaaccttcggtagtatccagccaagcctagaaaactccgaatttcagtcacagatttgggtgctttccattccgtgacagcctccactttagcaggatccactgctactccaccggccgagattacgtggcctagaaaagcgacttcttttaaccagaactcgcacttgctgaattttgcatataacttatgcttccgaagtttctggaaaaccaatcgtaagtgttccgcatgttcttcctcatctttggagtagatcagaatgtcatcgatgaataccaccacaaacttatccaagtaatccatgaatactttgttcataagattcatgaagtatgccggggcattggttagaccaaacgacattactgtgaattcatacaacccatagcgtgttgaaaacgcggttttgggaatatcctcggtcctaatcttcagttggtggtatcctgatcgaaggtcgatctttgagaacaccttagctcccttaagttggtcgaagaggtcatcaatccgtggtagtggatacttgtttttgatagttacttcgttcagtgatcggtagtctacacacattctcatgctaccatctttctttttaacaaacaacactggggctccccaaggtgacgaactggggcgtacaaatcccttctcttgcaactctttgatttgctttttaagttcttctaactcattgaccggcatccgatatggtctcttggatatgggggcagttccgggtatcaggtcaataatgaactctatgtcacgatctggtggcattccaggtaaatcttctgggaacacatcaggaaatcgctgtactacgggcattccctttaggggtagcatggtaaatatacccccagcacgttcggttagcctaggatcttgatccatggttgctctcatatccgatccccagggtgtggtcagggtaacctctctacgtctacagtcaattactcctctatgctttgctaaccaatccatacccagaatgacatcaagagtttggggtattagcaccataagattggagggaaataccacatccctaaggcgaattggtacgtctatgcaagcatgactcacagttatctcgcccccaggtgagtgtactatcataggctttctaagtcccacgagggtcaagttgtgcttttgactagccttcagagatataaatgaatgcgatgcaccagaatcgaagagaactttaaccggggtggaattgatagagaacatacccattagtacgccctgatcttcctgggcctcttcagctcggacatggttcacttgtccgcgcccaaatccagtggtggtcctgttcgattgcggagtcttgaataggcctcgcccgacagcaggggtagtagtgctgcgaacagtcattgcattcgcgccagttcggacaggggttttgcgtggatgagggcagttgttagcgtagtgcccgtattccccacagttgaagcagtccacattcttcttggctccaggggcagccaaagttggcgtaggggtgcggttctgaagtgcaactggcctgttgaagttgctaagtgcagcgggacggttggtcaccatgacagggggcttccatccggacggagtggcttccttaagtcgctgaggcactgtctgaggtgggcgactcatagcaagcctcctcttgcggttgtgttccaccgtcctttgatcgttctctagcctgacgaccttgttgatcaggctctggaaactctcgtgatcctgcccgatcataggtccacgcaattcatcattcagcccttctatgaacttgtcgatcttttcttcttcatctgccaggtctccaattgcgtagcgagccaactgagtgaacttgtttagatactcctgcactgttgtattcccttgccgcagtcttctaaactcgttcttcttcatgcgcatcactgcagcaggtacgaaattctcgcgaaacgctgcagtgaactcctcccaggtgggttctccagcaccgtcttctcgggcccccttgtaggtatcccaccaatcaccagcgggtccttccagctggttcactgcgaagatcaccttgtcggcttcgcgtaccctgactagagtcagtttcttttctatgatgcgtagccagtcttctgcttccatgggctcatcggccgtagcgaacgtgggcggcttggtcctcatgaactctccaaagcttgaccctccgcggttgccttggttgctcgcgatagcttgcagaagttgagtttgggtggccataattccggccagagcgtttaagtcgggtgtctgagtttcgtcattgctggttgttgcacgacgtcggcttgccatctgtgtaggttgatggagtaagcatcctaattttctaactagctcctatggctttatcccattaaggggggttgtgttgatatgaactttgtttcgcaagcatggtggaataaactcatttataatacaacaacaatagataccataaataacctcacagagtttcacaaacagtacataaatcatgatgcaatcgactgcatacatacgcagtccaaataaggttcatccaaacgatacatcaaaccaatcatcaaactactcgtcaatctaggtaagggaagagggtgtctcgcatactatccaaaaaccatctgatacgagatcgaagctgcaaggagtccgtcagtctagtcctccagccatccgcaggatcccggggcaggtagagggtggtcgctggctcgcgcaaaccggagtccccacggctcagaggtagtggcctctggatctggcttgggcctcttgcccgggggtcgtgtgctcttgcgagcagtgctgagggtgcgagggcctccgaggaaggtgatacagggaacaggagcctcatcctctgaaggatcagtgatgtctggctcgatctctggctcggtgtcggtcccctctgtctcggagtcgacctggatcggagtctccaaattggaacccagctgcggagaaggtgtagggatcagtggagtgtgaaccaactccggaacaggtggctgtgtcgctgtagggtccactaggtagggcgctgactcagtagctagcatactagcctctcccagaagagcgtggaacgccggtgggtacggcggggtgaggaagaagtagcggtcacggcctaccgctgtggaagtagaagcccctgtagtgctgatcttggctgctcgaagctgctcctccagctggctgacgtgctcctgactctctctcagctgctcctcaagagtatccatcatcccgcggcgatcgttgtactggtcggataactgctggaactgatcgccgtggacctggagctgtgccttcagtgagtctatctcactgccccaagcctggtgctcctcctccaactgaagctgctgtgccgtgaggtcggtcacctcagtctctaactcccccacacgtctctggtggtcgtcaatctccaacagagcctcctcgtagtagtcatctactgcctcagcccatcgtgacaaccgagtcaccatcgggttgtagcagcagggcgtgtcctgaactgtgcaaactgagttgccctcctcccggaacgggtgatgagcaaactcggtactcgctaactcagctcggtggatagagctgagtcggaggaaggcctcccgggcagcatcctgcatcgcggtctctggcaggtctcggtggtgacgtgtctgaaagctgtagtccaactcggaagggactcgggggtgaatctcgacccgagcctcccaaactgagccacactgcctcactcggtaagacgggaacccagggtatcgcagacgcctcaacatccgatgcagctcaatgacatacccctctgattgaggtaagctcaactcccaggtagcgggtgaatccgaatctgccatctaattttaagaaaaacccaaggtcagtcgagagtaaaacttgctttgtaaaggaaatagttaagagtaagatgaaaagtgtaccgagttttgtaaacatagagtttttatttttgaaagtattgctaaatgggaatttctcccttggccaacttagaaaaggtgtggggcgccttttggtcttttcctacagtcgtatggctctgataccagctctgtggacccccgtttttataacaggaatcaatcgtgtaaacagtaccatttccctggatcaagtagtttggtacacacgaattcatagctggaatatcaagtgcacatacacgagtgtttaatacgaattattacatcataggcccgcaggcatagccttaaatcatcggaccgagaggtccggaatacatccaaaagc

SEQ ID NO: 67985 - DNA, 3493 bp, Oryza sativa
tgttagaacaattcaaaaagtagtaatgtaaaacaaaagatgactcacaagttaatgaaatagtaaaaaaatcatgagaataattacgtacaacaagagtacagcctatttaaataaagcaaacgttactaatggtacataacgatgacgtgcaatttaacatatatgtagagttcgataatataacataacataacataacattacgtgtcgaagtccgacatacatcagcatacctaaagacactaggtgccttagtctgacgttacatcacgagacctaaagacataacaagccgaagtctgaaattacacgacgaaacataaacacatcgataagttcgaaacaaattacaagcaaacccacatgccaacatagaacataagaactacaccatgtagccagacgtggcacgacgacgcctaggacgtggtcgagtggaggtagtgccttcacccgtagggcgagctccatctgctgctgatcctgatagtcctgcctccgccgcacttggtttctccttgtctttaggacaatgcttgtaggtgtgcccacgttcatcgcatttgctgcaacgcttcaccctgccagcctccgactcgtccatattgttgcggaagcgacgagtcctcctccttccagccttgcctcggagcttcgatgggtcaggaatattgagtacttcatcgttagtctctatgaactccccagctatgccgaacccgtaaatctcgccgctccatgtatgatatattgcttgcttactgaagtactgcgacacatatactgcatctggtatgccacactccgctgcggcagcattgacatgggtgcatggcctgtggagcagcttcggctttgaacaagagcaatgacatgtgccgtcggctttgagaacacactcctgcttcactctcttgcggtagatacccctgcctgccttatcttgacatagtatctcgacccctatgttgttgggtaccatgcactagagctcgatgtttcattgcctttttacgcaactcctctagctttttatgcatgaaagttccaaacaaaatgctgttgttcggcatagagagaagaactgcctggaaccgatccctaaaatacctgcatgtcccatgtaaaataaactccactatgccaactagtggcagtccacggacaccgcgcatcacccagttgtaaacttctgccaaatttggtgtcattattccacatctagcaccaccggtgtcatatgccttggcccatttctcttttggttcatgcagaatccactgagaaaatttccgaatctccaatccagttcttctaaccaaagttggactatccgttgggagaggtccaagagcttgaggatggtcatcaacggcagtcgatggagccgctacacgctgatcactgcatttggctgtcaactcatctaatctcttccaaagctcattgaattttttctcctggttctgattgcacagcctcttgaacatgttcatgagctccttgttcttgaattgcttgaagaaattagctcccatatgacgcatgcaccacctactctgtacatcgtcccaaacaccagggtatcctcgttccatgctcccaaactgcaactcttctatcgctcgcagaatgccagcgtgcctatcatgtatcaggcacacatttggcctcataccaacaacttttgttttaaccaatttcaggaaccagtaccagctgtcggtattctcactctcaacaaaagcaaatgccaagggcaatacctgattgttcccatctacccctattgctgtcagtatctggccccgatactttcctgtcaagaatgtcccatcaatgcagagaactggacgacagttcacgaatgccattttgcatgcatgtagagctaagaacgttctttgcagcacactcttgccaggatgttcaattgatgggaatttcttcacttcgtaagagctcccagggtttctttcctcgataacaccaagcaggcgtggcaaattgtcatacgaggcttcgtatgttccaaatctcatctctattattttctgtttggccctccaggccttggcatagctaatagtatacttgtatgtctcctcgatgtgtcggattattgaccttggttcgtatgtgagattatcgatgacatgcgcatacatctcagatgcgacaaatgcacatgtaatgttcctgtggtatttctgaacaccaggtagaaaacatgtatgcttgttaacgactgacactgtccaataatccttccatttccccttatacgtgtgcactctccagggacaaccatctttttccttaacacaccgaacttcatattgcgaccggttggactaggcaacccaaaactctctatgaagtgacactgcaaaatattttaccgcctccttcatatcttctgttctactataaatcgctccctgaataacctcattttctttgtactcccatctcacactatcctcttcattgacgatcagcccaaaaaaatcctgactagcccattctgctggattaatatccgtctcctcatctgacgaatcaccttcctctacacgctcattgtcagaatcctccctctccatttcatccacaatggctgcgacagtctccccctcgtcggccactccacctggttgaatgcccactggagctactacgcccccgtccactcctgcgttgacctcctccacagaagtctcatttactttagcgcttggtccctcgccatcatccatgttcatctgcacacctggatccttcgggtgcacaaacggaaccaaagctagaggccacccacgttgcattgcattttccacataccatctccacacttgagagttttgaactggtattagttcccaataaaaaccctcagttgcccgacttactataacattgattgttatgtcacttgtctgtggatcaactctcaagcccctcattaatcatccttttatagaaggtacactcctctcagtcggtctctcaattcccctttctgatacaataaaatctgacagatctaccccagttggcccgtaacggacgtttcctggtccatggtaaacttggaatattggtttgttcgacatatctgtcaacgaattaaatagatcatattactctttcatacaataaacatctacaacgtaatatcttcttgtgtaagccaatgcaacggtaaagtattgattccaaactagcagatctacgttgttaccgatatctacaatacgcacttctaaattagtacaactaaaaccataaaaatataatgcatttattcaaacaaattttttaaaaatacacactatttaactcaatagtcacatataggatctacgaatattacctgaaatcggcgtctgaatccggcagggcttcgccccttcgtctcttctcctcccctctcttctttttttttcaccggatttgagaggtgaggaatgagggctgggggctgggc

SEQ ID NO: 67986 - DNA, 927 bp, Oryza sativa
cggaccgggtccacgggggtggggcccacgcggcagccccacggcccacggtggaccgggcgcacccgggctcacaccggccggcaccgtgggtcccacgcgtcagccgcacccgagggcgcgggcgcctgacagccgggccccacgcgacagccgcacggtgcgcccgaaggcagccacgccggcgcagcggcgggaggcggcgcgcccgcgcccctatggtcgccggcggcggccataggcacggcggagcggcggccgagagagggagagggaagggggaaaagaagaggcggtccacggctcaccctaggtcgacggcgacgacggaaaggcagctggagcggaggaaggcggcggcgcggctcgggttgacggggacggtggcgttccggcggtcggcgagtgaaacggaggggtggacgaggtcgccgaggacgcggcgaagccgaaggaggcggcgccgagggggaaggtggtccggggcgacgacggcggcggaccggagctcggcggagagagagaacgacggcgtgagctcgattctggcgaggagagagagcggcgagaggcggaaacgaacggaggaggtgcggggagggtttatatagggttggaagggggagagagcgaccggacgagggggaaatgggcgcggaagatccggccgccattgatggcgccggcgaggttaggggagaggtttccaaacgaatccgagggagagagggagggaaaaatggggggaaagagggagggaatcacagggaatatttccccccactttattgcgtgcgtggaccgcgggaggcggcgggattcgcggcggcgcgcgcggcgctagggcacgggcgagcgcgcgggagccgcgggaggacagggatgacaggtgggccccacccgtcagcgagggtggcgggcgggccc

SEQ ID NO: 67987 - DNA, 2346 bp, Oryza sativa
ccccaccagagggcggcaagggttttcatgcaaaaaaacccaccctccgtcaccgcccgtcctcccccgtttgccacgtcagcttgccgcccaccattggggcggcaggatctatttttgcaatttttctcgccgatagattatttctgtaaatattaaaaaaaatctaaaaacgaaaaaaattcttccctcccatacacccacgggcccccgtgtattgcaaatatacacactaacacacatctttgtaggccacacaaaccagatgaaagcccaaatactaaagcccagttacttattcacacatatacaatacactagcaaaaaccctaggtcacactcgagaaaatggacatttggccacgttcacaacagggtttcgctattatgccattctcaaaacgtgattcgataaaatgccaatacgaagtacacgcttaccgccatattgccatttgtgccattttattcatttccgaaatgattttagctcatccgcccgatgataagacggaaatgcccttgctttgccaccgcatctcggctaccgccattggaccgagagaggaaaggtggcggcatggactactactgggagagtcagggcgcccccgtgtcggaggacgctggagcggaagcagtcggggagcgaccagagaaccgcggaggagtgtgagtcggtcgccagggtggcgcgaggacagcgtctcgccgacagcgagcgggcctcgcggttgcagccatggaagatggtgcctcctcctccccctttacccgcgcatcaccaccacttcctagtccacctcgacgcgcagtgccgtcaccaccgcctcccacttcaccgcatcactccctacttaactagtactactagtactccccccagcagcaagcaagcagcagataagcatcactccctcccactccaaccaccacatcaacatcagcagcacatcgatcgatcgccatgagcgtggtgatcctggacgggtcgacagtgcgtggcttcgtggcggacgacgacgccttcgcccgcagtgtcgacgcgcgcttcgaggcgctgaacaccaacggtgatggcgtgctgtcctgcgccaagctccgccgcgcgcttgagtccttcctactcctctacggcgccggcttcggctccgcccagctggccccggtccccgccgaggtctccgccctctacgactccatcttcgagcagttcgacgccgaccacagcagcgccgtagaccgagccgagtttcgcgaccggatgcgctgcatcctcggctcgtagctgctccaggtcgccgttgacgacgaggggggggcttccttttagtgaagattaagcttcctaatcgactccgtcgccgacgagcaaagatgagggggagcagacgacgagagagaggaaagcacacccagccggccagcaggggcgatttcgtctcatcaagccatattccagcgaaaatgaaatcgaaaatggtgaaaatggagaaaatggcaaagcggctatggtggcgcggttcatattggcattttgaagaaacacgttttcagaatggcattccagcgaaaccgtgttttgaaagtggccaaatgaccattttctcgtcacactcacacacgagcactcccgtccagatccaggcctcagccgcgccgcctctaggctgcatcgacgttgtcttcaggccggacggcgcacctcaccgagctccttccgttctccacgacgacggtcgccggctacatcaagccgtcaacgccgtcgcgcgcctcctctaggtcgcgccgctcacgcctccgactggactacatccgcatgcctgtatctgcttggcttcttgtgttcttctttgtcctgtttgttgcttctctttttcagtttttctcatgttgatggcttgatgcaactgatgcttgcgaacagaatcgtgtagcttgtgattgactgatctgtgtttgtggccgactggccgtgttcatactgttgtgatttggaaagattcataatattctctctcgatctgttgcttctagtttttttctacaccaggtgcgcagccccgtcggagccccgtggcccccgtgggtctcggggacgggagaaatctagccccgacgccggggacgggggcaggttgcgggtagggatggcaacggggccatccccggcggagagtgctcccccgtccccgtccccacacagtcaaaaatcacccgcaacctaaaaaaatcaaatacataaatcctaaaaaatacacacaaatcaaatacatcgcaaatcctaaaaaacacacacaaatccaatacatgacagattatacatctcaaatccatgcaatg

SEQ ID NO: 67988 - DNA, 1076 bp, Oryza sativa
  unsure (1)..(1076): unsure at all n locations
aatagattatactctgatcagaggtgtacatctttacccacaagacacatcttcctcacgtgtaaccacgtgccacataccaccacggtatacgtacggaagacgtgacatagttcccacccatcctagccataaacaagagtaccgactcaacnccacctacggcgggaaccnccgggacaggtaggcaggactgagcccccagcagcaggacaccggccctgtgccatgacatctcgactaccgggccgcagctcgtgtagccttcatttgtcctagagatgtccatcgacccccgacttcgtccatctccatgcgtgtacttttgtttataaccagactgagccacaaactaagccttacccactagacatgtggaagtacggtagtgctttgcaacaaaggcccgagcttaatccttatagtacccgaggtacgactaacaaaacccaaccacgcacctcgagcccagcctaaaaccattttgggtgttttgaatagagggggaggtgtgtgtccacttccaacgtaagccaaccattacatagtgtccaaatgatatgagaattcccaaagtctaaagttataaaaccacctaatgttgcctaattaatcagcgaagcatctacctaaattcatactagtggaaccatgaatagagtacccactagttggggttttgtttatccaagggtgaacaaggtaataataacaatagcaataataatgtcttaacaaaggtaaataggcatggctaaataaaacagtgataacgcgggaatttaaataaagcggtaatgcattaatttaaattaaaataattttataaactgggattcaatatgctcaaggatgatgtgacttgccttgctcgctttcccaaacgtcggctttaacctccacgaagagtggatcttccgaagctgcagcgtctacacgaccaacggaaaagaaaaacttttactctataaactcatataacaagcaggaacaaagcacaaaatggcttcttgacttcttaaagaaaaatagagacttgaacggtccaatttcgagttcaaatggccagttatggc

SEQ ID NO: 67989 - DNA, 13707 bp, Oryza sativa
ctgtccgcgcgtggccgccgacaccgcccgcgcgtggtggctgcttccgccgtcgtcgctggctcgccgcccgcgcatggccgccgccgccgccgcccgcgcgtggccgccgccgctgtcgtccgtgcgtggcggctgggtggggtgggaagggaaatgaagataaggttagagaagggaatagatgaggaattagggttagactagatgggccttttgggcttataatatgctagttattaatagtctaatatgtatcctccggggtcccgcgggtcacccgcgggtggatgtcctcacccgcccccgcccccgcccccgcccccgctcatgaccggagccccggccccgactccccgcaggttgaaatccacacccccccccgtaggggcgggtcccttgcgggtccccggccccacgggggaatttgccatccctagccaccgaatgggaagtgagcaggggtagaagagggcagcaggagttagatctgtgaagaggatagggatcggatctatgaagtgtaggagaggataagggatagggattatatactacgtattaaattttagtcccggttggtgagctatggtgtttttaaccgggactgaagatcatttttagtcccggtttttatcgcgatcgggactattgtggattttggccgaccgaccatagatggtttctccaccagtgatggctacggagcggaaaggaagattgaagtgcgccagatgggaacacgtgtggaagccttcgtaccgttttaaactcgaacagctgagcatgcttggaacctcaacggccgtgccatctatgatggttgttgctggctggacatccagtgggtacggtgcagccgctgaacgacgacaacaccaacaataccctggcaccagcaacaacccttccctagatcgcccaaattcaacaaccatcccccagatcacgaaggaattgaaggaagaagtgttggaactgaaggccatgttgcagatgatggactcaatggcaaaggtggaagaaaggcgttcaaagcaggctgagagacgtagcgaagatgcggtgattggcacggtgctttctaggccagccgttgcacaatcaactccgcaccgcactccatcttccctgcgccccgggcaaagcaccgtcttcaaggggccttaccacatgcgacatcaagcaaaacgaagccttacgtccatcgatccaatggctgcctcaacaacgtcgctccagtccgcggcggcgacgacgcagaggacacaggcgagcctccacctcgtgcttggccatggcaacggcagcgccaccaccatgctcgatggagtcggaggcggcaacgccgactgatgcggcggggtgggtctcattgcagtatctggttcgttggaggcgacgcaatttccgggagacgcggttcggtttctttgggcagcagcgcgatttcagggagaagaaaagaggtcaccgcgagtgcgacgcagctccatcacctggcgctggaggtgcggcttctgcaggcggtgggaccggcactggcgcgattccctggcgacccgagagggtgcgcgtcgcgtggcggcgcctcctcgtcccggatggcagcatagatcgatcaggctgacttatgggtctgtgggctcatggtcatagaaggaaacaaggacctaccgctaataaattttgggtctactagtatgatgcccgtgcgttgcaacgggtcttaaataacatgaaaacataataaacttgtgcaatattgttctgtaaatatatttgtgattacaataatagttactctcaaaacattcaaatgatgtcaatcaactataacactatgaattgtacaatctaaattgcaaagcatatacaatggatttaatgattaataatagattgcctttggggagggaattatagaaagtatgcaattagaatatagtcagattgtatggcaaacaaaattttgcagttttatggtttggatctaaaacttgggcttgtgcaggcctgcgttttgagataaattaagctagtaatgtgtgatgtcatacataaaatgttctggactttaatagtcttaaacttgcacatgtattgattctgaaatctgaacatgggcatgcaattttttgtcaacctatctgcacagatagctcccatcctctttgaagtaagatctgacgatgatatactacagtgcatctatcattgcatattagttgtataacagaacacaggtgaacatacaactgcatggatcaacatcctcccgttcaccgagatgatctccaagctttatcaagtcccacaactgaagatgtccaaatctagcactgcagcttatactatacctgtgtatcacgtgataaactatgatatatcagattataacatcggacacaattgtttgagggaagcaaaacaaaatagcaaatccaggattcaagggaaaatcccgatacagtagagcgcaatgatgctatttcatctgggctaacaccagcatccatgacttttaacccatgaacagaggtagaccagctcaaatttacagcatatcccacagtctgattaaatattttggatacataaactcctgcttatatcccattactccaagctgattttagtgcatgtgtttaaaaccatgaaaataagaatcaagtcaaataataaccatgaatataattttcaaacaatcacaaaaggatcttgagtatagtacatctatgtaagtgttgttcttgatagccggccctttcaccgtgatagcaagaattgatggcaacatagattttattttataaagcaacaactaagagtttttttacctcaagcagtggaggcagccattcattaagtttcagaagaagcacaagtacacgcccttgtttacctaagtattggagaacaatatcaaattcatcacaaagaagaaaacaaagtgcttgtagcacccccttcactaataactatcgacatagcaatgtatggaaatgtacctcagtaataaggtagaaattttattcaaccagcttctcgttaaagttcctcacctccatacttgattaccgagaaatcagatgcctgtaaaaagcaataaatggtcagcatggtcaaaatctcttatcaaagcaaaacactataatgaacatatagtgggcagactattgttctcatgttgacctacgcctccacaccatgccgccttatatcaaaaaatgtattcatttgtacaacaattgtgcactacatttttgggaacatcaataagatattaatattaccctcattcaattcatatccacacaaaaaataaagaatctctgcatctctttaacaaaatgattagctgcttgctcatcttgttcttgtaaatagattatgaaataggaagagaactgaggatatacaaaatgatatgaacatattaatttagattgcagcattaaaacacactatatctagtgttgtggctgacaataaccacctaacatgtgccttatggaattggaaacaatgaaccaatgagatcaaatcagtggtggaacaaaattagttgatcctaaacagttataagaacaaaactatatataaattattacttctagaagcaaccaagtatgcatactgtcagctgaaaagagttcattactaaccttggatattattgaaagcactattcagaaaaggttaatcttttaagtgaggatggattatagttggactaaccatcttcctttgtcattttgatacaatatagtttaattgttgttgatctactgtgtcaaatatagtgcatgcgacatcatgtaaagaatacagccttaccctctgagttgtcattcaggtaatttctcatataattctattaggatgattttcaactttacgtgatgcatcaacatatattaattgttattttgaagataaaacatggcagcatatgcatttagcagaacttacctagcactatattatattggagaggtagatggcatgagggatgagtctagtcgccaaccaagtcgcctccagccgggatcgattcgcagtcgccggggagagagtggagaggcgatacggtgtgcgacggtggtggaggtggtcgaaggggagagagcggagcggagatgcggaggaaggcgcctactttgaagctgctcaatcaatttatccctagacaattcagaggaaccaaaataatcaattgtaaactgaaatgagattaaaaaaacagtgcacatggaaacactcagacatatccaaggagtggatgctgtagcagaaaaagacagattttataacgatggcatcaaatgtactgacaaacatccacatatgaaatgtattctccatcagctcaaattacctcaatactggatagaactatagatagagacgcaagaaagcatgcattttttttccgtaagagacagatgaactattcagatatatagggaggatttagcactattagacggtgaaaccaaacaatgtccatcagctttaagttaggttggacaccataccaggtggaggtgcaggggaggggggcagcgggtggctcccgtcgatccatcggtggcgcaggtggagcggcggcgcagccaatggaggaggttggttgtgtggctccctatgacggcgcaggtggagcagctggcagctcccgtcgatccggcggtggcataggttgagcggcagcgcagccgatggaggaggtcggagtgcgtaaaatttcaggtcaacgcattgtccctcatctgccaagcaaaagcataaaaacttgaatgtataatataagcagcaaaactgaaacaaagatagaaagcaatatggaccatgagtatgtctagataacagaggaacctactcagatttgctatttaaatttggttcagataaatgtctagtacaaataattaagaataattaagggaggcagagctgaggcaagcattagttaacaggttatttctacttgattgcaacgtcagtatcactacgaagaaatgctcaacatcgatagtgagctgtgcagcccagcatctcagaaatcagggtacattcaatttcatccaatggaaaatcgcatcagtagttcagtatttacagccgaaccttagatttggaaataacagcctcaatctcctacgggggaaatcagttactctatttgcttcaagtgactttagcatcagtctcacagaaatcaacaaggcacagatcgttcaagcgtaacaaaaccaaagctattgcaagaacatagattgaaactaaaagggagagaagatgtaatctagggtttgggtgacaaacacacacctcgagaacaaacgaatcaaaacttgtcttctcgttctcaatcctgctcctgtgaggaaaaaaaattgaacacccgattaaaaaaaagcaaggcaggaggcgcctcgcccactccaccctgctcgggcgacacgatggcgagacaacactatggcaagagcatccgcggcggcgcgtgaggggaggagaggaagagattagggtttggggagggggttggcagcggcgttggcggtggttgcgggtgggcagcggcagcggcagcgtcgccggctggggcgaggtgaggaggcaacgcaggaagcgatcgcgggtctggagaggaggccggcgggcgtggctggtgaggaggcgacgtgacggcggggtgaggaggcgacgcagggaggagggtgcaggagggggcgtggggaggagatcgatccgagaaaggagcgagcgtggggaggagatcggtcgttggatgtggcaatcggatggtcaagattacgcgtgtctatcagatgcatctgctgtgccaggaatcaagaccactactacagattttttaagtagtagagatgacagacgtgaacgtgggctacatactctcttcgtccccaaaaaaaaagaaaaagaaaaaacaaattgtctccaatgtttgatcgtccgtcttatttgaaaaaaatataagaaaataaaaaagacaagtcacgcataaagtattgattatgttttatcatctaacaacaatgaaaatactaattataaaaaaattcatataagacgaacagtcaaacattagatacggaaaccaaggtttatctttttttttttttgactgagcgagtatgttgcttactatgcctgtttgtttgggaaaaaaattactccttaaatgttccgtgatttctatattaacaaaatcgtgatttctacgtcatcaaaatgtaatttccgagcctttttcaaaccgtgatttctatgtcatcaaaatataatttccgagcccatttcaaataaaaaagtaagttctaatcagctaaggcatgttgataaaatttagtaaaattacttgcatattgccctagaaaaatcccatgtatattactccatccattaatactcgtagataacactgttgacttttgaacatacctttgagtattcgttatattaaaaaaaattatgtaaatacataatatataaatcatgcataaaatatttttgtgataaaacaactcctaacaaaataaataatagttatgaaaaatttaaataagataaataattaaatatatatttaaaagttaacgacatcttctattaaaaacgaacgtagtatcttatatcaaaagaacgaatgaaaaaaaaaacagccaaaagatacggctcggtgagattggctcgactccaaagatgctctctcgctgcagtgtggtgttggacacgcgtctctcatgcgcgtggtgttgcacgggaggtcttgtgcggcactgccgtagagaatttttttccgtttgtttggctggccaagaggagttaggctttttttccgtttgtttggctagccaagaggagttaggcctggtttagttcctaaatttttttcacaaaaatatcacatcgaatctttagacatatatatagagcattaaatatatattaaaaatagactaattgcatagttaggaggaaaattgcaagacgaatctttcgagcctaattagttcatgattagccataagtgctacagtaacctacatgtgctaataacggatcaattaggctcaaaagattcgtctcgcggtttccatgcgagttatgaaattagttttttcattcgtgtccggaaacctctttcgacatccggtcaaacatccgatgtgacacctaaaaattttcttttcaaaataaaaaggcccttaatctgattgttaagtacgtaggctaccggatcagctcttttttggttactaggccacggcgtggccttgttctttctctacaggcttctgggtggtggaaaagctagttaacgcgcgtgccggcggcgcgcatttcaggcccacaaggcccagcgccgctgcgctggcgcgcgcctcctccacgttttttttttgttttttttacctttttttccttttatttttccacttttttctgtttttttttgtctttagcatgttttgtgtttgaaagtttttaatttttgacttgaaaattttcaaatctgaacttcagagtttttaaatctcgagttgaaagttttcaaatctcgagttgaaaattttcaaatctgaacttgagagtttttaaatctcgatttgaaagtttttgaatctcgagttgaaagttttcgaatctcgagttgaatgtttttgaatctcaaattgaaagttttcaaaattttcaaatcttgacttgaaagtttttgaatctgagttgaaagttttcaaatatcaagttgaaagttttcaaatctgagttgaaaggttttaaaaattgactttaaaatataaaacttaaatcgaaagttttcaaatctaacttcaatctgttagtaaagaaatctccaaaatctttcctaattagtacaattagtgttgagtatattaactaatatagttatttaacactgcagggggaggagtgctcgctgctggcgcacacgcgccagctagcagccccctctgggtagggccctctgttttctgacaacaacttgtattggtgctctaccataatattagatctatttattattttagttcacaacaatatagcaagctgagatataaaaggcttgaattatgttaggaaattatctacagtttgtgttgcagctcgaggaatagctgctcaaaaggaggggtataatgtcatgggcattgggctagaaggcaaatgcccataggcagcctatatcaattaagttagagataagattttccttaattagaggccaggctataccatctatataaggattgtatctattatcattaagtaatgaatatcaattagtctaatctctccctcccaataatgttcttttctctagcctaaatctacacccttctccaggagccaatgccgcctggctatcctcccggtggtagatatcccgtcatgtcctcgagtcatgacagtaggacataatgttactatagattatgcttatttgtgttctttaaaaaacaacataaaggctagaatccatgcaaaggatccgatgctgtccagctatcctcccggcggtagttatcccgtcatagtctcgggtcatgacagtaggacacaatgttactataattatgcttatttgtgttctttaaaaaacaacgtaaaggctagaatccatgactggtttgttaatgtccattgtccgatcattgatactgagctttgactacccgtaaccctccactgcaaatagcaattggaacagaaatgcccatatatgcgggcattcagccggcttgcttgccaaccagctgaatagttctgattatttccagtaagacagttacttcagccttgaatgagacagctaatcagatatgtgttcttgtaaaatggaggacgttaagctgaaattatgcaacaaaaatgacaaaactgtaacaaagagatacgtaccatggttagaacgattcgaaagtatacagctcttccagctggcttcgaagcgaattaggtacatgaagtcgtggagaagactttatgcttagtttcttgagggaagtgaagctggcaagtgtatcacagtactgcaaattaggacatctcagctggagcgatctaagtgaaggcaagtaattcagtgactgaagacagattgagttcaaggtgtttgacgaaatcgatagttcttccagcgtcaaatgtgaattcgccatcctgtgaagtatctcacgtttgaatggatcgtctagatataagatggtgagcgagggaaagtgaccaaatgtaacaaagcttggacaattgaacagatgcaatgacttgagtgatgggagggatgtcagttccttcagtttctcacaaatcgatatgtttagttcctgcagagtagctgaggcaggaaaagtaacaagatttctgccgattggctatcgctcatctaattatgttttgtctttcttgctggttacatgatcaaaccagttgacacgctcttgacactcgagacaagccttgaacttgcactggagtgaagcaaatctcccatgctgccgtgttttccgtcaacactctcatgcaaagacctagctccacaaatgttctatgatagatacattgaattcatggtgagattaggagagaaagggaaagaaatgtagctaacctgatagctaacatattatacatattagcttcaatatgagcttatagctagcagttagctatcactactacagaaactctaaagggtgctggttggaaaacctcctttggtgccggttttcccaactggtacctaggaggcggcactgattacccaaggtcaaaggtgccggtttcaaaatcgacacctttgaggcgcccatgagccaaacaaaaatcggctcaatgcatcgacgtcaagccgatccaatctaatacccgaatccccaaaattcctcaaattcatgaacacaaacatagtcaataatcctagaaaatcaacacatcagcatcacattcatcaagaacacattcatcaagaacacacattcatcaagaatcaaacatattcatcaagaacacacattcatcaagaatgaatcggatcgagtaggaggctatcttcatcaccaccgccacttccggatggagaggaggagggcgctgccaccaccgctgcagctaccgaggaagcggccgtcgccacctcctgccgccgagccaccgtcgccaccttccctcccaccagatctagcggaggggagggcgccgctgttggaccgccgccgcctcccctcctgccgctgacccaccgccgccgcatccccttctgccgtcgggctgctgacaccacctcccctcccgccagatctggcggagggaagggcgccgcccgccaccgccgcctctcctcccgccgccaaccgctgctgccgtcgcctccctcccgccgccacaaccgccgcctccctcgggtgcgagagagagagagagaggctgagagagaaaggatagggtgagagagagaggtcacgggtgataggataaggttgccccctcacctcccactcggtgagtggataaggtcgtctctcggctcggctcgtttggtagggtgtcggtttttaaaaaaaccagcacctttaatatattataggtgtcggtttttaattgaccgacacctataatatattataggtgcctattttttaaaaaaaaccgacacaaaatataataggtgccagtttttatttagaacggacacctataattacttaaaggtgctggttttttacgatttcatcccgcggaggtgggaaaaggcctataggtgccggttttagcactaccggtatctatagtggcgacatctatttgatgttttgtagtaatatatattattaaacttactctaagacaatattccctctgtccctctctgatcatcacataattaaggtttttcaactaaacaaaggaaaacttaactctcctatatttcatttagtgcgataatatggttgtaaaaaaataaaaaatatatgcagactttaactcccacgaatgcacacgaaacgataacttaatttatatgcatagatgcaataatgctgtatgtcaaagaaagaaaggccaggattatgtgatgatcgatttggaaattctgattttttgttatgtgatgatcaatctgatgaagtagttggctatagacatatatatatattcaatttcaaccatgttacccgggcaccatggagtaccaaacaaatttaattaatatatatatatatatatatatatatatatatatatatatatatatatatatatatatatatatataagggcagagccctccatttccattaaagaaacgcatgagttcttacaaaaaaggagtcttggaaaaccagagaggaagaacccccaggtgctcacaaaagaaacagagacaaaatgaaatccagctagcacaggccttagagttttatgcaggccttagagttttatgctatctctccataactcatctcatttctctccaattcaccattgcgtcctcaactaccagctaatcaacagcctcaatagagcagccaaggctgactcctataagactagctaagttagcaagagaaatacttgaatcatgatgaagaggggatgagccctgacctttgttgaggaatgcattttgtgcttctttcctattcattgtcatctctagagtcttcttgtcctccctgtctctgaatctcttgcttgcccttctttcctcctcttgacttcccatctcctctttaggtagcaccactcccaagcttttggcaaaggcatcctcggaatcttgtgaatcaaaaagctcttcactgtctcctagctgcagcttcccttcctcatcaccttccacttccacaccatcctcacaattgctagcaaactgtccttcttgtgtctctcgagctactgacacgtcatgtggagcagacttggaggccttctcaaactccaacatgaggtgttcaggtatgttatcttcagcagctttatccccactgaactgacctcttgcttccttctcttgcagcaccagtgccaactccctgtcttgtataatctgcaaagccttgttcttatcctcctcagccaacaactcaacctgctctatactgggacattggatttgactgcattctcccctttgctgaaacattgctagctgcccagctgtctcttttgtctccaactctccatccctcgcttgcctttggtatcagacttctgatcttccttgtcttcaatgtttgcctttatgtcatgctgtttttcaagctgttgtcctttaaaccagcccatttccaccacattctccatagtaaaacatgcctcatacatcaaagcctcaggagtagataatatcagcctaaatggaaattgcttgatatccatcatccctattttcattctgacaatatccttagcagctagcaaaggcataaacacttccatgaccacccccaaattagaacccacctcatatagagcctagtaaaccttcatttcatcagggagtccttctactattacccagacaacatgcatttttcctatagctgcagattcactagtccattcagagacatttacctccaccttagtgcccttcacattaaagtgatcaaaattcgacatctcaaacaagagacaaccttaacttgtttggaaaggtgccacttggttgtttcttagccctccattcccaattccatttgaactgttgtctgaatccttctatccttcttccaactctgtttcagataaatcctctccatagataattttcaccattgccatggggtttacatgctctttaggtggtgcagatttgatattctgaatcaaaatgcaaccaaatcccggagccccatatccaactagcttagcaaccggcctgggttgtttgtcatacaaacagtcttcagttttgtatgaaggtttggaacaattagtacagaagatttttgtacagcaatccctagcaaggtgccctctctctttgcatctaagacaaacttctgactagagaacacaccaggatgagaaggattgggaatatgtggctgacctttttgctctgcaatcaccaacccctcccctttctgcccttgatcattctcctttggcttgaccgggcgatattgctgcatctgcttctccataccttgctgaggacttttggattcatcacccttttcccccttagctccatccccttgaaatcgccttggaggttggaattgttgaggttggtttgggggattttggaatcctcctccttcccatcttcttccacctccacctcctccatggccaccccactgattgttgcaaaaatctggcctgacttgatttcgctgcgccagccaccaccctgagccgcatatctgtgccttggatgaccttcgcaaaacggcgggagtcgtccgagactgtacccccgtcacctcccaccaccaccgcccaccccaatccgctatcccctacttcccgctctcccagtggccgtgggctactccttcctcgatcctcctccgcttcccagctcgccggcgacgacgaggatcgccagcgatgagagttcgcgtcgcccctcgagacacccctcgcatcgcccatctccccagataatttcattgatcattggctacatatatatag

SEQ ID NO: 67990 - DNA, 2237 bp, Oryza sativa
tttttataaaatcattttaactttgtttatttcttaataattattatttgtgctctgaaaattccactaaaatttgagggctccttttagaccaaggagaatttaacaaaaattctccgggccacatttgaatttttcttttacgtattttagtgtttgccaatttcttttcaaattttaattaattctattattccttttagaaaatgatttttatttcgggatgaatttatcaggacgtgacacaatttcctcttgtgggagtctgactggctggctggtttagaggtgtttggttgagcatcagaccgaatttttggtcctccactcccctgaccagtctactggcgaggtgatcagcactgagcaattgggggatctgacttcatcaatgcaaactcctgagcataatatttcgaattgtcaaatggcttaacaagagacaagagcatgcttttgagagaggttgaggtgtttgaatacataccggtggaggaagattgaaggcgttgtatggcaccaccggcagcaagtgcgaatagctgactacgataacgtttgagaagatcttgcacattctctccttcatgaccttaaaatcaagagagtctagatcttcgcggttttgatcatgcttgctgtcaaattcgaaggccgtacgagatctctctttaattggagctagccgactcttgataaaatgccgggtgatctgttctccttgcagaccttgctcctttagcttcagcatacggtccatcaggtcaagcgcctgtgcggcttcatcttcaattggcaatgagttccaagtgtcctgataaagtggagggagacaggagtactcggggagtgcaggctcagggttctgtacatagaaccaatttgcatgcttgcctttgttcgaggttttgaagggcatggaaaagtattttttggctcaaacttcccctaagttggaaaccagccccccctccccaacaacacatggtttactcttgttcggttggggcttgaggaagaagatgcggcggaacaaggcaaaatgcggcctaatgccgaaaaaagcttcgcaggcgtgaataaagttggcaatgtgaactatggagttcgggtttaagtgatgcaggctaaacccatagaaattcagaattccccggaagaatcttgaggttcgaagggaaaatccgctatagaagaaatgagaaaataccacgacttcatgtgtgtcgggggtcgggaacgcttcaccgaatgctgggcaccacccaatgatttccttcgctggaagaacgccgtgcgccaccatttccttcaggttttcctctgttacatcgaagggtgcccattggctctcgaagctttctctctcctccgccatggatgcgaattgggtgatgcgatttgctttggaaatggatgggagtggatgggggatcggtgcggttgttgcgcggaaggtttttgcggagttttggaagatggattggagcagatcgatgaaccctagctttgccggcgcatctttgcactgtagcgggaaatggggaaagtggcaagagtctcggcggggaagacgaagagacgttttatttctctttggtgttattagggtatcgggagtactaatgggcttgggcctaaaatagtacttcagcccaattctattatcagcgtggcccattgtgatcttgtcgcgaccgagaaaaatacattttcccgaacgctagtgtattaatccccgtcccaggaaaagccggggtacaccacacaaacatggtacaaaaggcacatctttattttatcgataatatttacattattacaaaggcacttaaggcctgacaatcaaaaataaacagcagcggactagcgggcctacggctccatctccacaggcgctcaactggggtataagccaggactccacctaagacttcttctccaaagcttctcttactgaagggggggaaaagattgagcaagaatgagtacaaccacagtactcagcaagccacaccggcagatgcatgattaatgcaaggggggtacaaggggtaataatataggggttaagttttgcagaaacagcatttaagagtcacttagttgcccaaagccatatataaagacgatcctagagctacacaatattattaaccaagaccgtgaaccctcacgaacctgccttaacccaaggtctacgatgattcagaccgaactggcaacccgaccatggg

SEQ ID NO: 67991 - DNA, 565 bp, Oryza sativa
cataaattaaattaagagggagagtatgacaaacatgtatattagataaataccagttataaatcttgatctcatataattatagttatagttcaactgtaaattaggattattcattgtaaaattatgtgatgggataatctgtacccataatatgattaacctgaacaactctaacatacaaagcatggataattattaaccttttataatttattgtgacaagtaaaatatgttcataattaaagtaaagcttccatcaataaaataataatacaaatgatgcactataactatttgattgatcctaaatccatctaacaacagaacctctagtaaataaccgtcctatgtagatagatgcatgcttagccataatccttccatagccacttgatagactaaaccactgattagccaaatatatatgtatcccataaatgctatgtaggttaactcctaaataggccacgatgacaatagaaagattaagaaactttagccttagcatgattgggatccattagcaaacacgaatagtacattttgttgcgcatatttgatt

SEQ ID NO: 67992 - DNA, 561 bp, Oryza sativa
  unsure (1)..(561): unsure at all n locations
gcagtgnnatganancattttgaanctagctggccccttgccggtctagctcgctcgctcgctcggtttgtccccttgtgatctctgcttccaaaacgggctgacccaagtttgaattgaatcgcgacaccaaccacgcgctgcgcgggcacgcacgccgcgattgacttgtagagtcgtacgtccatgcaatatattgcagccaccaatccaccgcccggttaggcgcagcggcgtattggcatcatattggagtagcggattagccgtgctgcgtcggatgcgcgttggcagcagttgccagttgaacccaccgtgaccatggccgtggtcagaggtagccagcgccacggtcactctcttccaactctcaaagctactagtgcaccgtacgtcagtgggccggccaacgcccatgatcgctactgctacttggcacttgcagagtgagtactactgttccaggttgcagatgcagatgcaggcaagaagatactttggggtttcacgaaactgcaggctgcagcttcccttcagacctcctcttctcttctactacta

SEQ ID NO: 67993 - DNA, 1138 bp, Oryza sativa
tgtcgttagttgcgcatctcacaaacgttgtatcttcacgaacttgtcattaccagccattgtgtcttcacgagaagcttagttctgttggcattctcgactagtccgatgtggtctacgtaatacctatgtgctctatgtaaacaaaatatttattcgagtcaattgtgagcacaagagccaatagttattaaacggtgtataacaatacttacaaattcaacaaaactagaaattccgtgaatgtcttctaggtgtagtgtgccagatcacgcactacgaccaagtagtcccatggatataccagaaataatatatagtggtcgctgcaaagaagatatgttaattataggtgatattgtagtaaaaaaatagtagtatggaagaaatatgtacggcaaagtggacattttagtcttggtgcatgtgcatcactttccccaagtacattgctacattgatcctctttttcttgtgcaattgtttgatgaaagctttttttccctctgttttatctttcaactccagacaatctttacgaagttcaaccatgtgttccgtccagcaaacccttgttgggtttacgtatcctaccggtctgctagcccttgcgcccatcaaggaattgcatcctaagtaatgcagcgggtaatttatcagaagtgagtttgcaaatgaattcatttatgtcataaaatgtaaatcacttataggcaaaacgcggcaactagattgatgtccattttaccgagcttgagaaatgtgtgaaggtcgttaaaatagataacgagcatcccattaggtccactaatggaagcgttatccgggaccttcatagtaatcatgtcgagtccctttttagatgccttcaagtaccaatcatgtatcaacctcatctcccatggtagattttccatgacatgccatcactggtggagaaaccctttgtagtcccggttcgtaacccccctttagtcccggtttccaaactgggagtaccaatccgggactaaagatcgctatctttagtcctgggtgaaataaccgggagtaaagatcgatctgagccatctttagtcccggttggtgttaccaaccgggactaaagatcgagctgacctttttttttttttcatct

SEQ ID NO: 67994 - DNA, 8952 bp, Oryza sativa
tcacctctagctgtcagaccaagctgtccagggctagagaattctgctcccttaatgggtgagacatttgcacctatgggttggtcgataccagattgagtgggagatcctatagtgttcattgctgacaatggagatgtgggatttgaagggtgaaagcttggggcatttggcactgcaatagctgatgaagaagatgttgccgggccaccagtagtcacagaaaccccttgccccattggtacctccacggaggaaactacattaagtagagaaggaaggagactgtcccatcgaaggtggcctcgagcacacaggcaacgtgtggcaaagagcaagaactcagattgtggggcgtggctactacactgcaggacaaatgagatgagaactgattccgtaactgcctgcagctgctcttggtcctgaagaaacatgcaaatcaaataataaatttgttctgttctcatgacataaacaaaagtacttgcgtaatgattctgcttactgggaactgcatgtgcaactgctcaaaatccgaaatgaattgctcatctcggggaggcagatctctgttcatagcagttactctcttctgcaacttgttcctgaggaaattcaatgcccattatgcattacagttttagaaaagcttgctgaattgacttccatcgtcaaactaccatatcaaattttgtccaaaaactaccatatatcaaaatgaacaaggcacgaaaaaccgctagagtacagcacactagttccaaaattgcggcaataatctccggatattccagaattcctttcaaaaaaaaaatctccggacattgcagaagccatcgccttcaaaggtaaagttgaacaaagcgcgaacgacaaggacaaaataatccgacctaacctatcataatgtttcatgtgctcgagccctcgagcaatccagctagccctaaaaagtaatccccaattagaagtccaacaagtgggaaatcaaacttacgaggtctccctagttggatcctcgacccgctgcttcgagttcatctgcaaatcacagaaacccagggtctgagctagcgttcacaagtgcaccacggttagagattggggaggagagacaaggcacgcacgccgaggtatagggtgaagagatcggcgatggacgaccgcgccgggtggtggtggtggtggtggagctgcatctgccgctgctgcgggagcaccgccgaagcagagatcgccggagacatcggctgcctctgcccgtgcgccccgtccatcgccgatgcgccgcttccgtcgccggcgactggagtggtgcggtgggcttgctccgaccgagggtttaggagtgtggcggacctgacctgatgagctcttgcagtttgggggaaagggaacagatcaacggacggtgggatgtgtagtctcagctgcatggagacggatccagaccgctggtatgcattctacctttctcttgggtcgaaaaattgaaattgaaacagaacaaaaacatgttctctggtatatttgtggttcaaattagtggccatataatcgaaagctaccaaataccatccggttatatactcctttcatttcttttttctttaacgtaggtggaataggtagtatcatgcttggtctcattattttacgtacagctaattataagtcgtgatgattttatattaaaactttaatatatttgtccttactagaaaaaatacacgtacattgcaacaagtaaatgttattttaattttattattgttacacaatttagctaaggtaaaattcaatgtgggaattcactttgatatttattgtttaaaaaaaatcatgagctgcaattaggagtctgtatttcatctcaagttagcatgcgagttttttcaaaagattttttatacgattccttctatacttccaaaaggaaacaaggttaaaatccaactcaaatacggatatgtatttccaaaaacgaacgaacttaaaaaccgactcaaatacggatgacgtaccaaaataccggcaaaaacatctttaatttttataataatagagatagagaagagattgaataaaaaccaatgctgaaaataaatcacgataaaaaaaactactatgaaattaaatttaaaattttaatttttggctttgagtgataaaacgaaaagcatcgatgctaggactcttacaaatattggagtatattgaactcaaggatgatcctacatatcacacatctgatatgtcccattgggatggtcccaaaaacataatttgaacgaattttgtgaattcgaccagctactagtacccagcaccggcgcttccaagaacaatccgcgcgaacgagcacgtacggcgctacaaaagtacacatcacaattgacacactacagtacgtcgtgatcggtgaactaaggcgcccgagacggcgacggcgccggcgacgcggcgagaggggtggtggcggcgcccccgctcccggcgctcggcatggcgtcccagaggaggtcggcgatgacccggttggcggcgtcggaggtgtggtacgcgtcccagaagacgaacgccttgcggtcgctgcagggccgcgagttcggcaggcacaggccccccaccgtcgtgtccacgttgcagcacgacgtgtgcgccgtcgtgaaccctgcacacacacacacgcacacacgcatcgccaacggtgagacacgcccgccgacacgcgccggaagtttgcgttgattgattgattgattgattaattaccgtgtttttcggggtggacgatgagctccatgacgacggagtagcagtcggcgagcgccatccgcgcgccgggcagcttggcgttcatgccgtcgagcagcttcttggcggccgcgttgaactccacggcgtagccgttcacgtggtccaggcacttgccgttgccggagtggacgcgctgcgacgggatgcagcccagcggcggcagcgagttgaacaccaccttcctcgcgccgagcccgtacagcctctgcaaaaacgaacaattcaaccaccgccatggacgatatatcaggccacctctttaaaattggctaatgggggggtcactgtcacggcgagattggtgggtgttctgcctttagttgccggtccagagtggtgatgaggaggcggatgaacgtgtcgtgcgtgtacgtctggccgtccgccatgaacggctgcaagaagttgttgatgtagtcgttgctcccttcagaaacagcagtgtatttcacgtcatttaacggctaaaaatccagctaactatctgatcaaatgcggtcaaaactcaaaaggccgatcgattcacgagaggaaaatattgtaccaagtccaatttggaacagcgccgcattgacggcaacctcggcggcctccttgccgatcttggcgatcatcgccttcttgaccatctcgaagcacgatatctgctggtcgaatgagaagtactgaacctgcaaatcggcacgccacgttcaacaaacagtgccaacaaaagtaacaaatcgtaaagcataacgatgatgcgatatatgcgacttacaaagtagacgcccgtctcgttcagaatgccggcgccgccggacgcgaagttgacgccgccgaggacgtcgtcgtagaccattgacagcgacaggaacggcggcggggacgggacgccgaacttgtcagctgcatcaaccgaaatactgaatcaggtcgaatgcgcgtgtggatcatcagctagttatctagcaagttgaattggttttgcatttacccatgtagtctccgatggttcttccattggtgaacctcccggtggcgacgccgttggggtagtcgatgccgtaccaggggtagttggacttggcgagggagagcgggaagtagttgttgttccccacgtccgacatcgagtcgccgaacacgtatgtcaccgggcctttggccggtggcggcgccgcggcggcggcggctgattgggcgagcacggcaatggccacgacggcggcgagagcttgagctgccattgttgcttcggcttatcagtatctgcgcctctgtgaatgtgttgtgcacttgtgctgatgctgtgcttgtgttgcatgacgaggtggcacgcacggatttttatagcgcgcggatgtacgcggtggcgtggttaagtcgtgccattctctacaagtttgggttaatctaagcgcaccgtttcaagtttcccagcttgtcagcttgagtgcagtgatgaaccgtgcaacatatatctattcgtgtggccatctgaagaacgaattcagagaggaattggcatgtgtggtagctgaggtggttgaagaacttggctctctttgctctatagagcagctttgacggtttaaatcggtagtgggaagggtatcagcgacctttgcaatcaaatagaccatatgactgaacaagaggtttccctttttctctgaataaatttccccaaactatagaatttttaagagttctcattttttaattaaactattacagaacactatatattcaaaatgaaacttaccgatttaatatcaaacttaatactacaaactatataattaagctggagtgtcgcaaaattacaaatttagtaatcaaatcaacacataactatatgtctaggtgtcagtttaataacaaattttagatgtttataactctaacataacattagtgatggtgaattaaattctaaaacatatagtttgtgataacattattattaaatctatagttttgcaaaccttaaacatttatggtaaatttggtattaaagctgtacttaataatttgatcgaagtaatagatttcaaatttaggcactgttcttttctccaacaaaagttgaattaaattttggatactcgtggcacgcttttcaaactgctaaacggtgtgtttcgtgcgaaaactttctatatgaaaattattctaaattataagattaatctattttttaagtttgtaataattaaaactcaattaatctcacgttattatcatctcgttttgtgtgaaacacttcatcttcatcttcaggagattgcgtgaaactcctttactagtagaagctagcatctcatacccagcgtgagcctgacctgggctggggcaatgcctggttttctttgggctaataatccagtacgcagcagcccattacggcccctataactcccatacacggccagacagatcggccttggactattttgggccattatttcccagttctaacagatgagatggaccgaaaatttccgacacacgaaggccgataaaaaatctggaaagcaagagagccccccgtcgcgtgcgaggatagggagagaggtgaaagagacacggaggagagggaaaccaaggcggcgaggcctccgcctcactccggtggcgacacggcgggctcgccgccatgacaggagctctggcgatgatgccatccacgtcctccccctaccctctcctcgctccgccgacctgctcctcccgcctcccgcctctccgctgcttcgtcggcctccggtggtccgctccccgcatccaggtaggcccgtttccccgttccccttcttccgagaggagcaactgctgtctgaccacagtagttatacagctgggtaatcgtgaggctagcctaggtggcgttaccgttcggctctgttgtttgattctagtggctgcttggtacaggtcagggagtatccggatgcggttgcagggattgccaagggtgcgggtggacgcggtggtcgattcaggttggttcacctatctgctccatgaactatggcaacgtttgaaaacgttcagttgttagattgctgctactcggacgaattcatagtaactgtgtcgtggtagtgggcaatggaagatggttggacaatatgtattggttcccattgctctccacaaactaacaccagcgagatatgtacctgttgttttagaagtgtcacttgatgtggtaaaagaagcgtgaaagttaagacatctgtcaggtgacagaatgggctgtttgcgctttgtcacagcgatatcctgaacatctggaaatataaactgccatgcttgtcaaagaatgcaaatatgcttggtttgctagcccatgtcagaaatcaatcactttgtccaactccctttttgtcaacaatctctgttgttaattcatctggtcacaagcagaccacaatttttttttctacttaggactatctctagtgaattttgttgagttgacattccattttgtaaaaatgtaactttttaagtaatagctgtgatcttgatgcggggtgatatttcattctagggtttagtagagttggtttagtggaaattgaatgtgttatagatactacctctaggatcttatgtcctgattatttccatttaatgtcttttttccttatatttttcagagcacctgcttcaagtatctcccaaccttgctctagaaccatcatcatcacaaatgaacatgttcaaaatgctgattttccacctaattactcgaaaagagagaagaaaccatttccaataccagtattggagttaagacgccgagcaaaagagagggcaaagaaagctgaagggaaacccaaacgatctttaccacctccaaaaaatgggatgctgatcaaaagactgataccagttgcatacaaggtgtataatgcaagaattttgctgatcaacaacttgaagaggcttatgaaagtaattccagtgaaaggatgcaagtaattctcctgttccatcccatcctgatcattatatacacagatcttgtttgtgttaattccacatgcattggacaacagaattgtacttccatcttgacataaaccacacaacacattgggatgcatacaacgcatagaacaataaggaagtagaaattattctataaaacaagatgtaagaaacttcattatatatcaatttgctgacttgtatttgtatatggcataaattatgaagatattcagctgcttaatcgatgtattgtgccaattctctaatgaggctttctattagacatagatcattcaagcatcaagtccaaaatgaactgcatggcatctgtggtgactcctctattattcatagttgtattttatctgattattgattgaagctatgaaacagtatctgttccaagaactcattaattgttcgcattgagtacatgcatttctataagtttagatattattagttccagataagcttccattttgctttataaaagtctgcattttggaatatctgcaattattttgactatagtttctgtttagcgtaatttaaatctcacgaccgccttggataaactttctgactattttggcttatgatgaggccatcatgctcatgatcctagtactgtttctacttggtagtaccatgttccatgatccatcattttgagtttgtaattttgacaattgtgtaccttttaattgttttatgttaatatgcacttttcagttcaccgacaagcacctctttcaatgaagattgtgcacttctattttgtgggaggaaataatgtgtgtttatcttgcagacattgcagtgagatacatgttggatctgttggacaccctttccgaacatgcaaaggaatgtcttcagataaacgtagggggcaacatgactggggaggtactttggttgaagctgtttttgtgccggttgaagcctaccatctagaggatcgcttagggaagcgtatccctcatgatcagaggtttgctgtacctcgcatccctgctcttgtggagttatgcattcaagctggagttaatcttcctgaataccccacaaagcggcgaagaaagcccattattaaaatcggaaagaacgagtttgttgatgcaaatgaggatgacctaccagacccagagccttacaaacttgagcatccaattcttgaagaactaaatgataacgagattattgccccagcaagcccagaggagattgttgctctagctgaggaaacactcgaagcatgggaggtagtcaaggatggtgccttgaagcttatgaaggctacgcggagcgggtttgtggatactgcccagaggttcatataggagcaagtggccacaaagcactgaattgtggtgccttcaaacaccagcagaggaatgggcagcatggatggcaagcagcagtgctcgatgacttaatacctcctagatatgtgtggcacctgccagaatccggggaggacttgcagagggatctaaagagtttctatgggcaggcacctgcgattgtggagatatgtgttcaggctggtgcaaaggtgccggagaagtacaaagccacaatgagactagatataggaattccaacaagtttgagagaggccgaaatggtcgtctgaacaaagacgtttctattgtcacctcaagctccagtttgtctgaccagaggttcacagttttactcatgtatataccaggaaggcaggaaattagctcaaacagaatttgtctaggtctgtattgtttgtaccatatgctcgctatcatttaccaaattcttctttgtatgaggcatggatgtttcttacagcagttcgagatgcatttgctaatgctgatatggtttatatggtgagctgtgttttgtgtgaaaagtgaacaccaataaaatatcctggtattaacacagtcagcaattcttgccttgaacaacagaaaatgagtcacaaactttcatctgattcactgcattctgagggattgcatgacaatatacacccatttgtgctccctggccagcttctgttcctatctgaccatccacaaggggcgacagaaatgacagaaatctaaggtacaccgcattcagccataaactaacagaatcagggctgcagga

SEQ ID NO: 67995 - DNA, 7662 bp, Oryza sativa
gcatttgggatgttttcacagcataaattcatgaactaactgtctgatcttcacaatgcggttggggctccacggccgtcctgaacaacagtatatagaccttatcaacggaaaagtacaagaatccaccccgggcatgggtgacatatgaaccgaaactcgtccctacgatgcagtgccaagctggtccataagcagtgtcaaactcctgcagcgaaggataagctcccatcatttatatagtattgcatatggaagtagatgaacatggacaaaatgacgagttatagaatttgtggacaaataataggaagtgcggttgcttgataagcatggaccaaaaaaattgtggaatggtcccagatttggttgctgattggttggagattgtgcaggattcaggcacgcggagaagattttagggttagttaggtccaactagaattgcaggatgaaaaataaaatgttttgcctactggtcagcatggtcaaactaagccaataagctaaatagctaataacacgtcctatgtaaaacattcggttctgttagatcccttatccaaggtacagatagaatttggacgttattctcacattgggcaagaactgaatatttatgagtggcagacaaaactttaccaagatatgcaaattaaagttctataggctgtgtttagatccaggggtgaaaagttttggcgtgacacatcgaatatacggacacacatttaaagtattaaacgtagattaataacaaaacaaattacagatttcacatgtaaactgcgagacgaatttattaagcctaattaatccgtcattagacaatatttattgtagcaccacattgtcaaatcatggagcaattaggcttaaaagattcgtattgcaatttacacgcaacctgtgtaattatttttttatctatatttaatactccatgcatgtgtccaaacattcgatatgacagggtgaaaagtttttgcgtgggaactaaacagggtcataatcgagtgatgcattcccatgctcaaacttgcaattccttttgcacaagacaaagagtcaatgacagatcgacaaccagatgatatgaccacctgattgcgcaacgtattaatgctagcaatggtagttaggagtacatgctagattgcatgaggaaatcttagcacacccacaacgaagagccaaagtttcattcagcttgaccctactgcttaggtgttcagaaactgatacttgagctgcctatgattctctgacccttccagttttgccatgacaaacaacaggccaatttgggtttcaggtgcatgaagatagctacagcctacaggggctaccaaaatcatcatttacgcaacaaccaaatggggtgatcaatcagcatggacatgaatgcacttgacaaacatcttaaatccttatcacggtaagccagtaataaggccccgacaaaggatacgtgctactggtacatcagttatgactgcgttgccgtgagaagcatgtgcaagcattgtgcgaatgcatttactccaagaaccaacactgctcgacgcgatcagttaagcacctactatcggaagcttaattagtcatggcaaggaagattctgtcctcactgaagaacagtctcaggtaatctaatgaacaagtggagaaaaacagcagcggacaaatgattaatcagttaattccattggctaatgcatctttgggagcaaactgactactcgagggccctgttcttccagatacgcaagctaactctacaaccaatttgcaggtacagtaatggagttctggtacttacgcaaggtaagtacaccggctaagaaatgtactatactaaccttcttgagggcgagggcgaggcgcttgggctcgagccgccgcggggagcgcggcatcccggcgagctcgtcgcgggcgcagcggaacgcgcgccgctgcagcgcgggcggcatgtcggccgccaccaccctcaccaccgccttcctctcctcgccgccgccgtcccccgcccccgccttcctcggcaatcccccctcggcggcggcggcgccctccgcgatcgcgccgaggccgagcagcgccctgacaaccccaccccggcgccccgccgcctgcaggccaccctcctcctgctccctcatgctcggtcgccgctcgccgttcccgccggccgcgccgggagctttgactcaccggaagcagagactctctctcactctcctctctgtgttactgtgtatgtgtcagtatgtgtgtgtattattattattatttttttggcgcttgggcagcggttggggcggctttatcgttcgttggggttcgttaaagttggcgtcgtggcgtctccgcttttctttgttttttgttttccctctctgcccggggagcgcgccggcgggatcaccgaccgcgcgcgagagagagagcgcggcgaattccgggtcgcctcgcgttcgcgtacgtattcagcccgccgatgcacgcggccggtcggctacacggcctccgcgagatcgcgaccgagcggaccgttgctcgcgcgggacgggggacgagcactagcagcgcagcctgcgctgctgctccgtgccagtgtaccgctgctccgggtctatttactgcgagaccgttgggacggacggacacggagagcctgagaggcgttgcgtcaccgtgggggtagcagtaaactcggatggagttattgctgtgcgcctgtgctgttcatgtggatcccacggtgcatcgccctcgcgcgatgtggcgatcaggtggacggcgtgggtgacgtatacggttccgttagttgttgggctttgggatcatggcccggatatggcggatgggccacttggtggtagcgtccctcggtttatccgatttggagaaggaataagttcactttagatctcttaatttatcgtcgagtgtaaaattcgttcctaaaccgcaataccagatatggcttgtccgtcaactcttaaaactagtgcaaataaggttagcagtttggatggcagttttggcaaacccaacatcatcacccccaaccccctatttcccttcttctcttccttcctcctctctctccctttccttgtcatcattggtgcacccgcagctacggcatcggcaggaccgcatgagcatggtgtcagcgtcggcgcaggaggagggcatcaacggcgtgggagcatctccttcgaccacgtgcctcattccccttccttcccccgcggttgtgtcggcataggaggagggtgtcggtggtgcgggatggcgggaacagctcccccctccccatgctcattgggttggccaagttctttccacgttcgtagctgcctgacgagtttatcccccgcacccggggtcggctaggtccttcctgcccacgccatggctagtgagctcctccccgtctgcatgtacatccaactgccctcctccgagcgcgcggatgacggatccgaccgagaagcgatggcgtggcacggatgtggttggcggacgatgagtcgggagaggatgaggaaaaggtcgccgttgtcgagctagtccctccatggctagctcgttactccatggcgagatcgtcctcgcatgccgtgccctgcccgtgggagaggagcggtcgtggcgcctttgtcgcggcgaagcatacgccatcgctctgccgcagtagctcagccatcaacatgtgtggggaggaccgacaaactgctccctgttgatgtagacgaacgacactacgggacagacgtagcagcatatgtgacttcggatcgctacagctcgcgctgctcgtgcagcaagagatcaagcagagaatagccggagcgtcaccatcgaccagagtctgcagaatagggggagaaatagagtcaccaccgccgctcgaggatcagacccgggctcgccaccaccattgagaagcaggaattcatcgctaccgtgcccctggctaaccaccgccaaactctatctctatctctccctaactaatccatgtgtgtgtcgatcgccatttccagtccggcgctctctcatgtgccgcttgcccagctcctctcccgccacatgttgctcgcatttggggagagatattgagggaagaaggcgcgccaacccagaggagatagcgaggggacgaggtgaggtggatgaagtggggcttattaacatgtgggtactactattttttatctttctatttgatttctccatatttttttaatcttgcttcgaatgccacgtcaacatcacgtgagacgaggactaagtcaaaccagccacctaggtgccacatcagataaaaacgccatccaaaccgctttgggacctcgtctgcactggtttgaaaatttgagggacgcattatatctattatgattcaaaaatatgatacaaactctacgtcatgatgagagatctaaagtgaacttattcgtttggagaactaatggatcattgggctggtttcattcattcgtgaccatacaggcctttcagattttgcaagcaactttgccgaaaggctcaaataggaacacgacccaacaacagccgacagatggccatcacgtgctcacggcgccggtccctcctccagtcctcctcccaaattttttccaggttagactcgattcttgcagcactactgtactactagatggacagtgacgtttgctaatgaacaggaaagctgccaatccaactccagcaatattggcgctggataatgctttttttttctttctctagagggtacaaacgaacggatatggggtagacatttcatgccactaatgacattatctagtatgagcatctttcttatgcaacatataaccccagcggcgtatttagaatttatgatatgggtggtccaacttataaaaatttttaaacattgcggatataataattttaatatatacaatataaatataggtaatagaaccatttcttccgcatcttgtttaaagtatactcttctgtcataactaggaaaggaagtagagtaattcagaagcattttttttacatgtttctgaaaatgagatgaaatatctacatatctacgaatgtttcaagaatctacaatacaatagtataattttagatgtatgagttgggtcaaaactgaaaattgaatgcctaatatggttctaatctgctaatcagtaggagtaattaattgctctttgttggttccttcccttgcagctcgcgcagatcccagttggccaatgccctagatgcaggcgctgatcgctgcacgtcgccgtcggccgccgcagccgcactagcactccggcgcccttgcttccttgcgcttgttgttggcccatcgtcacttgatccccaggaagtagggaagagaaggagcagccagcaacaaaccgccgtgctatgcacgcgtgatggcgccgctgctacaaccggtcaatcgcgcgaggagaaggagatggagtcgcggtagcggagagggagcggaaacggcgtcgcttcgtttggaagcttcagcctcacgggatttttttcctttttcttttttaccaaaaaaaaaatcatgttgggtcgctaatttttttggtggtctggggaccaccggaccacccattagatccgccgttgtataacccgcgatatttttgaaaatgacaatataacccataatctcgttgcaccaacaaagttagaaatgtggtgagaatggaaagtgggaaggaagctcttcgggttcttatctagttttggaagtactaatgtgtacttaagggggacagttcgttctgatgggggtaacctaggatgattaggcagcaatgtgcaccccatggctctgtggccaatctccttgcaatgtgctttatttattagccattaaccttgctgtatcatataaaatctatagcttttgccgtgccaaccacaatcgtccatcactgtgtgctactgttttactgtcgcatgacgataggagccgctcgatccattgtcagcctccatccagccgtttgttttttccattgcgttccaccagcttctaggtattcccacgagtgtacgcatcgacgccgccgccgcggcttgggacgattctccgtatctgctcctgcgagttccttcgcgtatctgccatcgccgctccactgtgctcgcctttcccctctccaccatgccaccttgaccttgctccccgacgacctctaccacgccactgcttgtcctactgaggaagcggtggcggcgccacgcctccaccaacacccggcgcccgtgggtgcacgccgcgccgtcacggacgcgggacgccgttcctcgcatcgcctcagcgcctcgcggggagccagcgacggtggccaactctctccgctctctggccgggcggccggcggcagtccggctctccgcgactccgcctgtccgccactcggacgaggcggcaactccgcctctcctcgcgtgtcgttgtgcctcgccggtcgcagccgtctccgctcccactctgcctctcctcgcccgcataaatctctgctccaactcccgctatccgtcgcgccgctaccgcctagccagccaccggccgccgataccgggagccagggaggtcgtggcgtgtagcacagcaggcagtagcagtgcgccggtgccaccttcggccttcgcccttcgattccggccttcccctgcaggtactttacaggtctgctcctttacctaatatgctctatactgatttttaattgaaacttgctctgtgctatcaatttgttatttttgattgtcgatttgtgattgtctattagactactatcataatgtcattgccgatttgtgattagtgaatatgcattttttgtgggccattccatagtcatgaatatgtggttacaacatatgtttgcttatttacacggcaagattattatatcgtgtgccccaatgacaggaaaaattagtgcgtaaaatgggaagtgttttacctagcctatagtgcttacttctttaatcagtagattgggagtttaggactttgcctttctgaatgctcaaattgtattctcagattgcatttaggtgcattcacaatcttttatggcaatatgtcatggttaattacatattctgcatgtagcatccaacctgaaaaccatacaattactgcagcatttattcctagcaatagagcatctctgcgagcagatgatgacatctttgtgctgtaagctatttctgtagaagtatatgtcttaaaagttatactatttggtaatgtttctaaatctatccattttcaaccttgagttcagctttctgcagtacacgatcccttcaaacaaaattaaatagctaataatttaattaccggtattcagaggacactttgacttttgtacttatcactgatggaaaattgagaacacttccctttttctggatagaatctctgctttgacctgataactttattataacatgttaaggtatggtattgcatatacacattgaaaaatattcccgagataaccaaacatggttactaatgaaaagtttgggaatttacaacctgtctatggctattccttcatgtcctgctaaacaaaaatcaaccatccaattcaatat

SEQ ID NO: 67996 - DNA, 8502 bp, Oryza sativa
taataatttcaaaaaattttgaataagacgagtggtcaaacgttacaagcaaaaactcaaaatctcttatattatgggacggagggagtatatgtgtggagctttccaagtccacaaaacatttaagttttcttttacctatcagtatatgctatattattctaatatgtgcatagatatatcttactccgttgcaatgtctctttgtaatttcaaatttatttttgtatagttcaaataactaatgtggttacaagcattacccgcagcaacgcgcggggccactgactagtttctaatatgcacacatggctctgtggccaatctccttgcaatgtgctttatttggcctttaaccttgctgtatttctaacatgcagagaatgtttttttttttgaaggaaaaaatttggaatactaagaaggaatttagcattcaatattgatagagaagaaattggtgagaaaacctgcgttcgaagggattcgaacctaggccagcacgttgctcctggcagctccctgccagccgagctaggtgccgttctcaatatgcagagaatgttgcacctaagcatcttaacaagactggtcgttccacgagggcaagagcaatacaagctcctcgtaagagggaccttgtgcctaaaaggtgtgccatgtggtaagagggaccttgtgcctaaaaggtgtgccatgtgggatgacgctactactaagaaactcagttcacaatggagatcaactagatatttctattttcctctccatctccctctcgtaggttcccctatccgcctccctcttgtgcatcgctgtcgctgtgatcctcttcgctggtcgcgctcctcccctcttccatatcggacccccgtgcatcccctcctccattccggccgttggctatccttcttttctatgccgccaagtcttcctttcctcctccgtgcatggatccatgttcattgttaccaaaatgagtttagacggcgcgaatcgttcttcggcagtgtgaattgagctcgggtggggcgaagcaatctccaatagtgctaatcgagctctaacggtggatcgagactgagcggtgtggcagatcaatctcgggtagcatagagaggtggacaatggcgagctccttaccgcggtggtgcagttcgagggatgacaggctccctcccaagccgtcgagacgagctccctctccagccaccaagacaagctctctctccggcctccctctcccttccccttgcggtgcgggatgtgaactatgggtcagacctgacgaatcctgacacattctaacgaggaacgtgtgctcagactaggatccgcagacgtggcatagaatctttggcgtggcttgttggtgcagaatgatacctactcgcattgtgaaagccctgagtacatggtccagcgataatgtgcagcatggtaatctttcttgagccatttgcgtattgtggtgttttccgtgaacacgtacgaatggtctcggcatggccaaaagcaactcgagaacatacagttccggccgttggttggcactcaacatgccatttcacctactagaaagtacgggcaactttccaatcttatagactcggtcacgactcacgagctgtctcggacgttcttaaacgcacgcaccaaaactgccgttgccactagtgatatcactgcgcgagccgcaggctgccaggctcccccaccgctccaccgccgcgcgctgtgtccgtcaaaagcgtcgaagcgtgcagcgacgatctttccgtcttttcccggcaagaaccttgcctagctttagctagccaagctgcatcagagcgtgcaagccaagtggcggtagcctcaccgaactggctggacgcgaagtggacgggaactcgtctctttacttctctagccgttggatcgatcgatcagccggtcagatatacgcggacacttgccatcgcccgtccgtcaatgcctgcaaaattccaagaaaacgggttttgcaagggcaggccggcaggcattctccttccttcgtcatcttcttctccaggtctgctttaacggctctccgtccttcgcctcagcaacctagtaactgcactctcactgtgccgggggatccatgctacggtgccctttgcatgccccggcccaacggtcacatttaacaaaaaccgccggatctcatgacggcgatggccgaaatgccgtgggaccgggtcgtcagctcctctgtctctgccgtgattgatggtgtcgtagattgcaatgcacggatcgatctaaaggtctactgtgcttatggatgtttggcacgcgattaaagcctagaactacgcttgttataaggacagtatgcatgttccagattatgggcagaaatagcggcattagcgtagaacaaaaaaatagtggcattagagtaacaaactttcaacggagacgctgagcagattttatctcagtgggtaaaaatactgaaggacgagcaaggtgaaaagtgaaaacacgattgatcacggggaggagcaatgacccggcattgaaaaacaacacaccacgcagagctgtataactaatggaatgaaatgtaaaagtcgaaactctagctgtcgcttgtagtactactcgtttcaaagagcctgtttgctggagtatactactgatcagtgatcactggctgcccgtacgcccaaatctggcaattacaacttcggatagaacaatccaaggtttccaaaaggtcagacttcgtaggagtaaaatacattcccaggtactaagggggtgtttgggagagaggggctaaaccccctaaaccgcaccattatactccagctgcagtctttccagaggtccaacggccgaaacgaaccaaactaaccaaccaacctttcacagcacagtacgcctcctccgccgcaacgttcgccgcatccacgcgtcggcgcctcactggcccttgccccagcatcctaggctgttttttctccccatggtccaacggtcccacccgtcattccgtccgaacatgtctgcggccgtcacgtgcagtatttatccgccgacccgttcggctccggctcactggcatccacctcactcgcctccctggcattattaaaccccgcctcgttgccaagccgatcactctgtgcaacaccgtgcggtagcagagcaagagcagcaaaaaaaaaaaccaccacgcctcgttcagtcactcgcacgctcgctcgatcacccggccgccgcgaagcgtcgaccgaagtgtatcgcacatttcgaaagttcttcgcgggcaacagaaagcagtttgtggtgtgcattgccgatttgccattgcgttgggttcatttcttccatcggcaatgctggcggcgtcgttgagagtcgaggcggtggcggtggttgctgcggctgtgctggtgctgctgctctcgccggctgcggtggtggtggtggccgggcagcatgattacggcgacgcgctccataagagcatactgttctttgagggacagcgctccggcaggcttcctcccgaccagcgtctccgctggcgccgcgactccggcctccacgacggcgccgccgccagcgtacgtattctcgtcctataacttggcgttaagaatgtactactggtgaagcagcattgtgatttgtgagtaacctgctgtggccgcgtgtaggtggacttgaccggagggtactacgacgccggcgacaacgtgaagttcgggttcccgatggcgttcacggcgacgctgatgtcgtgggggctgatcgacttcgggcggagcttcgggccgcacaaggaggaggcgaggaaggcggtgcggtgggcgacggactacctgatgaaggcgacggcgaagcccaacaccgtgtacgtgcaggtcggcgacgccttccgcgaccactcgtgctgggagcgccccgaggacatggacacgccccgcaccgtctacaaggtcgacccctcccaccccggctccgacgtcgccgccgagaccgccgccgccctcgccgccggctccatcgtcttccgcgacgccgaccccgcctactccaagcgcctcctcgaccgcgccatcgccgtaagtacaccagtgcgcgccaccgcggcagcattgatttcgattgtttcctcatgtccacgttatctgcttcgtgtactcctaggtgttcgagttcgcggacaagtaccggggcccctacagcagcagcctccacgacgcggtgtgcccctgctactgcgacttctccgggtacaaggacgagctgctctggggcgcggcgtggctgcacaaggcgtcgcgccgccgcgagtaccgcgagtacatcaagaagaacgaggtggtgctcggcgccagcgagtccatcaacgagttcggctgggacaacaagcacgccggcatcaacgtcctcatctccaaggtaaatgcaccattcctccatgattttactactgtgtgccgatgctgacgcgcttttcaaagaagcctcgtcatttttggcagcttcattatgccttcgtctttcacaaagagttgcccaaaccgcaagttatccggtagtactcttgaaacctctttttactgttaataataaagatctactaatgactgcataactgactgcgtacggaattgaaccttttaagttttaacccttttagctttacatgtgggctcaatcaggtttgttctgaacttctgatgcttgtctttgaatactcaaagagtcaaagtaagccagtacaccctgacggccgtgacaggagaactgatagtatcacgtagagtacgtactccgtaatactatactgctagtaatagcgtactttgactagcagcctaatccatcatactccctccgttccataatataaagtatacatgtatgtaagtaattaactatgacttattctctattaattattttttaatcctctctcatgttctctaattttaagagcacccgcaatggtaaagtaaagtgctctctataaaacatgttcatctcagcaatagactagattaatagtaaaccacctcaatagtatgtctacatgggtatctatacctctctcatgcattgcctcgtttttctctatagattatctctaagttagtagatagctttgctctctctattcatttaatatcttccaagtaggaaaatatgctgacatgaatctcttgtagagagcttatagataaccattgtgggtgccctaatggatgcatgcaatgtatttattaggatgatccatactacaatatgataataattattttttggtatttgggttaagggtggttatgccttagaacaagtataatagtgagctataagcctactataagcttaggtggataagagagatactgaaaaatcaaagttgtgggctctcatgcaagagctagcttatcacaagatccaagacaaatacattaaatgcataagtgagagatagagagaagataagaaaaatataaccaatcttatagctaatctattatatatattggctttaagatgaattaatagtaggaactgagctagtatactgctattatattttggaacggagggagtactagtagagtagtagtgtacgactactgtatgagcatgcttgtccgttgcactgcactcctcctatgatagcctcctaggtccttgtgctccggttgctgcccgtgctgcagtctactgtagaagtagcagggaagaacgcttttcagtgctcacggtcacgggtcgatcgattctctcgtgcaatgtccaaaacaccctgagttctagccttctaggggccagtactacaaacaactgtactaccagtaggagtattactgtactgcttacgttaattaatcttgcgttactccaggaggttctgatggggaaggacgagtacttccagtcgttccgtgtcaacgccgacaacttcatgtgcagcctcctcccgggcatctctaatcacccccagatccagtactccccaggttaatcaatctctctatcaccatctctctctctctctctcttttctcagctagaaccgcagctcttaaatttgttgtgttggcattgcaatgcaggtgggctgctgttcaaggttgggggcagcaacatgcagcacgtgacatcgctgtcgttcctgctgctcgcctactccaactacctgagccacgccggcgcgcgggtgtcgtgcggcgcgggcggctcggcgtcgccgacgcagctccgccgcgtggccaagcgccaggtggactacatcctcggcgacaacccgctgcggatgtcgtacatggtgggctacggcgccaggttcccgcggcggatccaccaccgcgggagctccctcccgtccgtcgccgcgcacccggcgcggatcgggtgcaagggcggcgccgcctactacgccagcgcggcgcccaaccccaacctgctggtgggcgccgtcgtgggcgggcccagcgacgccacggacgcgttccccgacgcgcgcgccgtgttccagcagtcggagcccaccacgtacatcaacgcgccgctcatgggcctcctcgcctacttctccgcccacccaaacccagccgagtgggccgacgactagaacaacccgccaaagtatatcagctatacgggcctgggctattgtttgttttgtcagggccgaatcgggtgattattgcctggttgattgatactacttgtgtaaccaaatatagttaacttcctctacaaaaccccaacaaagtatagttaactgcagccacctcctttcatgcgaaaaatatcggccaggaggaatgcataggctttattaggctgctactcctactagcaatgttgtaacagtactgtagacatagttacacttgtactgctatggttcagcgagtggattatatataaagtgcaccaccgacgtttcctctgaacaaatgctgcaccctgtgtactgaattcaccctgtcagacgctgactcaggcgactagtgacaatccaatggaccagcaaaggcagcagaggcggggatcacatgtcgagcttctgttcacgggtgaaatccgtgaatctctccgctgcgtacttgtgctggcacctggcgggcatcactagaacggtgtggtcggtgggtctcgatctctctcaatcgtcatgcctattttcaactacatcaggtgcaaatttccaaattcttggtagtaatttcaatcacgaatacgcaggaaatcattgttcatcagtaatgcttgcttgctatcgtaagttcatttactcaaacttaaaagcagaacaagtgtaatgacaaatcaggctccgccgctgcagatggcggtgagcagcaccggcagcctcactagcgacgacgacgtcgcctgcgccgacctccgcagctgccacttggccctctcctcccgcgcaggcagcgctctcccgttgtcgaacagcggcgtcgacgacttcctctcctccacgccgtcgccggagagcagcccggtgcccgcgagctgcctctccatgtgcaagaagtggcccagcgacgtcgtgccgccggcgtcgtccctgcaaaggcgccaccagctgccgccggcgccgcgccagcgcctacgcctccacctcctgcgccaccgccgcccgtcctcctcctcctctgccgcggcggcgcggggcctctcactctcctcccctccgtcccgcgccgcctccccctgctgctgctgctgctcctcgtcgtcgtcgaaggaaacgcccatgagcgtccccagcgtcgtgctccggtcccgaaagaacgacgaccccgtggactacaacagagcaacatccacacccatatcaagatctccaaaacaaatgaaatggcacggctaatgattctttgtgtacctcggtgtcgacatcggaggaagagggtgacgtctcggcggaggacgaggtcggtatcatgccagcgtcgccgtccatatcctctccttccggccggcggctcaatgggtgaagtgtgatcgtgatgtgctctagaaaaacttatctgcttctcccgtcgaatcgagggaagtatatggccgcggtagtggtgttttctatgcgggctgcgactgcgagccgcagacgcgggggtcgcagtggcgcaaggcaacaacggtcaagggaaatgaatgaatactccagcttgagctttgagcctctgacagtctgactgaatgtggggtagaggcaatcaggcgaagagcgtaggttccctacaataagcgactttcaaggcggtgtttgactgaactgttaacaaacagtgagctcctgccgattatattaattaagacaccttctaatcagactcgttggattagagcaagtttaatagtatagcccactaataactctaattcatatatagccaatctaatagcaatttatacaatagttgcttactatactattaatatatatacccacttgtcagggctgcagga

SEQ ID NO: 67997 - DNA, 12571 bp, Oryza sativa
ttcctgcagccctatttatagttggctaatagtattctattatacctgctgctctaagcacgtggatactgaatgatcgtacagcagaaaagagctgcaagcgggtactatacaggaatacatgccaccactacaccgctacgcaaggatggaacgtatcggtatttttcagcccgaagaatcaaatcatcagcggtgcagtgccagtgcgcacgatgcacacatggagtcgacctgcaatggcctcacgtatgatggatttctcacgggcgggcacgcatgggcggagcgtcacgcgtccgttccttccggtgcgcggagccgtgcaaaatataataaccgtgtgggaatcccaaagtcaataggcagtagtaaaaaaagaggaacagtcgtgcagtaaaaacaaaaattagttgctcacctttaacttcggctcatgcaaacaaaacgtaaacgcggtaatttggagtagatagatactcctcgttatgtggtggctgtttaagcagcgagaggaaatcaactaagcagttaaaagtttttaaaaatcaactgacaagtatggttattctgttattctgcaccagataggtccttgaaacgatcaatatatcaagcagaatgaatcaaaaaaacatttatcaagccgaaaagcaatactcaagtttgcatacctatttcattgaaatttcccatgcatttgggatcatgcattggcatatcaccatatcagtattcatctaactgccctttcagccaaaaaaaaaaaaacccgctcgtttcattgagattttccaatacatttggactcatccatatcagtattcgtcaaattaactatgctttcaccaaaaaaaagtcccaagtagtttcgatctgaccactaaaaacgccacacgaactaccaaaaaagtcccaactagtttcaatctgaccactaaaaacgccacacaaacttagttgggtgaggctaatagatcgaagcaattagaatgcgaaatcctaaagcgaatcctgattaacaactggggctaagttcagtagtagtaggtacatacgacgatgcgcggcgagtgacgagacgatggccggtcgggtggatcacgcctgcttgctcatcatggccttgaactcgtcgaaggagatgaccccgtcgccgtcgctgtccacggccgcgacgatctccgcgcactgctcagccgtcagatccatcccgtcgaggttcagcctacgcagcgcgcggcgcagctcctccgccgtgatcacaccgttcccgtcctcgtcgtactcgtcgaacgcggcgcgcagcgcgtccaatcccccgccctccatcaccgcgcggagctcctcgatgctgacgaacccgtccccgtccctgtccgcggcggcgaccatctcctcggcctcgtccaccgagcacccgtagaactccctcatctccgcggccgagatgaggccgtcgccgtcggtgtcgaagcagcggaagacgcggatcagctccggctcggcctcccgctccaaggacaacggggactgggagggatccaggacagccgggggcggcgagcggctgcggctgcggcggaggcgaccacatgaggcggcggcggaaacgacgagacccatggcgagacagatggtgcggcgcgcgtttccgttttgatcggtgtgtaggtttgggggtttggggctctcgggcgatggggttggttttggtcctcttttatttagcgcttgagtcgcttgaccagagatggtcttcaacggggcccacaaaacttgccgctgtgtgtttggctggcgacaagggtagtgccaatctgtgccatgctaatattttggaagtttgaaatatcattttggtagtatttggattgtgactaatttttacatagctaataataaatctactctatcaaatttagtagtgccaaaacttagtaccaatattttggtagggcctcaaaccaaatctagattacggccagcttgaaactggtaaatcgaccacaaacattgttgaagcgaatgatattggctaagagtgggtgacataagtagatagaaattactatatcaaatttgcgttgaggtgaaggagatataagataaaagagaaaaatatggtctataaatttcaaccgtatcacggactcgtgggttagatattaataatttagtatatatatccataacaaacagttgtatgagtatatctataccgagctattatataactagactataagattgacaaaatatgttaattattacatttggtacgtattaactataccaccgatcttaataactcttaaggctctcttagtttcatatgtggtatgctattgttgccatcaacgaatagagctttacattaaatgtgaagagcttttttttttaaaaaaaatgtgaagtaacatatatccacccgatgtacgaccagggagacgggtgatgcgatggtgctggcgtggtcgccactcgcactatcatgactgcttctaggaagaggtgtggagtgttaggtggaatagttggttgccatgcagcccgaccaagccaatgactcccttgcacgtccttttacttgaggccgacaaagtggacaccacaaacatccgcaagtacaccggttgccttttccatatcccatacgtgcgcggaggacgtgcaacacgcctccaactcagctggcttgaaaaggggcctatgtggactcaagaattgggttcacttgtcaataaggtacaagaataatcatacctaacccttgtgcataagaattcatttgtaaggagatggccaatgtggtatctccatgaactgtgagggtaatagcaatgtttaaggtcttagaggaaataagttaggtcccaccataccctatgtttatgacgacaatgtttaaggtaagaatagatgttaagatgggtcccgcgtttatgtaaacaaattttacattaaggtgggtcccaccataccataatctattctcatcctctttagtgtgcatatgtgatttatctcattattttattttttaaggttgagccataaacttatggctatttttagcatttaatgtctcatggctaatgctcataatgtatatggctagtcataagatcttatggctcattattatggcacattgtggatgccctaagaagagaggcatgaccacgtagaaaggggaccccagatctaaaccaagaaaaaaaagaataaggaaaagcaactcttaactcttgactactaccacaaatccaaaaaaggaacaccacactagggtgttatttatgcttctcagttacctaaaccaatataatttctttgctctcgcttgcatttacaccatgattactcctaatcatgaactcctgtttcttgggctgaacttagctgcgacgagagggggtggggtggggtcatccatttctcgctagagtagttcaatttccaacaacggcactcctccgccctattcgatcccctcctcaccccgccgttctacgtctaaagtgtaaggataatttgtattttcccgacaaggcccccgcgtcgcctcctcgtgagggcggcacgggcggcgacaacccgagacgccgtcgcaacccagcgccgtcgccccctacctcgccgccgcccgaacgaggtgccggcaaagccagcggctcgcgaggacggcagcggcggggttcacaactcccgtttctccagatccagcgcgggaagatctcgagacggaggttggcggcaccgtttcggcagcgggtggagacggcggcttgcgaccgagagcaggcgacggggtgggtggaggtagtgagaagcccggctggcgacggggcggaggagacggcgctggtggctgtggcgccagcgccggtcggcgtgtagcccgacaggcaacggagagggggagacgacggtggcggggtagaggaggcgggggcagcgacgggacgttggaggaggtgttgcgctgtggcttccccctagccacgctggcggtggaggaagaggccggcaaatccgcgccttgatctggcgggcaggcatccggcggcgccccggtggttgactagcggcggcggcggctgcatctgtggatgcggtggccggcgtcggggcaagttgcgggcgtcgatggctgcggctggcggtggagggagcgtcggcgcggcggcgctggaggccgtgatggccgtggaggggcaggaggccacgccctcggcggagggcggcatgcggggggccggcgtggtggaggcgcggctggcggctcgaccaagagcccgtctttgccattgtttacgaggtatggtacttgcgagtcattatgcgagaccttctatggccgtcgatggggtgcttgtgtgggtgatatgaagacgctggcgaaagccttgccgtgcctttggccggtttgacgacgacgcccgtaggcgccgtttcccttcttggaggtgttgtcgtggcgtttttcttctatatcgcccacaaatatctaggtaaaaaccttgttccggtttcggacgagcggcgccgatgttatgcatcatgtcctccttggcggcatcgcttcagagaagttcctatgaatcgatgactgttgatggtctttctcggtcaaaagctttcataccttggtgttcggcgaggcctttgtcttcttgagtccacttagttcttgtggtgggcaacacgctcttcggttgtttctactgatgaagtcggagctgctcgttgatggggtgcggcgatgctcgacaacgatgacatgctgcagtctcttctatggagttggtgctagccgtgtgaaggaagtggctccttggtggcttggctgatgtccatcgttagatatcggagctgtttttcgctttggcgactttcgtggcttagtgtcactgcggttgtgaagtcggcgctgctagattgcttgcgcgattagctcggcaacgataacacctcttctgcgatgtcgaagccgttgagtcgcttttgtgattagcttggcagcgatgtcctgcggttgggctccgccgtcgttgttagttttgtagctaggtcccttgctcttctctgcgtggtgggttttagccagtttcccacaattaaccgtgcaattgtttgtttttcgggtccggttttccttataaagtgggtcaattctcttcttcttcaatacaaagacaccttgcgtggtttcaaattttttttcccaacgacgacaatctaaacatgtatcaaatatcaacctcatcgtaatacgacttattagagattgcaaaaataattttaagagtatttttttatatactccctccgtttcaaaatgtttgacaccgttgactttttaatacgtgtttgaccattcatcttattcaaaaaatttaagtaattattaattctttttatatcatttgattcattgttaaatatactttcatgtacatatatagttttacatatttcacaaatttttttaataagacgaacagtcaaacatgtgctaaaaagtcaacggtgtcaaatattttgaaacggagggagtatttgttattagatatttaaaaacaaatgttggaaaaaataattacgttgaaaaaccccaaaattaagtcttaaattcagttttagaatttaaatttacgattttgcttttatgcggaaggcggaacgatagggtgttatcaaacttaccatgttttggttttgctaaaatttagatgagttcattttggcatcaaattaattacacttttagtgcaaggagagacgcgaatgacttgttctatgacagtgctagtagtgtgccgaaggacgatgatatccacatgacgatcatcagcaaccaagccctgatttcgacgattctgtacacgcatttgaaactggaaactcgaaatcgtatgactaggcagaaaacaagaccaatctatcaagtagaaaaacaatatctcctctctctctctctctctctctctctctaaaaaaagcaatatctcttgatcgatcgattcgagtttgcatatctatttcgttgaaaattccccatgcatttgggatcatgcatatcatcagtattcacgtaactaattaccctttcaccaaaagaactgtccgtcttcgttgaaattttccaatacacatttggagtcatccatatcagtattcgtccgattaactacggttgcaccaaaaaggtcccaactagtttcgatgttcgatctaaccactgaaaacgccacacaaacgaatcctggttaaattggggataagttcagcagtagcaggtacatacgccgatgcgcggcgagtgacgagacgatggccgatcgggtggatcacgcccgcttgtccatcatggacttgaactcgtcgaaggggatgacgccgtctccgcgtacttggccatcatggccttgaactcgtcgaaggagatgacaccgtcgccgtcgctgtccgtggccgcgacgatctccgcgtactcctcggccgtcagatccaccccgccgagcctatgcatcgcgcgccgcagctcctccgccgtgaccacaccgtccccgtcctcgtcgtactagttgaacaccgcctgcagcgcctccgaatccccgtcctccatcactgcgcggagctcctcgatgctgtcctcgtcgtactcgtcgaacaccgcatgcagcgcctccgaatccccgtcctccatcaccgcgcggagctcctcgatgctgaggaacccgtccccgttctgcctatccgccgcggcgaccgtctccttggccttcccgcacccgtagaattcccttatctccgcggccgagaggtgtcgtccgtcgccgtcggtgtcaaagcagcggaagacgcggccgcgctccggctcggtctcccatttccagaacgatggatgaacatccagcctatccgagggcggtggcggcgacaggctacggctacggctacggctgcggcagaggcaaccgcaggagaggacgagacccatggcgagacggatcgtgcgccgcgcgtttccgtaatgatcagtgcgtgggggttttgggggctcttggccgatcggccattggcttcagggtttaggtgctctttaacggttttcctataaatttgtttaacagattttatcctcaaaatcacacgatttttttgggttaaccacgtcatgacgtcacaaccagattatgtgaaaaaaattgataatttaacacttttttcgttgttcaattgctctaatggacacttgtgagaatgacatgtgtgaccatataagcgaatgtaagtgggccatgatgtcaaataataaaaatccattttaaggagtgttaaattatcaaatctctatattatgggtatgtttggagagcttgaaattttgagaaacagttgattggtagctagcttttaaaaatttgtttatggcttctaatttatttttagattatacaactacagatcctcgtaatctgaacaagaagctagatggtgtcgtttgtttcccagatttgtactacatgttttaaccgtacaatgtgcattgagatccgtgctatgtataagtcgcgggtacgctttttaattaaaccagggcactatgtatttaggtgaacaaatttatcatgtaatctactccctccgtttcataatataagagatttagggtgtatatgacactcatattaatataaatctagataggatatgtcacatgacacatcaactaaaaatctcatctcttatattatgggacggagggagtatatagtttgtcggtgacatgggaccgggagtatcatgaatagaggcttgagacagacacaatcgcccacgtggcctggcaccctcggggggcgtcgggcccgagggtgatgtgttcgccctcttctttgtctccccaagggggtcggaccgctcccgcctcggccccgagggccgaggcgccccgacccctcgtgggttttcgctccgcgtgtatgggttaggtgggcacagtggggctcacctaaccacatttattgcggtttggctgagcgtgtcacgccgcatgtaacgcggtgcagtgcactcatttatccggtctgtgaccagtcacagaccggtcagatcgcgggttaggtggcgacaggcgatctgacgcacgcctcgccccatcccgtcaggacgagggcttctaggcactcgtccccagctggagctagcgtgttacctcccagagatggcacgttagtcctggtcagatatatgccaggcttcatcctaaccattacaggcaaaatgttgtgtgaagaagggccaacgtgcagattgctaagctgacgcgtggtggacaagaatgaccgatttgtgaccagtctgacaccggtcatgtcgtcagcagacagccatgattccgcgtcgcgcctgttcccggcgaaagtggaggtaggtgcgggccgtcccatcagaaggtgactcgaacggcaaccatgcaaatctccgtccatttatgaaaaggtagggtaagtccccacagagagggggggatggtgcatgtggtatccccttaagatataaaaggaggaccttgcccactgagagagggggagttttttcttggactggacttttccagattaggaacccagaacaagggagaggctggctcatactttgtagctccttcacacacgaatccaccaaaacacgggagtagggtattacgcttctaagcggcccgaacctgtatacatcgccggcgtcttctgtgcttcctatctcgcgaaccttccacacacagattgggagcttagagtctcacccagggtccccggccgaaccggcaaaggggggccagcgcggtctcccggtgaggagccccacgctccgacatctggcgcgccaggtaggggactctgcgagtgatcttctgagctcttgcactctttcgtgtgcgccaagcttttcctgttcagcctcatggctgagcaagcaaaggcgcacaacctctctccgagtgtgagtggcgacgacggggagccgaacccacgccgtcgagctcgtactccaccgccccctccacgccaaagtcctaagcagggggaggcgctcgagagggccgaaggatccgcgacttcgacatccacaggaggtggaaaggggcggcgagatggggagcatcgcctcctcgtctatggtgacggcagcacgccccagggcgcgctccaagctgcgggcgcgctcctacgtcacccgcccgtcgcccatgacccggagtctccagcccaacgctggctggacgatgtggccaaattggtcatgactgcacggcagtgtatagatgctggtgggcggtcctccgccaccaaggcctctggtgctgctaccaccggctccgcgtcgtcaagacgaagggcgcggcgagcggcagccgccgttcgccattcggccaccactccttcgtcgactccttcggcccggaaagatctgcgagggaggccggacgcccgcaccagcatcgagcggcggcgtaatgaccgacgtgctacccacgcaacggagggcgcttcctcgtccagagtgtcacctcagcacagacgcgggaatcagccctccgtgcccccggttggtggtgtcggctgtagagcctttgtggcgagtcttcggaatgtccgttggcccccaaggttccggcccaccatcgccgaaaaatatgatggcagcgtcaaccccgccgagtttctccaggtcttcacgaccgggattgaggccgccgggggtgacgacagggtcatggcgaatttctttcccatggccctgaaggggcaggcgcggggttggctaatgaacttgccacccgcgtcagtccactcctgggaggatttgtgccaacagttcaccatgaactttcagggcacatatccgcgcccaggtgaagaagcggacttacacgcagtacagcgaagggatgatgagtcacttcgctcgtatattcagcggttctgtcaagtccgcaacaccataccatgcatccctgcacacgcggtaatctacgcgttcaggggaggcgtgcggcacaaccgcatgctcaaaaagatcgcctctaaggagccccagactaccgcggagctttttcagctcgcggaccgagtggctcgcaaggaggaggcatggacctggaacccctccggttccggtgtggcagcttcggccgcccccggatccgccgctcagacagggcggcgtgacaggaggaggaagaagaggtcagcccataccgacgacgagggtcatgtcctcgccgtcgagggcgctccgcgggccacccgaaaggggaggcctgcgagcgacaaaaagaaggaagccgacgctccctgacctcggctacttggaagagcgaaggcggcgcgcggcccttcgagccgcgcgctaccagcagagcctgcggcgctaccatcagcgccacgtccgggcccgatcactctgcgtcgacgacctcgtcctacgccgtgtccaaacgcgtgctggactgagcaaactctcaccaatgtgggcgggtccgtatcgagtgatcggcgtcccccggccgggctccgttcggctggccacgggcgacggcacagagctgcctaacccgtggaacatcgaacaccttcgtcgcttctacccctagtgggggttgggtgtcaggtcttgggctcgggccaactccgcacccccccggcgtgcagggttggccgggggcttatcttttttctcttccgtatttcaataaaagcattttcgatttcctaaaggctgtgtctgtgcttttgtttccttttgaagaatcttgacttgaaataggtcactcgtgctcaatcctaccctcgggggctcgggtcggctaaaatcgccaaaaggggcccagaaccgagccgtgccccgggacgtggtgaactccgggggggaatcggcaaaaacccacaatcgggtcacccataaccctcggtcaccacgctcccggcctggccagtctcgacatgtggatctccccaggcactagccttgacccgcgccgtttgaggctgggacctgggcacgagcccttgttcaagccaagacacagaaggaccgtggcacagaccatcctcgtctcatacacagaacaaatgaaattgacacaaaaatttcctctttatttgatcgcagattaaatcagcctataacaagaagggggcccgaaggcctcggaagaagaaggaaaagctattaagattggcggaggcctgggggctcactccgacgcgcccgggtagccggcctcgccgtcgctgttgtccgcaccgtcgtcaccgcactcctcgtcggagttgaaggcaaacgcgagccgaggggccgctcattattgtcggtcggttttcccttgctgatgcgcgcgatttgcgaccgccgggattctgcccgaagagagagagagagcagggaggagaggcccccgagccgaacggtggcccaaggcccccgacgaccggagcaggccctctgcccgcttgtcagacggtgccaggtgcccccgacccccaggatggccccgaggccactgcgggaaggccgcgcctgtcgccctctgaccccgaggtcgtcggcacagaagccgagtgcgccccgcgtggcctctcggatggagagcgccctggagatgtggcccctgacgaagaagatcggccccgccgaaaggtgcagcggcccgtctacttcgttagcgaggccctccgggacgctgagacccgataccttcaggcccagaagatgctttacgctatcctgataacttcgaggaagttacgccattatttccaggcgcatcgggtcacggtggttacgtcttatcccctcggccaaatcttgtataaccgagagggtactggacgggtggtgaaatgggcaatcgaactctctgaattcgatttgcgctttgaaccaagccacgcgatcaagagccaggccctcgccgactttgtggcggagtggaccccagctcccgagctcgtctccgcccccgaggccagctcgagcccatcgcagctgcctcacaccgccctctgggtgatgtagttcgacggcacctgtaggaaccggccccacctgtcaccaggccttagaagtggcgtcacgcccgaccgcttccctcggggagggcgatcgccctggcataacgccgggggctactgtcggtgacatgggaccgggagtatcatgaatagaggcttgagacagacacaatcgcccacgtggcctggcaccctcggggggcgtcgggcccgagggtgatgtgttcgccctcttctttgtctccccgagggggtcggaccgctcccgcctcggccccgagggccgaggcgccccgacccctcgtgggttttcgctccgcgtgtatgggttaggtgggcacagtggggctcacctaaccacatttattgcggtttggctgagcgtgtcacgccgcatgtaacgcggtgcagtgcactcatttatcccgtctgtgaccagtcacagaccgggcatatcgcgggttaggtggcgacaaggcgat

SEQ ID NO: 67998 - DNA, 1148 bp, Oryza sativa
aacgtgccatctccaggagctaacacgccggttccggctagggacgagtgcttggaggctctcgtcctgacgggatggggcaaggcgtgcgtcagaccgcctgtcgccacctaacccacgatctgaccggtctgtgaccggtcacagaccgaataaacgagcgcgctgcactgcgttacatgcggcgtgacgcgctcgtccaaaccgtaataaatgtggttaggtgagccccgctatgctcacctaccccatatacgcggcgcaaaacccacaaggggtcggggcgcctcggccctcggggccgaggcggtagcggtccgacccctcggggagacaaagagaagggcggccgtatcaccctcgggcccgacccccccgagggggttaggccacgtgggcgatcgtgtctgcctcaagtctctaagtcatgatactcctggtcccatgtcaccgacagtagcccccggcgttatgccagggcgatcgccctcctcgagggaagcggtcgggcgtgacgccacttcctaaggcctggtgacaggtggggccggtctaaaaatcgggacaagccggttcgtttttcctggagatatgatgatggcgcttcggtcggcgagcgtaattaacgcgcgcacgagatgttccatctagactgccacagccgcatatccacctcatgcaccgcaaacgggcgaatgggattagtggaagcgtgggcgcgagaaacgagggggcaagatagtgggcgcgagaaacgaggagccgggcacagcgttggcaagggtataaagtcgccgaggaagagatttgcttccttcctctcactattattccccttgtcttcgccgcttgcgccctaactccttgtttcctgtgccctaccttcgccacacgcgctcgctctcaaacatctcttcttccggcgtcatggcacggggctccgctccgcttgatggtagcgtgctgccgccttcccgcatcgtgagcgagagacaggccgagctgccgcgccgcttcatgccggaatctgccaccggccgggagatagtctcgctgggcgagggatgcccggcgccacgctacccggggcggtccgtcttcttcctcccttttgctatggcagggctggttccgccattttcttcttt

SEQ ID NO: 67999 - DNA, 9444 bp, Oryza sativa
agttggaaaatgcagatatttgtttaaaagtgacttcaaaatactgtatatctgtatgttgtaaggtgtaacatataccttcccatctttcattgtttaccctcaatacaagagatgcaaaagtaggtgtgttggagtcatctggtaccgtagagtcatccttgtagccatcatattgcccaaggaccacctcatcatgctttataggtgtcactgactgaagaacctgacattgtggtataaaaacgcagaaggaagtattgtaagcaacgaaggatgacaaaaaaaaaaaaaaagatccatacaggtttcctactttcagttagagtagaattgtataaggagaagcaaaaaccttgactttttcatctcttatgtgctcaggcttaagagagacaggcttttccatagccaccaaacagaagacctgcagacaagagcgaaatcaatacagaaagggggcctcaagtcgtgaaagtggaaacagcaatattctcttttgaggaattataatgcatgacaggttgctgctctgcctcctcgtggtataacataagaatggtgatggaataaagcaccaatcattctgaatggtcaagtaaaatgttcagcagtccccacagaccacagtaagcaaatgctaatgtagattcacattgggaagtgaaagtgcacataaaactcccctagaaaaggcaagtgcatggaaaactatgctgcataccaaaaataaatatatttacctgcaacaaatggttctgaatgatatcacgaatgatgctgcagcaacaaaagcgaggtcaaatatttacatcagcgaagacgaataacgatgcacgggaggtcctctaggtgattatttgtctcataacataaacaccataatgcagttgatttattttaaatctagcaaatactgtattatcataaaaactaaagaagtttaatgcctagaagaaaataataaaatgcaatttgtatatttctaatggacaactgtacacgatcgaatgacttcatgtgaactatgggaaccataaaccatttacaatatatcaaagtgattttacacttttatagtatatccacagtcacaagcatatgtgcttacaacaaaatactttcagtaaaaggaactttcatgcaaaataaagttactcccaacatacccatattgatcaaagtaccctccacgtccttcagtcccaaagtcctctctgaatacaatctgcagcatatatttattatgttcaagcacatgttgttcgcaccatgataatgataaaactttccagaatttccaaaactaatccattcaactttataccaataacagaggatgtcatagatgtaactacagttgacaaataaaaatacaaaggactacatagaaaagcatattacctgtacattagcaatgttatcacgattccaaagaggtaggaacaaacggtttgcaaagcgaagcacaagctgaaatatattgaaatatgttatagtagcatggaatatatcgttcaactaactagacgaagccatacaacttaccagattttggaccaattcttttcctaaatagtggtcaattctgtacagctgttgttcattaaacagctctccaagctgggcactgagttcctctgcagactccaagtccttcccaaagggcttttcaacaataacccttgtccagccagaatgagaagctgaaagcacaatatgacagttacagaaggtgactagcataaaagaaatgaaactacaacatagtatagcacaacttctaaaaatcaaacttaaaaataattaatttgatttttaatttactatgaaccaacacatgactcaattaataactaagagcaaattcattgcacccaaattgcttccagaaaaccaaaactttatgtttcaaaagtcccaatgaaaaagcaatgtcaggaaaagagtcggcgactgctaggaattggtatgcttagaaagttgaaatagtagcaaagttccacaagcaaatacttagttaaataaagaggacaaaaggaaaatagtacaaacaagagtggatacaaccaaatatatttcctatatttgaaactctgttgtggataacttcactacaccaaaggaagtgcagcagctttcaaaatccgtaaaaaaggggaagtactcacatggattcatgcagtatgatcttatcattttgcatactgaggggtagactgatggaggcaatgccaaataaaatagtctacgtgagcttcctggtttgttgttcttcgaagtttcattctctgaaatggcgttatttaatgatgcaaatccttccccgctattgtaggaaccactaacatatttaatctgcaaagaaaattcaacgtgttacgaaatctaaatgcaaagaagctattcatgatatcagtgacttactaattgcaaaaattgtgaaatatgttcatctgaagctcctttgaggtatctgcgataacaggagaatgctatttaggcactagtatatcatcagacttaaaaacagagaaactacttcctcatacagaacatcccaatttatttttacatgaaattcttaaattattttatggtaaatgttggtgctaatatgtatctttcttacccacgaatgcgttctcttaatccatcatccgaaatatttgatcttgcatacccaaatatatggacttctccagattgtagaaatccctatcaacaccaaaggttacagttcagaactttgtacgtgtgtcaacctgacaaaacattatgtacatggcatgcaatagcaatatagcattataaagtgctgcagtagaatttctgagcaattataactcatcacgaatgcatcaattttatttctttttcactacaactctttcagaagtttgacaactatggaagaagctagtataccaaactatgtaagaagctactagttacaatcaaattacctgctgaaagaggtgaaacagcgctgggaatgttttcttcttagcaaggtctccagaagcacctaggaccacaatggacaagcaaccagactctgaagaccttctaggtccttcaaacctgacaaagaactgaagctagcccgccctgatgaaggggaagaatcaccagatcctcctgacatgatgaactgtatggtctcttcctttggagacaaaacctaagaatgtaaaaaaaagtactgttagtctcaatatgaggtattcacaaataacttataatctatccaaaactttaatctatgctaatatgaacaaaaaggtctattggttgaatgatggattcttgaactgaatcacctgtcagtacctaacagccaatttgcaacagagtgtaaatcaaaatgaatgtttgcttcagaaaaaaaaaatcaaaatgaatgggattaaagttggtttcatgaaatcagtactaaactactaatatagctaccctgaacttacatcagcgaactactcccattgtttgccaacttatagtcaaagttctcataaaacacaaacaggtactgtagttatgctagtcaaatgcttctatgagattctaatacagaaaaaaaaaagtatctacaagactacaaatgtaaatcaattgaactcggtgcccctacattttgtacgggtaaactggaacacatgcaacaactgaccactgcactcactagaagtctagaacacacaacagcccaaccacccaataatcccgaaataaactagaactgcaacttgcaaagcaaattctgttccgagagcttcaaatgattaaaacgaacctatacagcaagcgcatcagggcgccaggaaatcgaggagcacacgcagaataaacacagagatcatgaacacaaacacggcgcacagaacagaggaatttgcctgcgaaggctgcgatgagatcctaaggccgcagcgtagcacaatcccttccacggcaaatgaaatcaccaatggaaaaaccgatcgcgcagaactttgctacggaaccgatcaaccaccaaagaggaatctaagcagtgtggatgaggaggaggagggagactaaccagcagtggcgacgagatttgacttcccgaggtggaagaagaagacgacgacggcgaattgggcaatggatggtgatcttttccgggtgcgatttatagggggatcttcctcactcacacccgctttccatccacccctccactctcctcccccgccgcttttatactcgcggacgactcgtctctcgtcggcgttgttctcagctttgacccgcgcttagccgcctctctgctttgccacacgcccacacccaccaaccctgctcgcttactgttaccctaccaacatagtataaatcaccaatcttataagttattttttttaaaaaaaatagcgtcaatccgattgattgaactactaatataatccatccgtttcacaatgtggagagtgctagaatgacttacattgtgaaacggaggaagtatataaaaaatgtgaaccgtgaagcgtaacgctgtggtagaaccaagtcaggttcaagctctatatttactcccttcggattgataatacttgtcgttttagaccagggtgagatcaaatcttttattatgaatcatttttaaaatatttatctttcaaatatggctactatatgtataaattagtcttaaaaagtagtttaataaaattatatatttgttaatatttttatacacattataatgaaaaataatggtcaaaattatttttttaagactatgcctttgtccaaaacgataaatattatccggagtaacatggatgctcgtatttatcaatactgactttatcaatttgtaatgtatttttgtcaaggactacgtggcaacttcatcaatatatactgtgtttcaaataaaatatgaatgaaccggtagaaatagtttatcattaacatttaatatttgtatcacttgttttagcgatagaaatagtgcatcagtaacatttactcgctttatataagttaatagaaaataaaactacgacaaataaaaaatcctaaaatgaactctataaatttcaaattttatatttttgctgaagctgatatactgagatttacactcccgtcccgtaaaaaaaatatacttagatacatagttagaagttgaacatccataactaaatattgtttttttttctatggattgaagggagttgaagatgcaggcgataagtctgagatgagaccaaagcaatctgtggaatgccgatggattgtagttttttctatggattgtagttttcccgagtatcctcactctggtactctagtactctacgtggccgtgtttagttgtaatttttttcttcaaactttaaactttttcatcacatggtttaaatttcaaccaaatttttaatttttgtgtgaattaaacacacctagtgttggtgacaaagtttttcactttttccaacccatgaggccatgacatgacatcaaccaaatggcgccgcaaatcgagcatcgtctggaaaatcaattcacgagtcgaacggcgcggccggtggtatatctatcatccccatctctttgttctttttttttttctgtttcgatgatttaacaatggtcatcagcgacgtcacaaaatacgctaaaaagcaccacgttttaatcctcttgtggatattatgggtaccccatacccatacggcatggttatccgactagtcataggggataacttatatctatggaatatgtaatagatcatgactcgggtattacgtttccttatatattacggaacggcctaaagtcctggtttgataatattgtaaagtagatttaggaaaccgataccgtattggttaaggtttctatcttgtaatcctgccccccaccctatataaggtgggcaggaggccctctagggggcatgatgacacaaactagatcgtcagatctataatacacccggcggattcaaatccccaaacaggagtagggtattacctctcattgagagggcctgaacctgtctaaatcctttgtctccgcatccatccacttttaggtctcgtgcgctacccccttttattattgccgaattcatgtttcgacagttggcgcgccaggtaggggttgcgtcgagtttcccatcaacaagcgcgatggaatcaatttcatgggtcgccgacttcgttttcgctttgggagttttcacttcctttccgtcgaccacttcttcaacctcctcttctctgacttgatccaaatcagtcagggggaaactcaatctgatttttatcattgtttatcatattgatttttaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccgtcggccaccaccgttgatgggcatcgtcatctacgccgccggtctgcctccgtcgccgccgactggtgtccccgcctatacggtcggttggtcacaccaccgttgatgggcatcgtcatctacaccgccggcctgcctccgtcgccgccgactggtgtcctcgcctatacggtcggttggtcacaccaccgttgatgggcatcgtcatctacaccgccggcctgcctccgtcgccgccgactggtgtccccgcctatacggtcggttggtcacaccaccgttcatgggcgtccacgacttcaccgccggcctgcctccgtcgccgcagactggtgcctccgcctacacggctggcctattatgccgccgctgttgggcgtctacgacttcaccgccggcctgcctccgtcgccgccgactggtgtcctggcctatacggttggttggtcacaccaccgttcatgggcgtctacgacttcaccgccggctcgcctccgttgccgccgagtggtgcctccgcctacacggtggtctattatgccgccgctgttgggcgtccacgacttcaccgccggcctgcctccgttgccgccgagtggtgcctccgcctacacggctggtctattatgccgctgctgttgggcgtccacgacttcaccgccggcctgcctccgttgccgccgagtggtgcctccgcctacacggctggtctattatgccgccgctgttgggcgtccacgacttcaccgccggcctgcctccgttgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgaccggccgcctcgtccgccgccgactggtgtctctgcctgcacggctggcctattatgccgccgctgttgggcgtctacgacttcatcgccggcctgcctccgtcgccgccgagtggtgcctccgcctacacggctggcctattatgctgccgttgttggatgcctacatcctcaccgttggctcaccttcgttgccgtcgactggtgtttccgcttacacggctgacctattatgccgccattagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggtgctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagataagataatttattttctgctcttaataattgcaaaagtacccgaatagtaaactccgatccgtgaaactttgttccattaatgacgaactcatgtcactcatatgcatgtttgggaagtgcttaggccgactcccagtgcttggtggctatgactagtcgggcagagtgtttaaacgtaatgagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccaccggctcgcctcgaccgccgccgactggtgtttccgcctgcacggctggcctttatgccgccgttgttgggcgtctacgtcttcaccgaccggcttgccttcgccgccgccgactggtgtttccgcttgcacggctggcctattatgccgccgttgttgggcgcctacgtcttcaccgaccggcttgccttcgtcgccgccgaccgatgtcctcgcctgcacggctggcctttatgccgccgttgttgggcgtctacgtcttcaccgaccggcttgccttcgccgccgccgactggtgtttccgcctgcacggctggcctattatgccgccgttgttgggcgtctacgtcttcaccgaccggcttgccttcgccgccgccgactggtgtccccgcctgcacggctggcctttatgccgccgttgttgggcgtctacgtcttcaccgaccggcttgccttcgccgccgccgactggtgtttccgcctgcacggctggcctattatgccgccgttgttgggcgtctacgtcttcaccgaccggcttgccttcgccgccgccgactggtgtccccgcctgcacggctggcctttatgccgccgttgttgggcgtctacgtcttcaccgaccggcttgccttcgccgccgccgactggtgtttccgcttgcacggctggcctttatgccgccgttgttgggcgtctacgtcttcaccgaccggcttgccttcgccgccgccgatggtgtcccgctgcacggtggcatttatgccgccgttgtttgggcgttctacgtttttcacggaccgggcttgcctttgccgccacagatgggctcttcggttggcagggctggcatttatcccgccgttgttgggcgtctacgtcttcaccgaccggcttg

SEQ ID NO: 68000 - DNA, 677 bp, Oryza sativa
  unsure (1)..(677): unsure at all n locations
atgatatgaaaagaattaataattacttaaattttttaaatgggtaccgagctctgatgaatcccctaatgattttggtaaaaatcattaagttaaggtggatacacatcttgtcatatgatcaaatggtttcgcgaaaaatcaataatcagacaacaaaatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgtttccgctttcagagcaatgttcaaaagaaagctcatgaccaatttctagccgaccttgcgagcattctaccgagtaacaccacaccgctcattgtcagngatgcttggctttaagctgccatgtataaatccgtg

SEQ ID NO: 68001 - DNA, 5402 bp, Oryza sativa
ttatgtcatagaatgtaatcacttataggcaaacgcggcaactagattgatgtccattttaccaagcttgagaaatgtgtgaaggtcgttaaaatagataacgagcatcccattaggtccactaatggaagcgttatccgggaccttcatagtaatcatgtcgagtccctttttagatgccttcaagtaccaatcatgtatcaacctcatctcccatggtagattttccatgacatgccatcactggtggagaaaccctttgtagtcccggttcgtaacccccctttagtcccggtttccaaactgggagtaccaatccgggactaaagatcgctatctttagtcctgggtgaaataaccgggagtaaagatcgatctgagccatctttagtcccggttggtgttaccaaccgggactaaagatcgagctgacctttttttttttttcatggccctgttgctgcatggtttatatatatatatatatatatatatatatatatatatatatatatatataaaccatgcatatatatgtttcaatacatatatatatgcatacatatatatatgtatatatatatattatattatattatatgtatatacatgcataatatatatgtatttatacatatatatatatgttatgcaaatgcatatgtatatagatatatatatgaccaaaatatatttacattatagaaaatgtgtacacatgcatatagaaacatatgtagtcatgtattaattacaatccattatatgtcctagctagctacgatttcgacgtagtattagtcgctgctagctcagaagctaaggaccggtgaattgtgtttccgtcttagtagaattcacccttgggatcaaggatttcttcgttgatgaatcccatgagttgtttttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttttctccatttgccgcggaccaaatgacggtaccgataccaagccctacatggagtttaaagctatgattcgtagtagcaattaacataacaagattttcttaattaacaaaggaacttatgacggtacctgtctataagtttgaaaaccttgtcaaacgtagactcttttttatccattgagtcatatacgttgacggtgcaggcctcagggtcgaagagtaaaagcacccagtggaatctgcaatgtgcgtgggatgcattacatatgaaacacttagcaagttcgtacaggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgataaatccagtatcgaaaaccctccgccgtcgggccctttgaatctccattctacaacgataaaagggagtatattattttctatagtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcaactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgtgtgcaatcgtaccccgggtccttgttcttggcggcgtcaactttcgccttcttcgttgcccttgtgtgggcaggcggtggagctggggggcccttgactttgaaggtgccggaagaggagcttgcgggggagtaggtgtaggagcacgaggaggagtcggtgcaggatcctgaggaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgatgccacctttatgttgtgagagattatttattagtaatcaacatatataagcagcaactagcggaatggctaaatcttacctttattgataagttcttcaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctgggatcatgggaccgatgtgcggccatgcgttcatcaaccttccttgccacctcctcttgcatgttgagttcgtagctcgatacccggaactctaggtctgcaatcttcgcctcggtatttctcttgctcctcatccgactcctgtacgtgtggatgtcctccttgaaaccaatcttccaaggaatcacccttttccctcgtgttcgtcctggatgctctggagtctgcagggcgagtgtcagctcgtccctatctatgtctggtcggaacgtgccctgagaggaggcttccactgcatctgttagtcgtcgcgcagcctctcgtatctgatcgccgaagaccagtgagccatcagctgggttgagcgttccaccatgagcatagtaccagaacttcgattgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtatcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccacgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattctagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatctaatattaaaactcaaataatattacatgctaagactaaaatagtcatgtatatgctaagtgtttcgtgcgtatatgctaagtctaattaacactacaatagtcaattgctacttgtcgcaccaattccgtagtcaataattacatactaagtctaattacaaataaagtaatcttatattaaaactcaaataatattacatgctaagactaaaatagtcatgtatgctaagtgtttcgtgcgtatatgctaagtctaattaagactacaatagtcaattgctacttgtcgcaccacttccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagatacaaaaagatgtattaggataaatgcgaagtaacatatatatatatatatatgtatatatatatatatatatgtatatatatatatatatatatatgtatatatatatatatatatatatatatatatattgcatttcacgttaacgttcgtc

SEQ ID NO: 68002 - DNA, 766 bp, Oryza sativa
  unsure (1)..(766): unsure at all n locations
cgccgggaatagaatacttttctgcatgcccgcaggtcgactctagaggatcccctcaaaggattggagttttccaaatcctatacaatttctatggaatagctcattgtatttaggttttggaggagatttagcaaaaggttcgatctcttggaaaaaaaatgctataactatatctttctcatccgattcatacgtttttcatgcggtctaatcaaacgattattcgtgcgtattctctgctttacatttagtcagaatcgtgtgtttttttatttctccaacccgtccatcgtgcgcccctccaacgtcgccggcgccggcggccgatcctgcatgtctcctccgcccgtgccgtgcccgcgcgcgtgcgccttgctcggcctcgctatccatctgggcgcgcgcgtctcctgccacttcacgcaacgggtggatggttttggagttttggccggtgcgaccaccaccaccaccactcctcgtagtgcgcctagcgccgagcggaggaggcgacgactagcctaaacaacaataaagaaaaatcgcgtgtggcctagcagctgcacacctgtagctctagtggagtangcccacaacagggatagagagagagacctgccccttatgcaagcattcaaatcaacctgtacaacctacgagggggggggtccaggatggccggacaaaaccacccccccctggccgggtttttggaggggccacgccccaatttctgccactttccataaagagtttttttttt

SEQ ID NO: 68003 - DNA, 2382 bp, Oryza sativa
  unsure (1)..(2382): unsure at all n locations
ccgtgtgnttacgagatgcaagcatgtgccnnnnnnnnnnnnnnnnnnnnnnnnnnnnnnnnnnnnnnnnnntggtgttatgatttgtgtcagtaaagcttatatggcgttcttacaaaaccttgtatgcattttgttcacagtaatattttattttaattattctttgcttgattcttgtataagatataagattaatgtgcaaaatactgcagcattgcaactgaagattgatactctcatgttatatgtctcaaaaatgcatttaggggccctgataaatagcgtcatatcatgttatgtctagttgactccttttcgtgtttttaccaaagctcttatgtatttaattgatctgtagtgttttgtaattgtattcactttactctttctccatatttgtcaataaagttattgtatatttgtattcatgttattaattttcagcaaaacaaaggtctgctatgggtaacagccttcctgtagaatcaaagttcactgatgaaaaagagaatgacagaattaagtatgttgtgtcgtctatgcaaggatggggtgagaaaatggaagatgctgtgagtaaacttgcagccttttgtatgacaaaaaaaaggatagttctgcaaaaatttcttactgatctgtaagtaattgtgtaaaatactgtgactgacatatgccctctatattctctagcatgcagctattctaaatcttgatgataccatgacgtcattctttggcgtttatgatggccatggaggtttgatcttcattctctctcttttttttttttttttggtttcaaatcctccaaatcgtcggcataactggttacatcatgctttgtttgactttgaatgacatgtgtttatctgcgcgcatgttttgaaaactttactgtttatgctgaaacttttacctgtgaattctcaaataaatattaggctacagttctggataatgaaccaagtttgctaattagtactaatcacctttgtgcggggtgctttctaggataacatgaactgcttaaacagaaatattattttacgagggataaaacactgcatggttgtgagttaatattaacagtcatgataattaaaaggatagccactgatgaacatgttggttaatttatgtgtggtgctatttttcttatgatacctatgaagtgctgatctgctgtgttcatcacattgttttgctttataagcttctatatgcacataggagtaatcttgagccaccattctgagttgtttattttctatctcaggagctgaagtagcatcatattgtgcaaaacgatttcatattgagctttgcaatcatgaagactacgacagcaatctaagtaatgcgatgaggagtgcgttttacaggttattttcgcctagtctatatcattttgttgcactgaatgatgctgcacttgcaaatttggaatatcattgttcctgtgtaatttctgcagcatggatgaggacctgcaactgtccgatgcttggagggagttagttattcctcgtaataatggatggatgtattttatcaaggctggtgtctgtgctaacctttcgcctttcccgcaggtagtgatcctttaacccctaaacatcttataatatccatatgttgaagaagttactcaaaactgtatttgttggacagtgcttattgtatctatgaaaaaggaaatggaagaatgtgtgtgatatcgagactattgttctttcttgagatgtactttggagttggaagagatatgtttaaccctaacctcaactaattgcgcctgtaaaaaaaggtccagttagttacttatcagttgcctggtttggtgagttggacgcctgacaggttattaagttcttattgcaccttggttcttgtcatagtatggcactaccctaaactgaggtattgtttgcggcatctcttctatggttatctctttcatatacactggtttggctttcagaaatgcttttctttgtctggttgcttttgtgagctatttcttggttaacctgtatctctactatgttggaattctctattatgtcctttagtttctttcttctttttccaggcaacatatactgcgccatcatatgaagggagcacagcatgtgtggttgtcatcagaggtgaccaattgattgttgggcatgctggtgattctcgttgtgtactctcaagaaatggtcaggtatagtgactatttccttatcgaatttcttgttggtacctaatttgcatgctcacttattttcgtgcctaacatttgnnnnnnnnnnnnnnnnnnnnnnnnnnnnnnnnnnnnnnnnnnnnnnnnnnnnnngcataaggatattcattcacatgggggggcgc

SEQ ID NO: 68004 - DNA, 766 bp, Oryza sativa
  unsure (1)..(766): unsure at all n locations
tcgggnnnntttgattgcatgtctnaacnnnnnnnnnnnnnnnnnnnnnnnnnnnnnnnnnnnnnnnnnnnnnnnnnnnnnnnnnnnnncaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagccgtttttgctcacggatatcagaccagtcaacaagtacaatgggcatcgtattgcccgaacagataaagctagcatgccaacggtatacagcgagtcgctctttgtggaggtgacgattacctaacaatcggtcgattcgtttgatgttatgtttggtctcgctttggttggcaggttacggccaagttcggtaagagtgagagttttacagtcaagtaaggcgtggcaagcaacgttaagctgttgagtcgttttaagtgtaattccgggcacnaattggtaaagagagtcctgttaaaa

SEQ ID NO: 68005 - DNA, 1236 bp, Oryza sativa
taagttgttcttcaaagatcttaaaaaagttaaacattgtatatttctttactggagcattagcaaatgtgcttaattacctggagaactgctttgatgttgtccatggtgagaggcatgtcgagggcaccttccttctggatcctgaggagcgtgtccaacaggtcctcctccatggcgcaatcatcacgatgcggctgcgcagccatggcgtcccttacctgctcgtgctgccggaaggcgctctcgatcagctcgttccccttccggatgctcgcctccgcgcggcgcgtcatgccgccgacggcggcggcgatcctcgacgacgggaacaggtcgtccaggctgaaccccgtgaagctcctcaccgcctccgtcatcgactccaggaactcctcccgcctctccaacctgtccccgatcaccacgcgcatcgtcgcgtccgccacggccgcggcgaccagcgcgctgacgttcacggcgtcgcggcgggccggtggcgacgacaacgaggcggcgacggccgcggcgaggttggcggcctcctcctcgcgcacgcggcggaacgagcgcacgcgccgggcgctgagcatctccacgacgcacaccttgcggagctgcccccacatggcgccgtagggggcgaacaccacgccctcgcggtgggggcgcagccggcgcacggtgggcggccacggccgcgacgcgaagtcgaggtcgtgcgtgcgcgtcacctcgcgcgcggcgtccgcggacgacgcgacgacgacggggacgccgccgagctggaggcgcatgagcggcgcgtcgtcgaggccgcgcgctaggtccgccatggtgcggtggacgagcggtccccggagcatcagctggtggaggttgccgacgaccggcagccgccacgggcccggcgggaggcgcacgacgtcgcggcgcgcggcgcccagcctgacgaggagcacgagagccaagaaggcgcatgcgcagatgaaccagtacgcgacttgctccatggcgaccaagctgcgcgtttagatggatctgtgagtgcaagatagaattgcaaaagcctaggccttgcaagcgtatatgtagaggtgagagtgtgagatgagttgcatttctacgtgccgacgtagtggctgaccttgctgagagataatagatttaaataaaacccggcctctgtatcccttggatataatgctctatcttggagatactattcggtgaaca

SEQ ID NO: 68006 - DNA, 729 bp, Oryza sativa
  unsure (1)..(729): unsure at all n locations
gcagagtttgatgacttgncgatcgcatgcatncaacgcgaggggaggtgatctcatccgagcctatctatttcatatccaacccttgtgggatgtatgatttgatcatcccaactctctagccttgtagcctcgaggtgatgtttgtgacttcaaaaacccaacccaacctcgttctgctgattagtttcgcagatgtgaacatgatgacgatgatctattgatctagtgtgtgttaaagtaacatttggttggtgttttgcaggacgcagtagttcttctgtctgaatgagcaagattgcactgcactgttcattggtcaatatcagatttgcaattaccatcagattgatcaagtgggagtaaaaaggtggctggcacaccttggatgcttactgctggtggtgaagaatgagaaagagaagggcatacgaggccacattctgccaatggcacctgagctatgcaaaatatgccgctcgtgggcaatgttaggcacacattttgcatcccgcattcctgcctcatcgaatagggcggaacggaagggatagaaatggttggatggatggataataccttgtggcagtcagtgttgatgctgcagcagcagcagccttcctccacttccgccaccggcgccacaagaaaaaaagacgacgacagacgccgacgccgacgcgtgcggcaccagccgacgatcgacgaggtgataccgagccttgtgcg

SEQ ID NO: 68007 - DNA, 4581 bp, Oryza sativa
  unsure (1)..(4581): unsure at all n locations
actcggtgcccctacattttgtacgggtaaactggaacacatgcaacaactgaaccactgcactcactagaagtctagaacacacaacagcccaaccacccaataatcccgaaataaactagaactgcaacttgcaaagcaaactgttccgagagcttaaatgattaaaacgaacctatacagcaagcgcatcagggcgccaggaaatcgaggagcacacgccgaataaacacagagatcatgaaccacaaacacgggcacagaacagaggaatttgcctgcgaaggctgcgatgagatcctaaggccgcagcgtaacacaatcccttccacggcaaatgaaatcagcaatggaaaaaccgatcgcgcagaactctgctacggaaccgatcaaccaccaaagaggaatctaagcagtgtggatgaggaggaggagggagactaaccagcagtggcgacgagatttgacttcccgaggtggaagaagaagacgacgacggcgaattgggcaatggatggtgatcttttccgggtgcgatttatagggggatcttcctcactcacacccgctttccatccacccctccactctcctcccccgccgcttttatactcgcggacgactcgtctctcgtcggcgttgttctcagctttgacccgcgcttagccgcctctctgctttgccacacgcccacacccaccaaccctgctcgcttactgttaccctaccaacatagtataaatcaccaatcttataagttattttttttaaaaaaaatagcgtcaatccgattgattgaactactaatataatccatccgtttcacaatgtggagagtgctagaatgacttacattgtgaaacggaggaagtatataaaaaatgtgaaccgtgaagcgtaacgctgtggtagaaccaagtcaggttcaagctctatatttactcccttcggattgataatacttgtcgttttagaccagggtgagatcaaatcttttattatgaatcatttttaaaatatttatctttcaaatatggctactatatgtataaattagtcttaaaaagtagtttaataaaattatatatttgttaatatttttatacacattataatgaaaaataatggtcaaaattatttttttaagactatgcctttgtccaaaacgataaatattatccggagtaacatggatgctcgtatttatcaatactgactttatcaatttgtaatgtatttttgtcaaggactacgtggcaacttcatcaatatatactgtgtttcaaataaaatatgaatgaaccggtagaaatagtttatcattaacatttaatatttgtatcacttgttttagcgatagaaatagtgcatcagtaacatttactcgctttatataagttaatagaaaataaaactacgacaaataaaaaatcctaaaatgaactctataaatttcaaattttatatttttgctgaagctgatatactgagatttacactcccgtcccgtaaaaaaaatatacttagatacatagttagaagttgaacatccataactaaatattgtttttttttctatggattgaagggagttgaagatgcaggcgataagtctgagatgagaccaaagcaatctgtggaatgccgatggattgtagttttttctatggattgtagttttcccgagtatcctcactctggtactctagtactctacgtggccgtgtttagttgtaatttttttcttcaaactttaaactttttcatcacatggtttaaatttcaaccaaatttttaatttttgtgtgaattaaacacacctagtgttggtgacaaagtttttcactttttccaacccatgaggccatgacatgacatcaaccaaatggcgccgcaaatcgagcatcgtctggaaaatcaattcacgagtcgaacggcgcggccggtggtatatctatcatccccatctctttgttctttttttttttctgtttcgatgatttaacaatggtcatcagcgacgtcacaaaatacgctaaaaagcaccacgttttaatcctcttgtggatattatgggtaccccatacccatacggcatggttatccgactagtcataggggataacttatatctatggaatatgtaatagatcatgactcgggtattacgtttccttatatattacggaacggcctaaagtcctggtttgataatattgtaaagtagatttaggaaaccgataccgtattggttaaggtttctatcttgtaatcctgccccccaccctatataaggtgggcaggaggccctctagggggcatgatgacacaaactagatcgtcagatctataatacacccggcggattcaaatccccaaacaggagtagggtattacctctcattgagagggcctgaacctgtctaaatcctttgtctccgcatccatccacttttaggtctcgtgcgctacccccttttattattgccgaattcatgtttcgacagttggcgcgccaggtaggggttgcgtcgagtttcccatcaacaagcgcgatggaatcaatttcatgggtcgccgacttcgttttcgctttgggagttttcacttcctttccgtcgaccacttcttcaacctcctcttctctgacttgatccaaatcagtcagggggaaactcaatctgatttttatcattgtttatcatattgatttttaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccgtcggccaccaccgttgatgggcatcgtcatctacgccgccggtctgcctccgtcgccgccgactggtgtccccgcctatacggtcggttggtcacaccaccgttgatgggcatcgtcatctacaccgccggcctgcctccgtcgccgccgactggtgtcctcgcctatacggtcggttggtcacaccaccgttgatgggcatcgtcatctacaccgccggcctgcctccgtcgccgccgactggtgtccccgcctatacggtcggttggtcacaccaccgttcatgggcgtccacgacttcaccgccggcctgcctccgtcgccgcagagtggtgcctccgcctacacggctggcctattatgccgccgctgttgggcgtctacgacttcaccgccggcccgcctcgtccgccgccgactggtgtccctgcctgcacggctggcctattatgccgccgctgttgggcgtctacgacttcatcgccggcctgcctccgtcgccgccgagtggtgcctccgcctacacggctggcctattatgctgccgttgttggatgcctacatcctcaccgttggctcaccttcgttgccgtcgactggtgtttccgcttacacggctgacctattatgccgccattagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggtgctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagataagataatttattttctgctcttaataattgcaaaagtacccgaatagtaaactccgatccgtgaaactttgttccattaatgacgaactcatgtcactcatatgcatgtttgggaagtgcttaggccgactcccagtgcttggtggctatgactagtcgggcagagtgtttaaacgtaatgagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccaccggctcgcctcgaccgccgccgactggtgtttccgcctgcacggctggcctttatgccgccgttgttgggcgtctacgtcttcaccgaccggcttgccttcgccgccgccgactggtgtttccgcttgcacggctggcctattatgccgncgttgntgggcgcctacgtcttcaccgaccggcttgccttc

SEQ ID NO: 68008 - DNA, 726 bp, Oryza sativa
  unsure (1)..(726): unsure at all n locations
cttgatttgcattgcnnnnnnnnnnnnnnnnnnnnnnnnnnnnnnnnnnnnnnnnnnnnnnnnnnnnnnnnnnnnnnnnnnnntcagtgttgccactggctgtcgaaaactttgtcatgtgatgcaagcatgagtgttgtaaagacctctcccctgtgtgcagtgccggacattttatgcacaaaggaccatgcgacggttgcccaaattttctctacctggaggggaaatacacaacgccgtcacttgaagaacaacgacccgacttgtagaactcctgcggtatacaaacttagtgtgccaagggtacactaatcatttcaacagatgcatgaataaacaagaggaaattcttaattgccctggcaaacacaagcgctatcaggatagggacaggtcacctgatagagagtaactttaaaaacggccagtgtggggaaggactgcatgccgtcaagttgaattgatatcaacctataagagtataatatcgctttcttccctttctatctttctaggttgaaaggctaacaatcgtcaagatgatcaacttgtgagatagattcatgagatgaaactgnnnnnnnnnnnnnnnnnnnnnnnnnnnnnnnnnnnnnnnnnnnnnnnnnnnnnnnnatggacctcaacgtgatagaggtgtctagacctttaagagctgtatccagcttctttatagtgcactcatgaaacgaacttggacgactc

SEQ ID NO: 68009 - DNA, 1327 bp, Oryza sativa
ctgtgcagcacagaactgaagtggtgtccaaaaccgaaaaaacaaacaaacaaattcgtatcttaatcttaccgaggatcgatgcgagcctcagattgtggctggtgtccggaggttctctgctccaagtgctcgaagaatccaaaggccagccgaaccacagtccgcacgctggaggaagaaggtggataattaggtgagttgggggcatgcgggggattgggtatccccttttcccaaaccctctccctcatttttcacacgcacgctttttaaactgctaaacggtgagttttctgcaaaagtttctatacaaaagttgcttaaaaaaatcaaattaatctatttttaaaaaaaaatagctaatactaaattaattacgtgctaatggatcgtttcgttttctgtgctcactgtccggatggggataaggatgtgcgaacacagcctaaaagtaaaacagaccgaggagaaaaacagggggccttaaaacctagctactgttgggctattggcggtgtggcgtataactctgtatctctagtgagttccaacccacctctctcatttttcgcacgcacatttttcaagtagctaaacagtatttttacacaaattttctatataaagttgtttttaaaaaaatcatattaatccattaaaatagtaaatacttaattaatcataagaaaatatgtcgttccattttacgtgccgaacaactccgtacaccaatctgaagcatagaacattggagacaagtcggagtaataagagaagtatataagaggatatgtggataaaaggagagaggaaataggtgattggatgagaatttaatttgaaagcaccatccattgggttcatagtttctatacataatgtatatatgacacgacaagtatgaaaactacttgatacgttttttaatatgtaacatcattcactttttgagatacgtttgaccattcactattagaaaatgcatttttcccgacgtggggtctgattttcacaggcggatatatcccttgaagccaaatgaccgcctataaaaatataaatcggggtgaagtgcgttgtccgtctgcgaaaatagattttcgcaggcggaccacttaagcgacgcctgcgaaaatgattttcgcaggcagaccacccaaaccgcgcctgcgaaaatcatacctaccccaaaaaattttaagtcttatcttctcctccaccccctccccaccactcatttccctcacttaactctctctccccctcaacactttcccctcccctcccctcccctcccctccctccctataccggcggcgatggc

SEQ ID NO: 68010 - DNA, 728 bp, Oryza sativa
  unsure (1)..(728): unsure at all n locations
ttatttcctaaacacaccctaccaatttattgccaaaattaaatagtatgtgtgttttttggattgaacccaaatattttggtggttcccttatactatttggtcattttctagaagtttcttccctgtactattagaatttgattttatattggtagcaatccaaatggtagccaaataattttaccctaccaatattttggtagtgccaaattttgcntagactttggcactaccaataaattggtagggtagagaaccaaacaagccctaagaaacggaatcagccctaatcaatcatatcttcctttttcgtggggcctctaatcatcttcctttgggatagtggttgagcacgggttatcatgtagtcgagtcaggttaggccaaatcacacgtcgacctttgggtacgtgttgggcctcacttgtgatggattgggccatgctcagtctttacttggcaagtctctcatcgactgcgggggtcgcgataaaccgccataaacggttccgggttttggaccaccaccccccaccgccgccacgcagccggcggccaccaccccatccccgtcgactccaccaccaccacgctagctagctgctgcctggacttggatcagacagagcaagggtagtagtagtagtagtagagatgcggctaatgcttctcgagttccgggtaccaaggtcgaatntcgaatttgcaatgnnaangcgcgcccg

SEQ ID NO: 68011 - DNA, 4163 bp, Oryza sativa
ccacgatctacggcgccacgtagtcctccgtccccacgaacgagttcgacttcgccgccgccgacgagcagcgcgtggacgacgaggaggacgaggccgtcctggacgtggacggcggggaccgggacgacgaggacgacgacggcgacggccgtgacgccgcggcgcggcgcgaggagaagcacccgaagacggccgcggcggccttcgtgctgtcgcgccgcccgccgcgggagcgcgcggtttgtggcggcggagccgtgtcgggcggcggaggaggtggcggcggcgggagcgtggtggagaggtcgaagtcgacgagcatgatgtggccggagtcctggatgaggacgttctccggcttgaggtcgcggtacacgacgccgaggccgtggaggtgctcgagcgcgagcaccagctccgcggcgtagaaccgtatcgcggcgacggagaacaccctcccggcctggcggcgccgcagcgcgttcaggtcgccgccggcgcaccggtcgatggcgaacccgacgacgctgtccgtggccacgacgccgcggagggaggggagcagcgggtggcggagcgcgagcagcacgtcccgctcgaaccagatcctccggtgcccgtcgccgcccggaccgccggcgacctccgcgcacttgtgcctcgccgcggcgcgggagatggccttgagcgccatgggatcctcgtccgccgtcgccgacaccgccgcggcggcgccgccggcgggcacgacgtggaagacgacgcccctggcgccgcggccgagcacggagagggccttgaggtcggcgaggctcagctgcggcggcagcggcagcggcggcagcgaaggcggcatgctcaccatgggcgcgcgatcgcgagaagcgcgcgggaagaagaagcgacgcgaactatattaattatatttggagggtttgaggtttaggtgtgagctaattcgtctgggttggcttcgtttatagcctcaagctaatcaccgtaattaacttcaaatggaagcttatgaagaggcaaagctacaataatccgtgtattaatgcctgagcaatagaagaaaaaaaatcaagttagcaacagcaacatgcaacataactgtagcttccgtctagaaaattcctgaactaattcacgtgtggtgtgaaaggcaggttaatcagatttgatcatgtacagtgagctgtcatcaacaccgaacaggaaagccaacacaaaatagactggagtagtagtaaaccgacgaaataacttagaaaagttcacctaattctcgtgaaaaaggggggaaaaatacagagctctaggctcgccattgtagtggcatatcaatctgaatcccctgaaacgcaactcacgtgcaaagtcctagtactttctttctctgtagctcatcacattcacatcgctagattggattggaaccctatatactgttcatgacagattgcgtgtactaccaaaaaaaagatccagtaaaaacatagatatttcagtggtaagtttgagtgtccatggagcacaatcacaagttgatactctgatgtaatgctgcaccgtatctaagcgcatttcacagcctttgcattgcatcggttgcatccagtgcaatttgctgaattgaggtcaatacacaggaaatattctgctgtttacgtcagtaagtgaggtgtgactggtagcaagaatctgcagggctactgatactttagcaagttgtgataaaaccggtggatgaacagaataagaacctgattccagcatgaaagggagattccacacggtacttgctactcttctgatttctgaatggttaattggcgaccgatgctgattctcaaccttttccagttgaagccccagcagtaggcatgataagaatcagcacactgcaaatagatttagttcagacaaaaagaacacaggaaaaatttgcttcattgtcaccccggttgctctggaagtgtggattaccttgacagctgggagtgacaggaaatagctgttccccctgctgaatgatttcacatgatagaaatggtgaatttatcgtctctacctgtcaaaaaatactcaaaagactacacagttgatatcagtcaccatagtatttagcacactggcaaccacatatgctctgctgaaaactgaaatgagcagcacactaaatacacaataatagcagaaaccagagcagagtgtacaagtagacatttccgcagatgaacgatctgcagtcaaattgccataacactgaacgttgttgaacaagattacaagcatgagaacttatgaactggacagaaattcagaatttataactcgaacttcactcaaacaaggtaaaattaaaagcggataactggatatatacatctcaagttgttcacaactacatgctcccttttgtggctattagaccacctaactgtgtgcatcactgcatccttgatgacaatactccaattatctgaggcagaagcagtccaatcctcagaaacatgacagtattacagcaaccagatgtgtgcattctgtgaacgatgcaaacacaacagaaccgggtctacacatccctagaaaaacaacagtagaacacttggacatggctcattagctattagatcaagatcacacagttcccgtggccagtgatattaaaaatggaggccaactgattttactcaagattagctgcacacttgagtcactgaaacttatcttatttacagcacaacatgatctcctaattcttcctttgatgttaatattccatccttccaggccgaaacacaaagttccttgccttgcgggagcacagcaaagttgccaatgatacatagaagctagtcattgtgctgatacagaatgcacctagggatacccatccgttctctccatgccagccaccaagccaaccatggcgattgcttcctgccattttcccttctggcatcctagaatgcgcactgcatccttccccgctgcatatcccagggtttccagccaatgctcctggaaacttctgcaacccatcagttgtcggcaaaggcccagataggctattgtaggagagattaagcacctcaagctctgtcatggcagctatctcaggaggtaccacccctgacaactcattatgtgagaagtcaagggtccgtagcttccccatccccccaatacctgaaggaatctgcccatccaaataattacaagagagattcaaatactccagtcccttcattgcaaccaacccgtctggtatctccccacggagctcattcctagacagatctatcccggtagctgcttgaagatcatagcccagctccaattgccggcctgccatatccgtggacactgacacaaacagctgaggtggaagcacagcctctgatggactcccctgaccactgcctccaccattaaggacggcactgacattgaacccaccatccgggatgaaacccacaaacctattgccggacaaatcaatccactgaagtgttgggaacgagaacatccaatccggtagctgaccagagagctggttaccagccagtgataagaacctcaagctctgccatttggccacagctccactgagctcccctgtgatcttgtttcctgacaagttcaccacctccagagatcggcacccggccaacggcagcggaatttcaccagatattcggttgttcgacaaatctaacaccttcaaactgtcaagggcatcaagctccggccgcagtgctcctgaaagatgattccccccaagccgcaggtacagaagctggaagcagccggcaaggccagcaggcactacaccagagagcctattacgcgacaaatcaagcgcctgcaagtaggttaaattcccaatcccagtcggaatctccccggagagctggttatccgcaagaaacaatccctgaaggctccggatggcggtgatcccgacggggatctcgccggagaagcgattgtgggagaggtcgaggaggaggaggcccgaagcgtcggggtcggcgacgacccgcggcgggacggcgcccgtgagcgcgttccgcgagaggtcgagcgcggcgaggctcgccgggaaggagaggcgcggggagagcgggaagcgaagcgcgttggcggag

SEQ ID NO: 68012 - DNA, 1813 bp, Oryza sativa
tccctccacctctccggcaccaggctactcccccctccgccgccggcctccgcggccggcttccgcctggggcgcgaggtggtcgatggcgccggagaggggaggtcgacatcgggctcctcgaaggcgtcgtcctcgaacacgacgcagtcgccgatggcgaaatcctcgtcgaattcatcgacggcggcgacggcgaaggaggagggagaggtaacgagcgggcggcgcctggggaggagagatttgctatgtgggtggaggcgaggagaggcggagagcgggtttagggtttggacatgggaagggaaggggaagaggaggaggtggtggtggagggagagggaaggaggcatcgcgtcgtcctcgtcccgccgtgccggaagacgagaggattagccggcgtttaaccggctcgtcagagtgggcctcgccgaaagggctacgtgtagtaacttatttgggccggaaggagcccagtttctctatggatgtgcaagaagcttctaaggcctttccaatccttctcaaattgaagcccataaatgaatgtcgggatacaacgagagaaggctgagacttgagagtactttgtgtgccatcgtgttgctccatatattcattctcaaatagatggcattttaggatgcattcatgcatgcattcgaaataaataatcactaaaatatgataagtatttgatatttcctagtcatattagtaggtttgttattcttaaaacttaatattttatgtggttatatttctaacatttttcataaattaatgcaaggtaaaaaaaataatgatcaaatatgtgtattggtattacctagaaaaaattaagtatatatataacttgttttaatagggtgagtctatccagcgaacgttcactagcacattagccgagcgagcaccttatctctttagatattctccaccagatctgttcgttccctaaagcttccccaaagtaacgtgaagaaagaggcggggaaagatgcaatgtgggagctcattggttcttcgccccttccctctaccccctttgttttctctcctcggcgtgccacacatctcaccagggtaaggtcctctttcacagcacttgttgggggtgtatccttcttcctcctcaccaaccagcaacgcaaaaaagaggttttaattcctttccggcaaggctgacatccccttcctcctcctcgccaaccaagcctatgcctcatcctacacaacatcgacaagatcctttatggatatacctcaccttttttccctcatatctaatttcttgtaagaccagtttcttgcattttttagctaagagttattgatttttggtagaaatatttacatatttaattgatagttggtgattttgagttttggagtttatgtttgaatttgtttgaaatttcatatgcagaatgtttctctgtataaagattatatgtacagagtttgtatgtgtaaagcttgtatacacagaagtttctatgtgcaaagtttcaacatgcgaagtttatatctgtaaagtttattcatgcaaagtttttacgtgcatttttttttagaaaaaaaggacactgaaaggtaggaaacccttcgtgttcatgcatgcttattaaaaatgcaagcttcacatgtcggacagattcaagcatactaccaacaaagggaaacatccacgcttccaccagattcacatgcacaaggggtggatgcaagtcgagccgttaatcacgcgcataagcgctagacagtgctaaatgacagtgcgaattgtggttcgaagtagggctgtcaa

SEQ ID NO: 68013 - DNA, 4919 bp, Oryza sativa
gctacaaattgccgtcattttttaagacctgtcctcttgtagagcaagtaggcctctaagtcgtcctggccttaggataccatgtaagctcacaagacaagccgataaggcaacagaggagagaggagatgcaaggcaataatgagtgaagaaatatatagacaaatggattaagaacaaaacaaataatataactcagattgtggactattagagcaagtgtgctggtggtgtgtactgtgtatattatcttatatctactgagtaataatgtgtaaatgatgtgaacaaaattagagtgactatcatatcacctctactataatcatcgtcgtagtatttagatctgattggaaaaacatggacacaacaccatatatagtacgtattccctctgttcataaatataaaaggttttcgccctctccatttggtcataactgtagatattttagagcactaatgttccatcaatcacctcttactcaaatctttccctattacctcaagttgccaaccattcctcctgtatatctctattctccaaggaccctcctatttcataaggatcatatcttttatatccattgttaatctccctcaagagatcataaatataactcgaatagttattatttttatatttttatatttttatattagtgaatatagatctatatgtgctttatatatgtgtccaaattgatatgaatactagtgaatctaaacaagtgaagagaccaaaacatcattttataatttgaaatgggggcagtttttttccctaggtgcttgggaacgctcaggcttagagcaggtacaatagcaggctataagtcagctataaacatattttgaagagataaaggaagaaagagaagagcagcgggctacagatttgtagccaactgcagcacggactcgaagacgtaatgtgtatatgacaggtgagaccagatattaatagtataataagcaactattgtatgaattagctattacatttgctatagatgatttggagctagtagtgggttatactattaaacttaaacttgctcttattgagctccacctcacaaaaatgcacataacagtgtatagtaggtatggtaattaattttagcatctccttagggaccgcaaaaattctttttttttacatgtatcacattgtccctgcaagtcggttgttgcagagctagaacggaaacaaaatacggtttgccgattgatcatatgtgagaagctaataactacctcaacgaaagaagcatagcataaatggttgggttctgttgtggtataactagtccatccagattaaaattcttaggtgtttttgtcctagacaacgctcgtggacaacgacatgttttttttgacttcattaatattaaattatgtcgctctagtttttagttacaagtgactcacagcataatttactttcctagggaatgataaaatgaaaccattgtcagtttattaacaggcagggtgtcaggctcggtgttttctcgagaattgaacgcgggccgctagtagcaagacggctactctttgtcatcttgggacagagagtatgctcctacttgtaagtcttggatggtgcaatgaaaggtgcgctctcactcaaaatctttgataagtagtactaccttcatcacaaaatattataagatactactattaaatttgatacatattttcaaatggagtgagtgtttatttggcactgtggtgggagctccaaaatccccagcatggatccctaccaaattcctgaaaactactttggaaatgtttttttgctagtgtatggtacggctagctgatattaaaacatttcagatactcctataatttttcttttggagggacccatttagtggctacacgctgcgtcatccgagcactgactataaaaattcaaaatattgcagactagaacatgcaagtagtagctgctatcgtgctagtatttcagtattgatctcagtagcggatccactgttagggctggttggtgcgtcagccccaccgctaatccctactcctaatctatctatctattatatactaaaagtccattaacctttctacaaacgatcctaaactgccatgtggcctcctacaaactctcataaactgtcacatggcgttctaataaattagaaaaaaaagggtggacccactaattttgccaattaaatcttcatctaaaagaaaaaaatctggtatccccaccaccgtaagcacgcacgtacacgtactcccctccacaccctcccaactctcccctattctcctattttttaagctaacttctcctattttatagctaacacttaatatataaaaatgataataatcaattatctaaatctacataattctcaagttacatatttttttctcattttttcaactgttgtgctatttatcaattaaataccaaattcaagatctatattacccatattttgttatttaaaaattaaaaattagatcatgtgacctctatctaattattgagtttttataagattttgtcagttaaaaacatagaggaggtgaggagtgagaaggacaaatagatacgtacgtacatgcacgtctcacgtatgtctcacgcctttttattttttaagataattctaactatataaaataatgggtctctcatctttaagttaaaatcgatggttagacctttttttttagaatttttatgattttatctgatttattatactgtcacatgatggtttattagtgtttgtagaatcacacgtggaatgtatgtgcttggcgctctaataaattagagaaatcctagaaaatcagagaaaaaaaacattcaaccttcaattttcacttaaattggtggacccgttattttaaaccgttggattagatctattaaaactcccacgctgctaatctccatcccgaaaaagaataacgtacgtacgtatagttcggacgatcatctcactttctggaaaaaaaacttaattacctacatcatatactatggagaaaaacgataaatcaaaaaatatatcaatagtaaaatcaaagaagcactaattaatcaagaaaaaaatcatcaaagccggcagtctggcacttatgtgttgtcaatagcctttaaactacgattttgttaaaaataatactacacagaaataagtagggggcaaaaattataactatttttatcacctcctcctcctttttgtccctctccgtccttcaatgcagggtatagtatttactatgctatcgtaaatattgcaagggtatacgtatggttgagttaaggtggcatcagtgaaaagattactgtaggcaatgtatataaagggacatactaactaatagaatcatttgtgggtgtgccaatagtgaattaagtgttaaatgatgctataggctggtctttgggggcatggctatgtcgatgtgggactgatgttccagggcattacataaggaagccttggcaattatagtcgactttatccgttagagaggcattcatgtctatttttaacggtgttattgtattattcgattcaaatggtatgtttagactatttatacatagatgtggaaataagtgatgaacaccaagttaaacagtgtagatgatttttagtgtattaataatgtataatttattttagtggtattaaactattaatgtcgtcttattaaaaaatgcacatagcttttgatgcaagaacaatagacgagtttatatatgaccacgacaaagggatttttatttaaatatgagagatattcttatttttatcatatttagtagtatattaaaatctaccatctattttacggtaaatatattgcttttttttattgttagataatttacatttccttaattacagtatatatagtgatgtatgatttattttaccattctttttcttaaacaacaaatattctctggcttatatcccacccttatagtgtttaaaatacagccctacgatacatagtcgcgcgaatgcgcgggctaccttccttgttagtcattaacaagtctaattagtattcaggaaatttctcggaaggcaaggatttaggctgcctcactgcttctcctgcccaaacttatagaacagaacttactccgagtatacttaacaatatattgacagatatttgtgaatattttaatatagtcacaaatcaaaattcatcatatgcgcgtttggttttcattgaaaaatactttagttgatatatttttatttattttaatcatattatatttttacactaccactcccgatcaacttgcatcctggattcgtcactgattgatcttatcgtgaacacccaacacaaaagcggcagcagccggccggcgacggcaagtttgtccacccatgagctcaccggagacgacgacggatcagagcggcagcaacaagcagcagcggcggcggcggcgccaccacttcatcctggtgcacggcgtctgccacggcgcgtggtgctggtacagggtgaccaccgcgctctcctccgccggccaccgcgtcaccgcgctcgacatggccgcctgcggcgcgcgcccgggccgcgccgacgaggtgccgtccttcgagcggtacaccgcgccgctgctcgacgcggtagccgatcaggacggtgaggagaaggcggtcgtcgtcgcgcacagcttcggcgggcagagcctcgcgctggccatggagaggcacccggagaagatcgccgtcgccgtgttcgtcaccgccaccatgcccgccgccggcaagtccatgtcgttcgcatttaagcaggtacatacctacagcaaaatcacccaaaaccttttgtgaagcagtgtctgaacttactctgaattgtacgaactgggg

SEQ ID NO: 68014 - DNA, 595 bp, Oryza sativa
cctatgttcagattcgaaatattaggatatgtcacatccagtattagcttagttttctatgaggtcgaagggagtagctggctgctacattgaccgacggcgcctgcctcaccaaggcggtggcaagggctgcagagcggaccacggtcgacagcgagacgtttatattgacgctcatttttatgatactaggtgattcctcacgcttcgctacgagaattctcaatatattttgttagtaaaacatcagggtttattagtacttatcatgaagtatatgttaaatattataaaaataatagatatatttgttaaaatattgtgcaaatgatgtgagtgtggttattggatatgcttgcatattgatttatggaattaaataaattgtagataatgttatatgcttacatgagattatatatatatatatatatatatatatatatatatatatatatatatatatatatatatatatatatatatatatatatatatatatatatatatatatatatatatatatatatatatatatatatatatatatatatatatatatatatatatatatatatatatatatatatatata

SEQ ID NO: 68015 - DNA, 18601 bp, Oryza sativa
ttgcttcattcttgtacttaaattgaaacaaccattgccataaccattgcatcattttttattaagtgcttagatattaatgatttttctctatcatacatcacggtattatgatttttctccacatattattgcaagtataagcaaaaatactaagattatagtatatagtttatttagaagttatatttataactattaatttaatttttaagggtcaagttgattagatttttctttttaaaagtagaatggatcacacatatcatagggaatcgagacctaggatgtatgtatatctcctctgtcttattcatacgtaagtaataattaaagtgcatcaatataaaccaaataaaaggagggctagctaaatggtacaaataaaacacatttgtcagcaatcatagtcttttatgatttgatagagaaaacatagcttttaatttacatttaatttgttagatatgttttccgaacaaactaaatatgtcatattttaagtgatgaagaagattatagataattgcttaaaagaacattaaatattataaaaaaaagctcacaaacaggttaaaaatttatctaagcaacacattctacgatgtatgcgcgggctaccttcctagttatctactaaaagttcatcaaactttcaataaatgctgtcaagccgccacgcggcgctctaataaaatagaaaaaatcctagaaattctagaaaaaggcaaaacatccgaccgttgatttttcatttaaattggtgaacccattattttacaccattagatttatcacaagaagagaacaaccaaagccacctctttccatctgttatgaaatatttgggtgatctcatccatatatatggatagagtaacaaccaactcagggacacgacggttggtcgtgccccacacctcttctcgcctcacggcgattctagcaacggacgcgatggttcccaaaccatcgcgcctccagttgccgcctctctcccccctgtatattgtaactgttatcaataaagaatccgctcattcattccctctacattcttgtgttaaaatttctctctcgctcaatcaattctattcacaatacgttatcagcactttcgctctcgcgaaggagatcacgaagtgaaagaaggaagaaactacatcattttttatcttaaggaaaagtgaaagaatcaacaggaaaggtacgagatgtttacctttaattacttgatcgatgccgttcttggcggatcgacgccgttcttggtcttcctcgccatgaccgagaccgccgtctgcaccaccttctccatcgttcaaggagtggccaccacaccactgccaccatcaccatggcgggcgccggcctagggttagtggccaccgccacaaccctcggcgccacatcaccattgctgctactcctccaaccccctataaacgctcctaatctatcgactatcatgtcgtagcatcatgtaaacactctcgagtcgctacatatcactataataagaccatcgatttttatttaaattagtggacctattgattttgattgtacgggaaaacaaaatctccctccgtccattcccccgcaccgtacgtaatatccatccggaagcgtacatacgatccatccgcaatgtacctaccatccatcagacctccatttcttttttcttcttttcttaatccccacataaaattaacaacttttttacaggcctaaaaagaccatcagcctagatctagccagctcttcctctatcttctcctaataaatattctattaaatatcatataaatatttttaaaatatcttctacatatgtcctattttaaatgcatttttaaatttccgtgtccaatgcctgtctgtccgtcttatttaaaaaaattataataaaattaaaaagaattagtcatacataaagtactattcatgttttatcatttaataacaacaaatatactaatcataacaaattatgacggtcaaatgttacacataaacaatacaaaactacggtcctttttggacggtggtagtatatagcactcttcatcagagaaaatctaaaaagaatgaaacattcgaccatcgatttacattattttagcttataagatatatctttttcttaagaaaaacatcccaaacctccttccacgctcccatgcggcgttaaagcccattaaccatccttataaatgtttctaaaccactctatgacacttataaattagaaaaatcataaaaaattaagaacaaaacatccaatcactggtttcgacttaaattgatggacatattatttaggctgttattagatttttatttaaaaaaactgtcaaacctcctttcgtccctccccgcccctgcaatgttaaagattttaagtactttaaacatcctataaatatttctaagccactacgggtctctcttaagttaaaaaaaatcgtacaaaattacgagaaaaaaaacatctcactgtcggtttcgacttaaacatccaacatattattttaggtcattagatcaatcattttcttcaaagaaaaacatcctgccctccatgtccccgtgcggtgtgcattgttccatttatcttatttttatatttataatagttgaaattaaaataatctttatggggagaaaaaccccaaatgggacctccacatattagctagtctagcgagctgccccactatccattttcttctctttctcctcttactagtacttataggaacaatataaataaaatagttatacccttttaaatcacatattcaacttatgatctgtttgaactattattttttagtgaaatcaatattttattatctatattaaatatatttaaatgctaacatagaaatttgcattccggacccacttctattttgaggcctccactaaaaaaaacatatttatcataaaaaaatcaacatatctcatcttaatttttaataaagccagtagacccattacttatatctcgttagacctctaacaactttatatcaacttgattgatttctcacaacatgtatgtgggggctatttaatttagctatacaatttaattttggtgcttttatcaataacttgtataataatacctagcatatactcccgccgttccaaataatagggcggtcttgtcttaaggaaaatcgaacttcgtattttttttactaataattatactaacaatttctaggttaagtgttatgaatgttatatcattatatttgtactttaaaatactttcatgtgacattgattttataggtgttgataacataatatgaaataaattagtggtcaaagtatgttattgatgaccgtgtaaataatttataggtcttataatttgggacatagggagcatatggttagtataattattagataaaagttaccaagtttgatttttccttaaaaagagtgtgccttataatttaggacggaaggagcagaaaggacgaacgacatacaacatttacaaataccttccatgtcacatcatccagaaaatgcaactgtgctgcaagagctttgggcattccgtaatattcagttccttaagggaggtgaagccggaaagcccatgacagtactgcagattatcgctgctaaacttgattttcctgagcaaaggcaggccttgtggctcaagagatctgcatgtcatcaaattgcaggtgattgttaagcactccagtgaagaccgaggttattcagcagcctgcacggcttgttatatatctttgaatggacctccaagacgcaatgtggtgagtgatgggaaggaaggaagttggtccagattaacgcacctacaaatgtgtagttgacgtaggctgggcgatgctggaatcgcagtgatattgggacaatctgtcacttgaaaagaaaccaaggacagaaagggcgctacaggaagagacagtatgttatctgcacatctgatggaaagcctgtgcaagcgcggaaatgcaccatcatccaccccagaccactctgaccactcgggcatctgcacgaatttcagtttcttcagtgctgggaagcccttgaaaccatggccatggctgcagaactcctgtcggatgtgttgcagaaacatcatttcacggacatggagaaactggagggacggtagctcaccaagcgttggaagtcgctcagatttacagaacaagaactttattgttgtcaagttggagaaggaaggctcacccaaccaagagggatatttggaactctcatatctctgtatgatcagttttcttaggctgttatatggtcgcaagttgtcaagcagcagctcgtgagacactgtaattgcaggttcgctttaatttgtaccgtgttttcactgtaatctgggctgtcatccaaatcaatggctctactgaagtccaagtgtaaggactgaaggtgctttttattatgtagccaagcttcttttgcatcctccttgcgatctaaatctgccagtcctcttactgtcaactccttaattttgttcaagctcttcagttctcccatgttacaaatgttacgaccgatatatagttgaggcaaagtatgcaggttaattaggctgtgaattccgtgtagctcaagcctgtagtaagaaatatcgtaccggttatctagcaggcattcacaatgtaaatggcgtagtaattttgcactgcccatgaagccctccaatgccttgcttagaaagaactccttctcgtaaaagacaagagctctcaacttctcacaaccgaggagcaatgcttctggattttctatatacccagatgctctgttcaacactatgatggctctgagtgaatgtgaggcaactgacatttcacgcgatatacaatgaatggacaggtacctaacatttggtggaatttcaatgcatccatcatctgcttcgagcctaaagaactcatctgcaacaagaaagcatgcaagatcgtggataagatcatgcatgatgtgaagcccttgaatatcatgcacttgcagaaatgagcggtcaactatttcgttgaaatatagtcttgcggcactattatgtcgaattgtcgatcacattgaattatatcaagcgatttccacagtccaaacacctcgcttctatcaattaaatagcctttgggaaatagagaaagggcaacaaaacatctcttcaggtgtataggcaagtgtctgtagctcaattccaaggctggtagaatctccttttgtggtggctccaagtcccatatgtcactttctaagacatatctccatctcatttcatcagcttcatagcacaacatgcttcctaatgttttgattgctaacggcaagcccctacactttactccgtacaataatattcttgccaatcttatccaggtctgctggggtgtcatcttgttggtcaacagaaaatgcagcttgttggaacaataaccagctgtcatctgaacttaagcagtctaggtagtagaaaggcattgtctgcaccaactttgccactgcctcattgcgggtcgttaccatgatcctacatacacttgaagcaaataatggcatgcacaacaactcccatgtatctcttcgttcagtccatacatcatctaggacaagtaaaaaactcttcccctgtagtttttttcccagcacctcctgaagatcagccagttctgatagactggagctctcctttgtcagcgaagagatgatcttttgtgtaatgttcttggtatcaaagtactctgacacacaaacccatgcgcagagatcgaaagattggttcacccttgggtcattgtacacgagttgtgccagagttgttttgcccacaccccccataccaacaattggaaatacagacatacaacatgcatgcaacgctgctgctttctccggacttcatcagcctttcgataattatctccttctctcgctctcttccaataattctctcttccactacaaaagagctggtttgccgcacagtttggaagtcagggacaatccgccgatacccatcatttttggacagactaaaactatcatagtaatgtttcatctcagtaaacctctgtacaaccttccttgctctatcagccaactcacttggaactggaactacgccaggtttaatgcggtagtgctcgtcatttaccttcagaataaaacatatattagctaagaaggagatttactaatttaacactaatttctacatgcattttcccatttttcaagacaaaatcatacagacaacttacggtttgtttacacaagttttagattggaacgatcaatgtttttgcagttatatatactaaacagtaaatttagttacttttctgagaggaaagtagtaaactaaataattagtttttcatgtacacacacagatatataaataatcattacatatggactgcattgatgaaataatgactatggttgtgtttagttctctccaaacttccaacttttccgtcacatcaaatgtttggacacatgcatggagcattaaatatggatgaaaaaaaaatcaattgcactgtttgcatgtaaattgcgagacgaatcttttgagcgtaattacgctatgatttgacaatttggtgctacagtaaacatttgctaataatggattaatcagggttaatagattcgtcttgcaatttacatgtggaatctataatttgcttcgttattagtctctgtttaatacttcaaatgtatgttcgtatacatcaaattttttttaccaaaacaactaaacatggcctatgtaattatgtagtattgacttagttggccgaaataattaattattacatgcctacagaagaatcaaagacatgagaggggagagacgttgaagacgtaccatatggtcactactagaaaaaaggtatttgcaggcgggcaaaaatggtcttcccaggcagaccggcgttccgcccgtaggcaatcgccggtgcttacgcttgccgttgcaggtattaaggctcctctcgaacacctccgtactgacgcggttcgcctcgtactcgtactcatccaccacatcctccgcgtcgtaggccaattccttgagctccgtgagccgcactttcgccgactcctccctgatgatccagtgctcctccgcgtcgtgcagcgtggcgtggatcctgcgcatcgtcctctccagcatccggaggtcttccaggccctcgcttgtcgtcgacggcgccgttgctacttgcaggcttgctggcagcaaggacgagagcttgtcaagtgcccatttcacgctcatggatgcgaacaattcagccatctttctctctgatgtgtcaactagagtgcaagctgagagaaaagcagctaaggcaaggggaagggaatgggaatgggaatgggaatgggaatgggaatgggtgggtgctttgttaccgtcgtacaaaggttagttcatcaaaagcaagagcaaattattgttggtggtgtacgtattataaaaaaaagatcattatggtgtacgataataaaaagagataaaatatttgttatggtggaccctggccatatgaaaggattaataaattataggtgtgatcgaagtgagcgtcgctcaacatgttagattttttgtggtggaaccaactcacccgagtttaaattctaaatttgacatgtgtgttcgcatttacggttaattattctttcagtggtaagctacgtacaagatatgctatcccaggggtaggatgtgtgtgcgtgccttcacaaggatccgtgtgaacgtgttgttgacgcctgcgtttgtactgtgtttctaaaagaaaaaaattataggtgtggcggatgcacaaggctgaatatcacaaatgattttttaatcaacgttatagactatttatatggtaaagatcatcagacaaccaatttcccatttcaaatgtacagatttcaactaagttactgccttacaatagtactaggatgtatcatatttagtattagattgtttatgggacggagggagtacgtacagtactctctcttcgtcacaaaatattatagtacaagatactactattaaatttgatacatcttttcaaatggagtgtgtttatttggcactttggtgggtgctccaaaatgccagcatggatccccaccaaaatcctgaaaactagtactttggaaatgttttttgctagtatatggtacagctagcagcttttaaaccatttcagatactcctataatttttcttttggagggacccatttagtggctacacgctgcatcatccagttgagttgtgatccaacttcatttaccttttagagtttcacctcatatatatacctcttgtaagccaccgtgcagcgttgtaacctcaccccgatatagtggagatattttgctagctggcgttcgtggttttttctctcttgttttagaagggtttttcacgttaaatctcgtgtcttatatgattgatctatttgttctttatcgtttgttttcctatcgttttgtaacacatccgagcaatgacgataaaatttcaaaatattgcagactagaacatgcaagtagtagctgctatcgtgccagtatttcagtattgatctcagtagcggatggttggtgcgccagccccaccgctaatccctgctcctagttagtcattaacaagtctagtagtgaagaaatgcaaggatgcaggctgcctcactgcttctactgcccaatgattgatggggaggttaattagagtattgtttttttcccgtcctttttagttggtaactgaggctgagaacgagctgccatgccattccctcccttgcagccaattgctactgcaacagaagcaacacacatagctaatcaagctggtggtcaaaccacagccaaagaaatggccggactgttcgcatccatggcaatcgaaggtgcactcgacagcctctcctccctgctgcaactgcaagccaacaatccaacgcctcctccggcgacaacggcggcggtgccgccggcggagacgagccacggtagcgtgaagggggggctggaagacctccgggcgctggagaggaccatgcgaaggatccacgcgacgctgcgcgacgccgagcagcactggagaacaccagggagaagtccgccaacctgcggctggaggagatcaaggagctcgcctacgacgcggaggtggaggcgacggccgctcagggcggcgacggcgccagcagcagcagcagcagcagcaggaagcgcaagatccacaaggtaaattaattggtagtccgctgcacctaggagatagaaatttaaactaatgttactgtagttaactatttaatccgtaccattcaagtagatgggacctcgtgaaactcaataggagatgataaaatactctatgcttttcaaaattttagctgttctaagtttgtactcgctccttctatacacaagttacttctattacttttatcaccaagtttaagaagaaattgactcatcttgcatataacaaaacttaagaagcgcatgcacgcatgcaaccaatgagtattaagatatatatctcctcgggttctaatgaaacatttaatttactctctatttaagtcttgatatttactctctatataattcatatgctgttaactgtatgaatttttataacttgttgatcaaaaatagatatgtttgacttgtaacaaagctaaaatgagaattactttgaaacagaggaaataccacatttaatatataggtgggacctcgtgaaactcactagatgataatataccacacttaggctgtgttcagtagcaagaaattaattcgtcccgcacaaaaaacaaaaccatctattagcacgtgattaattaactagtttttaaatagatcaatatgattttattaaacaactttaatatatatttttttcaaaaatgcaccgtctaatagtttaaaaagcgtgcaggcggaaaaagagggaagtgggttcctaactactcttgccgaatgcagcctaaattagtgtagtagtaatttgtgtgcttctgtttaatctcacaaagctgctgcggattcggttcgttctaaaatataaaatatatgtatcttacatttatttatttcttttataatatattatcaataattacaaaattaacatcatattaaaataatttcaaatatgaatctaataatactacatgtatgacattaaacacatatactttactccaattactctctcatttccataatataaggcacaactacttttttcagatgctccataatataaatcgtgcatacatacatgtaattaattaatatatcttctctattaaattatgactttttaaaatactctacccttaagatctctaattctattgggtgcatgcattttatttattaggatgatacaaatttggaggtgataataattattttttggtcttagtattaagggtggttgtgccttatattttggaacggagggagtattagtcaaaattttcaaatgtgagtttgtaaaaaacacagggagttcttttatctatccccatcaaatcaataaaagcgtctgaaaccctcaagaaatccctgaagatggatagtcgtattagttgacttcctttttttttctgaaattatacatgatgagcaggtattagggcatttaagcttctttactagctagtctgactctcaagtctgaacccttaacaaatcccttagggaaataaaaataaaaaagtaaactgtcagcatgatactagtagatgactaagagtccccctcttcgatgttttttgtattatttgtgaaaaggtacatgacgaggattacttcattgaggctggcataattccagtgccaaaagagttgactgtcagagcaaggaaagttatacaaagatttggtgagatcgaaggctactatggtagtttcaccttgtctgagaatgatggggacagaaggattatccctgatatcaatagtctgaggcagactagctcttttgtatttgcgcctataattgttggaagagaccaagacaaggagaacgttatcaagaagatgatgaccttggaaggaagccgcattggaggttgcatgtcagttttggccattgttggcatgggaggattgggtaaaacaacgttagcgcaacttgtttacaatgatccaaaggtgcgtcaagctttcgatcttttcggatgggtttgtgtttcagagcatttcgatgtgaataacataacgcggaaaattctcagttcaatagcaaagagaaactgtgattatatacaatctagtgagctccagggtcaattggaaaacctgataaaggacaagagggttttccttgtcttggatgatgtttagaatgagcaaagtgattactggaagtcgttgtgtatgccgatttttgcctctacgcgttgtgacattatagtaactactcggagtgaggcagtggcaaggttagttcagacaataccattctacaatttagactacttaatcctgatgacagctggttgttattcaagcaaacagcgtttgttgagcatgataatgtcagtccagcaaacctagtagagattggccagaggattgcaaagaagtgccaggggttaccgttggcactcaagactctaggtagcgtattgcgctttgaaaccaatgtaatgaaatggagagatgttttgcagagtgaactatgggacttggagcggtcacagaacgaagttttgccagccctggagttgagctacaagcacatgcctatgcacctgaaactttgttttgtttccctttctctatatctgaaagatacttacttcgatgaaagtattgttgtttggttgtggaagtcacttcatttacttcagtgtgacggaactgataacagcaatgaaattggaggtttatattttactcaattagttcagcgatcattgattcaacaagtcgatacccacggacgcatggctatacatgatcttgtccatgatcttgcgtgctttctagctggggaagagttctttagactcgaggaagatggatatgttgaaattccaaagggtgctcggtgtatgtccataatgccacatccacaatgtaagaggagtactcaaatatcaaatgcctcgcaatctctcagagtaatcatattgatcaggagaattaatatcaaaaatccagaagcattgtttatgaactgtaaaaagtttcagatcattcaagtcatagatgacagttttgcaaatgtgttgcttgacttcatgggtgacatgaaactactacgtcatttcaggcttataagaagctgcaacgaggtaaagttagtaatatctgattcaatgtcccagcaattcaatttgcaaacactgaactgtgaagcatatagtctacatggaattgggcggctagctaacttgcaaaatttgcctaatatacacctctggaaatgtggttgctacttaagggagctgaggaatatgaacaaaataaggaggctgcacatatatggactttgtaatgtatctagtattcaagatgtaaatgaagctcatttacatagcaagaaggacctcgagatactagaattggactttgagagtggagggatttgtaaagttcacaaagaggaagctgatgttaatcaagcaattagcactgtatctggtggctcaatacttgagagcctaagaccacatcatcagagtcttaaagtactaaggatgaagaatttgaatgaggtaaattatcccagctggttgggcagtgcttccttttccaaattaacaaaattgcggttagagaattgtcaatctcagcaccttccaacgctaggtgagctaccttctctcaaatccattgatatccgccaaatggagtacgtggaaaacatcggtcgggtgttttgcagccttgatccaagcgtcaaagggttccgctccttagcacacctgagattccaagacatgaatcgattctcagagtggtccgaagtgcatgatggcgagttttcgtccctggaaacactgctgatctggagtgcctctgaattgagctctcttccatcggttccattctcaagcttgcgtagcttcgaactatgtgattgcaaaaatcttgttacttttcctgcatcagctacccttcagatactaagcatctcgtcttgcgagaaactgaaggaactgccggctctcccgtccctccgttcactgaaactgagtggctgtgaaagcttggttgcagttggtcacttcccgtcactcaccgtcttgcatatgagtactgaatttgaagaagaggtacttcacaagttgatgaatttacacttaaagctggaagaattgtcaatttcgtctgataccatgaagttaatcaatcttgagccacatagcctgcctttacttagagagctcgagttagtatgccctaacttgcagaattgtgatgcacttgccagcctcagttccctcgagatactatgcgtaaatcgttgttctccccaacttcgggtgcctaattcacttcaaagccagctggaaaaactctacagtccttgatctttgtaataacagtcctctttttaaatgtactattttagttggtacttctgcctttacatggccacatatcttaattctccttttgctatcgactctgtagaagcagaacatcaattcaaagactgcaatttttcggaaggggattggagggagaatgcaaaacagcttctggtgtcccactcccaccttaacactgggacacggttttctttttcttgatggaactgtgggactagaacaataaaggaaaagcgaataattacacaattactaaagaaaaggattgttactgcgataatcatcgcatagattgattgagagatcaatgttagtacaactagaaaggtggcctgcgcgcatgaaaggtaagatttttattgtttgttaaaaaaatttgtctcatagattaagggaaaactaaagtttggatactattattttgtaataattttttaataatttaagggttctatttttcttaaggtatcttaaaaatccattcacaaatttttagtacttacgacttttgaatcatgtttttttctcgagtaaataataaactattgcttgtagtatggctacaaatgaaaaatgcgagagcaagatactcaaaattcttgtgattaaatcgtctcatgaaggcgcatgatataataagaaagggagggaagcgtatacatggagaaaaagaagaaagggaaaaatgaaaaatgtggaggggaagcgtaggtacccacgtacgtaggtgtgtaccgaaggtggagaggtgggacatcgtagtatttagtttgttctaagatcaatttaatctaatggtttataatattggacccaccgatttaagtaaaaatcaagtaatagatactttgcttttttttcttagaatttctaatattttctctaatttattagagcaccacgtggcagcttgggggcattttaagaaattttaatggacttaccacatgtgattacaatattgaccatgtaatatatatgtatgggatatatgttaatattcattccagcttcgtccatgtttatatacatgtagagagaaattaaatatgttgctagcaagccattagaaatctaattaatagcaattaattttgacacttatttacaattgttcatagtagctcttatagattcatcttacgatcttgattatgcgttgatcaccaatttactgatcaccatgactcgcatgaaaaaaaatatgtactacttaaggtttaggacagctgattgatgaattatctgatttatgtgatagctatttgagattataaatgaatgaattaacttctgaaaagttaaaaagttgtttaaaaaaagcaccatttaggaacttgaaaagcgtggagcgtgcaaacaaaaatccaaaagatagaatcagggaaaaaatagggctttaaattcccttataacactcttgtcctagtaaaagttctattctattgatattcattaatattgtgctcacatttataacataatgatatctttcaattgtacgaacaaataatgcaaaatccaaatacgatataacacaatacattataattattatgcaatcaactcttggtttcagcttaaatagagttaagtgttggaaaaactaaacccacggtgcttaattcttctctcgctgcatcacacctttaattttcttttcatgttattaacaaaattaatcatctccatatatgatttgatgtgtggcaaagcagtagcgctgcagcggtcgtgatccttagatgccttagacacgacgctttgtcacacgtgcaaaggtcaaaggtgcaattgtgcattctgcagcaggcaaaaaaagagaacttcggacactttatttattaacaatagatccgttgattaaaataatgggtccaccggttcgagggtaaatgtaaattagttaatatagatttaaattgttgatttaatgggtacacaatataatagtgtagactttatttttaaaatagagtattatttgagaataatagtccaaagtaataaaaaataggtccgatgatttaaataatgggtccatctgttaattgcacatataaagtagttaatatggatcttaaattgtttatttgataggtacacaatataattgtgtaaattttattttaaaatagtgcattatttaaaaataatagtataaagtaatgagtacaccggtttaagtggaaatattcaaagggtaaacatataatggtgtaaattttatttttcaaagattgtatagctaatttagttccctatgtttataaagagttatatgatggtatattcttttgtttggaaaattatgattatttaaaaaatatatatcaattgtataaatggaaaaaagaagaaaaaaaggaaaataaatggagggagccgtacgtactacatacccatacccatgtacgtacctgacctacctatgcacgatagaaagaggagaggtgagacccatagtattttgtttgttttattatcaattttatctaacggtgtataatattggacccatcaatttaagtgaaaattaaggggtagatgttttattttttcttagaatttctaggattttctctgatttattagagcgccacgtgacaacttaagaacgtttaatgaacttttagtatataatagatataagtatgagcaactttacagtccttgagaacatagcatgagataaaaaatttagtgtggtacctcgtgttaccttctcgagtgctgtaaaatttctcatataactatactctatcggttgccttacatccacaaccaatttaaagaaataggattgggagagataagcacggtcactaggatgtgggaccgctagacgaagcattgacaggagctggacccacgtcgagagaaaggaaaccgacgacccattagtatatcacggccccgcagtcaaactggctatagagatgttgactggtactaatttgtactattataataactaagaaggtgacccacgcgatgcacgggcatccgtactatcatgacgtaccctctatttacttctgatagtcatatttcatcttggcacacaggccaaggataagtaattctacttatcatctatttaaacatgctactagtcattcctcgtaaacaaatgattcattaatatttatatttctcaatactcatgtagctaatcatatatggaagaattgagagtcacgcattaaatccgagaaagtcattaagatgataggttgttcgattgaaatatgtctatcaaaaataaatttttcagatttaaaaatatgactatcaaagatagatggagggagtatcattcattgacttaaaagatagatcaaggtcgggcatatctaaaaacaattcattgacttagattatagatcaagatcatatcatatgacttttgaattgaattttggaccgagtgagtaaatatcatgtataccatttgatcacataccatacaatattgctacaagtaaaaattgcgatagcaaggaactcaaagtacgttgtgatcgaatgtgtctcatgaagatgcatgattttgtggcaaccaaactaaggatatattagcggttggattgtttttcctttcgtagaagttcaaatttttcatattattttccaaagttttaaagaatttttgttaggacacaaatcacttgcagaactgcttggttgggtagtgcaaaatatcaacaattgtttgaagctattctttttttcttgtttgcatgtttgattgttttctttgaaacaatatttgtttgaaattagagtagaattatataaatttaataggtatgtattgtgtttatcggtagacatgatcaccttagccaggagttataagacgtgcgacagatacaaacagaagttggaagaaaaaatagaagcacaagtgaagaaaacaattatactctctggctgcacaaaatccccaagccttcccaaacatatttcccgagccctagcaacagacagttcaggtgccaagcagtgtcggatcggttgaaacatcaccatatccagtggatcttatcaccggtccgacgccgtgcagcctcgtcgtgccaataggaagggctgggaagagaaaggtgggaactggactagcaataccaggttgttagttccacaacattccaattccagacgattacgcaagagtgcaagtagccaaggtccatgcggagcatacctcattagagctagatatcccagcaccggaaggaatagaattgtttggagatgcggtgaaccaatttatattgtggcatcgtcgagatatcctctaggtcggtcagcaaccttcaacaccaactccatcgggacctaagactactactgctcctgcgctgctttctccaccagggccagattcaccaccaaagcggccatattccccacttccttcgtccccaccaaagcggccagattcctgacctcgttggtcccccccccccccccacaacatccaccacctccatctcatgctaaagtccccatagaaccacctttacaaaaaatggattccattcaccaatctcctccaacatgacagtcagctctagcgcaacctgttccacctcctcggaaagccactagtctcccaactcctactaaccttgaacctcgtcagcttatcccaaagatggtacgatccacgtgcgataaaaaagaaatggtcgtatacaaacaaaggttagtgtttcaggtccaattgacaagaagaaagatgaacctcaacagttgtcggattcacagaagttagtgaagagtcacaatcaatgcaatactcgacatttgatgaagtgccagaaaagtatgcgtatggaaagccattcttaccatgcactggtggagaaaccatctttcgtcggtcggccgatttccacaatagtcccggatgcaat

SEQ ID NO: 68016 - DNA, 2496 bp, Oryza sativa
agagaagaaaactcaaggagatcgcggcggcgcccgtacgtctccatccaatccggcaatggggtggcgcacgtacgtacgcctcacgagtcgccgccgatggagatcgccgggcgggcggccctcccgagcggcgagcgggagcgctgcctcgcctccatgtcccggagcaccaccatccgccgcatctccgacacctggtgctggtacgtctcgtccaccttcaccttctccccctcctcctgcttgatccgcctcacctggctgtgcaccaccaccagccgcctctgctgctgccctgcatccacgtccctacccatctccatctcagcgaaaacctccctcggcttcctccccctcttgatttttttttattctgtctacagagacgatggcgatcacgcgacgaggcgaatccagaccattcgaacggtgcgttgcatgagaggggcgtataaatagcggccgcatcgcgggtgtggatggatggatgggatcaggggactgaccggttcccccctctcatccgcgccgttattgcggaggcaggcgcagcagctatacacacgtgtcctgctatcccgagcggtttagacgtttacccgatcgattggtcgccgtctcggcgccaattcaccacgtacgccgatcctccatgtgtacggggttgacgtcgcgaggccgccgagtcgtgccggtctgtccattatccagagtttccggacgggatggacgtttgccgatacgattttgacattttctttcttttttctgcatgatttgtaacgatgtttgataactatgcgtgtcatatccttttctatccgaggtaaacgcgtcgtgccagttgttgcaaaagatatataaacgcgtcggttaattacgtgatatggagccgatagggactcgtcgcacaacgaagcgatcgcaagtggcaaccgcgcgagagaaacgtgtgggaattggaacagagagtcagagcctatggcaagctgggttgatatccggcagtacgtttaggacaatgtttaagtcaaacattaggaatataaattataaagtttaaaaatataaaaattatatgtatagatttgtcttgaaaaattctttcataaaagtatacatatatcacttttcaataaatatttttatagaaacaagaagtcaaagttgtgttttaaaaacggtgtcgctattgtaaacgacttcctttacgagcatggagcgagtacgttgcaacgcgattgaacatcgtcgtctacagctcacttcgccgagtccccggcccatcgagaggatgcatttaattctgttatttgttatttttctcaaacgagggtaaaggtgatctgagttaatctcagatccccgaaagccgggatatctttatttatttatttatttcaatggagagtaaggcggttggagttttgatctccgatattcatcgatcgtatagtcatatttacgtactgcaaagcgatcgagtgcaacggtcagagttttcatctccgacctccctggagatcgagtccctatcgatcgcatctggtgatcggatcgaaatctcgcgcgaaaccaggcgcctacgtaacggtgcaaaacataccgtccatcggtctacagctcgcctagccgagtcgccgaggcttttcggccgagcctcaatcgagggcaaggggattcggagattaaaactccggtttccgaaccaccaggaaagataagatgattgaatcgatgtcttgcgccggaattaccaacggatgcaccaatcctccttctagagaggattctacgctcagagacaagtcgctaaccatgtcgtgcactggcgcaggtagattttcgattttctcgttgcttgggtcacagtgatatataccaactacctggtagaaccagaagccggctacggggtttcaaaaaggaagaaaataaaacgtgaaatctatttcgagagcgctctcggtttagctctatagcgtgacgcatctcatagccgtctaactgtgcacgtcgtcatgatgtccacccatgtgggtgtctttttcttttcaaataaagttctcgtgggtatctttttcctattcaaataaagtttcctctcaaattacttatccgatctacaatccgattacaccattgtgttcgttacaattaaatcttcacaaacaagatcttacatgattatgttacgttgaaaaaatatttatatttataaattacttttattatatacataagttacttttatcatatatataagttatttttagatttgactaaattacttcttagacatataaaagtaaattcaataaagtctaaaagtaatttacatatattctaaaagtaacttaaaataaaacagaagtaactttgtcacgacattagaagtaaattcgttgtaggggataaaatatgactttttagttaattccataatttgtgctgattaatttaatttatagatagagtcatgtttttatctct

SEQ ID NO: 68017 - DNA, 6005 bp, Oryza sativa
ttaggattcgcttttggccagcgaatgtgcaagctttgattcatcatatttacgtactgcaagcaaatactccatttggtcaggattcgctgcaggacggccgcgcggcacacggctgacacgagcgcacgctgcgcgagcggcgaacgtgcagaaaacaccgttcaatcgatgcgcccggccacgcgatggccaggcgtatgacacgcacacgctcgtgacagcgcgagatatcatcatatcaagcggccgaactgccaaaataccgtactccaacacgagatgatttcaatctctccccgctccgctaatcgtttgcataccgagattaaaaaactccgacccccggtatgtgtggccgaagttctcttttgtaaattgtaattaggagtattttggtaagggatgcaatgggatgtgagttttaatctcggatcctcgggagcggaatttcgtttgtcacttttttcaagcgagggcaaaaggagaggccagaattttttgtagggaggcgagggggttcggactccggagtattgttccccgaactccatggatcgcatcggatggtcggattgacacctcgcacggtcgcacctaccgcgcgcggaatcaccacttgacggcttcaccccacgccactccttaaccagcgagcgtatcggatggccactccttcaccagtcagccgtgctcacacacgactgacacgagcggcgaatgtgcaaaaaaaaaaaaaaagaccgtggaatcgacgtgcccggccatgcgagtactcggtgtgtatagcccattcgtgacactacgagtacgagatatcaaaccagccgaactgccgcaaatacctaacacgtatgggtacggcaatacgaatccctgcaaacgcgacgttcgatcgtatcgtatgtacggtgtgcttcagagttcagaagagctcgcgaggcagctgcgtcgtgcatttgtccattgtctctggacgggatggacgtgtgtttgcggcttgcagatacgatttggcattttttgcgcatttggtagcgatgtttgataagctatggattagcataactgtgcatgatttggtagcgatgtttgataagctatgaatatatatgtgcgtggcattcatttctacgcaaggaaaacgtgtcgtgccggtttttacacgggataaacgcgtcaacttaattacttagcactcgtatgtgatatgtggccgacagggactcctgaagaaacgaaccaatggcaagtggcaaccgcacgagagaaacgtgtggaattgggacagagacacacacggagccatggcaagctggatcgatctctaattgcagtttccggtaaatcacgaaattaaagcccatgggcttagctcgtttagagcaccacgagcagaaacggacgggctttaaggccgataggcccggctgaatgctacgttgcgactactaccattcacagagccgagtctccatcgagctagtttttagttattttagttatttttacaaacgagggtacggtggtttaggggctgttcaggttgatgtcatttttaaccatattatttttgacataattgttaaaaatatatctacgtttagtttgttgtcaaactttgataaatatataagaaatcctgccaaaatttgtaaggtttattttagctacaatctaaacagttacttaatcttcaatccacgaaagccagaatttctattgttaattttcgatctagagaaaggcggttggagttggcctggtttattaattacgtacatcgagagagggcacaagtcggagttttcgggtctattcattttgatgtcattttcagccatactattttttttataaagttgtaaaaaaatatctacgtttaatttgttaccaaatttggtaaatacataagaaatcttgctaaaattttagcaatattaccatcttgccaaaattttagcattgccaaaatttggtaagatttattttgactacaatatgaacatgccattcatctcccccattcatctccgaacccccccccccgggagatggagtccccatggatcacatctggatctggtcatcggatcgaagccttgcacggaaccaggcgagccacgcagaatgcatacgtgaaacgtaccgatccagcggtctacaggattacaactcgcccatacgatcgaggccaaggggttcggagataaaggggcgttttggtttgatatcaaaatattgccatactaatttttttagtttaaatagtaaatgtgatgatttggtttgaagccaaatatttggtaatgcctatactcagtttgtcacaattctagaatattcttcaaaacaatttaaaattggctctcaattggcataaatctaaagacacccatttacaattctaccctaccaaaatattggtagtgctaaaacttgcctagggttcggcactaccaacatattggtagggtgctaaaccaaacaaacccaaaaactccgaaccctaggacggatgattgaatcgaggccttgtgcagaatcatccctgcgagccgatcggattggatcccccacctttctggagaggattctacgcgcagtcaacacacacaagtcgctggccatgtcgtgcactggcggaggtatattttcgatgcttggccgacagtgatacaggcataaagcctaccaggctactagcgctgcaagtttgtgatcgaataatgacgagtactcacgtgtacagagaaggcgcacagcgcagtactcaactcaaattgtgtgcaaaacgtgcttgttctactaccaatactcaccgaatcaaagttttaaaacaaatactcaccgaatggcacgttgaatcgagaggatgcggacctccacgtcgccctctcgcgcgggcggcacggagggcaaaccctagcccccgccgccccctcccttcctctcccacccctcgccgccgccggagcgcgccgacagagttccgcgcggccagtcgtgagggcggcggcgaggcctttccccggcgacgcgacggctcagcacgaggacgacgacgcggcgcgcgatgggcgggcgacggcgacggcgcggcgcgaagtttcggatccggcagtgccgccaccggatctggcacccccgtggctggattcggcgccctgccgctggacctggccggaggcgagcgtcattgccgtccgcggcggtgtgacggggcgcggagtaagtggggcggcggtgcatgtgctggcggccagcggggtggaggccggagtggatccgggacctagcggtcggatctggcgttgtcgcctcgtcgcgtggcgcggtggacggcggtggcaggagagcggcgctgcgtcgaagcggccccggcgccgagggcgggttccggccgacatgtgcctagggcggcgtgcgacgcaaggacggtaacggtggtcggtggcccagccctcggtcgaggctcaggggcctgcgtgcctccggagatgccttggccggtggtgcgacgacttggcggtgcgtcctgtgggtgccgtcgccaccgcaccctcgtcttcctcttcccctccccctagtatcctcgtttgtctagtatcctcgtttgtgtgccctcttccccctagttccaaacatcactagtgatcttgcccttcaacttcttctcaatctagcgtgcttgtttggaaattgtgctcctctagtagctcggattgttgcggttctatgccctcctccaaagttgccgttgatgtccttcctctgtaagaatccccttggccatttctccttctgtctagcccctgctcgtctacaccctcttcctcgagatgtccaggaccgcaaggatcagtgtttctccctcctttgaggcttccttcccttgaatagcgttggagagagttgatctaacaagcaacttgataaagcctgattaaagaagacttaatgcgggtggcctcgagccacaaccttcagtggccctccctcctttggggcttccttcccccaaagggcgttggcgagctctgatccaaacagcaacaagatcaagtcagcttctggatagcttcatgcgggtggccttggacttcaacagcattcccttggcctctcttctcttccgacatgcttgtggctgtgtgaggaattggatgttgattagttggggtttagcagtaggtttggaatttggcaagataattttgcatgtgtcgttcatcaattgtaatctttaggaggttttttttctctgttctctcctcattgtattctccatgtattctgttctactatcctccagggtcactgcgcttgcgtaggtaaagcttgccctgtgtaagatcatttggctcaatatatttaggtggggattctctccccccgtgatttagtaaaaaaaaaaaatactcaccgaatctcttagcttttcggagaggatttgctgccggtcgccgctacctcgtggcggtgacatggactggagtcactggacggccgcgcggcacacaagcgcacgcgcgccgcgagcggcgaccgtgcaaaagagaaaaaaaaacaccattcaatcgccagacgtataacatgcacgcacacgctcgtgacacggtgagacgatatcatcaacatcaagcacccgaactgccgaaatactgtacctaacacgagattattttttaatctccctctgcgcagctaatcgtagcacgtatctaactatgcatggtttgcataccgagattaaaggaaatggctatacatgttacccgtgccatgtgtacaacctgcattcgactaacatgcacaagcataacttttgcttgcgtggtcctacatagagagaaaccgatcatggtgattggtggacgtagcatggttggacgcatgttgtatacaacacagttgtacgaacagcaggactgcaggagttgagattaaaactccgacccgcaaaggctgatcgaattttattttttttttgccgttaggagtattttggcaagcgagacaaggggatgtgttctcaaaaaagacaaggggatgtgagttttaatctcggatcctcaggagcggaatttcgtttgctatttctttaagggaagaggcattcataggcgtccagaacattttgtcgttccgtttttcattgtttcaagctgatgcaagggggttgggagttttattgtccgacccccaagcccaagggatcgcatcggagtcggacagacggatcggcacctccaccagcaggctgcgcgcggcgattgtgcaaaaaacaccgcggaatccacgagccccggccagccatgcgagtatgtgacagccaagcgtatagcccagtgacacgacgagatatcaaacagccgaactgccgagttaccaaacacggaaacacgaatcactgcaaatatggtgtcctaattcataagagctcgcttaattggaacctttttctggtcgccttttcccagccgaattttgactcgcagctcatatacgccttttcaggctacgtagaaagagtggaagactgcttccgacgtactagtagcagacaaaagaacggcgtattagagtactcacaatgtctgatcaggcagagctttcagggttcaactattcggaaactggatagccaaagcccaaaacacaggtccacggcaagctactggccacactggcaagcgaatcagcgattggctacagctctctgctcggcatataggccggcctagctagtggcacacaaaagcgggccgcactggtcaagacatttctccagagactgaccgtacgtcgtcgtcgacgccgtcgccaatatttgattggtgaccggtcctgcttggcaaccttgtacgtaagggtgtaagtgggtaggcttatgaacccatttctaatataaataaacaggtaactcatcgattatccgtttatttgtactataagtaaatttatagatttattcgcttgcacacttacctgtaacatcgatc

SEQ ID NO: 68018 - DNA, 4738 bp, Oryza sativa
agaagagggccttgtccacatcgcgaggacccgttcatcccaggcatgctggtgatgacaacgaaatcatcccgatctctctcgactcctccggtcctcccccgataataatcaacaagattatattttactccctccgtctcgaaatatttggcgccgttgacttttttaaacatgtttgaccgttcgtcttattaaaaaatttaagtaattattaattctttttctatcatttgattcattgttcaatatactactattattcaagtttttgaataagacgaatggtcaaacatgtttaaaaaaagtcaattgcgccaaatatttagggacagaagggagtagttctgaaatgaaaaacattactcccattttaccctaccctctagaattgtctgccatagaatgttgttcagctacacaataaaacgatcaatgtccatccgcccggtgctactgcacggtagagtacttcagcaacccaatgtccactcggtatgatcttcatctagaaggaactgaatagaggcgcggctgagcttcttatatcctatgctttgtctctcataactgatataagccgtaaacggtttatcaacaactaaaaaattaatctatacataaatgttttatatattggcgtgttcggatgagagttttgcagcagcgttgcggctgcagaatggctgcagcttgcagcgattttcaactgccgcaggcaatgggtgccaaacactcaccatgtatccttatcgatttaaaaacagatactaagaatagactatgattaaaaaaatctcaaatcaaaataaagaattaagtttcaaatttaaattttgatggcaacttataagctgaaacacacacacaaaaaaaagtagacatgtagcaacacacaactgttgaacgaacaacactgctaccataggtgccggttcctaatggcccataggtccggattttcatccgacatcaattagtcggcaccaataataacaaccgacatctataacgaaaatagaaccgggacctttaccattgctcgagccagagagagagagagagagagagccggctcgaattcgagaagaactcaccaagcgccgtcaccgggcatgcgccccaaaccccaaaatcatccacaaatcatcaacaaaataaattgaatcacataatgaacatattcaacaacaaattcacacagacatcaacaaaaaatctacaatagactggggagaggcgtagaggggagggcgccaccgctgcccgccacctgtcgcctcccctcccgccggatccagcgaaggggagggcgccgtcgcaacccatcagctgtgtcacaccctgaagtttcccccccttttcttgctttaaaaattggttaaataaattgcccgaagaaattatcttcattaacctagagctaaatccctagttaataaatgcaattaataatcagaaatagcgtggtggaatttttcttgagttccccatgctccaatgcattaacaagatttttagtggaattttcagagccttggaaataattttaaccaattaaaaatcaccaaagtgcaattttaaatcccaggaaaaatcctttcttctttttctttttcttttccttcttttttctctattgggccgtcggcccactccctaccgcgctcggcctccttcctttgggccggcccgttcccctttcccctctctccgggacgctgacaggtggggcccacctgtcaagtcgtccccttcctccagccgcctaccccacgacggcaaccgtcgccgaaaccgtccgcgccgccgccttctccgctccacgccgcgcccccactccgcgtccccacgtcgccgccctccccgccattcccgcccgcacgcgcgcccgcaaatgggcgggattcgatttgaatcccccccactctctctctctccccccacgtcgccggccaaatcggggggtttcccggccatgtccacccctctcgagcccctataaagcttccccgcatctccctctcccttttccccttttcgccgcgctctcccgtgcctcctaccgccgccgcttccggtcacgcgccgcagccgctagagccgccgccgcgccaagccgccgccgccattagcattgccgccgcgtgagccacctcggccgccgttcggtttccgctaaaccccaccggagcccagttctcctcgcacaccggtgagctatccattctccttcgtctccggccaacaatggtggccgccgtggtcaccctctctactcctaatccttctcaactccctccgtaggtgccgccgccgcccgtccgcccctccttatcgccaggtcatcgccgccaccttcatcctccgctccggccgccatactcgccggtgaggatcccccctccctcttcccctctctctcgtttgcgccgactttctccacgagctcgccgtcgccttcggtcgacgccgccgtcctttaccctgtccgccgtcgcttcttgcgccgccgattgccgtcgccggcgaccgtgcgcgtcgccgccggttgccatggccggccggccggttttgaagccgtgccgagccgtgcctagctgccgccgtgccgtccgatcggcctcccggccgatccggaccgtcggtcccgtggaccggcggtggaccacccgcgtggtcccggtccacggtagaccggccaccttgagccactgcccgtggggcccacatgccggcgcccccttcctctcccctttgagccgctgacccgtgggccccgcctgtcggcgccgcccccctagatgacgtcagccctgggtattattgcgcaataattaattaaggactttttctttattagtaaaaacacagtttatcttctaaaattcataaataattcatccgagctccgtttaagtccattcaagtctcagtaaatcaagaaaaatgcaaagaatccattaaaaatggttttgtttcctgtttcagtagtcttatagcatgtttttcttgtgtgatttgtttgtagagtttcggcagtttcgtcgatccgcggtttatcgaagacgttgctgaggtctcatcagtttgagagcaaggcaagtcatgcaatacgtttgatcatattgtacccaatttaccaatatcccgcatttctattaaatgttgcattcttttacaatgtaatgtgggatgagtcctattcctcagccacatattggttaccttatgccattgataacttgggtatcaaaatgactagatgttggcttaggaaatgcttagccatgcttagttcaactagtacacaaatggagatcacattattacatagactctaactattggcatagctttagattggtgccaccgcaagggtgtcagttaattaaaatattctgaatggcgggctgtgagtgcatggttttgctggtcgcacctatggcagttaaggaccggttcacgggaaaccctgggagacttaccgtgcttaccacaagcgggaatgggtaactgcttgatctgaagtatagctcgaccctttcctaggcaccggtggcgagggtgggcgtgatggaattgggtcggccgaggtgttcggttgtccagctgccgtattcaccgcggcgcaagaggggaccgcccactgccttttgaggggtgggggtgaaaccttagcgtggtgtggatggttaggggagggttatgtggagggtcttgtcatgatttccccctttgcagtatcatggtgatacttcggggcatggcaacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggatggttgggcctgttgcaacgtggtgtagcgttggacagtgattggttaatattgattaattactacagctgttttactgctttcaactactgctttgaaatgcctgctttatgcaaaagaacccctagcttcctttggttatatcctgcatcatacctcctcttccggtatgacttgctgagtacagtgggtagtactcaatcttgctctcttttcccccacaccagagttgaagttcttctcagttggagccgtctcagaggttggttttgttgctgccgtcaaggtttgcctgtggagtggagtcgcccgctgctgaagtcaagcttcccggtttagctcgcttttatctttcccgctgcatttgtaatcttttatatttttgtaagacgtgggtctgtatatcaacaattgtcgtttgtgtaccctggctggtcctggacagggatttaatgcacattcagcttagaaattctggtgtgacaagctgccgcctgccgcctcccctcccgctagatccggcggaggggagggcaccgccgccgcccgccgcctgccgcctcccctcccgccggatccagcagaggggaggccgccgccgcccctctagccacagccacacgctgagagatgtgagagagccgagagagagagggggggcaagagagagagacagacgagagatgtaacgccccgattttcgttcgggaataaaaatcaattaataatacattttctagaaattaaataaaagttaaatcaacttaatcaagtgaattattgagggaattaaaaatttcctttaaaa

SEQ ID NO: 68019 - DNA, 2652 bp, Oryza sativa
tccctcaagtctgttctgcctccccagccggcctctccctccctctctcttcgacaggtgggacccgtggaccccacctgtcatccctttcttccagctccaactgccgccatggccgcctgagccaccccacgacgccgcttcctccgcgcgcctccacgctcccgcgcgcgtgcagacgtggtccaccccacgtcctccccttcctccactttctcccccatttcccccccaaaaatcggcgccgttcgagccccactcgcccacgtcgccggagctccatccgccggccgttgccgcccgccatggccacgatctccccctccggggcctataaaaatgcaccccgacctcccctcatccgtttccccaactcactgccccctcctgcgcgctctctcgagctccccacgccactcccgtgtgccgccgcacgccgacgaccctccagccgcgcgccgtcgccgcttccgtcgcccccgcactgcgccgctgccacctatagcattgcagcgtcccaccgcaccccggcatccgctccatttcccctccccgcctctgaaacaccgtcgccacgcgcaccacctctctccaccgtctttaccacctccagccgccgcttggcgccgctcctaaccaccccaagcagcgccgccgccgccgctcgcttcgcagcgccgaggagcacctcggccgccgcttttcacggccaggatcccgccgggacacggttcccctcgcgccggtgagcatctgccgcccgttctcacctccgaccagcgattcatgccgctgggaggcctctttccccctcctaacctctcccccatcctccctaggtccttccagccgccgtccgctggttcccgctcgcggaacgccgccgggccgccgttccgccttcgtcccgaggagcgccgacgccgagctccccgcctttccccgccccttgtcgccgcgtccttggtgagctcctcctctccctcctctgtctcccgtgcgcgctgccgcgccggtggccgcctgtcacgcccagaaattcccgagtagaattccaagtagaatgtgcattaaaatccccatccaggaccggccggggtacacaaacgacaatgttgacattcagatccacgtcttacaaacatcataaaagtcttacacaaatgcagcggaagaaaagaaagacgacaggagctacgccttgactagaactgcagcgggaacaccactccacaggcatcctcgacggcacggacgaagcctactcctcggagaaaccttcatctgacacactctcgtactctgggattgggaaaagtagagcaaaactgagtactacccactgtactcagcaagtcataccggaatagaggcatgatgcagggaatcatcaaagaagagctaaagtggttcatttgcataaagcgagcatttataaacagaagttgaaagattaaacagttgtcacatttaattagtattaactatccactgtccaacgttatcccacgttgcaataggcccaaccatccacctaaactatccaaattccaaaagattacactagggtgagactaatcacggtgaatctggttgaccgcccataaccgcgggcacggctattcgaatagttttactctgatcagaggtgtacaactgtacccacaagacacagccccacgacacgttaccgtgcgccgacatgtcaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagcgacagaggccgtcgcagggcccgccccgctccatcacgcccacccttgcctggatgcgtcggctcgaggagagctacactacaagcccagccgttgcccacgctggcttgtggtaagtacgataagttcttccagggcatcccgcgaaccggtccttaactgccatgggtgcgaccagcaaaaccatgcacccacagcccaccatgtgatttattttaattaaccagcatcaaagcggtggcactaatccaacaatctgaacattaataagattttccccattgtgcactagttgaactaagcatggctaagcaatccctagtccaatctctagtcatgttataaccccaagctgacaaagggacatggtacaacaatagcatggctatgacaataggtaaacaccccatagtaacattataaaacaatgcaatatttgaaggaaaaaaatagagcatttgcaatataggatcaacatgttcaagtgacaagcatgacttgccttgctctgctgctggaggaacctcggcgactatttcgaagtacaccggagcgtcggaggaaccggaatctagcgacatacaaggcaaacattgcaaacaggctataagactactgaaacagagaacaaaaccatttttaaaggattctacacaattttcttgatttactgagacttgaatgggcttaaacggagctcggatgaattagttatgaattttagaagattcactgtgtttattactataacaaaaatccttaaatattttattgcgcaatattttcccagggctgacgtcaacac

SEQ ID NO: 68020 - DNA, 26970 bp, Oryza sativa
gagcacccacccgccgccgcgccgtcgccgattcatggccaagttcaacgtggtgcagaagaacaggcgcgagtggaagcaggaccgcaagcgccaggcccatggcgaccccaagaccggcaagctcaagcagcgcacggcgcccgtctccgtctccggcaagcgccagcgcaagctcctgcgccgcctcagccgggtacgcttggttacccccccccccccccgacatctttccccctactcgtgtccttctcgcggcgcagcggcatgctttgtggtagtcgtggggatttcttattttctttgttcttatttggtgggatctggtgttgcaggagcagaaggaggctgtgatggccaaggcgctggagaacaacatgggcgacgtcgagatggtatctgcggaaggtgcgtttgcgatggtcattgctgatttaattcgtttgaaacttgcaagtgattgtgaattgctccacgttctgtacttctattacactgaatagtgatgcttgttgtacaattgggaattagctctattgttgtgcagtgattccatgcaattttacagtaatattggttatgttggtcatggttgcgacttgcagtgatgtcttcttttatgctcattttgattattttgggcccagttgcaatatggcaccatttgtagtcataatttccacctcttgttggtggaagactgacaactaatgtaggcaaaaaaaactttatgcttgtagttacagaggttggaacagctgtttttcacttaaatatagtattgcagacgatgaagataaggaaagtcaggttgttgcgtgacagtgtgagtgaatatggtttattcactagattttcatgatgatggatggttgtttttgtatgtgttgattcagtgtatcaagcaacaccattctgttctgttacgatgaatgaattttactgttgtctaggtgctctaagttgtaatgttgtgaaacttaccaggctatcctagctgtgtagtagtaataatttttatttggctgtatatttactgactgctatttggttgaacgtctgctgttaacacaaggaacttatcattgtacctcacgtggttaaactagtgtttgaataaataaggaaatatgcataacattttcttgtttgcatgaattttggtcaattgttatactcctcttgtttatttttggtgagctataagaaaaaatatatgaaatattatgtttgagaatgacttagtgatggtaagccaaccatcaaggattcttgatagttaatcctaaaggcagatgtctggaataaatttcaaatcaccgttttatatttagtttgatttgccccttttcttgagatttgttggaccttctttatgtgtgtgggttccgaagtttatttcctctggattatattgaactggtgatttgagatgagattctagcatatgttgctcttggtgttagtacgttttattctaggacggccatacaatcgtacactcacacttaacaacttagtctagctagctgtctgctactgctacatgcgtatccattgttttgcattgacacaaggcaaagttatgatagggttctcaggttgttccatactaggaagcaagtgtgagtcagcatgactagagttattagtcctaagttgaccatgttatgcagggtattctgttaccatgtgtttcttcactactactgccatgttatctggatgtgctgtttacataatgatttcgttgccttgtcctctgtttaggcaaccacatgtttatttttataagtatctggtgctaaatgtgacacctgattttgtgttttttgaacaggctcttcagaagctgcaaaggacaagtcacaactgaagtttaatgtgaaaaagaactcaagagtacagatcaaaagattaaaaggcaaaggtgagttattcgtgtttgattgacctgatattttcttcataggagttgatcactctgtttacttatatttagcttttgtcctgttagaagatccattaaagctttgttgtttcattcttcaggcagaaagaaagccaagaatgcaaagccgccgacaaaggacaaagttgacgccatggtggagtgactggatgtggttgataacactcagcttctacattgttgaagggatccgcaaggattgaaaataccatgagctatcaaagcatctttactgtcttaatgtttagtacaagctagttagctttctaatcaatgtatcctactaaatacgatgatcaagacctgagaggttaaatgcatggtttttggaatatttgtatgaaagcctgatttgcatggtttctgcgtatttagtcgtgacatcctgtctgcacttcctttcacgttggacacaattttgatcgatcaatcaagcaaatcacctgactcgcatcagcaggcagcaggggcgagctcatattccaattattacattttcgactccagtaattactatttgctaaaggctcgtcttggctagctcaggatttaaaaaagggaacactctgcattgagtgtttgagaccatgctaaactcttacgttaagctattatcacaattcatattggagtgaacgtaccatcccgtggctggagtcaagcagaattcggtggcacggtatatgctctgaagtctgaactgctacaatcttacaatactgattggaagctgaaaaattcagctcgttttccctgcctgtgcagtcgcagaagtctttcaatattttgtggagaacaggagtagtgtaattatagacaatataataatgttggaacaaattatataagggaagtttctatttgggcctacgtgggctggttcaaaggaagcacattaacaactttccacgatccagtaacacaaggcttgtgtggctgacttgtgggcccgcaaacagctaggcgctcccgccctcccaatggtctaacgcgctcgtcttcggcgcgctcaactcaaaaccacgccgaccgaaaattctcctcttttcccctccccgctgctgctcctcgccctcattttttccgagcacattggtcgccgccttccccaaattaatcaccaccaatccgcgtcctctccccctcccccaccggaggcgccaccaccgcggcgaggaaattgcggcaacgcgtgtagcggcgcctgcgcctcctgccgccgtcgtcgtcccgttccccgccatcgccatcgcgccgcaggtatgggccgtctcgcgcctatgcctctaccgcacttcatcctgccagaaaaccctaaccctagtgccgccgaccagttgcgtatggatcggcgaccagccgcacgcgtgtcacgcccagaaattcacgaaccagaatttctaagctgaatgtgcattaaacccctgtccagaaccagccagggtacacaaacgacaattgttgacatacagatccacgtcttacaaaagtataaaagattacaaatgcagcggaaaagataaaagcgagctaagcctgaagacttgactcctgcagcgggcgattccattccacaggcatccttgacggcagcggcgaaaccaacttcttcgaaacatctccaactgagaaaaacttcaactctagtgtgggggaaaagagagcaagactgagtactacccagtgtactcagcaagtcatactggaagagaagttatgatgcaggatatatccaagggaggctaaaggttcttttgcataaagctagcatttaaaagcagtagttgaaagcagtaaaacagttgtagtaattaatcaatattaaccaatcactgtcaaacgctacactacgttgcaacaggcccaaccaaccacttgaactacaccagttcattagctaactaggggtgagacaatcacggtgaatctggtggaccgcccataaccgtgggcacggctattcgaatagtcttactcatatcagaggtgtacaactgtacccacaagacacagccccacaacacatttcgtgcgccgacatgccaccacgacatactggaaagaggccgtgacaggacccttcgcataaccccctctaactaatcacaccacacctcgggtttcacccccactcctcgcaaggcagcgggcagtcccccctcgtgccacggtgaatccggaagccgatcaaccggacacgctggccgacccacgcgccagcaactcgcgatccctccccgcttccttgccatcgccgccgcccgccgctgcctgggccgcctagatatgggctgtcccgcgcgcctatgcctctaccgtacttcacctcgttgcaaaaacctaaccctagctagcgcggtctaccagtcaactacgaaaggatcgaaggatcggccaccagcctcgccagcaactcacaagtcctctccgccgcttcctcatgttcaaggccatccccgatgtgcaaggtatttggccggtatctctcttctgaattctaattaccgaatccgcttgaggctttttcgatttgatcgggtctggaaacatgaagcgattatgcgatttagaaatgttgatccatgcacaaatgattgttgcaacttaggtggtgaattatacctctcccaagctataggtggataaatttgcatttgtacataagaggaataggggggagtttggtttctggattattcaccgcttcgtgttgtgttcatccgtacgagtttcatactatctccgtgcgtcgcaattaattagtcggtcttgctatgctgatatggatgtcgctcattctcctgtctgtctcttgctttccctgctgagtttgttagctgtttcatattccaaattgcctttatcttattatttgatcacattttcatttcctactatcgatcgaactattttgtttcctctagtaaccatttaatagatttggagaatatgtgtatcttattaatcgatgtttttgtgattgtgcatagatcttccccaactatctttctctgattaagtaacctcgatactgagcttgtgagatcactcggacgattccactttttttttttaaaaaaaataaacaaatgcagaagctctgtttcattcattctcttagattccacgtttcggtttatcccgaatccgagttccatttttatagccatgagctttttcgttgttacaaaaggatccacaagaattataaatgttttcagcttgaatcattgtttgaatttgctctgataagcttcaatcatttcagcttggtcttaaaatgaaatttcatcatttattcgcttgtggtgaagaggctaatgattgcaacccaatccacccaacttcaacaccaacagttatctatgtccaagtgccagggtatctatcccagaagaaaagggtgtctggacaaaatctgattgtttcaaaggtccagaaagttcttcctgaggaatcaagaataaagtcagatgctacaataaaatgggcacttcagcttcatagtgctggctattctcttagtggaaaatttcaggcctctgatctctgtgtcgatccatcaacagaattaagtgtttagtcacaaagagtgctgcttaagaaagcaactatgaagaacaaaaggaaggattttaaaagattgaggctaattatcaagcaagacatccttggaatcaaatgtgaagctgacctcccaaatgatgtcaaattgctattggaccttcttaaagactatcatgctagtgactaggtattaattgctcatcacccggggttgatgaatgaagataacaagatttctactatattccacataatattcactgaacttgaagctctaatggtaacagatgccgtgaagtatcagcgcatcatctctgctttggcttcgctgtatggaaatggttgctggaaaccttacgcctattgcaacaagcatgtcaagggagtttttgttgacggctgttaaatacaaaattctcgccgtcaatacctgcataaaaccataaaagtaaaacatccaatatagtgataggatttatttctaaccatttccacaaatgttggtgtatattcgtatgcaggtaatcaactaccaaagatgggaaagaatgagcatgaagaatacaaatatattttgtgctgatggacccacaaggttttgagctacagcatataaaatgtgcaatcattttgagccaaaacatggtgtaccataaagtggggcccacatgttagcattctgaagaaggatatgggccaggggagccggccacagttggaccgaacccccagctggcccaatccagcccaacttcggcatgatagttgtacttctcatcctatgacggttgtggccgttaataccggtggaaaccgtcatcaaaagagacacttggcaagagaaggatgaatatgctatttggattctatggagaatattccttagcatctccactctctcaagtcacctccacactataaatatccctctcctctccctcattcacacacactccaagcttgagctgaattataagaggctctattgtactactttgtatactagaattagaaagagagtagagtagaagaacttggaggaattccggagttctcggtaatcctctcctatttcttttattctgttaattactctattttcaatagaaatatcttcctgagtaatttagatttacttgcaagaattatctattggttagttcctaatcagcatacgagattattgttcactataatcaactaaattataataattgctttagtgagttataaacactagagtagatattaattgcttacatatggtgtttaggtaatttatatctagtaattgttgtgtatcccacaatgcgtaggtggtaacagccctcaagagcacttaagtccttcctgttcgggtacgtagtagagcgacatttgggaacaacgggttgccagtgcctgaagtattgcgctaggattaaaattaagctttccttggacactgtttctcactagaaaatcgtctctattattggctaactttagctttgtgtccttagatgaacatgataagaaagtaatacacattccttgtggaaatcgataactaaaaatactcccgggtgaagtgccacatcggtatcttccatgcgcttgcgaattttatttgaaacgttaagaaataccaacagttttcaccttcaaaaaccgcatgaccaactatgaagattctgctgaagggttttatatctttacagaaactactttcaccatatgataaaggatcactctacgcatgtccaagaggtaaaactgtggtgtttttttgtgcacaaacagatggaacacatgttgggcacaattctcttggggctcatagttcaattgatgatggagctacccaaatagtcagttctgggtagcatattttgatgaaggaatgaagctgataaacaatggttcaattgagtaattgccaccacgctcggattttgcgtactaccttttgtcaacttaactctgtagaaagaatgattgtacggtttaaagataacattatttgtttacatagatatgtacatagaaattacagaaaattgctttgacactgggctaattaagaatgattgtacggttcaaagagaacatcattcgtttacagtgatatgtacatagaaatacagttacagaaaattgctttgacgctaggctaattattttggtagtcattttttgcttagcagtagggtcctctttacttaaaggttcggattaaaaaggattaatggcaaacttgtttgcttgtcctgatacagcctcttttaactatgatatttatttcttctgttactggtctgtatttgcgaactaccttgtacttattgttggtttttgtacatctgcaaaactatgcagcctgtagtttggctactaatctttgagtatactgttctagttacaattggtggtgtgatatgctctcatgatcaacagctatacaggttgtgatattactgcatggtggatattgtttgctagtttctaggagtacttgatttgatacaaacaaagcccactttaggtatcgtggcgaatggctgtattaaagtgcgaatcatgtgtcctgagaccttacgttaccagatccggcctgcacttaattggaattgtattatttctttcgattattctggcttaaggattcccgtattaattgggttacttctatcttctcttccaatgctttgttttgatgtagctctgtacatgctttcagtcaacaactaaatttgtgagtgcctgtacattctgcatgtattcagttagctcaactaaagatataacttattctgtgcacgttcatagggttgtgtcattgtgtgcatctcagctcttcattcatcctcatttgtactagttacgtgcttctcaccagctcggcaacaatgggacacatcaggaaaagacaatagaataatctatgatagaatatttcatgttatgcacggtttcgatttcagagcatcagatgcaaacctaacaggccggacacatgtcaacatgctatgatcggttttcaccatagaatcagcacaaaaatctgcatttgttaagatagtgactgctcataggcattttggcagggaaactgtgatatgatggaaatgagatctttctacaaagcataccgtttcaaagtcaaattacaccggtttcagttaaaaaaaatcagattattacattatattgcaacaaatagtgcacaatgtttcaaaacaatggacacagaaaatactttcatgaagtcactgttcaaaatttcaaatataccatgtttgttcatcgctacaatttttccaaacttgcttacagccacagttatcaggtaatgctattaaggcaaggatttgatgaaattaacaataagatagatgtgggcatcaaaagaagggcctccaaatggatgttggcaccttctttaatcaactgtgtatcaaacccgtctggattcatagacttgagtatgactacgtcatcatgatgcctgccgagtaggattgaggacatcagaccacattatgggtactcaacaggccaatactaacataaccagtcatctgttcagccttatcatctgcagatattggaattggtgcccctgcatcaggaagttacagttagatgcatgcccaaacatgatctaacagctgtaacaatggctgaagaaaactgaatggataactacattatattcatccttcgatgcaaacagaaactatttcattggtctccagtcactaattcagtaacagttgcagtggacatggttgacataataaaatcttgatagtgttaagcaagacaaaaaggacaccacattattcagtactcatgagccactaagttttaggctagattaagaatgatgtagtaacatgtatagcacatccaagcgactttacatttcctacaaggggggatttactgaaagatagtgttgctaagctaacaaagaatatatatctttttccattagattttcttatggagtggctcactgatgttcagattccaaagccctaaaaaattagataaaacctagcactaattccagattctacgcatgaagtatctaaagtggatagaccgaaatagcaaaatgccacatcatttggaattattccattgtgaaaatgatagatccacaatcccacaaggctgaaaaaagcctttgcaatcacacgttctaaaagaagtagaagattcaagtacatgaaagatagcatacaagtagaactaataattcagtgcaaaaggttgtctagcagaaaattacacatgtaaattaacaaaaaaaaaactcccttttactcataattgtctaactttggcaggcccttactaatataactgtggtggcctcaggttccgttgtgccaactttaggtggcaatccaaacatgcccttactctatcaaatcaaataaatgagcatgtacaccaagtatgtataccaagcacgaagggagatattatctttgagatcacaggcagagaacgctccctttgagattgaagccttttattgacttccacctacaatttagctaccttttgcttcctaagctgctcatggaacttgttggttagtgacaatctgtcaatcggacaacacaggagcaagataattgtagaattcattttgtaatatcaagttagaaagatcacacccatgcaaccacatgataaagtggtagctatattacggcatacatccaaaacgccataggactctttagatgatcatcgtaaaccgttgcaatttcaggcagttgataggatccaatgtggtggcattttgcaattcgcagatcttcgtgcttgtcatacttgggagagaaagtagttatccgaagcagataacgaatgcgttgaggcaggaactccttccaaatgtccccttggtgattgtcaatcgatagatactgcacgaggcagaccatactcctgtcaccacccatatgcacaagggttgcgccaatgtgtttctccgcggtgtccacgcaaaacagcctctccttactgagcttacaagctgggggctgcccatcatcgttgtcagctgataaaacataacaggcacagatgtggccaagggtgtccggatcacaggacaacccaacctaagcatccaggtcatggtcatagtagccacgacctttgaacggcaacgcccatgcaccatgctgcgtccaccgggagctctccaagtcaaaggagaaggtggcaagaaggccggtgcgcttcttcatggaatacttcgtcatgctgaagaccatggtccgttggtcagggtgcacgccatgagagatcacattgtggaatggtggcgatggaagcgtgcaccatgaccagtcgaacttgaccttgacgcctacagcaggtccattatctcgcggtggtggtggctcacgaagcatctcgaagatgccttcgtcgatgatgaagagcttcccatccacctgcacgtaggcacaacagaatgggctggtctctgagtcacaccgaggtgaggaggtgagagtgacactctcagcataatgggctggctctcagcataatgacgctcgtcggaataggcttgcgtggcggcgtggacaacccattcaataggggaccaagcataatagtcgagcagtcgtgggctcacctatcgagggtagaccatggaggaagaggactatgatagagcttgatggtgtcgtgatgaggaaaaggaacacattgacaggaagcgaaggacctcgccagaacttatggaggaagtggaggaccatgatagagcttgagaaggaagaggaacacattgatgatgagcttgtccatgcaagaaacaactatgacatatagctattgctgggaaagaaggggtcatggtaggctgagggtcaaggatggatgtttttcttatggtgaatcacaccttattttcatcactatacacgcacacatttgcagtactagttacggtcacttgacatagtgctacattatttctgtcctcaacaataaacaatgcacattttctcgttcggaagtgtcgggatcgaggtccaatctcacccacccaaaatgcttgaagtcagcagtccatactttgccgtttatatgacatatgctcaatctaaagacggataaatcattgaatacctgagcatcatgccagcccacctaaaatacttaaaatcgaccattttctccatgatgctagttgatgatttagcacttctaaatggagaatatgtcatcctaacccatacattacgaattcagagaagaatctcacatatcactatgaattcatgataaatgagaatctaaaaatgacaaatcatcatttttctcatgcagttcaggaaggaaaccacaaaagcggcatagacgttccccttgcgagccatatactatgcatgcgaaagattttattattttttaaagatttcataaaaccccatatttattgtcaaatttgtgcaaaaccgctgatattttgtcttgtgtctcataaccatatattttatggtctaaatgtttcataaaacaccatctttatttaaatttcagttgaattcaatatatctaaaacaatatattttaaaatggtaaatagttaaaccgacaacctcaatcaagcaatcaacaactaaatgtttcatatacacgttatatattttatgtttaaaatttttagtaaatacttgacaacaactccctccgaaaaaaaaggagataaactctaactatctgatacagcagctagagtttactttttttttctttaagaacggatggagtatatatatatatatataagggtggggggttttcaaaactttaaagtgttaggtgccgctggttataatacctgtggttttatatgcaacttgcatcataattcataatgagtggggtttatcgaaatttcgctctattttgaacgaaccgagcaaataattcgtgattcgagcaaatataaatagacagaaacacccgcctttcctttccttgcgcgcactccctcctcccacccaccttccccccttctccccttccccctcacacctttcgccttcacctacacacaccggaatccgagatcccggtgaccgcgtctcgcacgcgtccccctcccttccccgccgccggatccagcccccgcgcgctcgccggagtcgccgccgagctaaaccgcgcacccgtcccccgcccccgcccaggccgagcccccgggtctccgcgcgcacgtgggggggacggcgccgacgccgacgccgcgccagatctgagagatccgcaccgacgccccccatcctcgccttccccgaggcgtcacgccagatcccccagatctggaatggtggtggtgttgttgctgctgctgctgccgtaggtatgcttaggtgagtccgtgatcctcgggactcggtcgccgcggcccgcgggtagtgggagggaggcaaacctcgtcgtcggcggcggcggcgtgaggtgctgcggagaggtggtcggggaaggaagatgcagcggaacggggtggtggaatgcagcgtgtgccggtcgcggctggtggtgccgagcccgcggagcgtgtccagggcgtacgacaagcaccgcagcaagatatcgtccaagttccgcgcgctcaacgtcctgctcgtcgtcggggactgcatccttgtcggcctccaggtgtggcttcaccctccttgtagctatatatttcattcaagtatccaaccgctaggtgtctgtgttacatgtttagccaatcccaaatactcggtagtttggtgaaatggtctgacgaaaattcctgtttatgcttaataatcatcctgagcctggagagctgtactaatgatttgctttgtatctgcagcccatcctagtgttcatgtcaaaggttgatgggaagtttcagttcagtcccatcagcgttaactttttgacggaggttacaaaagttgtctttgctatcgtgatgctaataatccaggtgtgtacttttgctgatgtttcttggtgtgcttgcattctgatgatgagtaatttaacccctataaaatgatatgtagagtacacttatagtttgtcttgatggctttggattggtaaaatactctgttagttcattagatcacttgtactcttacatgagcagcctactgaattcttctggtacaattcttctgcgtccaatttcttatagtacattcgtgtatcagaagtgattgcacatttaaaaaaaatggaaggagcagcaaatttgtgctaatcttccaaattgataagctcaactaatgcagaactaaagatcacaacaacagcctttcaagatgtgaaagcagtttcggttgatattctatgtgctacctgcacttcattatctttatgcgcaatttagcttgtcagcatgttcactgttccttgaaaatttgaagtcctacagattcgcaattgctatgctgcaacagatgtacattttatgccttctatatactttccattatgatcctacctcttacttgtttaccttctcgatgctgctttctgtgtggcagtctagaaagcaaaaggttggcgaaaaaccacttctggcacgttcaaccttcatccaggtgatttgttttctgctttcatgacttatatgaaccaccagtagaacttttttacatactcatttttaaataccttttttctttaccaataatttgtttccgctacctatgttctaacataatactgcttgttgcatgtctttttgtgacattgtctgatcatctgactctccatcattttcatatgtaggcagcccgtaataatgcactactagcggttccggcccttctgtatgccatcaacaattacctaaaatttatcatgcaggtgaatctgaagccatagttgtcgcccttctatatacccctctattgtcatcatccatgaatatatatttttatgttgtctgacatttttgagctgattatgcagctgtacttcaatccgtcaactgtgaaaatgctaagcaacctaaaggtacatattttatgcactactcaggtgttgtgcttttcttattagtgtgtatacgcatatatcataccttttgtaatccaaatttctctaggtgctggtcattgctgttcttctgaaatttataatgaaaaggagattctccgtaattcaggtaagcttgaggttgtgttgcagttatttctgactttatatatataggttgcattttgggggtaaatataaccaaatttttgtgctatataccatctgttagtcttctaccactatagtgcaatttaaagattactgggtcatgtgttcactgctttgtgttacatatcctctatagaatcatattgccagtattcggctactttgtacatagagatgctttaggagtattagtaaactcttaaataaaatcaagtgtgagagaattttgtaagtgattttgcatagtaaagctgagtctcaataaagctagcagtgatagtgaatgtttgtctattgtctttgtgtcagtttccactggtcttatggtatgtttcaaataagtctgcatcacaatgctaggttcaacttgtactttactagaattgccatgttttatcatttaatgttgatgaccataatcttcaatctggattacttgtaactcactatgttactgaggtatattacatgacaaagtgccttttgcatagctcttacgcaacattctagcatcatcaatcatgctgattttctcctgctctcttgccccccttaattttgtcagtgggaagctcttgctctacttcttattggaatcagcatcaatcaacttcgtactgtaccagcgggcaatactgcatttggccttcctgtcactgctattgcgtacatatacacactgatttttgtaagtagcttccacaccatttgacctcttaggatttccattttctttcacttcattttctcagctctctcaacagacaatatgctttaaaattatttatattctcttgcaactgtgcattgtaggtaactgttccatcattggcttctgtctacaatgaatatgccttgaaaagccaatatgatactagtatatatcttcaggtaaattacgtagtattggaaatttattgagtaatgatctttattcttctatccaactatctacttatttcgtattagctattttgtttagttgtccaagattgtattttgtagtataaggcatatgatgattcttttttttatccgcattattcttgtcttttgtttgcttcactgttctttttatatactttgcagaatttgtttttatatggatatggtgcaatattcaacttccttggcattcttgggactgccttattccaaggtacaattattttttttggagtgttatcatgcatgatcaatatttttatcagtaatcagcgtcagattctacaataagacaaccattaactgtcttatgtggtcatattcatataatctttagtgaacgccatgttgtctaatgttttgacaatcaaagcaccatttctttgacataatcatctcctgtctatttgcagggccagagagtttcaatattcttcgaggacattcaagggctacgatgtttctcatatgtaataatgctgcgcaaggcattctttcttcattcttcttcaagtatgcaggtaaattccgtgcgtacttttttttagtttcctgtgtaaacactatcatttgctgttccgcctatattattctataaatttatatcttcaaattgttaatgttataatcaatttgcagacacaattttgaagaagtattcgtcaactgttgcaacaatttttactggtctagcttctgctgccttcttggggcataccctgaccattaattttctactgggcatatcagttgtgtttatttcaatgcaccaggtgagtttgcctgcttaactaaatttcattgagacgacattttttgtcttccatatacataactgctatctgttctcagttcttctctccactcgctaaagccaaagatgacaaaccagctgaattgttagagttggaagatacacagaatcatcggtacgtttctaccttgttttaaatggttggatcatggtacttgttgccatatttttttggttttcaccttcgttctaatcaacaaatgacaaacaaggttatagtgactttaatatgtactgtgcatctagatatgtgctaatttccaaatatttcttgctgcattacctcataagatacatattatgttgcaggtcatctgaatcttcttttgtaaatatgactgctggcgctgctgaagatgtatgtgactcatttatttctaaagaaaaaaagattaatttgtgttagaacaattacattattagttgcacattatcatttcaggccagccataggattggaactgatgagaggcaaccactattgccaacatgaagtatttttttgaggtacgcatggcttctttaaccagaacttttagtttggttgatgtggcttgtttgctttagtgactagtaatatggcacaagctaagatatgaaattatggacaagtaaacagagacgtgcttgtgcccacaaactggtggatagaataactagattgatttgcgggaattaggcagagacagactctccgcatagattaatagcggcatcaaatgtgtgacctgaatatctgatataaaaccgaagctcccattgtttgggtattgggtcataagttttaagaccaaagtgacctgataaattttacctgtaagttagtctgatatgggttccagaattagctttttgttcctaaaatggaaggaaatcatgaaatagtcagataccttgtgggtgtgatactttatctaattcatctgtccagaactaagtttctgaaaatgtatgttcttttgtttctgcaggtagtgtagaggacaattctttttgccatccaacttggaggcagcagagtttatatagcgtggcgagtgaaataaactattgtacactgtaaaggcaaagaaagaaacatcgatgtatttttcccctttgtcatttttattatcttttgtgatagggagggttgtcagctgtggcctaacgagtgtggcacaacattttttggataggcaaattccacatgaatccccagatacgatactagtataaagcaattttttccctggatatgtatactcaaatgtatcaatgagttactgttgttatatggaacttttgtactatcacactggtgttacatattgaaactagtcggttctagacttaccatggtagctatgaatggccttgagccatctcttcaccattgcatggtctgtcttttgtgcctgttctgcctggagagctggataaagattgcatataatggagatccaacaagcatttgcatagaagcgaggacttctccgtctaatttatgctcaataaacttatctgtggtgcttgctattcatcagtcgtcacatctgaaattttctcgtccttggttgcccggaccattcccccgggcacatggcgctgatcacactcaatactgtggatattgttcataggcctaagattgtgagcggatggtgcatatttctcctaacgcaacctctgcattttgtactctatccatttgcttcaactcgccaactcgcattgccatctagcttgtgatcctacgcaagcgcgcgaggcttggtgtccagtccgaatccgaaccaatcctactcggatttttgggagagtccgattcgaatcttactcggagacggtatcagccatcgggccataaaagggcgggaacgatcggcgcgcgcgcccttttgtcctgtctcgatcctgcattcccgccacacgttcttggcttcttgctccgccaccaccaggcgagagcgagcgagaactctcgagatcttcgtcaccaccaccgtccccggcgatggaggagatcatcggccgctcctccccgcgcggccacggcggctccggttccctcctcaggaagcggtgccggtcggagatggaggcggtgcgaggcctcctcaagaaggcggaggcgctggtgcgcaaggcggcggcgggggcggcggcgcgccgcccgctccctcgccgcgtcaaggacaaggaggccatgaccatggcccagaaggagcagctggtcggcctcctgtcgtcgctgccggcggggatcctcccgtcgcacgtcgccgacttcatgcggcgccggtgcagctggcgcgcggttcccggcgttgacggcgacgacgacgagctggagatcgatctcggctccacggaagacgccgcgctgttcgagctgaggaagatgctcgacgacgaggccgccgttcgccgcacgtcgccccgcggactcgaggacggcgaggtcgccgatgagtacatggacatctgcggcggcgtctctcccctgccggcggcggcgcgcaagcctcctcctctcgccttatcatcaccacctgcagccgcagagcaagaagacgatctcatcgacatctttggcggcgactctcctctaccggcgcacgaggatctcctcgacgcgtcgccgctcgtcaagccagaagccgacgagttcgtcgacatcgacggcgacacaatcgacaagtcgccaggaaatcctagctcaaccaccaccggttcgagcagcggcaacgcctccggatcatcaagcacatccgcctcctcttcaggcagcgactccgactccgacggcggcggcgtcggcgacaccgcgagcagcaacccaaacacagcaaaccatctccccgtcgtcgtcgtcgaagctgtggccaccaaaccattggagccgcagccgccgcaggtcgccgaacaagcttacaagatgggggagaagctgacccggagccggagagaagcagctccagctccggctccggccggtcggatgagcgagctcatcgccagagcgcaagcggagaggctccgccgcgacgccgagaggaagagggcgcgcgaggaacaaccacgttgatcgggatcactcatcggagtagagggcatcgtacggagaaattccggcggccggccaagccgcggcgtcggcttcttgatgagcggcaactcggattcatcaatgctgtactctgcaggtcctgcagattgtcatactgtcacattaggaacttgtactgatgatcaaagagatgatcatccatataccatagtgttgtactctgtaggtcgtagttgtaaaatcttcttttaatatatatatcgatggagatggattctaatagctggagtggacgtccactcgtttattgcatgtcaactaaatggttatgaaaaatttttcaaaaaaaaaaataccaagatagatcaatatgtaatatatcactccaaaaacatgcaagttcaaattcaacttctacaagttgtaacaaaaacaataaatttaattgtaaatatacatataataatttgagttttgtttgttatttttgttacaacttgtagaagttaaattttaacttgcatgtttgtggattgatatattacatattgatttatcttgctcatatttttttaatttttttataaccatttagatgacatgtaataaacgggtggacgtccactcgagctgttgaaatagtttcccatatatcgatgtgcaaagcttttgcacgtttataaaaaagatctcttaattacttcctccgtttcatattataaatcgttttgaatttagtcaaacctttttagatttgattgttttatggaaaaaattagcaatatctaccatactaaattagtttcactaaatgtaacattgaatatattttgatattatgtttaatttgtgttgaaaatattactttattttcaatcagtttgatcaaacttaaaaatatttaactagtaaaaaaagtcaaaacgacttataatattataatatgaagtggacggagtattgttctcacgtttgtaagagtcgagcaatttgatgtgtccggtcatctggtgtatataaagatttaatctttgcagccatttcgtgctgtaatctgcgttgttaggagcatgtgctatttttcagacaatgattacgcgagccaatttgtgcattgaaaatttagaactgaaccaaacaattttatactctgtatccgtaggctccgagcttgaggcacattggaaactttgtactgatcatgtgtttcaacactattgttgcttaatttgggaaacggattctaatctcgacagatatatatcctcgtgtacctttgtgtgcaaatagttgtaaataattacattgaatgacctccttcggtcattccggtaaaaaaaaaagttgtaaatgtatattttttaaaaatatatagcaacatttatcattccactaaaaatcaattcaaattcaatatacagttgttcatttatttctcaatgtgtgagttgagtttggaacttaaattgcatgttgcaaaaaaaaatgtcaaaatttttaaaggatttttttatagtttttaacgggaatatcctcgagagatcagcgtagtttcatcttaatccactagcaaatcagcaaaatacttttaaactcttgagggaaatgtctaattgtttgctcaaacaccatgcaaatagttataaagaaaatctcaaaatatttgacaacatttattcaatatatatacaccactccacaaaaccttaggcctaaactcaactcacacctcaagaaattaaaaataaaaaaaataacgtatgaacaaatatagttcaaatttgtcttttttacttctaaatgtgtagattgagtttaaagtttatttttagtggaatgatagttattactccatccgtttaataatgcgtgggcaatgctagaaagtcttacgttacgaaacggaggaagtactactctacattgtcaaattattttagattttttcataacaatttaaattaaatttaagagataacactacactccttcgagattttagaatccattcccgccaaatcgatgtgctaggaatgcgtgtagtgtgtttgcttgctatgatacgaattgtgtcaaacaatatttttctttgtctcaatcatatggccagtcattcatatgtgcttgacaagaatatggctacagaaaatcttcagatgagactccaagctccaggactgatccaattttggggatcccagcttatctgtagcagtacgtgaaacatagacacttaagcagcacccaaaccaaagcatgcagaaatcaaaatacgggcatcaaagtatatatatggtgttacgtctgtttgtatgtgcgtgtgtgtgcatcttccgtgtaattgtaaagaaaaatttaaatctgaacatgtcggggtttttgaaaaatagaaaatccaagtagggatgaaaacggcgcgagtatttcctgaccgctggcctgacccgagacttgcaggaagaatatgggagacaaaatgggatgctcgatattatcttagtgttgtatctgaattcgtaaaataatatgggttaggatataggaagagttgtatcttcccatatatcccatattatgaaatttgtataaaattctattataaattcacctataaacatgatgaaatattggttagtaactattttgcgagttcacgtataatattgtacaatttgctccttgatatatctcgtcttcttatattaaatatttatcaattagagatacaaatagatagtatccgtttccgaatccaattcggaggaaataatatgggatgagtgaaattttacccgatactacctataaccaattctgaatttgaaggaaaatatgagttaggatatatgaataccatgatccgattgtgcggctcgttttcaccccaaaatccaagaaataccatggacaaacatccaagtcgaagaaatgtcatcgacgaatgcgagttacataaaatgccatcatacaagcgattttacccccaaaatatcgtcgtcattagggttccgttcatcctataacaattaacggaaaactgctaaccgaaccctaacgctgatgacatttctaggatgaagtcgtttatacgataacatttcattaaactcgtacttatcatttattggaataagacgtttatcaatgatattttttggattttctttttttttaaaaaacaaagtcaaatctgaacatgcaaaatccgtatcaacatcaacagggaggttagcacagacctctgaataagtagcatgatcgtaaaaccaaaaactgcatcatgccaatgtttttagtgccagccaaagctgaacttgcaaaatccaaaatacagtagttctaaaaccgaaccctgcatgcatgcctgcagcaaaccaatgcacagttcatatgcaagtcaacatgtcctctgaattctttcgagagtgctataaccaacctatcgctaacggttttgatatgaaaatttttcaaatcaatcggccgaaacactcgcactttcaatcctccctctcgattgtaacattttggatccttttgcagccactcgagagctacaaatgacaggttcaattttgtcaggcaccaaaattttgtcagacaacacattgaaacgtgtgacgatcagttcgttataaacctgggacgaaattcccgcgctcgccgcatgcacgctcgccatgtcacgcgccacgcatgcggattccgaactaagggcctatttggtacagctccaacttttaaatataactccaggagttgtctgtagtgaagttgtggagctgcctaaacccagctccacaactctagtatattttgtgagagagctccacccaactccactcccaattttggtggagctgaaactgtttggctgagctccagctccaagaggggtggagttggagctggagctgtgccaaacaggccctaagtacgcgcttagttaaaaatcaacatcatcttggcttagtagttagcacgcgcgcttaaccctaatcaaatcggagtcggattaacacccatgacatgcacgataaaaggcgagaggcaccatgcatcgtccccgcgccacgccacctgcacgagcgtacgtgcaaactttcttccagccgccgcctctcgctctccctctcacttccgttgagacctcgccggacttcttgctgctgctgatcacacgcacgcagcgctcccaggtcccagcaatgtttgggccttactccggcggcggcggcgttccgcttccgcagatggatgctgacacctacgtccgcaccatcgccgccatgcctccgcatccgcttgcaccgccaccggactccccccgtacccctcacacctacgtcggcttcctccccgtcttcggtgatcttccaccgctcaccggcgccgtcctccaggagcccgtgccggtgccacccgagcagcgcgccgatcagccggtggccgtggccaccgagaactcggcgccgacacggccgcagctgtgcgcgccctacgacgacgaggtcgaggccaccctccgtgccatggagacgaaccccgcggagcggccgtcgccgtacttcttggagacgactcagggtgggcggatgagcgctttggtgcgcgcctcgatgatcgccttcatgggcgagttcagccggaaaaacaagctcgccgacggcacgctccagcgcgccgcctacttcctggaccgctacctgtcggtgacgcccgagtcggacgacgcgctgcagctccgccttgtcggggccacggccgtgttcctcgctgccaagtacgaggaccagtacaccctgaggaagatcgacgccagcatggtcgccgcccggtgcggctacaccagcgagacgaggcacaagatggtgtcgatcatggagaccgagatgctcgccgcgctgggcttcaacctcggcggcccgacggcgtacacgttcgtggagcacttcacgaggtactacggcgacggagaagaagagaagcagttgaaggaggcggcgcatcgggtcgccgacgggacgctgctgacgtacgggttccaccgctacctgccgtccatggtggcggcgtcgtcgatcttcctggcgaggctgcacgagctggggcatgagccgtggagcaatgatctcgcggagctgacaggttacaaggccatcgacttgatggggtgcgtgtgcgacatatacagtcaaattgcatgtcctcgctttgctcttttgcaagagtacttcttcgaggatccatagcccatgtataggaagaacaaaagagtctgtaaaagcacaagcatgcaaggcatgaatatgatggcttaaattttgcactgttgcctgtacattgatctgtaaactcaaaattgtgcgtgttatttggttgaaatatatgtgattcatcaattcaaatttataattactagcttttagtactctgatctctctacaattatggcccaaccgtggattcgtggagcacttcacccggtataacagccggggagaggaagagctacgggtgcagcggctggagcgcgacatcgccgaccagtcactgatgaactacggctgcccgcgggctacctgccgtccatgaaggcggcggccggcggcgtcgatcttcatcgcgaggtgttcgctgaaccggcccgaccggtctggactctggagcacggagctgcaggagctgacgggtacagctccgaggacctcgttaactgcatcgatcctcgccatgtagaacgtagtgatcgatgaggacaccggtaggagcagagatctcttgtaaacatgttctgttgattgttcatggttgccatgcaatgcaacttgattgaggttttttttggccccctcagcaagatcctaactagagagtctttgtaaatatggcaaggaggttgtcttcatttttttttctcgaacacgtaaaagacttatgttataaaaccggtccgagatcattatcgaaaaccaaacgagaaagaaacatcataggagatccaaacacgatgacgatactgaaacacgatatttgtttacgagattcagcagtaccctacatcccagggcgctgattacgggcactcctctctgatccaacatattacgacgtattcgagttaaaatgaccctcggccggacgtcgtcggcagccgctccctctcgctatgttaagtcgtcatatcaccatgcggttacaacatttctgctcctctatttaagagaaatcatatgatagagtcgactattgctctgttcctctattttatgtatgccttttatttttctccagtgtcatttcacacattttttatagctcttttctttcatggaactgttgaattgtttatttttacacttcaattggaaatttggaatatttgctccctcagcaggtttacagggcgctgttatacgaaagaagcaagcacatcttgtgtggtaaactggtaatcattagaggaaattagatcattgttggaatttcacagctagccatttaagagaaaaaggtcatagagcatttcagattaattggatgatttggaattcaaaagaattcctcttagcgacttagcccaagatttatgagaaaatttgatccatagcacaggaaaaaacacggtaccaaaaattagcacaacaaatttttcacttcgaccagaaacacaggagaccaattttccttcgatacatagcacttcccttgtattttaagctaatggttttagtttgcagtagaaaaaattatcctcggactaatttacccttcgaccatgtcatctcgtcgttgcagccccgtgcggagcagctactgtgccatgcgcggtcgagcaaggagccaccgtcgtcgcctcgccgtgcctcgcagccatcgcatggaccaaccgcgcacggtcgaaccaccctccagccatcgccgtcgtcgcctcgccacacctcgcaagcagtcgccgccaccgccgccgccgtaaaccaagtcgcctcgcttcgcagccgcacgcggtcgacccacctgtgaggccgtcgtcgtcgttagaggtgatgctgaggccgatgacccaatgggcggagacggagctggtggtgccattgggagcgtggacaaaggggattcggtggctggcggagaagccgatggtggagaccccggctggctccgacgcgtctcgctgtccaccaaagccagcggccgcctcaacgtgtcagcccgagcacttgcctcccttggccacgtgcgcgctggagtcaccgccgcctcgcgctgtagcggccccctccaccgccgaagccggagggccttgctagatccggcgacggcagcgccggatctgccgccggctagccgggagacctcgctgccaccactcaccgacaccggcgaacg

SEQ ID NO: 68021 - DNA, 4816 bp, Oryza sativa
tatgtgtgtatgacaggttgatatgatggaaaaatactgaagtttagatccatactttggatctaaacacagcccaagttaaaattgctgtgctcgtaacaaggccaggtgtagatccaagagctctgctgccagttgcttttccagtctggttacctttcatggaactgatttaggccctgtttacatcccacccaaaaattttcaccatgtcacatcgaacgtttaaacacatgcataaagtattaaatataggctaaaaaaatgactaattgcacagattacgactaatttgcgagacgaatcttttaagcctaattgctccatgacttgacaatgttgtgctacagtaaacatttgctaatagaagattaattaggcttaataaattcatctcgcggtttactgacggattctataattagtttttttattagtgcccgaacacctcatgcgacaccctatataataccttatgtgacacgccaaaactttacacctttgaatctaaacacccccttaactgcgaggctagctctctggctgtgcgcttgtgccgaaatcacttcaagttcgtccatgctgctaacaacgttgaagagctctggttgacttgacatagaacatggacacaactacacatggcctctccaagctggccccaaggtacttgacaccgcttcctcccataggattaaaaagagcaatttgatgtagcttatgggttttcagcaagccagcaatatatttttgcctcgttctaaacggcaaatcgccactggtaacgttcagagcagcataaggcaaccaacagcaagacatcaataggagcaggttttgcagctcaaccagtgtagtaaatccatgggtctccatactcccatggcactgtccccctcagcgtccccaaggatgacgctggcatgcccagactctagagttgtttagtcataattagattctcatcgtacagtgtttgttgcatagagaagtttcttgatagttttaagatcctacaattgttaaatatttatatatatcccaaagaaaaatgttgcaaccaccatgtctgatttctgtgtatattattgtttattaaatccaaaattgaagcgttggctgtgtcacatgtgaaaatatgcagagaaagtgcattaacgactgccttggagtgatacagactttgagggacctagggatgcagccataccttcattaagctgcattattttgaggcagacctgggtattgaagtccccaattaaattgtacacttgtactaaggccctgtttagatggggaaaagaaaatttttgggtgtcacatcagatgtttgaccggatgtcggaaggggttttcggacacgaatgagaaaactaatttcataactcgcctagaaaccgtgagacgaatcttttgagcctgattaagccgtcattagcacatatgggttactgtagcacttatggctaatcatggactaattaggctcaaaagattcgtctcgcgatatccatgcaaactgtgcaattagtttttgtttttatctatatttaatgctccatgcatgtatccaaagatttgatgtgacgtttttgggggaaaaaaattttgagaactaaaccaagcctgaatagattcatacggttttgttgaaaaagttcgtgtaattggaatgggaaaatagcagttcagtccaaattgcttccttgaaactaaatttatgaattatctatatttatttagtagttttaactacatggattccacacaagcagtgcaggtagtagtactaaactagtaacatgttttgatctgttaaactgctataaagactagctctaattctgtaccacgagatgtttgatatatatttgaggtcattcagggagaagcaaattgcgattgggagggaacaaggatgtaggatcttggacatggatctcttgaaagattgagataggcaccactggggatcaaagaatgagccatgcacaaactataaaagtaacaagcacgaactgtgcttgtgtgatctgaaacctctgattacaagagactagagagcatcaggctcataaaatctcacttttgatttttaaactggggttgcatcatgcattcatttctgaaggtatttgagggcaagtgacaattaatgagttgcaacagtacaaacccttaattccatcctttcttagcaaggataggtggtttaagatgagaaaataactaactttgctaagctaacttgtgggtcatggcatgtacaagggaacacagtagcacactagtgccaatggtgatgctcaattggttagagtccggaaattttgacacaaatcggcatgtgacgtcctgtgcattttcaacaaattttatatcaaaatatactgatacatacactttttaccacttcacatgtggtgagaaaaattatatctgttctgccgatgcagtgagaatttacactaacaatcgggacgtgaaggagaaacaaaataattcttgattaatatttgtatccaagatgctaggaatatctaagattaatggggtagaaagagaaaataatactactggaaatgtaaaagtatgcaggtcacgctaaacttatatttggcattaataatttgggtatcttgagttttttatggctaacctcttaagattatacagcattgatatcatggaactttggccttccaattatcatgggcataccacaacctgttgattcccttcaaggagcaacctctatctgaaaccaaatgcttccattcagttcaagaaaccagcagagatgtataaaagcatagaggctaactgtacctaccttgaaccagaagtgattagatcatgcactggagaaaacagagttgcctcccaacagctcagtatctttcaataaactttaataaatttgacagtgtcatataccatccaagtgctgaactgggtcatgttgctttggtagacgaaagctcttgagtaatttgataagttcatacgtccttgcatgatgacccaaccggaggcataactccaaaggggtaaatccatcctgaagtaagcatataaaccaaatcatactctcatttgacagaagcctttatttaagagaaatgcaggaataagtagtgctcatgcatgtctcttaaataccatctgaaattatggcactggaaatgcatcacaaacagtgataaaactgatgtgagaatatgataatagtatcacaagagaattggcgattaacacaaaacaacttatagacaactggtggcacataaataagttcctcctgggtcatttgagaactaccagcacataatttgctttacttacttgagttttcaaagttctatcagcaccctttattaagagtagcttaacgatatcagttctctgtgtttgcacagctagatgcaaaggtgtccatccatactgcaaaatgaatgagttagacaactaatccatcagaactgaaaataaagcaagatactcccaaaaatgaacatacatcatctggccgattaatgtcaacattgtacagcaagagagtctttatggtctgactgcatgctgtttggactgcataatgcattagggttgcaccatcctgtatcaccaaaattgcactgttgtcattgaccaaaactatacaaaatactgcatagaacaggaaagggatcaagaagtacgagtctgcaacccaccataacaatgcctaccagaggtagaatatcttagcataactaaaagatacccaagccatccaaacatagagcatactcactttatcgtggatgaatggatttgctgaattccttaggagatagttgataatggcatgcttcttggaaagaattgctttatgaatagctggtaaaccatcctgagaataccaccggaaaaggcccaacaaattataatgatatcacaaagatgtaaagcttctaaccataaccttttttaagatgagtcaactttcagaatagagcttaccttatcaagggcattcacattaatattatgttttagaagattgtccaacagatagaaatctcctgatgctgcaattgtgtgaagtggaagccacttgctctacaagacaaatagattaaggtatgtcaaccatcagtcagtagataatattgcacagtaaactaaaagagagagtagcaaacaccacctacatagcctagagatgaaacccaactggagctacacaaatcaaaatagataaactggaaataacaaacatgatcaagcatacgcctggagataacacaagctttatgatgtgacatatcaagatgttagtaatgcaagtcagaaaaaatatatggtgcacaatgcactcttccatgagacaaaaaaaaatgttagtgtgacgaattacagacaataatagttaagtcactctgggcagagagtgcttacagaagtagcagcttcaagatcaggtactctcttgttcagaagaaccttctcctcatctgtgaacagcttccgtcggcctaaaatataatacaaattattcaaatccacgagaacagcaatgaaagaaaaatgtcacatagtgaagttgcaccattacttggtcatggataattggatataccaaacaaatgtttcatccgataaactaaactagaaatggtataatcactcagaaagttgtgtttcgttgaccatgttaatggcaaaaactacatatatttgtcacgtgaggagtaaagagcatcaaatatactgtggtaatgtacaactactgcattaatcttttttttttttttggaatcacctacta

SEQ ID NO: 68022 - DNA, 11798 bp, Oryza sativa
atcggcccccaaccacaaaaccagatatataacatcccttgacttataaaaccgttcactttaggtccctcggtggttttgaccccgattttgtcccacatgatggctgaatcagcgtgggccccacatgttaggatgtcatgtcatcccctcctatcccttctctcctcccgggcaagctagccgatgggtggggaggaggtcgtcgacaacgagagcgaggacgagggggtcgatggcggtggtagtgacgttgcagaattaggcaagtaaatgaatgaatgagaagagtcctacccctatctctgtgtctccaattcttgcagaattatgcaatccctcttggactacctcggtagtaggagggttgtataatactcatatctcaatcctcttcgtgctcacctgaattcacatgtaacaacacagcggatgagaccagcaaggaggccaccttggatgcgctgcgcgcgcacagagttgcggatgagttcttgcgaacagctaagataggggccatttttgtaaatattttagatggtataatattttggatgcgcataccttgccgccctctacttgggcggtagggggcattttttaaatattttggatggaataatatttttgtaaatactaaaaaataaaaatgaaaaaaattcgcatcccaggtggcaaaagaaggaaagagcaaagcggggcaaccagctgcctgcgccggcccacccgtccggcgacgaattttttttattttaatttttttttattaaaagttttacaaaaataatttttcattttgaaaattgacagaagtggtcgcctaccgccctctgggatggcgatttttaaaaatcgccctcccagagggcggcgaaagtgacgtggcagacggccgttcgctctcgggcgacggccgtcaacgaaatttgcaggcggcccccttgccgccctccgctagggcgattttgtactgtgcggggggccgcctgcaaatgggcggcggggggcctggaattttgcaggcggcccccttgccgccctgggggagggcgattttatactgtgctttatattttttataaatatcaatagttatcaaatttttttatattgaaaactatacaagattaaaatctccaagactggtaaaatacaattttattattttttagggcctatttggaatgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattacgtattaccaatgaataggcttcaatcgaaatcaaacacaagtactattcaaattaccaaaatattggtagggcatgtttttggtagcaatccaaataggcccttagtcttacgcatacaaaaaatcaccaccataattaaacattgtaatgataagatagataagaagtgctatcgatacacggtacaaatttgtcgatcccgacgaatcaagcatgcggtaacctatcggccccttctaggtcggtcagaatgcattgcattctcgtggtccttcaatcgttgatactctacttgtgtttctgactctgttatcttctggccatgatatgatggagtgacattgtcgatccatcgagtaaatccacccatccttggattgccctgtaaaaatagtaatgttattcagtttgggtagtaattttgtgcaaatcatagcggattttgtaaatggttagacatacaacgaaatcgttgtctacattggggcagacaaaatatctccttcgaaatgtttgttcagcaaaggatgtagccacctgccagcgatctctgcacccacactttggacgctcggaccatttatgtaaccctaatggattgttcctccagtctaagcttgcaatttccacccgacgttcgtactccatccaagcatgaatgaactgtatggtcggttcaggttgcgttatcggcccgccacttgaagtaactctgactgtgtcaatccattgtacgaaagtgtgttgtcgtgagcataagttgttctagcaccatatgaatgaaaagaactatgtagaggagacaaacacaagtagtactgcagtagtaatagcaaaagtagtactgctttacaagtttgtaagccaaaagaaacggtcacataaggactgaagaggtagaacactactgacgaggcctcttacccatgtccctcctaccctgcgccctaatgtgcccctgggagtacgtgagtcggtccgggggtacggcacggccaacccgtcctgcctgtacaggtgtgacctctggctgctcctgagtgtgcgtctctggagctcctccaagctgagaggagcctagtacgtcatggtggtgtgcaccgtgcaagtcgtcgtcgtagaactggctagtaggaccagtcctaccggcgtgagacgaagaggccccagtaccgaagatcccggctgcaaatcctgctggacaaggaccatcagtttcatacatgtatttaatagtattaataaaaagtaaagtaccgtgtgggcgagggatcgacgctccgtgagaggaagagctggcgaacgcgcccgaagaggtggcgaacgcccctgcggagctcgcggaagcgccggtcgtgcctgcgaacgcgctcgaaggcagacgaggtcctgcgatgaggaaacgtgcagttaaaacatggtgacatattcgtgcaaaagctgaaaaaaaaatgaactaatctctgggctgaactgtaccgtgcgaaaccggtgctgtaggtcgcactgctccgaagctaggggcgctcgaaggcaaacgaggtcctgcgaggatggaacatcaagttacgacggggtgatgttttcgtacaaaaacataaacaaaacttaagaaacctctgggctgagcagtaccgtgcgaaacaggtgccgtaggtcgaggtcctgctccgacggtaggcgcgcgaggccgtggttgtaccggaccagctggaggtacgacgtccacggcgctacgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaactaatacaaattcgacgtacccccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatatgcaccactgcaatgtgcactctctctaggaaccagtaccagctttcagtgttctcactctctacaaatgcaaaaccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtaagtattattattcctctgggcaatggtggctaacaaacgaggcaaattatcataagaagcttcaaatgtgccatacctcatctcaataatcttttgtttggctctccaggcctttgcatagcttatggtgtacttgaatttgttctcgatgtgcctaataattgattttggttcaaagccaatgttaccaacaacactgctgtacatctcacttcccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattacatcaccttcctcatcggatgatgcgtcgtcgtccgcttcctcattatccgaatcttccctctccatttcatcaacaattataccgactctctccccctcatccgccatgcccatggcctgctcctcccttggttgattttcctcattttgcatcgatggtccaacaacatcccttgcattgataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatactgacattttgtagacttcttggtctattctaaatcctctcaacaaccaactataaattgactgaaatgttttctccgcaggcctatcgatacccttagatgtcattacaaaatctgacagatcaacaccatctggaccaaatctaatatttccttcaccgtgaactatctgaaatgtgaccttatttgacattgtgcctgatgaaaacaataactgcgttaacctcgcatttctgtactacgccctaagttacattctctacaatattgttctccaaaattctaaaagtaggttacattctccagatcaaactaaactacatcttacaattaacactactgtctatgtctcaattcatactattatattctatgctctgtatctacacatatgtgctgtgtgctacagatatgctaaaatatatggaactaaaactaaaacgcaacatatatactcaaacataacatattagtacaaatgcaaaagatgtatgggagcaaacctgtgatgaagtgagcgaaccagcagggcttcgccgctccccttctgctgccctctcctctctctctttcgttttttttggatttttagtgaatataatgaaatttcagagaggggggactgggctttatagggggaaggcaaaaatcgccctcccccagggcggcaagggggccgcctgcaaaattccatgccccctcgccgcccatttgcaggcggccccccgcacagtacaaaatcgccctagcggagggcggcaaggaggccgcctgcaaatttcgttgacggccgtcgcccgagagcgaacggccgtctgccacgtcattttcgccgccctctgggatggcgatttttaaaaatcgccctcccagagggcggtaggcgactacttccgtcaattttcaaaatggaaaattatttttgtaaaacttttaataaaaaaaaataaaaataaaaaaaattctccggcgacgaggcatttacgtgcacgggcccgatgccccgatggaggcggtggcagggcgagattccccggcgtctcgctcgcatttacctcccctgcctgcaaccgcaaccgcacgggcatctctcatcaatgcacgggcatggcatgcacgaaccatattccagtcccggcctgggcctgccccaaccaacaccccgccttgtctcttttgtctcgccgtttgggcctcattcaacgccaacaccacgccaccaacacacaacactctcctctcgcccattcaatgcaactcggactcgccctctcctctcgtcctgtatgtactcctcattcatatacgtgctagtactactactagtactacactacagtcatgccgtatacaggcacctgcagtctctccacatacaatgcagtaaatcgatcccagagatctctgtagaaattatggtagaagaatcaaaatagaccggtgagtttaatggcctggtgatacacgcgcatgcagcacatattctgtcagtattatttgctgcaggaacatgtgctgtcagtatttatttttgcggtgctcatttctgccatgcaacctctctctcagtatacgtacctactgcaacgacagtactactacgaccagtaaaacttggcatggtacaagtacaactacaaacaagggagtagtagtcgtagtagtgatcgtcaagtcgtcaaggagttaggcatgcatgcgtgattcttcatcgtctcctgagtcccgatcagccagatctgcagctagcgtcatggagtacagtagtagtacattcaaattgccatggtcccggaggttaaccccgttccagtacctgtcccaggttggccacctaatcgagtgctcttgtagaggtgtggctgtgcatgacagttttgatcgatcatctccctgggcaggggcaggggcagggcatgctcagcctgactgcatctcaatcgctgctcgtctcaatagtcaatcgtaatcgcaatattgccaagatgtttctgaaaccgagcctgtttatcctgacctgtgtgatgcagcatggggcggctagctgatggcacatgtaagtttgtgtctccgtgaatgaatgctgtaagctatagctagctgtaatcgtccggatctcgccaagcagatcaatcaaggcccgaaatcatcctcacccgtccctctccggccggtcttccagctcaaaaacccacggaattaaacgcgaggaatcctcacaccagcacgtctaggacgctagcgcgtttatagggtgtgtttcacgttaaattggaagtttggttgaaattggaatgatgtgatggaaaagttgaaagtttgtgtgtaggaaaatttttgttgagttgtgatccaaattcatttgcacttaataaatgccagcttcttccgtagtggagcggaggcccgtcgccggtaggcttgggccggagcgtagcggatcgtcatccctattagggttccaccatatatatacctcttgcaagccgccgtgcagcgttgtaacctcacctcagatatagtgaagatattttgctagctggcacccgtggttttttctctcctgttttgggaggattttccacgttaaatcccgtgtcttctgtgattgatctattgttctttatcgtttgtttgtctatcgcttcctaacagttttgatgtgatagaaaagtagaaagtttaaagaaaaagtttagaactaaactcggcccgctacttgcattgcgcttttgatcgattaggctacggtgaagaatatgaacgaagcaaacagaaaaatacgtgctgttatcagtctaaaagcttgttgttatcagtctaaaagctaaggcagaaaaatatcctacaataaaaaacctaaatcaactttaaaattaagttttgaaatttaaattttagttgtggctcgtgagacaataaatggacgacgataactacgaaactttcatttatcagtgttccaccatgacgctatcctcctagctggccgctgcttgttcaatgcctctagggagggatgagaccatgggcgagagagacataacgacgataactacgataattcatgcatgttgctggcccccgttgcacacaaaaaagcatgcaacgatcgatcgctggctcaagcagagatggggggaaggaatctctacacatttatgccattgcacctacatatgcatcatttttttgaggtagagagagggccgggtttccattaatgctgcagcctgtcttacacatttggtagccgggggacttgaatgctcacccacacaaagaggtccataagttggaggcctctgctttgctacccctctccatccctaagtccattccttcaccacacctctgctcgcctccttctccatctctctctaagctgcatgccttccattggagacaagggagagaaccattgcatgtccatcgtccatgcatctgcatatgcatggtgttgttcttctcgtctacctcctgcttctacatgtgacggagaagaagggaatgaaatggtagctatgatgttggctcggctcactcagacggcattggcgtgatgcaaagcatgcatgcgtgcttgctagctcacttgtgtttctgattgagccgtgccaatatcttagtgctctttcatgtgtacgtacgcgcacgcacggttgcaccatgcatcgacgacgaccactgccatggccgccggtatgcgtgtcttcacctgcatcaattcttcttgcaggtatatatgggctatggagttcttgcattacaatgagctgcttagctgattaaccattatcgcctagttttgtagttttcgagttttcagtaatatcgcacgaactaatgatgttcttgttatttagaccccgttatatatagttgtataacttgtacacgtagtatttctagcgtgggtccaattaatggtccatatgttaggtctcgactttgattttcaagcaccaatgcccacggagtgcacagtatatatcaattatatgcatgcagaaacttacaggattgcatggacggggtgcagcattcagcattctcatgcctgctaattgctgttccagcaatccttttttagggcagtgccattgctgctccagtaatcggacatcaccattcatacatgtttgtaacacgtcgtgcagaaagtacgaaattacctgcataattataatgtacaagctgatgatgaagcccaataaaatcgtgtaataaataacttcgatggaaattaaaggttggataatgcacgtaggaatgtgtatccaccaatctgttaattatggaggaatggtttatgacaggtagatcctagatactagcagtagcagcttactacactgtattgactgaaagtatctgctaatgtttttgtgcactcgaatgctatgcttagttgtttacctgcagtttgattatttttaactcgccaatccgggattatatgatctcatcagaagaaaagcttactcacgcgagtttctgtcagaagaaaatcctggaatatatgatctcttcagaagaaaagttcgaacttctaattctgccgtgtccactgaaatgatacaaactgtacttactgcgtgccgtcagcacgtcctgaagtctgaatatagtacaactaagctgccaatagtatttactagtttttttttactgaaatatctctttttatatttattctctcatgcaattctattcttcaaaggacctcccatcctgcctcctgccctcctgcttctccagttgtttacaaaattaaattatcttatgtacccaaaaatagttctaattcaacttttgtctacatttaaatatttcgaaaatatcagaatgagcgctgtcattacaaaaagaagaatgcggggtatccaggccaacaccccgacttgtgcttacacaaatgtaaatgcagatggtcgggtaatctctctgtttattaattgctgcaacactgtgttgcagcttccaacttccacaaaatgtaaatgctccagctcctctcgctctgcctcttactcaatgatgtgtctgtgtgctgtattcttgaatacttgtatttcattcaattcgaaatcaattaaattgaaggggggaagggggcagagtaatacagcggatcaccatgatgccagcttgtattggttgccaaattgcttgcatatgaaaatatcaagatgcagttgatgacagagacggcatttacccgtcactaataaagatccaaaattcagagcaattgtaacagagatgaatgaaatcagcaatgatggctacccagaaaattttgtgctatcacccccgtggtgttgcgacagagcaattgtaacagatataatgaaatcaataatgatggcaccatttgccattttgccacacttgctactgagagcaacagtggaccttatggcgccactttaggtatatgtacttcgaatatcagaatggattaatatgaagattacaacaacaaagtgctaggagtagagatcaggcatgtggttctaatggaaaccataactatatacttagttttcaaccaacttgtagccaactttatgtcttggccccttttcagaatgcaagaatgataaaaacacaaaagagagggttgcagaacatataaaaaaaatatatgaaagaatggatgtttggttagaccacatggatttagggagagacagactccaagaaacattcccatgaggttggacatcattttaaatttccttcgaaattacatcattgagggcctattcgttttggaggaattttaacatatagaaataggaaaagtgaaagaataggaatgaatatggaagaattttaacatatagaaataggaaaagcaaaagaataggaatgaatgcacacttcaatccataggaattttcaagaggtttgagtgatgaaatttttcctatgttttctctttacaacttgtaggaaagaaaatttttcattgatttttttatacctacattcatatgaatgtaccgaatgaaactcataaacgaatagtccatgaatattccaaagaaattaggtaggattctaaaagctttaacattttgttccaaagaaccaaataggaaagaaattaccatatatatgattcaaattctacaaaacttctctacaattgttccaaagaaggccttacatcataacgtattgcacattaggactagagtgcactaacaacttcgggtaatagaatggttttctgaaggatagttagcaggacattttgacattgtgaatgataccaggaattggaacttgggttggaatatgataacatcagagtagtaaaggaggaattgcaattactgtagctggtactccagcacagtagtcaggagcaccatacatcaaatcaaagggatgaggttcccatgggtagttgggacttgccaaggagtaactatggaagtaatgatatgagcgtaaatgagatggcagggaaagcatcaaaagagacagcaggtagagaatatggggcatggttactttggtcagggtcagggcatttacacgcatagcatagatagatcagatgcatggtgcccggaccggacctgacctagcctggcctctatatcgtcagacaaagattccctcattcactccaacccccgcccagccctatacccatgttgcctagcatcgcagcatcaccactccttgctaactgtcatctcggcaccaccactgtgatagcatcaccatcgcttgcctattgtgttcttctacagttcacagctattcaaactg

SEQ ID NO: 68023 - DNA, 594 bp, Oryza sativa
ttcaccttgcgtcctcatccggatcaactgctgggaagaaccagaacgagtcgccgtcggcggggaactcgccatggcggtgcggcaccgtcttcttcagcaccagcagatcacccggcgccgcgcccaccctcgactccgaccagaaccacgcctggccacgggcggcgacgtccacgtcgggcagcgtcgacggctggtgcgcgaacaggacggtccccggggcgcggccggccgcggaggaaggcgggacggccgccgagcacccgcggccgagcagcagcacgcgctcgccggggcaggcggcgatcggcagccacgccctcgcgtcccagttgagcttgtagagcgcgacgcggttgtggcgctcgtccgagagacgaggaggacgtggccgagcgactccacgaggtagtcccgccacagctcgagcgacgggagcgcgaaccccgtgtccctgcgctgcaccttggggttctcgtcagcgagatcggcgcgccacagcagcctccgctcgtggacgaggtacaccgtggcgcagacggcgacgacgtcgctgagggccgcgtggtggcggaaccccggcgcgcgcag

SEQ ID NO: 68024 - DNA, 5365 bp, Oryza sativa
gggggcgcgcatccctacgcacgaccgcgcccggccacaccgtgctactactgccctggtacgctcgctcgctcgctcgatcagatcagcggctaaacgcctaaacgcgcgcgtacgtcctcgactcctctccgccacacggccggtgccgccccgcaaacagcggcggtgttcgcggctggacgcacgcaactacccgctgccgctacgatgcgtgatggcaaaatagagcacaatagcgcccgatctgcttgttggaggagagacctggatcggcgtgccccatggccgtttgtgcgcgtctcttctctccggcctttccgtcaatcgtttctatagtacactacacttgtataggctttttagtagaaacgatagtatcatagtagtagtatttacctacgtgggtgacaggtgagaggggcactgcggccgtgttgcctacggagtacgaaccgaccggcgtgaatggtgaatcgtgatggtgattcacgccaagtcaagtggatagatcatagatagcgctctgtgctgcgccctttcgcttgcggtgggcggtggaagggggcgtggttgtgctagataggccgtggtgttctgtggttaggcgggccatttggggtcatgggctgtctcctgcctgggtcccttcccccttccctcagcacggcttgggtttcaagcgtccgatcgatacaacacgtacgttgttcagggcgtctcgcgaaattgaccgctgcggaggtggccgcgagcctgcgacaacgacgcaggacaaattcgaaactttgcacgtgggaactgactaatgcagcgtcttattaagggcgagagtaccacggcttatctggtgttacgttgggaactccacacatctggacatctggtacgcagcaatgacgcggataaattccaaggatttcaaagggaaacagttcggacacaattcgacaggattctctcgttttccaagtatagggctcatgatcgtgtgtggatctatcaacgcagattatttcatctgacatttgtttaccggagctttcgaaaccctccactaaaacatggccaaaaactcgagatggaacacatagtttcagtacttcacgttgcacaggagatgccatgttgccaatatatccatcagcggctgctccgtgacccacgtcactttttcaccaatctcctacagtatggatggatggattccacgaccacgagtcgatagtcacacaaggtgctgaaagctgctctgctatgctccgaggtagctacgacgcctacctggatatcgacatcagaaccactccaaaaggccgaagctcttcagtctgaaagaaaagatgtggattctctgaagtgagaagtctgaacccttctgcaagcgactcattgcctgcagaaaaattcaacctcagcctgtcctgcaagaatctcctcgagcatgcaggttattccctttttgcattcatttctcagggtctcaacgctgcaaaaggaatctgatttcttacgaacacagcagtgttcccagcagcaacaattggatcctcgacagcctacaggttcagaacaaaatgtaaacacattattgagtgctcgaattgccacccccaatttttttttaagaaaactatcagaaccagcctatgcatgtcactggctaaggtaccccaattttttttaagaaaactatcagaacacagctaatgtctggctaagaaacagacgtgtggaccatataagaaacacataaatggttttccaaaaagatgggttacattagcccattatggccgttttggattgataccaaaactttccctaccaatgttttaggaggttgaatagtaaatatgatggtttggtttgaagccaattagttagcaatgcccatactcattttggcacaaataagtttctctaccataatatgaaatttggtatcatattgatagcaaaccaaacacgagttaatatatctctgccctaccaacaaatcggtagggtagagaacctctgtagcaatagaataatttatagagaaaagcacagtgctggtccaagaagcaaaacatattaagctatcatcagggcattcatatgcattatagaagacatgtagaagtagaaatgaagagttaagggtatagtctaaactggttgccacaatgggatgaaacaaagttcaacgctgtaatcaactatgcatcatgcttcatgcagatatgctgctaaaatcaactaaaacaagatgcttacaaccagacaagcaaagtaaccatcatgtaaccgtgtatattatagaattattataacatacactgtaggatcctttcctatagttgttccccctgaaaaacacaaatagatattgaattcaaacacatgaaaacaagaacatacattgataggatatacgctagtttccaggaagtgccataaggttccatcaaacaactctgcatttatcatcacatatgacggcggtaagcatcaaagactgtccttaaagcacagagcttattaacgttgagtacttacttctaacactgaagtttcaacctaactagcagggattggctcgtggccactcacacacccaggttctattcctaagacttacttgggcgcctccctccttaagtgaataccagaggtcctggcctttttttttttttaccaaagtgatcatatccttttttttagaacaagatttattgatttttagaacaatagtagtcatatcctagagatctagaacacctgaagactgctaatgcagagaaaacatggcaacaatccaatttcttcaatgagtaagagtgaaagcacagtacaataggttatttgggtgaaaaaggttagcattacagcaagaaacccatcgcatatacaacagtatgattgaaatctacagagagtagagataccttggacgagtagggataccttgaacggtccatttcgccctatcaacccacaaagagaatattcctgacacttggtccagagtgccttcaagatcggtggaagtctctaccatagtcctcagtcctcgcgaccataaacatcgatgatacctgacaccacagtcagacggactcctaaagaagtataatgtatgaagcatgctcagattgagaaaaaattaaaaaaaaaactaaatgatgatgcaaggtcactaccatccagactgtttttggaaagcaatatagttcctatgtgttgagtgtccatggagtcttcctctttgacagtatcggtaaagaacacaattattttctgtaacaacatatgcccacaactcaagttaaaatcatttttaaaactgcacgatcataatgggaatagtgcaaaagaggaaatacaccagctgatactagttagaagaatacatcactaaataattctaaagcaaaaaaatactacgaaagctgcaaaaaaaaaaaaaaaacagcagcgatactactggaaagtacagtttcaatattgccacacactggtcgctgcttaattgttgcagaggggctggctagggtacactaagttgatatcgtgcaagaaaatactgttgaccattcatcaaggtcatcggagacgttttgattcatgatatccacgtatttgattgctgcagtagacctgatgaaactccttcactatgccagaaaacccttttaagttagaaaagaaggacaacacatgaaaacatctttggtaaactaagaatcacaaactagagtgactgagattggatttttgacaaggggctgcacctagaactgtatccattgtgtcaaagcaaaaccacaagaaccatgagaatgtggttcaactaccaaaaaataaccgacgacctagaaagaaagagttggatgagttaaaactcctctatatggtacctcaaaatgtgatggcatggtaaaagtaaacctttccctccttgggaatgaaccttcaggtccctttctgtaactctaccagacaaacaagttatgtcaagtatttcaatgctttgacgcatacgattggtggtcccttatttatttgttgtcatataaaatcatgctgaaattgtagattgagaatgccaattagaacaggagagtaaacactgataccttacagggcttgtatgattgatgaggagttggtcttgtgattggtgaagagtaccctgattgagcatgacactgagatctaattctggaaggtgactgtaatcttgatctgaattgtttaccacctgcattaaacacagaaagttatatgacaagaattagtatattgcagttgtttgatatgacctgaactctgtaagtacagggcacccaggaaaccaacttactagcccacatgatcaaattctttccaaatgaattagattgactactttgaaaaattcacatcaccttccacattactaccaaccaaagccaattccagtaagttggttcgcatatgcaagttttaacaagctccataaattgtgaaaattaacattgaatgtcattgactcaactccataacctagaatagtaagataagattacaatatgccactgagcctacgattagaataggagaatctttagatatgtcatcccagagaaaaaaatagccagcatctatgagacgtcaagatgataataatgatggggcacaaattcacgtaatgcgacaaattgcaattcatgatgaaagaaagaagaaaagggatgagcacaggaataggcaatagcaatgcttctgggagcagagtccatgtgatgaaaggaagaaggtaagagaagggcatagcaagttggcaattgcatgaggtcttactccttgcaagtgagtcactctcctcgtgaaaatagttgcctcaaaagttaaaataaattgccagaagatctcaaaccaaaagggaaaacatacaacaaccaaactactttggcaagtccaaactccaacctgcatgcacaaagaatgcttggccatgaatgcatcgaaccttttgttggagcttgattatgtgagtgagtcttgacaaaatcagctaatcgagccagttgataaaataaggtaaaaatgtcgcaagtcatgtatatcgtgctatgaaattttggttggggatacaacaggactgtgccaaatagacctgaagatatgtaatcctgaataaaaacatacatgttttctaattactcaaaatgaagaaaacaacccattggcttattcaacttcttctacttcatatttttatagctagtagctgaagtggttaattctcatggcacaaacagcaataaaattttttaaaacatcgacaaaagctttgccgtatatgtattaatagagaaaagttattttcagagtt

SEQ ID NO: 68025 - DNA, 1175 bp, Oryza sativa
cacacattgaccaaaaggtttgaagtttgatccatatccattggtgcccagtagtatataacatcctcattattttcgccagccatagtttcctctaagggttcttcggctttttcagacaaggatacctgatgacataagaatgtttaaaacttatttccatgtcattatcaattgaaaacggcctcattcaagtgttcaagcaatctcagcacatggaaagcatagaacaacaaaaggaaaacataggcatggcaagccaaaaaaaaaaaggcattttcatggagatgaaaccaaatagaacacatggaaagcatagttccaatactttttaacatctgaagcaacaattgtattgcaaaattgcatttagctggtgcagcatagaattgcctacatgataggcatcatgagttcatggctagagggaactgttgctactgcttaaaaaatcctctatgaaaaggtcgaggaacctattttattatattgtatgtccaggcaaactggaaaactgagatagtttgggagatttggaagcaccgcaacgactgcgttttcaataacgccaatcctagagtagcgacggtcttgcaagtgatagaaaatgagggccatctttggggtgttgctggagcttctcgccttcaaaagctccttagtgggacggctaacctaggcaactaagctccccgggctgtctagtgtgtgtgggtcttggtaggagggctcgggcactcctactttgttttttctttgtgttctgttttttgtattgttttttcttccccttaatgaaatgaaatgcagctctcctgcgttttcgagaaaaaaaagaaaacttgaggtagtgaaaaattatgtctagttcatagtacagaaaaatatcgaacaccacaaatttaagtagctttagccactataaggcatatccataataatagcattggacaataatacaagaacgaattaatttccacagtttgaatgaaaggacaaaaagtggatctgtgaaaaaaaaagttcagcaggaagaatgccaaattgccaatccaatatgaccaaaattagcacatgattctatgagaaattaacttatacctttcttccagcagcctgccatgactggaaacctatccatggtaacttgtgaacagcatcgattctgttcgcaa

SEQ ID NO: 68026 - DNA, 822 bp, Oryza sativa
agtccctagtcaactatgacacttgcttagaaatgctattttagattcatgcatactcatatttatcaaatgctatatgcttgggcaattacctttgggaaggtaattgagatgcggcatgtggagacatgagcgccacattgccatgatattgatgacataatttgtgaaaggaaaataaagtaaaacaattgttttcgactggggcggctggaggatttgggtggtgtccggaaaaggctagtgccgtccctggtcaattaaggaccgagccatgaagttaagcatgaaacgacccccgtacaaccgcatttctcgtatgggtatagacctagcagagtagatagctgagcggaggcagtatccatgcatagtggtttcttgatgtgtgaggcaggggctctacggtggggcagccattggtaggaccgcgaggcgggtgtctacaatggtgtcgccatcggtaggactgccatgtgagaatctaaaacataattataacttaatgcatgtgtgagtcttcccttcccgggtgcgccagaactcctctcactgctagaaaccgtgtacgcctagagtgtatgaggatgaaaagttcatggagcgggtactgccaatgcgaggttatcgaaaagctttgccgtgacgcgtctcatgtgttgggacgaggctcatgtgttgggcagtcgcggagtgggggtaaagtgtacatccactgcagtgtgagtaaaccaaatctattcgaatagccgaacttgaggttattgagccccgggacatgtattacacttggctagactctaaattcttaacttgtgtggg

SEQ ID NO: 68027 - DNA, 14165 bp, Oryza sativa
gaggaggagggaggcgaggtggtggaggggagaggcgttcggcatgggggggagttggctgggctgggctagggtttgggcggcgcggcgccggcgtggagcggaagcagcgcaggtggtgcaggagaggagcagcagcgggggcgtgtgggcggtggtggcttccgtggggtttatttttgggggaaaggtggcgacggcggaggaatttgggggtggggttttacgagccgggggaagcgcgcacacgtgacagcggcacggctggttcgcactcgggcgtgggatgcactgtagtctgtacgtgtaggggggcgccttccggcgaatgtcagatggcacgaaaaactttttaatggtacggactacggagggcatttcactggtacaatcgtgaatccgtcgggccatctataatatgagccactcctcgtggggaaactcagcttacaatggaggataactgtggatgggctactcaaaatctgaagcaactcaatagagacactccaacccatagtgggtatgcagccacaaaaccccatatatatttttactaccctacccctaatctctctctccagacccttcttttctttttttcaccgccgcacgggtctctccctctcgccgctgccgccgctcgcctctctcgttgccggcggctgcgaggacgacgaggagggccgcctctcccatcgccggcatccaccgccatccctctctccctctttcccgtcatcggttaggggcgccagatccggcgccgtagtgggcggatctgggccccccgcggctagatcggggaggatacgatggcgggcatggcgccggcggtgacgggcaaggcgccggcggaggaggccgagcaaggcgcgcagtggccggatctcgtcgctgtcgtccccaagcatgacgaccacaaccacgacgtcgtcctcgtgctgcttggccgtgagcacgggcgcctcaagcccgtcgacggcgccgagctcgacctccgcctcctccctcgctcctcagcccgtcgacggcaccgagcgcgacctccgccgcctactcccgttcctcgccaccgctcctgctgcagcctcctcccgctcctcgccgctactcctgccgggtggttgctgtggcggcgaagggcccgagagaggggaacgggcgagagagagaaagagagagagaggagaggggtggaaggggaatctgtcgctggagacatggtggccacaggagcccgtcgctgcaatgcgtcgctcgcctttgtcccctggccgaaaagtagcgagaggcgcgtcccctagccagggcgcgcacggactcacgaggggatgacgcggatggaaagattgacggatggtgctaggggcacgacctaggggcacccgttgtagatggcctcatactactggatacttcctccgttataggggtgggtagaaaaagaccgagatcgataaatgcggtcatcaatttggtcctaggcagggaaataccaaattttgttcagtcaattgttagtctcctcggttaaatgaatagaccgaattaacaaaaaaaatgtctaaatacaacctacaatccactatgttcaataggattaaactctaattttcacgttcctacttcttctaggcatgcaatctaacaagagtctttactcataagcgcttatgatttttttatttttgtgttgaaaatttccattatttctttgcatatatgaaaatgatattgaatttcggtcaggaccgagaccaagacaaaaagactgagaccgaatttgttggtcctgatatttttgcgttgaaatttggtcttcacttttcaaagaccgaaagaccgagaccgaaattttcggtcagaccgaatacccacccttactccgtggtgttggaattggatcgtgccattgcaaattattaatttgaacaaatattactacaattcgcgatatcagctagataccattgaattttttttgcaaaattgaaactgtatcgtcgttgtcagggttatggataccacatacttaatagtagtcgactaaatctcggcaggacccaccacatatcatatcttatacggaaacaaccttaggatataggaggagttccgcataaggaaggatgaatagagttctacatgaaaacgacaaggactactcggattgtatccatattggtctctgtcggtgatatgggaccgggagtatcgtgaccagaggcttgaggcagacacaatcgcccacgtggcctggcaccttcggggacgtcgggcccgagggtgaggtgtccgccctcctcctgatttccccgagggggggtcgggtgactcctgccccggccccgagggccgaggcgccccgaccccttgtggagttagcgccacatgaatgggttgggtgaacacggtaagcctcacctaaccacatttattgcggtctggtcgaacgtgtcacgctgcatgcagcgtagtgcagcgcgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgtaatctcttagagatggcacgttagccctggttagatttataccaggcttcatcccaaccattacaggcaagatgctacatgaagaagggcaaacatgcacgttgctaagctgacacgtggtggacaaggatgactgatttgtgaccggtctgacactggtcgcgtcatcaacagacagccataatcccacgtcgcacctgtttccggcggaagtgggggtagatatgggccgtcccgtcagaagggcacccggagagcaaccgtaccgatctccgtccatttatgaagagaagaacagtccagtttggagagggagaggggcatgtggtatccccttgagatataaaaggaggaccttgcccacttagataaaaagaggacttttggacacaaggccttggccagatccgatcccagagcgattgggggctggttgacactttgttacttgttcatacacaaatccaccaaaacacaggagtagggtattacgcttcccagcggcccgaacctgtatacatcgcccgtgtctcgcgtttcttcctagctggcgatctttccacataccgagagagcttgagatttcaccctaagcccccggccgaaccggcaaaggggggcctgtgcggtctcccggtgaggagccacgagctccgtcatctggcgcgccaggtagggggctcagcgtgtgttttctgagctctcgtactcctccgtgtgcgccaagtttttcttgttcagcctaatggccgagcaagcaaaggtgcacgacctctctccgagtgtgagcggcgacgacggggagccaaacccacgccgtcgagctcgtactcccccaccccctccacaccaaaatcctaagcagggggaggcgctcgagagggtcgaaaaatccgcagcatcgccagtcgtgggtgatgcaggagaacggcgagatggggagcgtcgcctcctcgtctacggcgacggcagcacgcctcagggcgcgcttcaggctgttggcgcgctcctacgtcacccgcccgtcgtccctgacccggagtctccagcccagcgatggctggacgacgtggccaacttggtcatgacggcacagcagcgcctgggtgctggtggacggtccgccaccaccaagacctccggcgccgccactaccggctccgtgtcgtcaagacggagggcgcggcgagcggcggctgttgcacgccattcggctgtcactccctcgtcagcacctccgactcgggaggatcagcatggagagccggatgcccgcctcgacatcgagcgccggcgtaatagccggcgtactccccgcgcaacggagggcgcctcttcgtccagagtgtcacctcgacatggacgtgaggaccagccctccgtgcccccggctggtggtgtcggctgtagagcctttgtggcgagtcttcggaatgtccgttggcccccaaggttccggcccaccatcaccgagaagtatgatgggagtgtcaaccccactgagtttctccaggtctatacgaccgggattgaggccgctgggggtgacgacagagtcatggcgaatttctttcccatggccctgaagggacaggcgcggggttggctaatgaacctgccacctgcgtcggtccactcttgggaggatttatgccaacagttcactatgaactttcaaggcacttatccgcgcccaggcgaagaagcggacttgcacgcggtacagcgaggggatgatgagtcacttcgctcgtacattcagcggttttgccaagtccgcaataccataccatgcatccctgcacacgcggtgatctacgcgttcagggggggtgtgcggcacaaccgcatgctcgaaaagatcgcgtccaaagagccccagactaccgcggagctttttcagctcgcagaccgagtggctcgtaaggaggaagcatggacctggaacccctccggttccggagtggcagcttcggccgcccccggatccgccgctcagacagggcggcgtgacaggaggaggaagaagaggtcggtctattccgacgacgagggtcatgtcctcgccgtcgagggcgctccgcgggccacccgaaaggggaggcctgcgagcgacaaaaagaaagaggctggtactcccaccagggagcgcccagccggcaagtggtgctccgtccacaacacctccctccacgatctcgcggactgtcgcgcggtcaaaaacttggctgagcgaacgaggaagtgggaggaggacaggaggaaggaacgccgtgagggcaagtcgccggcaactccctccggtaaacggcgaagtgaggccaaacaaaaggcccccgctgttgacatcgatgacggtgatgatgacctaggtttccaagaacctggggccaccattgccactgtcgatgggggagcgtgtgctcacgtctctcgccggagcctcaaggccatgaagcgagagcttctggccgcggcccctactcatgaggcgacgcgccgggcgcggtggtcggaggttgccctcactttcgaccagaccgaccacccaccgtgcgtcgcccggggagggcagattgtgatggtggtttcccccaccatctgcaacgtgaagttggggcgtgtcctcatagatgggggagcggccctcaacatcatttcccccgcggcttttgatgccatcaaggccccggggatggtgctccagccgtcccaaccgattatcggtgtgacgccggggcacacatggccgttgggtcacatcgacctaccggtcacctttggtggatcagccaacttccgcacggagcgggtgaacttcgatgtggcggacctcagtctgccctacaacgcggtcctggggaggcccgcgttggtgaagttcatggcggcggtccactacgcctacctccagatgaagatgccgggccccggtggccccatctctgtccatggcgacctgaaagtcgcgctcgcttgcatggagcagcgcgcggaccacctcgctgctgcgtccaagcccgagggtggtgacgagaggcttggcaccaccgcccccaccgccccgaggcagcggattgtcacatgcgccgaggtcccggtcaaggaggttgccctgggcgacggcccatccaagaccacacggatcggtggtcttctggatggcaaataggaagacgcgctcgtctccttcctgcgggcaaacgctgacgtcttcgcgtggagaccggcggatatgcccggggtccccagggaggtgattgagcaccgtctcgccgtgcggccgggcgcaaggccggtccggcagaaagtgcggcggcaggccccggaacgtcaagccttcatccgcgaggaggtggcaagacttctggaggccggattcatccgtgaagtcatccatccggagtggctggcgaacccggtggtcgttccaaaggcgaacggcaagcttcggatgtgcatcgactacaccgaccttaacaaggcatgtcctaaggacccttaccccctgcctcgcatagatcagattgtcgactccaccgcggggtgcgaccttttgtgttttctagatgcatactctggttaccatcagattcgcatggctagggaggatgaggaaaaaactgcgttcattacccccgtaggaacctattgttatacatcaatgcccttcgggttaaagaatgcaggtcctacttttcaacgtactactcgcatttctttgggtagccaaatagggcgtaatgttgaggcttatgtcgatgacttggttgtaaagacgcgcaaccaagagactttactctcagatctagcggaaacttttgaaaatctccgctccgcccgcataaaactgaaccccgataagtgcgtgtttggtgtacctgcgggcaagcttctcgggttcttggtctctgcccgaggcatcgaggccaaccccgagaagatacgagctatagagcggatgcgcccccccagcaaacttagggatgtgcaatgcgtcaccggttgcattgccgccttaagtcgtttcatatcgaggctgggagagaaggcgctacccttatttaagctcctcaagcgctcggggccgtttacttggacggaggaagctgaacgtgccctcactcagttgaagacatatctcagctctcccccagttctagtcgccccggggccaaataagcccctactactctacttagcggcgaccccccaagtagttagtgcagcgttggttgcggagcgcgatgaagacaatcctcatttcgcgcacccccgccctgtgctgacttggcccgggagcgagcagggaggagaagcccccgagtcaaacggtggcctaaggcccctgacgaccggagtcggccctctgcccgcttgtcagacggtgctgggtgcccccgaccctcaggaaggccccgaggccactgcgggaaggccgcacctatcgccctttggccccgaggttaaccctgtgctgactcgacccgggagaaagcagggagaagaggcccccgagccgaacggaggcctgaggcccctgacgaccggagtaggccctttgcccgcttgtctgacgacgccaggagcccccgacccccaggacggccccgaggccactgtgggaaggccgctcctgtcatcctccgaccccgaggtcatcggcacagaagacgagtgcgccccgagaggccacttggacgaagaacgccccggggatgcggcccctagcgaagaggatcggccccgccgaaaggtgcagcggcctatctactttgttagtgaggccctccgggacgccaagacccgataccctcaggcccagaagatgctttacgctattctgatggcctcgaggaaactgcgccattatttccaggcgcatcgggtcactgtggttacgtcttaccccctcggtcaaatcttgcataatcgagagggtacaggacgagtggtaaaatgggcaatcgagctttctgagttcgatctacactttgaaccacgccacgctatcaagagccaggccctcgccgattttgtggcagagtggaccccggctccagagaccgtctcaatccccgaggccagcacggacccctctcagctgcctcacaccgcccactgggtgatgcagttcgacggttctctgtctctccagggcgccggtgcgggggtcatgttgacctctccgaacggagacgtcctcagatacttagtccgtctcgactttcgagcgactaataatatggcagagtacgagggactccttgccggactcagagtggcagctggactggggatccgccgcctcttggtgttaggcgactcccagctggtcgttaaccaggtctgtaaggagtaccggtgctctgacccacagatggacgcttacgtacgccaagtgcggcgtatggagcgccattttgacgggatagagcttcggcatgtacccagacgggataacatggttgccgacgaactctcacggctcgcgtcctcgcgagcccagaccccaccgggcgcctttgaagaaaggcttacccagccgtcggcgcgacccgaccccttaggggagacggatgcgcctgaccggcccccgaggcccgtcggagtccaggcctcgggacccgaagggagcgctccaagctcccttagattgattgcttggatctctgagatccaagcatacctcgcagataagactctacctgaggaccgtgaagggagtgaacgcgtccaacgcatttccaaacgctacgtgctggtagaagggaccctctatcggcgcgcggctaacggaatcctcctgaagtgcattcctcaggaacaaggcgttgagcttcttgccgacatccatgaaggcgagtgcggagcccattccgcctcgcgcaccttggttggcaaggcctttcgtcaagggttctattggccgacagctctcaatgatgcagttgatctggtccggcgatgcagagcgtgtcagtttcacgccaagcaaatccatcagccggcccaggccctgcagatcataccactttcgtggccatttgctgtctgggggctcgatatcctgggaccgtttaagcgggccccgggcgggtttgagtacctgtatgtcgcgatcgacaagttcactaagtggcccgaggcttatccggtcgtcaagatcgataagcactctgcacttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcatggcgattcgtggatcgaggagttgccagcggtgctctgggcaaaccgaaccacaccaagccgagcaaccggggaaacgcctttcttcctcgtctacggcgcagaagcggttctcccatccgagctcaccctgaggtctcctcgggccaccatgtactgcgaagctgatcaagatcagcttcgcagagatgacctcgactacttggaagagcgaaggaggcgcgcggccctccgagccgcgcgctaccagcagagcctgcggcgctaccatcagcgccacgtccgggcccgatcactctgcgtcgacgacctcgtcttacgccgcgtccaaacgcgtgctggattgagcaagctctcaccaatgtgggagggtccgtatcgagtgatcggtgtcccccggccgggctccatacggctggccacgggcgacggcacggagctgcctaacccgtggaatatcgaacaccttcgtcgcttctacccctgaggggggggtcgagtgtcaggttttggctcgggccaaccccgtacccccctcgggtgtgcagggttagccggggggctaccacgcatgcacattcttatttctcttatttcagcatttcaataaaagcagtttcaatttcctaaaggttgtgtctgtgccgttttttccttttgaagaatcttgacttgaaataaggtcactcgtactcaaccttgccctcgggggctcggttcggtcagctaaaatcgccaaacggggcccagaaccgagccgtgccccggggcgtggtgaacttcgggggggaatcggcaaaaacccacaatcgggtcacccataaccctcggtcaccacattcccggcctggccagcctcgacatgtggatctccccaggcactagccccgacccgagccattagaggactgggacttgggcacgagcccttaaatcaagctaagacacaaaagaggaccacggcacagatcatcctcatctcatacgcatagcaaaataaaattgacacgaattttttcatcatttttgattgcagattaagttggtctatacaaaaaagaggcatgaaggccttaaaaaaaaaaaaaaaaaactggagtctggcgggggcctgggggctcagtccgatgcgcccgggtcgccggcctcgtcgtcacggtcgtctgcaccgctggcgtcgccctcctcgtcggagttgggggcgaacgcgagccgaggggccgacccctcgaaactgtggacgatgtggtcggcggcatcccggacccgcgcgcgcgcgtcgtcctcggtcccgggagggaactcttccagcgccatccatggagagaagttggggtccctggcctggtaactcgctagtacgagttcaaccgctccttgggcgaggtccctcgaggatgacttgatggtcttctcgagctcctcggggagttgttggagagcccaggccatcttcgtgaggtgcggagcgaggccttccaggttggtggggtgtgtcattgactggcctttccagaggcccgcttgccgaccggcgcgatccaggcgggagaccgcatcccaaagcatgccgggccctatttcgcccgccaagcggagggcctcggcttccccggcggatgagtctagcgcgcactgcatgtcggcgacggtgagttcggcagctgcgaggcgggcggctaagtcgctttcgcccgcagccgccccgctgatacgcgccctcgcgtccagctccttttcccgcacctcgaggtcggcagcccgctgctccagtgcggctctctcggcgcggacggattccaaattgcggcgtgcctgctccgccagcgctgcctcacggaggaaaaggctatccgccaaccgttgcgccgcggcctcggcctcttcgagagctcgctcccgctcagcgagtgcgtcctcgcggaggcggagcgcggactcctcttcggcgcaggcggcctcgtgcaccgccagcgttgtctcccggatagcggcggcggcctcgcggtccgccaagcccctctccacggcgccggcgtgttcctccaatgccatagcacgggcctcaagggcctcctcgcgccgccgggacgccgcttcgatctccgttgcccgccgctctcgggcagcggcggtgtcaaggaccccttgggcggcgtcgagctttttctttagctccgcctcccagctcccgtgttgaaggcggagggtgtcctgcgcctcgatcatcgcggtggtggcaatgagggcggcctcccgctcctcctccacctctcgggcgatctctgccagcgccgctttgcgggcttcaagctccgagacgtgacggcggtgagccttgcggcccacctccaccatgacatccaccgagcgccgcccctcctcgacacgcgcccatgcggcctcgagctccgctcgttccgctcgcagggcctccacttgggcgctgaacccatctagcaccgcggtgtttgcggcggccaaggcctgcagaaggggctcggcgctcagcggggcgacagaagacgaggagaatagccgccttggagagaatgcgacgcggctcggcccgccggaggacgcactgggctcggggatgtcccccggacccgattggtcctggacgtcgcctggggaagtgggcccaggcgatccgcccgcagcctcgtcgcgagccgccccggaggctgtcgcctgagcgtcgcccgagggagtaggcccaagcgacgcgccagcagctttgtcgtgagctgcctcggaagacgccatcgcctcagcctgacgagcccgggcggcctcctccttagcagcttcttcggcttggcgagcccgggcgacctcctcccgagcggtatcctctgcatggcgagcccgagcggcctcccgggcggcctcttcagcttcccgaaggcgatctgcggcctctcgccggtcagattctcgcctccgttcctctgcggccgccggatcttcggcctcggattggccggacttgggatggcgggaggaacgtgacgggacatcgctgaagcaaaagaaaaaaccagaagacaaacaagatgggtaagagaaaacttgcttttgggataaaagaaagacggtcgcaaagagagtgggacgaacctgcgagggggtcggttaaatgaccaccttggaggggaaatcaggtttccccaggatggttccgtctcccccatcttgcggagccgcttcttcttgcgctccccctcgggctgcgatgtcggcgcggccccctccgggtgccgactgctggcacgcaccgccccgccccctcggggaggagatgggggaggtgttcctcccagcttcctcttcccctgggcgtcggcagggcggctgctccccgagcccccgacgcggggcccagaagcacgaccccctcctggggtagattgttccccccggcggctctcgcccgcgccgtcgtggcccttaggagtttcctcctctgaggccccgacccccatcataatggtcagaatggaggcgcggtcgggatcgctgcagagggggaggattccttgagggatgagagacgcctccacggagctgagattcagcaccctttggaccacgatcttgaagtcctcgggagcccaatcccatctgactccctggtgggtccgcatgtagtcttcggacccggtgtactcccaggcgccccgggcgcgccgttggagcggcgcaatccggcgacggaggtagtcgccgtacaccatggcccctgtgagcccctgggatcgcaggcccgccaggcggtcgaggacggcgtcatagtcatcccccagatctaccggcgcccgccagctggagacctgcgccgggggctgacttggaagtcggaggcgcgcttcgttggcgaggggggtgtagaaccagtcgctcttccagtcgtcccacttcttgcggagggcgcaggggatgtagcggttcaacaccggcccccgcggctggaagtagcagccaccaaccaccgacggcggcgacaccgactgcacggtgaagaaccaccggaacagccgaagagatgggcgcaccccaatgaacatctcgcacaggtgcgcgaagatggccaatgtcatcactgcattgggggtgaggtgcgccatctggagatcgtagaaatccagaacatccataaagaaagaagaaaatggcggaaccagccctgccattgcgaaggggaggaagaaaacggaccgccccgggtagtctggtgccgggcgtccctcgcccagcatcactatctcccggccggtggcagattccggcataaagcggcgcggcagcccggcgtgcctctcgctcacgatgcgagaaggcggaagtacgcttccgtcgagcagagcggaacccgtgccatggcgccggaggaaggatgattgagaacgagcgcgtgtggcgaaggaaaggcgcagcagagaaagagttagagctcaagcagcgaaggcaaggggaatagtggcgaaaggaagggagcaaaccctttcctcggtgtctttatacctttgccatcgctgtgcccggctcctcgtttctcgcgcccactatctcgctccctcgtttcttactatcccgctccctcgtttctcgtgcccacgcttccactaatcccattcgcccgcttgcggcgcatgaggtagatatgcggttgtggcagtcgagatagatcgtatcgtgcgcgcgttaattacgctcgccgaccgaagcaacgttaccatatctccaggcgaagcaaatcggctcacccagattcgtacgtcgctcaagtaatgtggcagtcttgaagagaccgcccattatggacagccaagtcaccattaccgatgtgcatgatttgagaccgttgggtttctgcccaaccatggagaccggtcccacctgtcaccaagctttaggagtggcgtcacgcccgaccgcttcccttgagaagggcgatcgccctggcataacgccgggggctactgtcggtgatatgggaccgggagtatcgtgaccagaggcttgaggcagacacaatcgcccacgtggcctggcaccttcggggacgtcgggcccgagggtgaggtgtccgccctcctcctgatttccccgaggggggg

SEQ ID NO: 68028 - DNA, 18968 bp, Oryza sativa
ttactctttcataaacaactaccaacagaaagttcatacataactctgtatcatatgtggtatttgcctcttgatttagctactatggttaaactagcatctttcccatgtgtcgcagcagatcataatggttcagagtgcataaatgcaaataaataaataaataaataagtaactatcctggaatctaaaaattgtatatgtgactacatgataccgatcaaccatctgcgtgtactcgtgtggaaataagcatttttctttgtaaaaatcttttgagacagtatgcatatgcctacatgtttgcaatcacaaaatatctaagtggggattgagtgtcgaacacaccataacccccaatcaccactttcataagagtaaagattgcttgcttctttcttcaacaattggacgattcctcgtgtgaacaaaccctaccatccgctacaacaaagctattgctaaattatgtatgcaagtattatttggatatatcatagagttgcggttgcttgaatgaataataagatgtctttaaccattatatatgtgcatcagctgctgtttaccattgaagaattagcctgctcaaagtggatcaggactgatatttagatcaccagttcagtacagacagttcaggatttaaggaagtggtcaaataccttcttaggggcatcctcctgcacagctgagttcgctccacttccgtcatctttatttgcttgaggtgctgcatggttatccataccaggcatgtgaggtcttggttgccctggtctgttagcaccatccatctgtgcctgcaaatgtggtggcaaaggttgccgcacaccagtagcaggcatcccagctgctccaggacccttgtgtggcagtcctggcccaacataaaataccttatgagcgaagagagcacaacgagaggtagacacaagatatcatgttgtgacaaagttatgaaataataattgaaatctggtagccagtattatcacttaccttgattttgttgccatgacgggccgttgtatgctgttgaaggcaagcctgttgcacgcagcagtacctcatcatatttaagagagtcaggaagtgctggaggcaaaggagttccagctcggtgcctctccatcaaataaagagcaatgcaaaactctctcaaagaaagcatgccatcattatcttggtcagacaggtcccacacttgcttcagaatctctgaaaattatagaagaacatcacttgcattagacgtttgcaacagaactccatcccaaggggatatgtttggcatcttaagaaaactatcatagaaatagaattagtcgaaattataacctacaccacaagtattatggcagtaaacataacaaatcagcgtaaaacaataagctaaaacagaaaatgtgtacaagaacttcacaaaagaaaggaattagagtatcttacagacagaaacaagcatttgcatacttaggagttagaagaattaaatgctagtcatgagatcccacctcttggaagtctccaactgaggaacagggtgcgagcttccgcgccagttattttgccatctctgtccctatcaacatccgcaaagactttagtgtacttctggatgtcagactgagtaacttttggccattgagaagctgaattagaaactccagcagaaacaccagatacagttggtgctggaacactcggctttgtgatgggatgagtctgttgaggttgactgccaccagaactcactgtcggaataccttgttgagaaccaaactgagctagattcgacaggttctgggagccagatggtgtggacataaaactggatgaattaggagccatgctcgtcggaaatgaaagtgtggatacattcgacttaggctgagtaagagcagagaagatgtcattgcttgctcctaagccactggcagagccatttccagacagcaccaaagctttcgaatcttgagctgatacagcactgttgctttgtggtggcattgacgaaggaggcgttccttgtgcctgttgtccgggagccatgcccattgtactagacaatgtaagaccaaatccacccggtgttgcttgttgtggagcagttgctcctggagtagcttgcgggagacctccaacggaaccaacattgcctcctcgccaaccagcaggtgctcccatgctgcctcctcctagtggtacttgattaatcccgggttcttggccttgaagtgatgctgctggagctcctggctgagttggcctcatgaaaccagtactcgaaggaggaggctgttgattaaaccccatgctaggcggctgtgattgcattcccctctgcgttgcaaactgagttggctgcagagcaccaccctgacttgcagccggcatcatagaattgaccccttggggtcttggcacggctccggcgttcacctgctgcgaaccgccaatttgagcagagcccggcatcataccacttccctgaggccttggagcaccagcaacattcatctgcggctgcggagctccagcctgccctggagcaggtgacaccgcggcatttacctgcggcctgggagcgcccgccgcagccatctgcgggggagcttgcccgccgccggctatcttgggagctggaattctagcagcggcagggccatacagcgccgactgcactatgtcgggcgtgagctgacgcccgctctgcgccacggtgacgaggcgcagcgcgttgaagaactccggccggccgaggaagccggtcttgttcttgtcggcgtgcatccatacctgcaacacacgaagttccgacaccaacaaccatcaactcattcgaattcgcgggagcgagagagatctactactgctactaccatccaccaccgagatcacgcctaaaatcgggcgcactctctccccaatcggagagtggccattagcagcggcggcggcgagggaggaggggggtgtcgtcgggacgaacctgggcgaggacttgctgcggcaggttggcgccctggaagaaggcgacggcctcctggccgctgatgcggccgtcctggttcaaatccgcgcggcggaagtaggcctcgaaggcctccatcccagccatcgccgggatctgggccggagtccacgccgcgcggatctgcggcggcgagcggcggagatctcgggaggggggagcgtgtcgcgggcggctgcagcggcaggcaggaggcgctcttctcctctctgtctgcgagggcagtggttggggtcctcctcctccgggtgtcgagatggtgagcgtgccaacttgcaaattgccccctcaaatttttcatatttgttcgaatagggcaactttagataaaaaaggaaaagcaaaatttgttcggaattattttttttcctcgaatttggttgaattcgtttcagctttagctggaaaatcgcgtgaaactaaactaactttctaaattcgtgagatctcgcatcggatttatgatagagttgatactctttgccggacaatagatcgataaccttgccatcacttaagtgaaatgaattcatagctaaatgatacaatgatttaccacgcttttatctaaacctggttatgttttaattagataacacaaatatttcttttggccttcacatgcacacaactatattatatatgtggataggaagatttgaagcctagttttgtttttaagaaagtaagcatctatgacttcatttggttgaaaataacaggaatgctaggtaactagatcatatccatagcatccgcatgtattattgatggtcttctcggctggactatcctttggcttcaccaaaactagcacattgctgctctgattggtcgtttgggaacatcatgctctttctatatggccttgtcaagcgctcaagcttgtagacacctcgccactcctccacacacttgtttagtgtcgcgttacaccttcatgtgcgacattcatcatcagctccctttccaaccgccaacaagacttgatgctaaggggcaaggagcttattgggtcggaggtatatgttccctgccgtggaacatgttgtgctccttcatggtgtcactaatggctttctcgttcaacatgtccttcggctccactaaatgcatgtgttgctacttggattggtttttggtgcctcctcgaatcttgcatatgaaatgtgccaacaagcatctctttccatgtccccgagcaggacctcgctgatgctctagtggtgctcctcatccttggattcctagagttatggctctcgtggaaccaccagatagccgccctcatcactcgtggtttccgcacattggcaactgacctctgcagctatggtgactcttattgatcccgtgacctacaccatcctctaaatcgtacgagacgtcattgtccccttcaaccgtcttagtctacccaaggtgttgccttttttatgccttactgttcgattcctaagttcttgggcgccactatgagtctaaagggtcctttgattcatatgattggtagagaattttcataggatccaaatccctatgaaagtttttctatgcgtcttttttgattcatagaaaactttccatataattgtattcgtacacgcttcacctttctacgaaaactagcaagatataccgctttagaaactttacattgtttttcctatggcactttcaaaggtttcatatcctcttttttcttatgttttgattcccgtcggattggacaagcatatagtattggagaaacacaccacttcaattactgtgctttttgttttgtttttttcctatcccacacgcatgctagggttggaaggtggtggtggtgatgggtacaactagagtgcacaggtggcgtggcatcactgtatattcagaccatacatagcgcgcattatcgtcacccttagaatttcctccaaatggttggaacataatcaacaaaaatgtgccaacaagacgccggtaaaactagtattgtagtactgataggtattagccctgtgtcacatcctgattttcgtttcaggatttataaattatttaataaattattattagaatttatattaaatgttcattaatttacaagtgaagttaaatgtgggaaataaaatttcctaaatataaataatggatggatttaatttttattaaattctccatggttaattatactccctgaaatattctcggatttttcggagctcaattcctaattttaaccatacaaagaacatttcagtaattatccacatattgaattaatcattaaatggtctgattataatttttttaagtactttgagtgtccaagtattttcaggatttttcttgaaactatttgagcattggaagtatttttaacaattcaaagaccatttcagtgattattttaattggaaaaagttgttaaatcctctcctaagccgttgggctgatttcagcccaacatctctctccctcgcgcgcgtgctgtgcagtccaagtcggcctagccgagctccctcttctctttctttctttcctttgtttttcagccagcccaagacgaaaagtctaatttgcctccccgtgtactgttcatcttcaagcttggacagaagcccgagctgccgtcctgtgctctagccgacgccgcttcctccaccaaatccgccgcatcccgtgctccgtttgcaaaattagttgaggggaaatattcctcttatcctcctctatcttttcccccaagaatcggactttatcccgaagaaatcaacgcggaatcgaattcgttttcgagtttatctctccaactaaccctcggtttttccggctcaaatcctctcggttggagtccgatctcttcaatccaagcctataaatagcatcccctagtcgtccccttccgtttgccccaagtcccgagctcccccgtcgtccgtagagccgccgccgttgccggcgatcctccggccgcgttgcgctgccgcggtagccgtcgccgctgccgtccgtcgccgccgtcgggtgcgcacggaggagaggaaccccgtccgccccttcgcagccgccgaagaccaccgaagcgccatcgccgccgtcaagccgaaccgtgccgccatagaagctcgtcgccggtcgtcatccgtcgtcgttcgtcgcagtggttagtaccggtgagatcgcgttgttctcctctacgcgtaggtaccctccaaaagtccggccgagtcttctagcgccggcgaggtcgtcgctgatgtcgagtcgacattgatgatgtcagcgatgacgtcattaatccctttttcttagttttctctattagatgaaaatcgattaaacttcggaaattcataactaaatcatcataactcggattcgagtggttcaagttgctaaattcatctaaaatcgagatctacatgttaaaaatatccacatgtactgtttatgcttgttttttactgtttattaggtttttattagtctttttcttcgttttgcgtgttagcttgtcgtttccgtcgttgcgaaggttcgtgagtgcgtcggaagtgttcaggaagattaattgaagaccgattattgcaaggcaggtcacacagattctaaacacaatcctttgagcatgttgatcctatatttaaattctctatttattttaactgtgcatttattttcgaatgtcaccgggtggtgtgaacctattcctttgttatgaccaatttgcattgaataccctattctttgataccttgggtaataaattgattagcttgaaccttatatattggtttggttcagctaaatgctatatatatatatatatatatatatatatataattgcttagccatgcttagaaacattatcacataattgggataactaatgttacactatcacttatggttatatttaatggtagctcacgatggttaatcgtgttatgataattaattgataactaaaacttgacaatggtgggttgtgagcacatggttttgaaggtcgtgctcatgacaattaaggaccggttcgcgagctactgttgtgaaacattaaccgtgccaaccacaagccagcgtgggcaacggctttaccttttgtatagcatgattcattacggggtgccagactgagaagtggcgagaagtccgtgggggtcgctgggagtccatgcctctggttatatttatagagggggtgattatgatccaggaatggtgcgctgtggtgagttgtgttgtgcaggggatattgtcatagcctctattcgggtactttccagtatcgcgacgcatggtagacatgatgttgaggctgtgtcttgtgggtacagtggtgcacctctggccagagtaaaactattcgaatagccatgcccgcggttatgggcgggttgagtaatgtttttcgtgattagtctcacacctctcataataattatggatgttataactggtaataatttgcttagctcctggtttggagttagatctgtacagccgggtatggttgttcagaatggttgggcctgagcagcatgggcgtgttgttcagtattgattaaaattaatgattaaagtactctactgttttattactcttaaatgtttgctaaatgctgcttttgcaaatgaaccctatattatgccatcctttggtatcattgtgcacttgcatatttgctgtgtggcttgttgagtatgtcatatgctcatccttgcaataatcatcaaacctcttttaaagaaaaaggatccagaaggagaagacgtttggcttataccctagttgagctgcctgtgggagtggagctgaagccattgctagaccgttaattccgctgctgttttcttttcttttgtaagtatgtaacgttattattatgatggatttgtatattaaattgtcagtttgtgtacctcggctgatttctggacgaggattttatgcacaaattagtttggaaattactagtgaattttcggacgtgacaccctgttacatatgtagcaggttcatcattcacacatgtatcaggtttcgtacccacttgtgcctttatatcaacctggtatatccaagtttagtaccgtcatatcataccatgtaccagacacgtactccactaaaataaaccaacctcgtgctagcatgtcacacattatagtataatgaattagtatatagagtatatccagactttgtcacatcctagtatgaagctatgttcagattcgttgtactatgatgtatcacattttagtacagatgttagtttatcttaggataaaatgtatcacattctagtacgagattggtttatattggaacggaggaaataagtataatactattttggccaatattctttttgaaagaggggacaagtgaataaaactccattgatttgtaaaatcagaaccaatgcaaattaatcgactgtcatctcctcgctataacagcatgtcacacaactcacaacaactgcgaaagggcatgtaactcggtaattacagtgaactgaatagtaacttaaggttatgagtggttggatataaaggctggtaaaaaaaaactctctctagaaaaacaattcacaactagccagatgtatgcacagtttcacacaggcccagaagttagcgccgttgcggtggcggccagcatggccttcttcctcttcttctccctgagcttcaccaccttcctgtggcggttggagtacccgtcgctcccgaagccggggctcgtcgacggccggtactccggcagcaggtggtcaatcctgtaccggatgccgcacgcgttgcacagcgtgctcggcccgtccggccccacccgccactgcggcgtctccgtcgtctggcagtggccgcacctcttctcctcgccgcatttgcgccgccgcttggcggggcgcgagcagtgttctcctccttctcctccgccgccgccgccgctggaaacttcgtcgcggctgttgtcgacggcggcggcggcggcggtggccagctggggggataccagtgaccagaccctcttgcgtacggcggcgggtgcgcggcgcggcttcctcgccacagccgaagcttggagccacggaacgtcgtcgacggtgctcggcgtgcccgccttctcatcgccgccgcctactgctctctgcaagtccagcccgccgccaacgtcggcgtgcatgtgctcctcgctcctggagtccacgtcggcgtcggccgcgggcgtcggcggcgagcaatcaagcttgaacgccgccaagaaagggtcgtccaccgccgagaggcatctcatgacctcctcaaacgggtcgtcggggcagcacagcccctcgccgtcgacgaggtcgtcgaaggggacgtcgccgtcgacgaaatcgaaggcgacgacgtcatggagggagacgtacggcgtcggtttccgcatcgatcaggtgcaaaaactaattcgcggtttccgcatcgattaggttaaaaaaaattaggggtaatttgcgaggtttagggcttgcattagtggaggcgtcgacgaagagggagagaggagagagacacggttagtttcgtctcgggagaaaaactagcgatttgtattccgaaacaaactctgataacagaaggcttccggagagaaacacactcaaaatcggctacgactgctatcttgtattgacacacgatttctattctaaacagatacaaatttcgttaaaaaacgcctgagcggaacgggccgggagagatatctcggtgggcttaaacggaaagccagacttctcattgtaaatgggccggccggcctccagaattcggcccatgtccaattatccatggcagtatcttttgccctcgagaacagaaggggaaacagatgagttgtgggcaagatgaagagtagtattgggaaagtatttttatccttagagagtattcccttgtttcttgtacatcacctaaataaatattattttcttctaaaaaataataaggtatattaatataaaatatatcacacttccaagagttggaagctgtcaaacatcaccaggcagtcaagttgtagagatggtgaaatgtatggagaagctgcagtcaagttgctacattaggagtaaaaggtgatttttcatctgaagaccaatccagaaatattgggacaatctgactgaataactgctaattataaccaacgttttgctctaagtgttattggatgttttcattagtggtataggttgcttatgtaagtatgtgagttttctctaggtgatttctttgtatttctttcaaacttgatactgtatttgtcactgtgaacaatgtgaatattttcctttactgtttaatattgattgccactaatcatgatgtgaaaaaataactgaggcaaagaatcatgcctttctgctatgcaaaatgtaagctttattctgcgcaagggctcaagcatttcatacataatgtcaggagccgaagagctagaaaatataatatgcagctagctgatttgttgttgtcagttgtatttgagtagtacttaattttgttttctattgcatgcattgctggatcaatgggtgcttggtcaagtcagcctcctgcaactatgtcgctggtaatatgctttcctatagctgatcttttccctcttcggtcatgttttattctgttctgttctgcttaccacacctctcctcctccccaaaaaataaagtatggaacatcattatgtagaaactaaaattcaagttgactcaaattaagtagaaaacatgctagaaaaaagaagtatccctccctcactgcttcaaaagaattgagagtacaggtagtggaagaaggaagcatatggagcaataaatttgtctgcctctactactattagaggtaaagctgaaaatgatttataatctcatttggatacagttagcataaatatgtaagtcataaacttacagtggagctgtataaatattttttgtatgaattttgaatagcaacctgatatgacatccatgcacattacatttacagagagcatatgacatgcttgcaatgattagacttccgaagaaatgtgcggtgttgtcgttatgagctgtgaggcccagcaagtagagcagattagtgtgattactgattctatatgttaaaatcgatatactacatcatgtttctatgttttgtagtgcagactgcagactttttcttgatataatttatgtatctattcaataatatttttttctacagctaataaacaacaatgatgggatgatttttataagcaggacataaacgctagaaagctaaattgacaccctggtgcctcccgtttatagatgtcaccaacaagtaagagaattcctcctgtgtttatattggaatcttgttgttgcttctatctgtaaaacctgaaaaatcttaaaccattcctatgctgaataatagaagatataaaatgatatgtgttgccattgcatccttatatttatttcttcaatccacaattaactatctaaaccacttttttttgttttaattcacataaattattttcgttgctggttttagtatgaatattttgatatatctccgtgcaaaaaaggattttgatatagctatatgcatgtgcattgccaatcgattcctttccaatatgtaacagtagtcattgcaaatatactttcatattgtttctctctgttggggcaaaaactctgaaaaatgatatttggactggttgataggctcaccgggtaaaaaggtagaaaccatgttagaaacacaagtatcggggatttgatgtatatattgtttagatcatgaacatttaagttttgaacaggtttatttacaatagctgacatatagtcccttaatgtattatgaaacccacaaggaatttaattttgaaataaacatcatacatttatatcatatttttactaccactgttaatatggtttgtgcataataaaaatgttctcttgcaatatgatgagtttgatttatattagttggagaggatatatccggtttaattgatattggcttatacatgccttgcacgtgcacgatcactagtcgttaaataacgcctgagcggaacgggccgggagagatatctcggtgggcttaaacggaaagccagacttctcattgtaaatgggccggccggcctccagaattcggcccatgtccaattatccatggcagtatcttttgccctcgagaacagaaggggaaacagatgagttgtgggcaagatgaagagtagtattgggaaagtatttttatccttagagagtattcccttgtttctcgtacatcacctaaataaatattattttcttctaaaaaataataaggtatattaatataaaacatatcacactacaaattcaaatttaacattttataaagttgtaaaaaaaataagaaatataactgcgaaggtacgttaactattttcaatttgatttgttatttttcttgtatatatgtagatatcaaatttaatcttacatatttgtatagtgatatatttcatatattttgatattttttaataatcattgtttttgtaaactagtacgaaccttctctgccggatgcaaatgaagctgcatatgcaactacagtcgatttattttttcttcactcctttttaagcttccttatgcatttgtgatgacaaattcagtatccttcaacacacaaagcttacggacattttgcactcaccaacaccaccttgccacaaacccagcaagcactctgaaaagcagagttaaacaaaacgaaaaaaaaaaacacgccccaaaatgtacaggtatactcaaggagttgatccacgagaccgatcagtcagtcaatcagtcgccgacgttgagcagcacgtcccagagcgtctcgtcgacgagctcgtccagtatctccgcctccatctctgcgccggccgcgccgacgtcctcgcggaacgggccgttccacggcgacatgctcatgtcgcggccgatcagctcgtccacggagttgggcgagtccgtcggcggcggtggcgccagccacgcctgcacggtgttccacagcccgtccagtagcctcttgccgccgggggatctcctcggcgccgcgccgtaccacctgctgaacgcgcacagcgtcgtcgacgactggacgacccgcggcagcgactcgttgatcaggtcgaagaggaggcggtggtcgacgccggtggccgcagcgtcgcagtcggtggtggccggggctgaggaggacgacgacgactcgacttcctcgaacacccacgcggggatcggtttcacctcgcggtctgagaagagttggtcagagcttcgtctctgtccgtacagaccggcgatgacaagaattgctctgatgtaagctttgatggggttatctatctcgtctgtgtcgtcgtcgtcgtcgtcctggattggacttgtttctgcgagttcttgatcggtttgagcttgctccgacgatggatgctctggttctgagaaaatttatttggtcagaaacatcagatcaacattgcaagtgccatgcctgatggctgcaagcaaattcagagagcaaagctgcagttgctacttaccagaagcactcgaactcatgtccctagccgccatcttcaagggagatcggtgctcgctgaacgaagcctccaatggcgagacagggctcgggtaacctcccctgctcatctcatcaggagggctactgcaccacgacgccgggctcggcggcacctcggtggagttctcctgccacaaaacaaacagcattctcatgtcagattgagctgacgcacaaaacagaatcttgaagcagaatgtgctcaaagaattcagatttgcctcacctggaggacgccggggtggatgaggacggaaggggcggtgaccagcgttccgatcggagggagatcatcggggaatggcgactcgtcggcggagtggagcttcttgccgaacagcttcgctctcagccccagattctgcctcaggttggacaccctgcccttgatgttgaacgtgtccttcctccccttcctctcctcctccgacgatggcggtggcggcctgctcccgtagccttcctgcttgcgctgcagccgtgctccggtcagcacccgcggctcctccgagagaagcttcacgaaagtggtccccgacaccggcgccgagaacgacctgatgaggttcctcggcgataccgggtcggagtcgatcgccggagttggtgacgccttgtggtggccacgtctgaaagacctgacgtcgaactcgatcgcgtgcttcttctcctccttgctccttatcttgcccttccttgccacctcatgcctcggcttcggcctcggctcttcgttgaacgacgccgaggcggttcttctccggtgagacagtgccggcggctcggtctccggctctcgtcggagcacattcttcagcctgtcggagaggtgcttcctggcatctctgcagatgtagtccatctggctctggccattgagcgggatgtcgctgcggtacgaccgcgtcgactccgaccggagcaacgccgagtgcaggtccttggtgacggtctccctgatctggttggcgatgctccgagcaatctgcttcgggtcagccggaatgtcgccgccggcggcccacctgtccgccgccctgtcgtcggaagccatcctcccttcgagctcgaccttgagccgcttcttcacctcctcgaggaaggcctccatgttgttctccttcttcaccatctccggcgaccccaacgacgactcctcgatgtcgtcggtgctcatctcgggacagggcttcaggatcactatcttcttcggcgacagcagcctctcctcctcgtagtagaatctcgacagcggcagccgcgtcgagctggcgtccgcgctcgtcagggagaacgtccggctgccggagatcgacgtgccggtgccggtgccgctctccttgctcctcctccagtgtgcgtcgccattggagtgcgtgtgcttcttgccggcattatccttccctctgtgctggaacctgtaaggcacgatgtcagtgcacctgacgtcatcgtcgtcgagatggctctccaattccagagctctcgactgctcccacatcctgctcgcctgccacgcctcgaaatccttcttgaacttctgcagctcctcctcctgcgggtgctctcgcggctgcggtttagcccattcactgctgctgatcgccttgctcagctgaccaaagagctccatgctgtcgtcgtaggcacagacctcagcttgcttcggcgaatgcttcatggagcccttgtgttgcacgaaggagacatgcttggttgagaccatttcagaaggatctcttcttggcattggccttgtggaggttatcatgtcttgccttttctcctccgtgtggccggcggcaagctcaccggcggttgtactcattggaggtgagtccatgcccatcaacctggcaatgacacttggtctcttctgaacttcatttgttctgaaggatacgtcctcatggatgatcctcttgattggggatgagctgtggttgagaccagcttttgggtattgttgcctcatgttgcaggagtactgcacaagttacaggaagcttaatcaggccactgcaaaagttcttgccagttaattagctcttgcacaggatgtaaagttaaacattggtttatacagctccttatttattgatgaaagatacaactttgttttcacgatgaaataattcatccacatggggttagatgccaaatagtaacttatgtacccaacagtagctgggggtctactgttaggcaccattattaatggatgtttcatgatgtcttctcatacagcaacattcgggtacagatacacctagcagcaatgttactatgatgtacagaaatcataagtaggcatctcatctgtcaagagaaatctaactactttggctccttcgtgcagaaaatgaactgttagtcactgaaaagacaggttcttttctggaaacagaagaattcactagatgcttatgaggggacaaaacatgaaaggaattactctcttactacagaacagtgaggaaatgtacaagactcaccgggacatcctcttggaagacgccatagctttgtggagcctccagggtgaactccatgctattccttggggcttcaaatcctacaaattcagagatggcaccttgatcagttataaatttgcttcaaattcaattaccgaatagctggaaaaacaacatagaaagtctcaatgaactcttttatttcaagtgtacgttaactcgttaagcatcaaccatcattaaggatggggcttgtcctggtgactcggtgattcagaacttaaggcaaagaccatgtgtaagttggacagagagaaatgaatcaccgtgtatcaccgtaccttcgccctgcttcttgtgtgaccacttccttgaggtgctagcatgagagaagtccaggtactgcagcatggtggcacttgttgccagagagatccagcagtacgctgcgatggcaatattaggatatctgaaggacgaacgagacagaccttactatcctgtaaaattatgtgaggtatcatgtcagattctacagaaaatcagccacaccaaaatattgtagtgaacacaatttatgatcaccattacgacttttttcctgcaaataaaaggaatagcgcacaagacagaattcatgaagacatttgctcatttcaacaggtcaatgcatattcagcaagcttgaattccttcgaagaataccccgatcaagaacccaaaatttccaatgtgtgaggtggaatttcgtatcagtaatcaacatgaccgaaaccacagaaacatagagggaaaaaacatcagacgaactggaggagaatcttctgagaaatggtttctggaattcaattcatttcgaagcaaccatccagtcatcaagacggttgagcacatgaacagaagcaaatgatgatccaaaaacgtcaaacataatgagcagttgaaccccaccacgtgcaaacagatcagaagcaaccgcattcctcccagaaccaaacgcatgaactaaacggacggaacagagggagctgatcaatcaagcaagaagaactgaggagaggaagctacgtacaaggatcctctcgtgcctcctctctgcagttagcatgcagctccccggcaaccaccggccggccgccgccgatcagcggcgaaactgttgcttctcccaccgtggaaatggggtctcgctggggtaagaagagaagagacgccgcactgcgatgctctgcaatgagctgcaagcttcttgccaatgagcctgtgctcatgtgcaggtagtagtggtataagagttacagcccatgaagagggaggaaagcagcagccgggaaagcgaaagcttctccctttgcctctctttccccacaaccaccctccttttggtctccctccttgcctttaatattccctcttgatcgccatcttctccttgccacttctcttgtccctgatctcctcctcttttttagcctttacctcttgcaaatttttaacagatgccgggagaagatgccttaatctcttcttggcttggcattctagctagaatgcatgcatacccagctggccttgcctacatgctggtgaagaagagaaagccatgaaatgcttagcgataataattcctcctatcagagaaaagattatgttttttgtgggggctgcagatcaaaatgacagcttttcttgtatgtagccatggaagattctcttactacagaagccagcttcagtaacggaagaggagagcttttgctgagttattttagctgggatgacagctcaagtacgcgaggattctagttggtgcaccacacgctttgatcttttccgttttccctaaccacacgaggccgttccatttggcgccattctgttaactgccaccggccgttctgaagaaggcgtgggatgcagtcagcgccaatgcaatctgtatctttcttatctccccctgcgctggtcagcatcatgtgggaattggatgagatgtttctccctttaaatattcagttaatcacataatccataggagaatcacttgacagttgacacccagagttgtaccacaattttacaataaccagtgtctgaatagactgaaagaatccctacaagaaaaactgaagatgaattgaactacataatttatatattagacgttaaaagcaaacacaatatctatttaatttctccatgaccccaatatatacgcctacactacacaaggctatcatcggcgagacattttttcactagagaaatgcccaaactcatgaacacgatactgcccaaggagcagacacacatagcccctgtttaggggagcttaagtcattatcgaaaaaaaagaggagcttaagctactctcagattttccagcttttaaaacaattcagcttcttgctcaaattctaaatccagaaattaaacaaggagacagaagacgggagatccattttcttctgattctcacaagttagatactcactagctgcttcttaaaattttccaaagtccaaacagcaccatagtgctctcaaggaggagtggatagttctaaatccagaaattaaacaaggaggcagaagaagggagatccattttcttctgattctcacaagttgatactcactagctgcttcttaaaatttccaaagtccaaacagcatcatagtgctctcaaggaggagtggatagggtaggcgccgtgcaccagcgggataatcgaccccatgcgtgagggcgacatctgatggcgaggatctc

SEQ ID NO: 68029 - DNA, 756 bp, Oryza sativa
ctcgctcgcttcaaacccacaaaatgcttcaccagccaagataaaaatggtgagatcttcgtagttcttcaaaaattgatacgtgctagttgagaaacaaactgaagaggacagtaatacagataagcgacttgttgctagttgccaaagatttctccgccctctttcaaatgcatgtgcaacaagttttgcagcatctgtccttagctgatagaatggtgaatctgttcctgatgtgctagtatcaggattgctgacatcagaagatgatgtcctgtcactcatttcagctgcatgacctctacctgaatcacctaatgattcatctgcactctgggatgtgttgttccttcctgtcagagagttttcgccctcggactcgatactctgaaaagtaaccacagtaaaaacgaataaagatatcaaaaatcaaaacaactcaaccaaaatattgcattagaatatgtaaaattatggaaagataagcctaattaacttacatctcttttattctcaaaacaggtaattcttggtgatatattatgtacgggtcaacttacagcatatttgacagttgccaactgccagctccatacacaaaatagagtttaaactgttaacatttgacatctttatacataaaagtttgttcagttgtaagattctggatgcttttattgttgttgttatttcaacttcctaaactattatttctcagttcggctttgcaattttttatgatggtttacaatttta

SEQ ID NO: 68030 - DNA, 555 bp, Oryza sativa
ttagtacttgggtagtgggttgttgcaaatcaagccttcagtggttatgacaatcatgtcatcgactttagatagagaattgaatcacttgcattacgagcttgactggattagttagctgagtgggttctggctcctctagattgccatgaatagctggagaaatggataaatatgagtttaagcatgcttaaataagttatcttaatctttccttgcgatacttttgctttaattgttagttgtgtgacatcttaagttcacagagttgcactttacgtccttgaaatattatgctatattctaactttttggctttggatattttgtagtaacatgaggcaaacgctagcttcctccttattaagcttggttggaacacgtgtggtctatgaagatgcagattcacttgaaccttacatggatgatgcctgcttgattgtccaagtgaaagcctattcgataggcttttatgtgtcctgcaagctttgcttggcaatagccaaccaagttggctgaagactaagccaagctccaagccagctgttaaatttt

SEQ ID NO: 68031 - DNA, 577 bp, Oryza sativa
agagccattgatttggatgacagcccagattacagtgaaaacacggtacaaattaaagcgaacctgcaattacagtgtctcacgagctgctgcttgacaacttgcgaccatataacagcctaagaaaactgatcatacagagatatgagagttccaaatatccctcttggttgggtgagccttccttctccaacttgacaacaataaagttcttgttctgtaaatctgagcgacttccaacgcttggtgagctaccgtccctccagtttctccatgtccgtgaaatgatgtttctgcaacacatccgacaggagttctgcagccatggccatggtttcaagggcttcccagcactgaagaaactgaaattcgtgcagatgcccgagtggtcagagtggtctggggtggatgatggtgcatttccgcgcttgcacaggctttccatcagatgtgcagataacatactgtctcttcctgtagcgccctttctgtccttggtttcttttcaagtgacagattgtcccaatatcactgcgattccagcatcgcccagcctacgtcaactacacatttgtag

SEQ ID NO: 68032 - DNA, 539 bp, Oryza sativa
tttttcttcaaactttcaactttttcatcatatcaaaactttccacacacacacaaactttcaacttttttatcacatcattccaatttcaatttcaaccaaacttccaattcattccaatttcaatttcaaccaaacttccaattttgacgtgtactatccacaagttgtcctgcctttgtttcagagctccaacaaaagctgctcgaccattttgagtcatacgcacgccaccaatcgtaagttcgtaatgtaggggtaattctctttggtttactaggactttatcacgtttcataatggcaaattaacaggcctataagtaaggttaatccttgattgtcaattaaccgcacaacatatttccgcacaacactaaaaagagggttattgccgtgttcttgcggtaacagttgaacatctttggatgatattcttatatgttcaatcgttcgatgcctctgttaaatttggcatatacaaatttactgcttttatgattactcgtatttctaccaatataaacatcaccctgtcta

SEQ ID NO: 68033 - DNA, 2652 bp, Oryza sativa
ttccacaggccaattccgaattaatattcgcattgatttaaaagggtttactcttgctttgcaccggtattttcttagggtcatttataaattaaatttaggcttgggaggagaacttcggggtgtgacaccgccgccggcgaccacctggccgtgcgccgccgccccgctcgcctgggccgcccggaccccccttgtcgcgccgcgtcgatctcgtgcgccgccgccgcccatgcgtgccgcctctcccgcgccgcccgtcggtcgccgtcgccggagaccgcgctaccgccgcgccatggctcagctaggccggctttgtgccgtgctgtgccccagccgcgccgcccctggccgcccgatcggcttgggccgatccggaccgtcggttcccgtggaccggtggtggaccggcgcccttgtgccgctgaccggtggggcccgcttgccggcgccgcccctccccctttgatgacgtcagcaaccgtcttttcctttggaaaaataaataataattgcgtcataattcgttaataattctagaaatccatttaaatggctcaaaacttctaaaattcatatctaattcattcgaactccgaattgagccgttcaacttgcaaaattcatctaaaattgagctctacatgtttgtttagtttttatgtactgtttccttggtttttattagagtttttcctcgttttgcgtgccagcgtgtagttcccgtcgtttcggaagatcgcgttcgcaaggataagagttcagaagatccaagtgaagaagcaaggcaagtcacacattccctttgagcatgttgatcccaatttataaatgttttaccgtttacaaataaatatgcatgttttgctaattacatgggatccgggtattacctatctgctcgcttgtgccatgtttacttgatatctgttctttgtcaaccttagataatgaatcgactagctcatgttacttatgtgacctagctagaactatatgcttagccatgcttaattaccactagctcagttgatgggataattacagtattagacctttttagtatcagagtgagctgcgtgctcgagacatctggccatgcttcatggtcgtaattatccaactaaaatgcgactgaatggtgggctgtggctgcatggttttgctggtcgcacccatggcagttaaggaccggttcgcgggatgccttggaagaacttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcctgttgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacagctctgataagagtaaagctattcgaatagccgtgcccgcggttatgggcggtcgaccagattcaccgtgattagtcccatcttaataaatcgacccaatacactgtagttcaggtgggttggttgggcctgttcaacgtggtgtagcgttgatcagtggagatttaatgttactttaattactcaacagttttactgttttgctcaataaaatgttttataaccgcctttatgcaaatagccacaaaccatccttgtatccccttgcacatctgcatcgttggtgtggcttgctgagtacggtggttgtactcagtcttgcttttattcccccttttcagaagtgtagtacttctgagctgaagacgaagttagaggaccaaggctcagaccccagttgagttttgcctgtggagtggagctgaagccccgctaggatcgccttttccgctgctgctgctttcgtttcggtgcgaggactaagtgcctcttttgtaagtattttacgctttatttacgtttggaactgtatattacttgtcgttttgtgtaccctggctggtcctggacaaggatttaatacacaaaatagtctggagatttgggctaaatttctgggcgtgacaagagagatggagaggggataaggttcactcatataggggataaggccgatgcgtcggcctagattggctcggcagctcggctcagtttggataggtgccggtttttttaaaaaaactgatacctaggtgcctttttaattaaccgacacctttaatatattaaaggtgctaggttttaaaaaaccggcacctatactatagatgtcggtttttctttagaaccgacacatatagttgcttaaatgtgtcggttttatgtgttttcagcctgtggaggaggtaaaatcactataggtacatgttttagttgttcccgtacctatagtgctgatttttatggatttttttttagtagtacaccgtcatgacttttgcaatgcatgataataataccacaccgtttctagctaccaaacggctccaaagaataggtcacattgtcatcgccggaaatattctccaaccgagatgctctaaccagta

SEQ ID NO: 68034 - DNA, 644 bp, Oryza sativa
ttcaagcctctaactgatatattatcttctgataatttcttgtgttctatgtccgtacaagccattaggatgccaggctttgtggatttggagatatttgtttttttcaaccattacacatctgtcattgtgccaatttggtttcaatggaagtcatgaaaacttagcttgctgccttactttagccaatttgtgtcattatgctaatttgtcttttcaatgcagttacccccccttttttgatgacattgctgctcgtctgcttctagtcatcccgttgataatttataggcttattgagaacgatgccacagatatcgcagatagagtccttgcagtttattctacctttctggccttccatcctctaaggtttacatttgtgcgtgatattcttgcatatttctatggtcatcttccatccaagttaattgttaggatcctcaacgtgctgggtgttagcactaaggtagaccctatatactctttgagttattatggtgcttcctcctgcccatcttggttaattctttactaatgtgtgcaatttatagacacctttctcagaatcatttgcccagtatctagcgtcatcaaattcatctatttgtccaccaccggaatacttcgccaaccttttgttt

SEQ ID NO: 68035 - DNA, 1665 bp, Oryza sativa
catgaatggcttgaatctacccataccgtcatcaagcatcttcggccagtcaactcagttgccatgttaagaattgctttccgcatattgggtcccttgttgcctcgtctagcctttgctcgacctctgttcatgaaggtattcttggtttgcttaccacttcctgatggttagatttttgcattaataaattggaattgattttgagttaactgctggggacaacttcgtatgatattggcgctttgaactggatcaatatatgtttacttgcaatcagtagctattacaggatcgtgctttgtctcttaacatcttcaaaattttatttaattacatcttttggtggcataacctactaatcgaacacagaaaaaaaacattatgtagttttctgtattgctttgtgttgtccttttatgcaattaagctaaaaaacgaactgcagttcacttttgctttattactctatggtccatgtacatcctattacgagatttgttcatcttgacctacacaccacagtaattctatatgaagaaactactgtcttccgttctctactaatttagtatatgctgctgggatctacagaccttggctttgctgttcaatgtgttgggggatgtatttgggaagaattctcaggcttcacctcctgtggaggcatcggaaattgctgacataattgacttcttgtaaggcgcacttcatcttttccgcacttgtcatcttccctggcatgcagtttgtttcagttctccttctacactaattgttactgcataactcattctgcattatattctcactgcatcgttctctatatatagtcttataacagttattttttttctttgttgctaaaataggcaccatgcagtcatgtatgagggtcaaggaggtcccgttcagagcactagcaagcccaaactagagatattgacgttatgtgggaaagtaatggaaattctgaggccagatgtgcaacatcttctatcccacctgaagactgatccaaactcttcagtttacgcagctactcaccccaagttagttcaaaacccatcttagtattacaaggccatggaggagaactgacatatttcagtcggaaagatgggaggttgttcgaatgtgtttctagaaggcgagattctaattgccgctgcttgttaaatgaaaatttgcttgctccttatggccatcacaaattcatgaatgaaaattagcctgttaaatgaaaattacaagttcatgaatgttgtaaaatagaccagacctcatcccctagatcttgctggagggataaaggttgatgatttacagtagttgtaactaatagcttcattaggccgggatgtagattgagattgccctagtggttagagagagacattattctcccgatccatgttttcactttgtagctagcgttgttgtacatgaatgtaaaatacttgattcacaatttataacataaacaccaaattctatcaggccaggcataccattattcgttactccattcaagttgcagctcgtcagagctgtatttatttgcacgacctcaggaatgcgcggcaatcagtggagtgatgctattagacaagcacctggttgatggtcaaagtcatgcctcgccatccatgtacggttcttatc

SEQ ID NO: 68036 - DNA, 5650 bp, Oryza sativa
ataacaatgcttcttatctcattcccatgaaatgcaacttaccacatgcagactgtaaaccaccacgaaagacatcaaaaggaagaagtgaatacctccgtgagaagggaagcttcaggagtagcgtcgacattgcattaatcatgtctggcatgtaaatgaactgcatgatcacaatctgcaggatccaaaaccacaagttcttcgtaatcatctcagcagcgtgccttgcaatagcatgcccaacctacaacaaaaggcacaactgtcagttccaaatctccaatccaccgcaactaaccaaaatcacacatgaacccggaaatcccaagtccacctcgtgcccaagcacagtagcaatctcagcatcagtcttgaaatggttgagcagtccagtaaagactacaatcttgccaccgggcaagcacattgcattgatgaggtcatctctgacaacgatcacctcccaattgagcccatcaagatgcctcgtctccggctgtgctccccgtgccttcccacggtcgcggctctcggtgacccatctgtcatccagaacctcctcgtctcgctgggccgcggcagccacgctcgcgttcttgttgccacgggaccggccgagcatcacgtcttccgcgccggcctcgtggttcttgatgacgacgtcggtggagatgtcgccgtaggaggcgtcatccgcggcgaaggcgtcgtggtgccttccagcgaggccgcggtggacggcgcggacgacctccgaggcgatgaggcgaacgcggatgctgtcggggtgtagcggggggaggatcttggggcccagctccttcttgagattgttgaactgggactccccgagctggcgctcgagcgggggcgagaggaggatgaggtgggtgcgattggtgtaaggcacggtctcgaggttgccgaagtagacggccgccgcggcgccgcccgagacgacgaccaccgtggtgagcttccgcgggtcgtggtaccaccgggacccgcgccggcggttgaagtggactaccttctgccgctgcggggaggtgtagaagtaccgagacggcggcgcctgcgcaggccgcggcggcggcggcgggcttcggaggagcactcggccgaagcggacggcctccgggcgactcggggaggtgaagtagtacccagcgggaggcgcctgcggcaacggcggcgacggtggcagccgcgggcagccggtgggcttgtggcggaggagcctggagaggacggagcgcgagttcttcaagtaattcatgttcttgttctatttttgccccgtattttggggatttttcgggggcggcgtttgatcgctgcggggaatgggtgagggggtttcaagaggtttgccaggtggcatatggcggtgagtcgctgggcccgggagaaacttctaggcgcgccgcccaagtcgctcatttcgggccgaccgctcatgggcccaacaatgcaatttccggcccaatttggggtagcgctcaatccagtcatacgaattgttgcacctctattaattacttaagctcgagctagctcgtaatctctaacgagctttgaagccagtttggctcgttaggaaattcaaacgagtcgagctaagttgagcctagcttgtcatgaaccgagcgagctaacgagccacgagcttcctgtccattcctaagcctacctcatggctgagcaccgtggctgctagatcggcgtccttccggcagaatctcctgaggtaccaaccgaataccacgatcagtgttgatcacacgcaccctccagttgaggccgcggacggcactatacatgctcggtcctctccgacagccgatccgctgctcgaaaacctcgtcctcgcacgccgccgcgatgatgtgggcggccacacgccgcacccggactcgtgtcggggtggccgtccgggagggcacgggttaggagcctaggagcacctcgtcgcacaatgtcaagctcggcctactcgcggagactttgctgatctccttgcgcaaccagacgaccgcgcggagccgatcgacacgactgccgccgcggccgcaacgcgtggaaggagacgacaagccaagcacctagggctgcagtgctcgtgttgttgtgactcaaaaaacacacggagaaaaagcggaacaaagcggactcaaaacacacggatacgacaagccaagcacctgggccccgctcgctcgctcacatcgtgctttgctcctccgcccatcgtgctcgctcgctcgacgacgacggcgcgctcaagcgacgtccgcgccggatttggtggtggtaaggggtcgacgcgcaatggcaaatccgtcggtgtcggcatcgaatcagaagtcgggcttgggagacggcagagaatccggcggtggtggcggcgaatagcaagcaggggagggcggggatggctaggtggcatcggcggagaatccgaatacgcgctcggacgacgccggcgaatccggcggcggtggcggtgaatccgaagccggggagggcggggatggcttggtggcggtggcggtggcaaatccccgtcggtggcggcggtgaatccgaaggcggggagggcggggatggctcagtggcagcggcaaatccacatcgccgttgtctctgacgtcggcgctactcctccttccgcccgcgccaatggtcaccgctcctccttccacccacaccgccggtcgccgtgccgctccgctccttctgccgtggtgctaacgttactccaaacgacattcatcccatccctacccatcccttctaccaaataaaaaaactagattattccatccaataaaccaaacaagtaaataaatggaatcaatccatctctaaaatcaggatggtatcatcctatcccacgtagtctcctaaccaaaacactaccaggctagcgatcgagcctctgtcgggccggtctcggcatcctgtttggaacttttgattcgaacacgttctgcggtgctttgtccatctttccgatgttttggttccttcacaaatttgcaagtgcacggtctgtgattaattactgaccttaaaaatagaggctacgttacatgatctgacagaatctgctggcacttgctcttccagtcctacacaactacaagagaacaaaacatacatgcttgagagcctaagattatggttgacatttcataaagctatgttcggcatagagggttagcgactaacggccttatttttccagttatgtttataattatcagttaaaatttaaatttttaacattaaatttgaagttgattttgggggtcttttcactgtttatttattagcctatgcttttagatcattaataacacgtgcataaaaattttattcaaaaataatttttcgttagataagtattagctttaaaaaatttttgaaaaatagattaatatgattttttttaaaaacaacttttgcataaaattttttcgacaaaaacactcagttcgttaagcgtgtacaaaaaaaaaaaactataggtggaagttaggaaagtggagcgccgaacacactctaaatgatcaatagctcacggcgatcagagatgtacgaaaacataatcagcatagcccgtaccgataaaaaattgtatatgtacaataatatcagggaacaatatccctagtggtttggttgagtgctcgccttgatgaccagctatgtcagaggacgacctcctcgagcggaggaccgtgaggcccctcctttgttagttcggccgagggcagcgagtgaaaattgaggaactaggaggattgggagagatcgagggccgggagtcgggcccccgatgaagatgagacactagggagttatccaggttcgggccgctaaaaagcgtaataccctactcctgtgtatgatgatttttctgagtttacaaagtctctgaatttctggtgtacaagctagggctaagcgttccacctcttttttcttctatccccctcttcactggacatggacctccttttatactccaaggggttcccacatgcaccgggtgtgcttcccagtgaagagggaaaatattctctatattaaatgtttgtctcgtgccacaatctggaagtcatctgagcatcggctgctgtgcagggcccatcaaatcatgtcggctgacgtaggccgacacagggaggatccccgtcattcaccatttaatagatgtagacttccggcgcgcacgcactggaacacgatccccagtgtgtccaaagcggtcaagccaacttcggatggttgagaggcgttgtgcctcttatcatcgcgacgagacagggcatacctgccgcacgccgcctaacaccaggctaacgcgcacgtggcttcccgctgtcctgtctgtcattcgaccggccacgcaccggtcacaatttggtcaagcgcgcagcacgccgcattcaatgtggcgtggtgcgcttgctctgcccgcactaaaagcggttaggtgggcgtagaggggcgtccacctaacctcacttgcatgacggccacgtggtgaccgtcccgatgggtcggggcagcccagggtcgggctagggaggggtggctaccacctatccacgggcccgacccctcgggggaaaacgccacgtggacattgggggggggggggggtaatcttctaaagttggctcttctgctaactttttgattgggtccacatggcacccctccctttgacgaaaaaaaatcatgaattcatactagagaaaataatctgagaatcaccggtgagaaaaaaaataaattcatcaaatatactatgcctactccaaaactatcttccccttacaaatcacacaaacttccattcatttgccttcttcaaatatactatgcctactccatagtaggcctaaaaatcttgtggaacaaaaggaaataaaaagaggtcttgcagatgcaaagaggaaacttgattgtggattttatgttacagattgcgttgcaaaaaaaaagaactcttaatatactaaatgtttgctctttcaaatattcaaacctacaagtgtacatgttggaaccaattaatttaattgaatcttaaatttgacttgcatatattttctcaaaattgacgtttactataaacatggcattaaattctatccttttgcttaacattgcatacgagtttatatttatttatgataaaaatatttttatttctatgcataataaataaattatttatacatacatatttttttcaataccatatgtaccaatttgtcaaaaccaaaataacggttcacaatttcatttataaaatatttgatgaaaaatatcaaaattccaaaaaagaaactgaagtatatatatgtttcaaattagtaagcgcacccctagcgtgtttattttacaaaagataaaaaataaaattgtcgcccattttaatcatgtagtatctgttaggtgatagaatcatcttggatttttggttctaattatacttttacacccaaaaggcataccagcattctggttgctaagataaaaaaaagttcactataatattattacatgctacactaaaaattaaaatatcactaagaggccttattaaaaataaagtgtatatttttaa

SEQ ID NO: 68037 - DNA, 1262 bp, Oryza sativa
aaatatgaaaacatagatcaatatgtgataaacatgcaaattttaaatttttaacattgaaataataaacatccatatgccatgagataaccattcatgatgtcggctatcgcattagtaatttctcgttaaagactctcttagaaaagaaaaagaaatatctttgaagggagcttaagccttaaaggctatgcatgcacatgtcgttgtacggcttcacggaacacctccaatgcctcccccatcactttctcctgcctaacttccgccgcgcgcctctgcaacggtggatgtgtagtaccctccccatttccaaacttcatgagtgcctcccagaagttcgggtttgcacgtgggtcatatcctgccgcagcctgcagcatgaggccgatgcggtctgcctctagttccgttctacgatgatcacaaggcaaaacacagtaggcgttaggcttattgagtaatctgtgttatacatatgtacatgcatatacgaggtgtcacctgtggaggaaattccgcataaaaagggacacccactcagcgtgcgggatcctatcgaccggaacatagaggagctcctcaacaaagttggcaaggacggagacccaaaatttgttccgcttcctctccacacggtgccttgcgatgacatgcccgacctgccaagaaagtttaatgtatgtaatcatctacccctgtgtttcatattataaatcttttaacttttttctagtcaaactttgttatgtttgatcaaatttatagaaaaatttagcaatatataaaatattaaattagtttaactaaatctaacattgaatatattttcataatatgtttgttttgtgttaaaaaatactgctatatttttctgtaaactaaagtttaacttagaaaaaagtcaaacaacttacaatatgaaacggaaggagtactggagattccttcgcccatataaaaaccatgtatacacactaatcttgtgtaatagtactacatctataactaaaggaaaaagtaccaattacccctcccccgaactatcgcggtcggccgaattaccccctgaaccataaaaccggacattcttgactccaaactatacaaaccggacaaattacccccgtcgactaatccgcggtggttttggtttacgtgacgtacgcgtggcagtccagttagcattctatttataaaaagatgtgggacccacctgcctactctttctctctcttctctctctcactctttctctctct

SEQ ID NO: 68038 - DNA, 3121 bp, Oryza sativa
gcgcccacgtggcgcgcgttggatggtggtggggttgaaattttgcaacggttaccccgcaacggctacttcaacggctaaaatttgaaaataaccgttggaggtcgaaaaaaattcaaaaatatatgaaaaaaaactcaaaaattaggaaattttttcctataaatagggtagccaacccaaacattctggctcatccaaacattcaatcttgtgctctcttgtggtattttgtgtgttgtaggttacgactttacggtcttccgaatttttggcaaaatttctctaaatattgccaaaaataaaaataactaggggaagacatatattcctatttgtaagctgcaaacaaagagttgaagaaggtaagaaattattattattattattattagtgttattatttacgtatatgttaattttgaaatttcagcatggacgatccgaattacccaatatttgacatgagcgagtacgacccaaatttcggcatggagcaaggtggcagcatccctgcaccgatgccggaagaacctgcaaccacacaggtggcttcagaaggatcaggaactgtggccgcgagtgggtcaacggcctcgtcctctaaaagatcgagaacttccaccgtatggcaaaattttgatgagatcaaggagaccggccctgatggtaaagaggtaacgttggctagatgtaaaatatgcagaactaaattatctggaaaatcttcaagtggaacaggacatttaagtcggcatgcggcgtcgtgtgctaagaagcaaggcatccaactgcgacaacaacaactgatattgaatcctgatggtacggtacgttcgtgggagtacgatcctcaggttgcacgagaatctcttactcgattaattgctagacaagatttacccctaaattttggtgagtcaactgcatttgaaaaatatattcaaactgctcataaccctaggtttaaatctgttagttctcaaaccacgacccgtgatttaagaaagttctataaacaaggtcgtgatacactgaaagaattatttaacacttgcacattttctgttagtatcacatctgatatttggagtggtaaggccaaggaagactacataagtgtagttgctcactttgttgatgataattgggaaattcagaaaagaatcattgctttaaaattaatagatgttgcacatactgctgataatatcgcggaaagaatttccatggttgttcaagagtttgaccttacaaataaaattttcgctataacactagataatgcagctgctaactctagggccatggaaattctacaacctgtattctctgtctatggtcaatcatttcttttacatcaacgttgtgcatgtcatatcattaatctgatagttaaaactggttttaagagggtatctacacatattgattctgtgcgtgaggcaatctcatggttatttgcctcaaacccacgggttgcaaaatggaaaagattttgcgatgcatcgggtatgaagccccgtaagttccgcacggatacagatcatcgatggaataccacgtacctaatgttgaggcatgtgttgccttataaggatttactaaccgtttttttgcagtctaataatgctacgaacagtgatgggcaactaataatgtccgagccaacttggtatgtagtagaaaagtttgctgcatttcttgagatatttcacgatgccactgttgctttatctggagtttattatccaactgctaatttaatgttgcacaaaatccttgaaattgctactttattacaagaaaatgagaatgaccacctactatctgctgcagtctttcatatgaaacaaaaatatcttaaatattggaaggaaatccctgtactgtatgcttttgcatttattcttgatcctaggggtaaattacggggattggttaatatgttgaatattattggagagataatgaacatagattatactaactattattctgatgttaagactaaattatatgagacatttgccaagtatgagaataagtttcagggacttcgcctacaaagacccccaactgtctctgtcgctggtaagaagaaaatacaatggggacggatttggggtggtagttcctcttccactcctgctgggagttccgcttcaggaacaactggtacttttcaaggcacccaagaattgtcctcctacttagacagtgactgtaccagcactgaagatctcaacgtccttggatggtggaatgatcacaagacccaatatcccgtgctctcaaaactagcacgggatgtgttcacggtgcccgtttctaccgtatcctctgaatcggccttcagtacatgcggaagaattattgaggaccgacgaagaaatctaagcagcgatatggtggaaatgctgctcatcgtcaaagactgggagctagctgctgaacgtgctcaacactccgcagagaacttggaattggttgctcagttcgaagatctctacatcgatacagatgcacaagattagctagttttttctaataattttcgacttataggctgtactcttttttctttgtcatggttttctcaaatatgagtttttacatgacaaagtttttaacgaggcagccatgtaatatcaaaattaataaatatcattattccatttttctcatattctttatatttatttagctttttcctattttttataatcatcttttttatatttatgtacctaatttcctatttttttctaaattataatcatattttttattttcccttttttccttttttttaattttccccctattttcccttttttttaattttttccctattttcctcactgttttttcatttttttattttttccctatttttccctcttttcctccttttttccccttttttttctctattttccggattcccgggctgcggccggcccacgtgcccccgccggcccgcgtgctgattcgtgcccgtgccggcccggcacggcacggcagcgtggtgggccgtgcctgggccgcgcacgcggcacgcgggccggcacggcacggcccgctacaggacacgtgccgtaacgggccgtgccgtaac

SEQ ID NO: 68039 - DNA, 1706 bp, Oryza sativa
acatttaaatcattcaagaattacttactggtttggattgaataaacaaagttttcaacttcaatataataggaaatcaattcatttcaagtattcttaagcaataacagtatcaagcaggatggcatgaaagcgttattttaccttcatcctcaaatttgtcccagtcttcatcccactcaattgccccctcttgcttcccaggttcccaacctaacaaacaaggacaaactcgcagattatgtatctgaagaatgcaggaagtgaaattgcactagggcagtattttgttctactgataacatgccaggagttggatagtgtagtaccaaaaggaagctcaactgatgcagatggcttgaactgcagtccaaagtgcttgcaccgttcactaaaagctttctccatctcctctaattggtattggattcgatcagctcgaacctaggaacagtggaacagtgcacagtgttattcaagagagataggtgacaacacctaagtacctaacaaagttagaacatacctgaagcaaaccatcaacacttccaccctgtaccattttaactaatgcatcatgcagttcaaattttcctctcctgaacaaaaaccaaccaactttgattcaacacagagagacaagagataagaagattgcagcaaaaaattcaagtggtaattttatgcggtgcagcgcagagcaacctgaacatcacggaaggcatgttcttcaactgccagtttggaagctaactctgccacttgcttgtatttctcttcatacttcttagctaatgattccacctgaattaaaataaaaatcgcccatcagtgtgttacaaattaatgattcctaacacctgcatgcttccaaatatttaaaagcaagatcaaacggccccaaaaggggataaagtaataagcatgttctgtacctcacgtttatcagaggatgccctttctgtgatttcattcagcctgttgtcacaccgacttttgtacagaaccttcgacaagacaaaacaaataaaggaatgataactaaatcacattaataaatcaattttcagcaacctagttatgttcatttaaaaaatcagcacatgtacaagccagaattactttaattaaccaaatcattttgcacatgaaaactagtaagagattacaagtgtgcttacaagatcttgcatctttgtacggtagtattctagtttctctctggaatctaggacttgcttctccacctcaaccttcacaatgcaaaagagacaaaagacaatttgtttcaaagttcgtaaaagagcaaaatataacatatattaagcaatacttacggctctaactgtcatttataggaagttgggatggaaggtacaaaaagataataatatcacttaatcaagagaaaaaagctatcctgaacttgcaatcgatgagtgccaagaaacagagtatcagcatatatcagtcaacttaataatgcatggaatggaaacttgtatggcacaaagtcagaatttcataaagacattagtgggggatgaaataatttcataaggagtgaagtgcacaggcggtccttaaacttgtacggatgtatcatctaggtccctaaactatcaaaatgaattttttgggtccccaaacttgtcatgagtgtcatataggtccaaacgggcttcaacccgctccatgagatgatg

SEQ ID NO: 68040 - DNA, 8624 bp, Oryza sativa
  unsure (1)..(8624): unsure at all n locations
caaaaaaaaaaaaaaagatccatacaggtttcctactttcagttagagtagaattgtataaggagaagcaaaaaccttgactttttcatctcttatgtgctcaggcttaagagagacaggcttttccatagccaccaaacagaagacctgcagacaagagcgaaatcaatacagaaagggggcctcaagtcgtgaaagtggaaacagcaatattctcttttgaggaattataatgcatgacaggttgctgctctgcctcctcgtggtataacataagaatggtgatggaataaagcaccaatcattctgaatggtcaagtaaaatgttcagcagtccccacagaccacagtaagcaaatgctaatgtagattcacattgggaagtgaaagtgcacataaaactcccctagaaaaggcaagtgcatggaaaactatgctgcataccaaaaataaatatatttacctgcaacaaatggttctgaatgatatcacgaatgatgctgcagcaacaaaagcgaggtcaaatatttacatcagcgaagacgaataacgatgcacgggaggtcctctaggtgattatttgtctcataacataaacaccataagcagttgatttattttaaatctagcaaatactgtattatcataaaaactaaagaagtttaatgcctagaagaaaataataaaatgcaatttgtatatttctaatggacaactgtacacgatcgaatgacttcatgtgaactatgggaaccataaaccatttacaatatatcaaagtgattttacacttttatagtatatccacagtcacaagcatatgtgcttacaacaaaatactttcagtaaaaggaactttcatgcaaaataaagttactcccaacatacccatattgatcaaagtaccctccacgtccttcagtcccaaagtcctctctgaatacaatctgcagcatatatttattatgttcaagcacatgttgttcgcaccatgataatgataaaactttccagaatttccaaaactaatccattcaactttataccaataacagaggatgtcatagatgtaactacagttgacaaataaaaatacaaaggactacatagaaaagcatattacctgtacattagcaatgttatcacgattccaaagaggtaggaacaaacggtttgcaaagcgaagcacaagctgaaatatattgaaatatgttatagtagcatggaatatatcgttcaactaactagacgaagccatacaacttaccagattttggaccaattcttttcctaaatagtggtcaattctgtacagctgttgttcattaaacagctctccaagctgggcactgagttcctctgcagactccaagtccttcccaaagggcttttcaacaataacccttgtccagccagaatgagaagctgaaagcacaatatgacagttacagaaggtgactagcataaaagaaatgaaactacaacatagtatagcacaacttctaaaaatcaaacttaaaaataattaatttgatttttaatttactatgaaccaacacatgactcaattaataactaagagcaaattcattgcacccaaattgcttccagaaaaccaaaactttatgtttcaaaagtcccaatgaaaaagcaatgtcaggaaaagagtcggcgactgctaggaattggtatgcttagaaagttgaaatagtagcaaagttccacaaggcaaatacttagttaaataaagaggacaaaaggaaaatagtacaaacaagagtggatacaaccaaatatatttcctatattttgaaactctgttgtggataacttcactacaccaaaggaagtgcagcagctttcaaaatccgtaaaaaaggggaagtactcacatggattcatgcagtatgatcttatcattttgcatactgaggggtagactgatggaggcaatgccaaataaaatagtctacgtgagcttcctggtttgttgttcttcgaagtttcattctctgaaatggcgttatttaatgatgcaaatccttccccgctattgtaggaaccactaacatatttaatctgcaaagaaaattcaacgtgttacgaaatctaaatgcaaagaagctattcatgatatcagtgacttactaattgcaaaaattgtgaaatatgttcatctgaagctcctttgaggtatctgcgataacaggagaatgctatttaggcactagtatatcatcagacttaaaaacagagaaactacttcctcatacagaacatcccaatttatttttacatgaaattcttaaattattttatggtaaatgttggtgctaatatgtatctttcttacccacgaatgcgttctcttaatccatcatccgaaatatttgatcttgcatacccaaatatatggacttctccagattgtagaaatccctatcaacaccaaaggttacagttcagaactttgtacgtgtgtcaacctgacaaaacattatgtacatggcatgcaatagcaatatagcattataaagtgctgcagtagaatttctgagcaattataactcatcacgaatgcatcaattttatttctttttcactacaactctttcagaagtttgacaactatggaagaagctagtataccaaactatgtaagaagctactagttacaatcaaattacctgctgaaagaggtgaaacagcgctgggaatgttttcttcttagcaaggtctccagaagcacctaggaccacaatggacaagcaaccagactctgaagacagttctaggtccttcaaacctgacaaagaactgaagctagcccgccctgatgaaggggaagaatcaccagatcctcctgacatgatgaactgtatggtctcttcctttggagacaaaacctaagaatgtaaaaaaaagtactgttagtctcaatatgaggtattcacaaataacttataatctatccaaaactttaatctatgctaatatgaacaaaaaggtctattggttgaatgatggattcttgaactgaatcacctgtcagtacctaacagccaatttgcaacagagtgtaaatcaaaatgaatgtttgcttcagaaaaaaaaaatcaaaatgaatgggattaaagttggtttcatgaaatcagtactaaactactaatatagctaccctgaacttacatcagcgaactactcccattgtttgccaacttatagtcaaagttctcataaaacacaaacaggtactgtagttatgctagtcaaatgcttctatgagattctaatacagaaaaaaaaaagtatctacaagactacaaatgtaaatcaattgaactcggtgcccctacattttgtacgggtaaactggaacacatgcaacaactgaaccactgcactcactagaagtctagaacacacaacagcccaaccacccaataatcccgaaataaactagaactgcaacttgcaaagcaaattctgttccgagagcttcaaatgattaaaacgaacctatacagcaagcgcatcagggcgccaggaaatcgaggagcacacgcagaataaacacagagatcatgaacacaaacacggcgcacagaacagaggaatttgcctgcgaaggctgcgatgagatcctaaggccgcagcgtagcacaatcccttccacggcaaatgaaatcagcaatggaaaaaccgatcgcgcagaactctgctacggaaccgatcaaccaccaaagaggaatctaagcagtgtggatgaggaggaggagggagactaaccagcagtggcgacgagatttgacttcccgaggtggaagaagaagacgacgacggcgaattgggcaatggatggtgatcttttccgggtgcgatttatagggggatcttcctcactcacacccgctttccatccacccctccactctcctcccccgccgcttttatactcgcggacgactcgtctctcgtcggcgttgttctcagctttgacccgcgcttagccgcctctctgctttgccacacgcccacacccaccaaccctgctcgcttactgttaccctaccaacatagtataaatcaccaatcttataagttattttttttaaaaaaaatagcgtcaatccgattgattgaactactaatataatccatccgtttcacaatgtggagagtgctagaatgacttacattgtgaaacggaggaagtatataaaaaatgtgaaccgtgaagcgtaacgctgtggtagaaccaagtcaggttcaagctctatatttactcccttcggattgataatacttgtcggtttagaccagggtgagatcaaatcttttattatgaatcatttttaaaatatttatctttcaaatatggctactatatgtataaattagtcttaaaaagtagtttaataaaattatatatttgttaatatttttatacacattataatgaaaaataatggtcaaaattatttttttaagactatgcctttgtccaaaacgataaatattatccggagtaacatggatgctcgtatttatcaatactgactttatcaatttgtaatgtatttttgtcaaggactacgtggcaacttcatcaatatatactgtgtttcaaataaaatatgaatgaaccggtagaaatagtttatcattaacatttaatatttgtatcacttgttttagcgatagaaatagtgcatcagtaacatttactcgctttatataagttaatagaaaataaaactacgacaaataaaaaatcctaaaatgaactctataaatttcaaattttatatttttgctgaagctgatatactgagatttacactcccgtcccgtaaaaaaaatatacttagatacatagttagaagttgaacatccataactaaatattgtttttttttctatggattgaagggagttgaagatgcaggcgataagtctgagatgagaccaaagcaatctgtggaatgccgatggattgtagttttttctatggattgtagttttcccgagtatcctcactctggtactctagtactctacgtggccgtgtttagttgtaatttttttcttcaaactttaaactttttcatcacatggtttaaatttcaaccaaatttttaatttttgtgtgaattaaacacacctagtgttggtgacaaagtttttcactttttccaacccatgaggccatgacatgacatcaaccaaatggcgccgcaaatcgagcatcgtctggaaaatcaattcacgagtcgaacggcgcggccggtggtatatctatcatccccatctctttgttctttttttttttctgtttcgatgatttaacaatggtcatcagcgacgtcacaaaatacgctaaaaagcaccacgttttaatcctcttgtggatattatgggtaccccatacccatacggcatggttatccgactagtcataggggataacttatatctatggaatatgtaatagatcatgactcgggtattacgtttccttatatattacggaacggcctaaagtcctggtttgataatattgtaaagtagatttaggaaaccgataccgtattggttaaggtttctatcttgtaatcctgccccccaccctatataaggtgggcaggaggccctctagggggcatgatgacacaaactagatcgtcagatctataatacacccggcggattcaaatccccaaacaggagtagggtattacctctcattgagagggcctgaacctgtctaaatcctttgtctccgcatccatccacttttaggtctcgtgcgctacccccttttattattgccgaattcatgtttcgacagttggcgcgccaggtaggggttgcgtcgagtttcccatcaacaagcgcgatggaatcaatttcatgggtcgccgacttcgttttcgctttgggagttttcacttcctttccgtcgaccacttcttcaacctcctcttctctgacttgatccaaatcagtcagggggaaactcaatctgatttttatcattgtttatcatattgatttttaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccgtcggccaccaccgttgatgggcatcgtcatctacgccgccggtctgcctccgtcgccgccgactggtgtccccgcctatacggtcggttggtcacaccaccgttgatgggcatcgtcatctacaccgccggcctgcctccgtcgccgccgactggtgtcctcgcctatacggtcggttggtcacaccaccgttgatgggcatcgtcatctacaccgccggcctgcctccgtcgccgccgactggtgtccccgcctatacggtcggttggtcacaccaccgttcatgggcgtccacgacttcaccgccggcctgcctccgtcgccgcagactggtgcctccgcctacacggctggcctattatgccgccgctgttgggcgtctacgacttcaccgccggcctgcctccgtcgccgccgactggtgtccccgcctatacggttggttggtcacaccaccgttcatgggcgtctacgacttcaccgccggcttgcctccgtcgccgccgagtggtgcctccgcctacacggctggcctattatgccgccgctgttgggcgtctacgacttcaccgaccggccgcttcgtccgccgccgactggtgtctctgcctgcacggctggcttattatgccgccgctgttgggcgtctacgacttcatcgccggcctgcctctgtcgccgcagagtggtgcctccgcctacacggctggcctattatgctgccgttgttggatgcctacatcctcaccgttggctcaccttcgttgccgtcgactggtgtttccgcttacacggctgacctattatgccgccattagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggtgctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagataagataatttattttctgctcttaataattgcaaaagtacccgaatagtaaactccgatccgtgaaactttgttccattaatgacgaactcatgtcactcatatgcatgtttgggaagtgcttaggccgactcccagtgcttggtggctatgactagtcgggcagagtgtttaaacgtaatgagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccaccggctcgcctcgaccgccgccgactggtgtttccgcctgcacggctggcctttatgccgccgttgttgggcgtctacgtcttcaccgaccggcttgccttcgccgccgccgactggtgtttccgcttgcacggctggcctattatgccgccgttgttgggcgcctacgtcttcaccgaccggcttgccttcgccgccgccgaccgatgtccccgcctgcacggctggcctttatgccgccgttgttgggcgtctacgtcttcaccgaccggcttgccttcgccgccgccgactggtgtttccgcctgcacggctggcctattatgccgccgttgttgggcgtctacgtcttcaccgaccggcttgccttcgccgccgccgactggtgtccccgcctgcacggctggcctttatgccgccgttgttgggcgtctacgtcttcaccgaccggcttgccttcgccgccgccgactggtgtttccgcttgcacggctggcctttatgccgccgttgttgggcgtctacgtcttcaccgaccggcttgccttcgccgccgccgactggtgtttccgcctgcacggctggcctttatgccgccgttgttgggcgtttacgtcttcaccgaccggccgcttcgtccgccgccgattggtgtttccgcctgcacggctggcctagtaaacagccgcccaccaaattaaaaaananccccc

SEQ ID NO: 68041 - DNA, 547 bp, Oryza sativa
actatagggcgaattcgagctcggtacccaaaaaacttatatactgatcaatatataaacccaaacagaagttacggaccttagctagatgatctgaaaccataattgtacgagctctaattgtacagtacccatgtattacactagtattaattgatccgggaaaatctagcaatatattgtgatgaaaagaatatattgcaactaggacacacggagaatataaatcacaatcccaatacagttcatccaatcaatcatccatactcacggtcgatcgattcttgattcgccgattgggtaccacacgcatgatcatctaggcccccattcacgtactcatccatctacacatcttcttctcatcatctcctcctcctccatggccactataaataccactcgccatgcacactccaagcacacacaaagcaagaacctcgagctgatctactagctacctagtactctcatcttcttcactagcttttgcttgatcaattgcagcaatggcggcgaaggcagcgctcgttctagcggtgagcct

SEQ ID NO: 68042 - DNA, 923 bp, Oryza sativa
tattcacataattaaggctactatttaatacttcgtctattaatttttattgtcatatttgctttaaccagcaataccaagaagagtgccaaactttattagggcagtctcaacccatagtgtccataagtagtgcctatgatgccatatcaataagacatcacaatagaaaccacactccacaactcatagtttcttaaagtgagccattaataaatatatcatctctcttctctaccaatcacatttattcttcatttattatgaagacccaattatctcccaatgcaaaacttgatagtgtctggtgcataggttttcgtgttgaaggtatgtcttgcatgagacccagtttcatcctctcttcactctctctctcttaattaatatagtgccacataagctaaaagtcctacatggcaatgtagttaatgccatagacaccatcctaggtggagggttaggactgcccttaaggctgtgttcgaatggtgatattggaaactaatctttagcgcatgcaaaactaagcaacccattagcatatgattaattaaatattagctactccctctattttaaaatataagtatttttagaatagtgccaagtcaaccatttttagctttgactattaatagcaaaaaaaaaaaccaatcatgtaaagttgatgttattagatttatcattaaataaattatcataatatgcaactctttttatttaaaacatcttatttttatagatattgttggtaaagtataatctcgaagactgtgttaaagtccaaaaatgtttatattttgggatggagggagcatttttttagaaaaatggattatatgattttttttaaagcaacttccgctagaactttttttcccaaaaaatgcactgtttatcaaattgaaaaacgttagggg

SEQ ID NO: 68043 - DNA, 625 bp, Oryza sativa
atccctgaaagttggtttttataggacgagaggagtacatattttttaagaaaattattttataaattatttataatcaaatattttaaaattcgatcttaattttgtccgaaacaacgagtattataagagcttatttggtagagctccaactcctaaatttagcttcaagagttagatctgaagtagagttatatgaagctgcttaaacccaactttgcatgtctagttcattttggagatagctctacacagctcagctgaaattgtttggtgaagctagagctgtgccaaacagggcctccgtctggagagaaagtagcaacgcatccatgcaaaccactcttgctataggctcgatcggctataaatacaagacgccatgacaccccaagcaaaccaacccaaagcaacacaagccatagcagcagagccgagtagctgagctcactgttcgatcgatcactagctcgctagctgcatccatggctgcttccaaggtcgctccgtgctggccctgagccttctcctcctcggcgtcgcggagcacgggtgcgagccccactgcttcggcggtggcgcgcccgcggtcgcataccgacgccgactgtggtggtgccactgc

SEQ ID NO: 68044 - DNA, 9033 bp, Oryza sativa
cttcccgtaccgtgcttttgttgcttcgatggttttgaagtttgaggtggagtgtggttttctgagttggaggaggaggctgatgagcaccgaagcttcatggtgtattgatcttgctgtgtgtgtctcaaagtctctaccagtgcgtgcgcaaaaaattagaccacgtcaattcgtttctcttgtctgcttgtattttccagtttgttcagttaattttggtgtgttgcgggagttcagtttctgaaaatttattaaccagatgccgccttcgcccttcttgttcttttcgctgttcctgatgcaggatgcttcttctctatgtgtctctctgacgtgttctcttggtttagtttctgtttggaaagaactccatgttctctctgacgtgttatcttggtttagtttctgtttggaaagaactccatgttctgttcatacaatgatttctgcatgtgtagcttggttaaactgcttgtttttttttccctttttgatgagaaatcttctgattctttgcatatcaaagaagctttcatctcttgaatcttagatttgggatccttctaagcccaacggttttggttctgcaagattgtacaatttcttcatgtttgttacctatattttacttctcagtgacgctgtcatgttgtattcttcttgctgaattctactataagtgcacgctgctgtctctgtttttcttcttctgttcacttcatactctgtttcgaattattgaagttttaatacaccaaagaggtggccatatcgggaggaaatttattgtccttgtacaatacgccttttctgtttgtttcctcttcatttcactttggaatttggtgttatgatttgtgtcagaaaagcttatatggcgttcttacaaaaccttgtatgcattttgttcacagtaatattttattttaattcttccttgcttgattcttgtataagatataagattaatgtgtataattactgcagcattgcaactgaagattgatgatctcatgttatatgtctcaaaaatgcatttaggggccctgataaatagtgtcatatcatgttatgtctagttgactccttttcgtgtttttacgaaagctcttatgtatttaattgatctgtagtgttttgtaattgtattcactttactctttctccatatttgtcaataaagttattgtatatttgtattcatgttataaattttcagcaaaacaaaggtctgctatgggtaacagccttcctgtagaatcaaagttcactgatgaaaaagagaatgacagaattaagtatgttgtgtcgtctatgcaaggatggggtgagaaaatggaagatgctgtgagtaaacttgcagccttttgtatgacaaaaaaaaggatagttctgcaaaaatttcttactgatctgtaagtaattgtgtaaaatactgtgactgacatatgccctctatattctctagcatgcagctattctaaatcttgatgataccatgacgtcattctttggcgtttatgatggccatggaggtttgatcttcattctctctcttttttttttttttttggtttcaaatcctccaaatcgtcggcataactgtttacatcatgctttgtttgtctttgtatgtcatgtgtttatctgcgtgcatgttttgaaaactttactgtttatgctgaaacttttacctgtgaattctcaaataaatattaggctacagttctggataatgaaccaagtttgctaattagtactaatcacctttgtgcggtgtgctttctaggataacatgaactgcttaaacagaaatattattttacgagggataaaacactgcatggttgtgagttaatattaacagtcatgataattaaaaggatagccactgatgaacatgttggttaatttatgtgtggtgctatttttcttatgatacctatgaagtgctgatctgctgtgttcatcacattgttttgctttataagcttctatatgcacataggagtaatcttgagccaccattctgagttgtttattttctatctcaggagctgaagtagcatcatattgtgcaaaacgatttcatattgagctttgcaatcatgaagactacgacagcaatctaagtaatgcgatgaggagtgcgttttacaggttattttcgcctagtctatatcattttgttgcactgaatgatgctgcacttgcaaatttggaatatcattgttcctgtgtaatttctgcagcatggatgaggacctgcaactgtccgatgcttggagggagttagttattcctcgtaataatggatggatgtattttatcaaggctggtgtctgtgctaacctttcgcctttcccgcaggtagtgatcctttaacccctaaacatcttataatatccatatgttgaagaagttactcaaaactgtatttgttggacagtgcttattgtatctatgaaaaaggaaatggaagaatgtgtgtgatatcgagactattgttctttcttgagatgtactttggagttggaagagatatgtttaaccctaacctcaactaattgcgcctgtaaaaaaaggtccagttagttacttatcagttgcctggtttggtgagttggacgcctgacaggttattaagttcttattgcaccttggttcttgtcatagtatggcactaccctaaactgaggtattgtttgcggcatctcttctatggttatctctttcatatacactggtttggctttcagaaatgcttttctttgtctggttgcttttgtgagctatttcttggttaacctgtatctctactatgttggaattctctattatgtcctttagtttctttcttctttttccaggcaacatatactgcgccatcatatgaagggagcacagcatgtgtggttgtcatcagaggtgaccaattgattgttgggcatgctggtgattctcgttgtgtactctcaagaaatggtcaggtatagtgactatttcttatcgaatttcttgttggtacctaatttgcatgctcacttattttcgtgcctaacatttgtgcttgtttctgttgtgtcaaaaggccagtgcattatccgtcgatcataaaccagacagtgagtctgaaagagagagagttcagaatgcaggaggagtagctgttgggtatagttatcgtaaaataatggggaggtgggtaaccaagaaacaatggggcttcactgattttaagggaagagtatcaatctcaagatcaattggtatagtcttgcctggatctgtttttcgtttattgcagataatagcaccgaaaaaaaaacatattatgttgtgatttgctgatgtgttgtacccacttacatttcaggggacttcgcttgcaagaagaacgaacgtttacctcctgaagatcaaatgctgacatgtaatccggacatcctgactgtaagtgcaactatgtttgtttagtatttggttgaatttgaagtttgtactgctgtgtggggtctgatggaaaatccccctttctgtgtcagatggacataactgatgacatggagtttcttgtgatagcaactgaaggcctctggtaaattttgaacaaaaaataactgacaataattattatttgatcattttgatgtcactagtactctttgtgatgctgttttctttctcctgctgatgcatatatagtttcatttatagttgcatacctactgtactatgttttttccatgcaggtgcaacatgacaaatcaaaatgtggttgatcacacacatgaccgtcttttggtgagtccttttcttttgctcagtttgtcttcttggcaggacaagagatctcctactgtaatagcaaaaatattttgtgtcaaattctaggaaatgacttcactcaggcaatataaagcatccgattttttaaaaaagaaaaaaacaagtgctaataagtacactgtcatctgctttgtgattgttcgattcttttgttgttaaaactgctgttccttttgccttgatcaatattgctgtgactaatatcttgcatgtttacgtcaaaaaaatatcttgcatgctcgattgtttcgttgttaaaactgttgttccttttgctgtggccaaatattgctgacttgctgtgaccaattaatatcgctatgcaggagggtgcagaagcgcgtgtcatctgtgaggagcttgttcagtttggcttgccatcgggcgacaacacgaccgtcatcctggttctgttcaagcccggcgcctaccctgctgttccgccggtcgacaccgacactgacactgacagccacaccggcgatgatgtcgacaacaacgaccccgccaacgaggttgatcccactgccaatgccgggtctgatgacagcaacaccagcgatgaggtcaaggtcgacgccactgccactgccgtcggcagcagcagtaccaccgccgtggctgccgacgaagccaccgtggtgtcgttgtcgactgcaaccatcaccattgtggacaactacttcttcattaacaccagcgaggaggttgatcccactgccaatgccgggtctgacgacagcaacaccggcgacgaggtcaaggtcgacgccactgccagttccggtctttccgattgggaacttatatattctgaattctgatcctgttagtggtagacgagtaatagcaccgacccgttgatagtagtagtttggttgtgctactttgctagactgagacaccttgaattaattgtttacgaatcatctctagcctttttagttctgaaggtgattgatctagtgatgcttttgttgatcttcattttgaatctctgtgcatggtagtggtttatgaactactagtagtatttttcccagtttccttttgaccaaagttttcttcattcttctagtctctgtgactgtgatactcaaaatcttttctcgggaatctgtaactaggattaaggcacgaaaattttctctcctttttttcaagagatatcctgaatttgcgacctctctcttccgccttccccgcgcggggggtaaaaaaaaacagaaagttagaaaaaattatgtataaaaaatttgaattcaaattcaaatttgaatcaggtatgtaaacttttgacttataaactttggatctataaagtttagatgtatagaaatactatatatagaaaatatttgaattcaaattcaaatttgaatcgggtatataaactttaggtctataaactttagatgtatagaaatactatatatgaaaaatatttgaatttaaattcaaatttaaatcagatctaattcaaatttaaatttgaatcggatatatgaactttaggtctatgaactttaggtgtataaactttagatgtatagaaatactatatataaaaatatttgaattcaaattcaaatttgaatcggatatataaacttttagcaaaaaaaactttagatatgtaaacttgaggtgtataaactttaggtgtataaatttactaaaataggaaagtaatatggtgaaaaaaaaaataaattaggtggagggagggagggagaggagggggaaatctaatcgccctgggcgatcgctcagtagcatttccgttccccgcgttcacttgcccacccgtccgcttgatcgtgcgggaaaccaacaggcaacagcgatgcaggagggagttctatgtattgggtactgttgaatttgattccaaaattgaatctcaaaattcaggtttccaattaaatatcccttcctatgaatccttgccatctacttctcccaattccaaaaatatcgaattcatattcacgctcccatcggatggcctaatcagtcaaagaaaaagccaaatgttaaattttcaaacttaattttaagatattttcaacgtagtttctttttcaccattggtttttaagtcataaaaacacgtatataaaagttttatctataaattcatttttatttcctaataagccgtaggaaaaaagccaaccgatggggacctcagtttaccttcttgactccttgttgaacccttgagttcaaatatccaatttgaattcaagtccaaatcaaaccagaccccaaatttcttcaaataatttcctggaaaatggtcaaacattttcccctctggtgggctgcctctcctttctttttagataatggaaatggattgcatctccggcttctgtcataagacacacagccataaatttaatagtaataaaaatgtaagataaaagtaaatcaaaatgagaaataaggtgatgggacaaatccccaactcccctttattattgactaatgttaaaccacataaaatattttagctagcaattcttatgaaactacgccacccatagtggaataagagacccttggctaccgattccaagagtgtagcaccattgcgcatagtatcctgctcctcttgtggtagcattgtagaccataagtggagccagtaggaagacatgaagataacctgcatagggttagataattgtttaccattaaaaactttatcattgcgacaacgccaaattgaccaacatacagcgctagctccaattagaatcatcttcttaatggacctagatacccctctaagccaattatcgaaaatgtttttggcgttacggggtggggggatattaaaaacaaaaaacacacatctccaaaaacaaactgagcaacatgacactcaaagaaaagatgttggattgtctcttgtgtatagcagaaagaacaatgtttgtctccgccccctccaattttcttttacccaggttatctttcgttagaaatactttcttgtgaagaaactacataaagaccttgatctccagtggaattttcaagtcccacagaattctctttttgatccgaacattacagttcatgatcgcgacatacatagatttgacggaaaattgaccattcttatagagcgaccatacaaagcagtccttttcatttgacagagttatattagctagcctgaggatcaaatcgttccactcgattagctagcctctcctttctatgtggaaaaagtacattgaaggtccctcgacttgtcatcgagttacaaaatcatccctcacccgtaaaatcagatatatgacatccttcaacttacaaaatcgttcattttagatcctttagtagttttgttctggttttatttgacatggcggctgagtcagcgtgggacccacgtgagccccacatttctggatgccacgtctcttcctcaccagtcaacgaggttttttcctatatgccattaagaaagatggtgcctgcttctgtgccactaaaaagtttaagcctccctctctgccatcgttaaactttatcgtgccctccacactattccgtctgtttttgttgtaacggtgggtaatggcgcagtaaaatgacttagttgccctttggtccaatatgctctctcctagcactctcctctctcccctcagatgcagcagcagcagccaaggagcggaggggagaagacggcggcactgcgacagcgacggggcgctgcgacgacgacgatgacgacgggggcagcgctgcgacggcggcggcggcggcattgctgcgacgacgacggtggcggcatcgctgcgcgacgaagacggcggcaacaacgctgcgacgacgacgacgacgaagacgggggcggcgctgcgacgacagcggcggcggcagtgctgcgcgacgacgggggcggcagcgctgcgacaacaacgacgacgaccaacacaactatggctgcgaggactattgatacttgctactggtgttcatgactgttgatgcttgctactagtaatgcttgctactagtgatgccaggaccagcacaacgacggccgacggcggcgaggactattgatgcttgctactagtgatgccagcgacctcgcctgatcagccgcgcggcacatccaggaagccatcagacccacccagctcgaccgaaaaaattcgcaagaaccacagctcacagccacaggaccaagtgtccgtcctaatttccgcgaagacgagtgcgagagattgcttactcgggccgccgaaggggatgggtccggggttgagcccggcggcgatgctcggcggcggctggacgtggagcacgacgagcgcgccgtcagggcggaggcggaggttgtcggccggaggtcctcgccgctcgtgttgacgccggcttgcatctgcgtcagcggcggaggcggagccgccaccgcaacgtggactggttcgttgaactccatgcggatccacggcatggtgaagctggaggagccggttggaccgaggttgaggaacagcgcaccgacgacgaggatcaggacgacgacgaccgggccgaggcgacggcggcgcggtgccccagctgggcggcggcctgaccgcctgagggagaagaggggaatcgagggagaagactgagtgaaagggcaagagcgacattttttctacccgggcccatatgtcagagctgccaaatagttaaatctaaacggaatagcaacggaacggtgtggagggcgcgataaaattcgacaatggtataaagggagggctcaaatattttagtggcacagggacatatagggccattttggtttgatgccaattcttgccctaccaattctttggtagttttgaatagtacatgttagcattttggattggagccaaattttgccaaatcaatagagtggagccaaatctgtactataaaaaatttgttagtgccaaaatgtgcctaaggtttggtactaccaatattttggtagggtttcaaaccaaacaagcccatactatctttcttaattgcacacggggaagagcctcccagtcaccacgtctcttcctctctcttctctagtcgtcctgtcgaggagcatagccgacaggggaggagggccgcgcccggtgggcgcgccggcgcccgggggggggggggggtgggggg

SEQ ID NO: 68045 - DNA, 641 bp, Oryza sativa
taaacggtgtgttttgtgtgaaaactttctatattaaagttgttctaaaatataagattgattcatttttcaagtttgtaataattaaaaactcaattaatcacatgttattaccacctcattttgcgtgaagcacttaatttttatcttcatctacatcttcaggagattcaaacactgtcttggtgtgactagataacggtataccattcaatcaatggaatattttacatgctgatgtcaccatgatattagcatgataccgtaggtaccaatactcacatgtattaggttatggcacctaagtagcattttaatgttagcagataccttaggtacgggtccgtccggtatcaagagtacccgacgtgatacccatataccagatctggtatctaggtaacatgatgacattaggatggtgtttacaaatgtaaactatatcggatagcattttatagtatttccgtagcatagtactctctctttcggaatgttagatattttggtgaaatttgactaaatttatagaaaaatatataacatccacaatagcaaattaattttattaaacctactattaaatatattttataatatatttggtggtctaaaccatgttaattactacttttcttata

SEQ ID NO: 68046 - DNA, 36923 bp, Oryza sativa
ttcgttccgtgggccgtgccagcccggccggcccacctggctgtctatatccagaacagtcatcactattcactcctctcctttcccattctgtttctcttctgttggctcatcgttggtttcgcccatattcctcttcttgaaggggatcgctgatcagcaaggtactctctcttcgatccccttcccccccctctctctctctctctctctctctctctctccgcgcgcggcctgtcgcggctgttgggctctgcctcgcgtgccgctcgccgtgctccgtgattacttctgtgctcgtcaggcttccttcgccgtcgtcatcctcgcgctcgcgcgacagaatatctcatgatcgatccgtggtgacgttccgacacgcggtcggtgggtcgttcccccgtttccccaccgtggggtgtgcgttggcacggcttttgcgcttggggacttttagcgtttgtgcccggccatcgtagcgatgcgggggaagttgtcggcgatctgctgatgcggctctgatcactgcatatctgatcagttacgtgtccgatccgttccatccctggttggcggtgaaattggcgtgcgtattcgcgtaactacatatctacatgtgctgtttgatcaatctcacgtttcggttatgtgcggtgatgaactgatgatgtagcttatctgaattctcatagcaatgggctttgttcgctatcaagcaagcgttaattctcagtacagtgctttgctttagatgttcagttagtataaagctattgcaggttctgaggtgctcctgacctgcttccacaatgcaagctaaagaatccaaaaagtcaaggttagatccatctcgagctctcaaatgccaaatttattgtttgatttaaaataaccatttcttcatttaagttagtatactgttgtgtgcagggacaggggccgggaccgtgtgaaatggaatgaagaaaatttgaatgacattgagtcgaccaagccagtaagagaaaaaatcaccgagcctaagacgccatatcactcaatgattgatgaagatgatggtatgtgctttggagcttgcatatagaatcatgttttaatacagctaaagaaaaaattccggacaacatgcatctgatgcttgcatctggtccaagggactgtttctccaaaaagaactattgaagaatcagtggataagtccactcatgctgatgcgattaagactgctttgatggaagctgtttcaagtggaaaattatcagcaagagaacatttggaatcctgtagtaatgaagaagaagaagaagaagaagaagaagaagaagaagaagaagaagaagaagaagaagaagaagaacaagaagaagaagaagaagaagaagaagaagaagaagaagaagaagaagaagaagaggtggccatcaaacaaggcacaggttagtaatctgcagtcttttcttattgacaatgaaaaacgaaatatccttgtgagtggtatcttgactcttaaagtcttaattggcattttgtattttgatgcttgtgcaagtcgttatgatttcggtgctgtactgccatatagcatatcatgtctgatacatctcacataaagaagataaacacaggaaggaataatttcaggtatcctggtctcaggctatggggttgattaagtaacctgatcctgtgatctgtaaatctgatttgaattgtcacattttagaccgatttgtcttcctagctccagaaaatatctactgatagaaagttcaagactcccttttgtctgattactcctttatccacttcacttgtttttttttttaattcaaccctgctgttctattggcatcatggtatgccagaccaaaacttttgcttgatagcaaggtaagagctaatgcagtgtacaccagtaggttagctctagtcctggtttagtagctagttggaccatcaaaatttgtataattgtaaatagatataaatctcccgtgtgtgttttcccgaatcagttggatattttttgtgggatgatgaccattggggaagactggttgcaagctgtgttgctattttcctatctctagttcagattccggaagtcctcaaggcactggtggatacgcttcaatttttactatctatgtgttttgcaagagtaacctcaaatttcaccatcttgttttgtgtttttttttcaaagtaagaatgactgcttttacatgctttcatatagatttcgaagagcaacggaaggctcactatgatgaattccgcaagatgaaggaactgcgtcggaggggaacgccgtcacaagagggtgatgaatgatgactctggcaccgtcgcacaactcggaagcatatgatcagcgaatcctcggcatgttaaatattggcagtggcaggaatgttttacagatatcctactaaaccttaaaaagctcatgtgactatctgttctcttgcttaattattagtactggtcctaggacagtaccaggtaaaattttggctcttattatggaggtaagaaaatctgtatcgatcttgtactcaaaacttatgctcttgttcatgctgttgattacaaagttcgcaaatgtgacactctctgtggtaatctggtgtgtaatttgtgcaaattctaagcaaatgcaaattgctgggaatattatctatttattttcggcgcactttgctgggcatcgttcagaaatgccaacgtcccactctgtgtgcgaggtagcaaaatttgcattcagcacccgcagtttctgcatattgtcataacccccctatctggacacggtcacacgaaaattggagttattagaggggtttatctgcaaaaggaacaggataaacctggccactcccgttactctcgtcgtcgacctcctcccgctgctcccgttgcggcggtcgccgtcgccgccgacgatgacgagcttggaggcggccgcacgcccgagcagccgccgcgtggcaccgtgcgacccgcggggacgccctcggcttccgccatggcggctcatcctttccccctccccttcctcccgcaggtaaagcctctgcttccttcttcacgcgcttttaagtggaattggccttgctagattgatagctgagtggaaatggaagctgtgtgtggagtttcctcttggctcttgtgattccagactcgatttgttcacctgcgccattcacatggagctgcagttcaaacccttaggttttagcatctgtgtaatttggagagtaggtgctccagttctacttatagacgaaagattcatattatagtcctggtctcagatggggatgccaatgactgaggtcctgttagaattgtgaatttcaatgtcagaaccaattttgcctcctttctttgggatcaaaactggcagtcattcttttcaaaaagaaaagaaagagaaagagaaagagaaatggcagtcatttaatttgtttgtataaatgcaaaagggtctcaattttagttcatttgctacttttgttttggttggactagaaaaccatcaagctaaaacataaactttcaaaagtaaagtaacattgagtatttaacattgtccaataattgttcactcttattcttatcatgatatcatcatcccatacattcttaacgctgctatctgttctacaggctttgcactctaatttctagacaacttcccatttgcaatgcacaatcatgtgaggttacttatttatcccttcttaagatcttctccatgtatgtaagcaactaagcatgcaagttatcgttacagtgcacatcaattctctgtgatgcagatacggataatctgtggttagccagtggtaatgctcaaagctccgctgctgttcggtcaaggttgcttgctgcagaaagagaggaagcaaaagctgtgctatcactatttttaagacagaaaggtttgagaagtatactggctgcacgaattgccaataaggcagatggtttcattgaacacctagtttcaaagctccacattacttacagatcacgatatgctgaaggtttgctttcttgattgtgctttttgcatatctattggtttgaacttttaacaacacgtttatttttcaggaagggagctcagcacaccggagattagagatgctttgattccatatctggaagccctttctaaagaacatggagatggtttggttgaggtggtggagaatttccccgatccatttgctatggaacgggaagccttgtcttcttcaatggttcttacgcccacaagctcaaataaacacaaggcaatcgctcgggtaagcgcaccaacctcagggggagcccttcctgagctagttctctatctactggaccttggcatggatcatgaagagatcaagaatgtcgtgcggaaattcccagcatttgcatattacaatgtggatcgcaaaataaaacctctggtggcgctgctacttgagcttggtgtgccaaggtcaaacataccaggaatcatcaagaagagacctcagctatgtggaatcagcctgtcagataatctgaaacctatgatgacctatttggaaaacgtgggtatcaacaaagataagtggagcaaggtgctttcccggttccctgcacttctcacatatagcaggcagaaggtggagacaaccgtgagctttctcactgaactaggagttcctaaggaaaacattggcaagattctgacgcgatgtcctcatatcatgagctacagtgtcaatgacaatctcaggccaactgctgaatacttccagtcaatcggtgcggatgctgcgtctcttattcagaaaagcccacaggcttttggtctgaacattgaggcaaagctaaaaccgatcacagaatttttcctggagagagacttcaccatggaggaaatcggcactatggcgaatagatttgggattattcacactctcagcatggaagataatctgcttcccaaatatgaatatttcctgacaatgggatacccaaggaacgagctagtgaaatttccacaatacttcgggtacagtttagaacagcggataaagcctcggtatgctcggatgattgattgcggagtgaggttgattttgaaccagctgttgtcagtttcagatagcagatttgaagatattctacggaagaggatggatggaatatgagatggtcataatttcggataaccatggtttaggacaatctcatttgtaacaagacttgatcgctgccctggtatatagtttatcagaacaagtagtgtcctggaaatttgtacttagccatgcttggcagctgaccaattgttattgacagtttgatgtataacttggcggtttatgatgctagtttagctatttttgcatggagtactggcaaatgcattttgtacagctgttgtggcatgctaatgcccctttgccatcctgaagataatgcacttgtatttgatatcaggaaaagttgcagcaccagcacgtataacatggattctcttgcacatcatagaagccggaaaacagacgaagtacatattctccagtatacaactaaaattttagaagctaatcagctataaagagtaattagagagtacactaaaagcatgcagtgcactagaactctggtttacattacgaatatgtaagtgcttcgccatcactcaccactcatcaaggttagtgataaaatggataaaacacagggaagccctgctttttctttaacaacagatgtttgccagggctgcgttcatgaatgcgctgcaaaacgggctcctccttgttttcctgcgcttcagcgtcagcatcgcatgggtgttcgttgtacttcagtgctgaagtttcagatcatgaagattccaacaatagccaacctaataaaaaggaagcacatcaagaaatgctgcaaaatgatgtgatgcaaggactgtataacgtaatttaccaaatgcaactaagacattacactgatgaggaaatacacaaagcagagaagtcaatttgacagaatcagtaaggtaaaacatcagaatttttgcttcaaaattagcaaaaatacacagttgaaaatgcaacttggaagaaatattccaatgccatcaacactaactccaacctccacagcccaactcaaggagtcaaaaagaaagaacgttgacactaaatatcagctatttttaagctttaagtgttttaagtttttgactatttatgccatgaagggcaagtttttcctcaatgcgtgaaagcttctcaattgaatatgtgaaaaatccgcagtagcatgttagccaatttaaatccaaacatgcttttcatatcaaataaaaatatgacagcagaccttttatcactcaattggttgatatatatgaataagttattatggttcacggctaacatttcagcatatgaaagatctgcttgcatggagtttgataccacgtcccgccatgttcaaaaagatttattttatcatatgcagcataaacaaatgaatgatatgcacaacaatcaactaaccagttgcagtagaacaagtttgagtgtttcaattgttgaagacttgaagcagcgatttcaacctactttcaatgtttgcacacatgagcacatatatagtgcaactatgagatgaaaaattataagaggccaactattgacaaagtgcagctcttagcagaattaaggcaataatgaaaatgacaaaataacggactacaaacaaaaaccactatgctaaagcctcttgggtacatgactaaattactcccagtaaagaacactacatcagttgaataactcatcggaaccatgaaaagtaagaacacaccatctctcctagcggcgcacattgagcatctccttggcctcttcctgctcaacctgcagggcgtcgctggtgtacttgctcagcagctccttcttcttccgctccaacaccatccgctcaatctccttctcatcgggtagcggcacatgcgcgataaactccttcccagcctcctcgcccttctctctctccctcttctcctcctccagcctcctctcctcctcaacctcctcctccacctcctcgaacagcacctccctagcagcctccccgccgcgcccacctgccgaggccacctcgccgctcactacccccttcatggcctcccgccgcacccgctccacacggtgccactcagtgatgacctcattgcgcatgcgcttctcggcaacggcctcgagccgctctagcatgccgtcttcgtcgtcgtagtaaccgtagtaccctgcgttgatgcgcttgtggatctcatagcgggtccgccgcttacggacctcgggtggcttgtcgaagagctcacggacgccagggagcttcttggcggcgccgaagtagcggtacccggggccgcggccggaggggttgggtatggcgacgatgttgccgtcgaggtcggtcatgaggggcgcgttggagctgcgggagtggtcgcggccgccgagctcgacgatgcggcgctcccagtggccgcgctcgcggaggagcttgttgatctcgtcgttgaggtcgcggaggcggtgctccccgaggccctcgttctggatctcggcgaccttggcgccgatctcgcggaggatctcggagcgccaccgctcggcgtcggcgaggtcgcggcactcggaggcgaggtacggccgccgctcccgtggcttccgcttctcctcctgcttcatcgtgatgaagcggttcagcatggactgagccttctcctcgtttcgcgccatggcggccggtcgggaggcggcggtggccggtggccgaaggcggcggcggcggcggcgaggttcttggggctgggagagcgagggtttgggaggcggcgggttcgatttggggatttgcgggttgggtggggaagagggaggctgctcccccgattcaatcgtgatgccttttcgggtcggtttggcgtctgatgatgatccaacggtgcggattgaatttgggattcaagtactcatttttgctattgaaattgagttgaacttgcgaagatttacgcccagaatttgaattcgtttttagtcaattcaggcatttgttcaatattgtacggaccatcgatggtggagatttgagaaggaaagtgatgtgttttgagtgcatatggaaaatgatctctttggcctttcaggatctttgatatggttagaatctgtttgttgtaaagcttaatattcgtgttggataaacttatgctgaaaattctatccaaatccagtgtgagatgttcataaatcacaagtacatatgctcaaatctatgcgatgcaatgaattgaggaaatcctagctggttaggtaacttattgaaattaagttataaacttaacacatgtaattgtgtatacggctttcaaggtgctaaagtaaggcgtgcatgtgcatttataccttgtttcacaaaaaaaagaacgcaatgatgtgtttcgaaaaaagacatatgtatttgccatgtttacattctaacttttttcttcaaacttctaacttttccgtcacatcaaatgtttggacacatgtatggagcatcaaatgtggacgagaaaaaaaacaattgcacagtccgactgtaaattgcgagacgaatcttttgagactaattgcgccatgatttgacaatgtggtgctacagtaaacatttgctaatgacggattaattaggctcaaaagattcgtttcgtttacagacgaaatctgtaatttattttgttattagtctacatttaatacttcgaatgtgtgttcgtatgcttaaaaaaattttggcacgtgaactaaacacaagtttgaatgcgtgtaaactttgaaacttgatagtgtctcgaaaatcactgggaggacttgtcaaaatcctatggcccttttggattccacggcccaaaccagcggacggcctgcttaaaactagccgccgacttccggcggacggcggcgccggaaacccccaccacatctcccggcgattctctccaaagtccaaaccccccatggctcggaagaggaagcgggggcggacgcggcgcgccacgcaggcggaggcggaagtggagcaatccgagcgagaaatggtaggggatgaagccgtggaggaggaggaggacgacgacgtcacgaagatgaatccgccgccggcgacggccggtgagcgcgaggaggaggaggaggaggaaggaatcgaggggcttctggagccgttcaccaggaacgagctcctcgacctcctggtcgaggcctggctccggaaccccgccctgcgctcccgcctcgccgccaccgcggagtccgacgccgcccaccgccggctcttcgtgcacggcctcagccccggcgtcaccgccgccgcgatggccgccgccttcgcccccttcggcgcgctcgacgagtgccacgccgtcgccgaccgcgccaccggccgctgccgcggctacggattcgtcaccttccgccgccgctccgccgcgcgccgcgcgctcgccgccgacgcctcctctaggctcgccgtgggcggccgccccgtcgcgtgccagctcgcgtcgctcggccccacctcccccgaccgcaagctcttcgtggacaacgtgcccgcgcgcgccgcccacgacgagctgaggaggctcttctccaggttcggggagatcgaggcggggcctctcggcgccgaccgcgccaccggccagttccgcggctacgccatcttcttctacaagtaccccgaggggcttacgaaggctctcgaggagcgcaaggtggtgttcgacgggtgcgagctccattgccggcgcgctcacagagtgaacaaggagaagcatctcatgaccatgcctgcagatgcaggggcacagagcaatggcttcgagaacgctgcctcacccatcatccatgtccagccgaaggagcttgcattggcatccaccacgcagacgcctcttggatcaaatcggccagttgagatgatggcgaaggggcctagatcaggcacggttccctttcgtcagaacgctggagctggtctcttgggtgcatgccctgtggctacggtcacgtcctctacgccagatcagagcacaccggttagccattctggagcttcaatttccacaccccggactgctcagagattggctaaatcaggtttgatacagagttagtacctttagttatagttataaatactatgagctattgctagcccacaaatgcaatggaacataatcacacagttaagtgggtactaacaacataggcattttctttctcaaaataaggaataacatgtgtgttttacaacaataaatctcatggttaacaaactacagtagaaataaagatcaaagtgtggttttgtgaggtgttttaagtttctagagacaacttagaattggtgaccgaatgcatgtctattgtctaatatagcatcctggactcctggaggacaatttgggaactagagttaagttatggcgactgcttttaatgcatcctctggataatgatgagaaagaataacctgtaatggccacgcatttttgtaggaccttcttatcctcattttacttggggtatccattttttgtaggagcacaaggatgaagagaaatatgccttttctctctaaaacaaggatgaaaaaagaaatatcgaagatgactcctccaaattctgaagttgttttctttctatcaaatgagaggattacctgcaagataatctcctgctgatcgaattgtgcttcaactttgatgtaatctctgtttgtttataggcagagctcatatattgcaggtaacacctgtcccgcctttatagtggggactgcgagtagctaacatggaagaagattttggtttacatattcagttcttgatattatttctattttgtcatttcaccatgcatgtggtaaagtagtttcatagaaaattcgacgaaaagtggaaagtgatgaattcacatttccatattccttcattccttttgagttttgactgaccaagaaaagaagtggtggctctatgcatcgacaatgagtggtccttgtgactttcttgtggtctcacatatgcaaccaagcacagggggaaggcataactgagatagatttgacatgttgcaggaacatggcacatcaacatgaaaggttcagttacttttctttttggttcagacatgattccgtcctgttcaggcattataatcagagttgttttcagccaatggatcaatttgagttttgtttccctatgctgcacatcccattgccccgacaggtctctaagccctcttgttggccatgcagcgcagcttgtgaagcagggcattgtgatcgtgccatggacagcactttcacattggtataacaccaggatggtggttgtcgtgctggatgaggtgggacaaggaggatgtcagtagtgtaaccttgtgatctgatgtcctggttctcggtaatgtgtggcttgctgtggagtttatcacatcatgtcaaaagcagatgcgcttgagtgcttccttcagcgaatggctccagtttcttgggcataattctgttttcatataagcacctgatcccccgctgtgcctagagctgtcaactgaagacagatagaatgaaaagaaaacttgagtcaaggagactatggcattatattgtgtcactttggctctctgtatgaacttggaggcataatctgaccaagactgcactcacatgttgggacagatatggatttataactcgaatggccttctgcttctgcaaaaattagctttgctgctggtggtggaatctgaaagcatgcctggtggatggtgggaggattctgaattctgattcatagtgaggtcatcagcatagatcctattgaattggttttcattacatgtgaggtgatggaaaaagaactcctaggcctatagcacctacaagctgtggatcttacagttttcactgtagtttccttcttacacttctaatccacaattagatgttgctttgcatgaatctggtagagtcttaacaatcctggtagagtcttaacaatcacgagggattcttttacttgcattatactattatacattaaccttaggcttctgtatcaagaagctgagatggaccaattatggagaattatcacatgttaagtgaaggtcatttcttctggaacactgtagtcagtgtttgtacagatcacaaagtaattgagaattaagttgcattacagtccagcatttactacccatatatggtgtgcttggccttatgcaacattcaatcgaccctcctgtttgtagaggaggaatgtcattatccaacttatcatctaatgtatcgtctgccaccacaaccattctctctttggcagttgaagaacacggcagccaccggtggtcctaggttgtaaagtgccgagaaatcccttgtgttaaaattttgtcgccatccaggtgcataaatggtctgttggacagattgacggaaaagcacaaagacaaagcgatgtattcccgctgttggctttggactttcatagctgactatctcatttcctgaaatagtttgtcaggacttcttagaacagattggtgtaagtgaaaaacaaatcttactgccattgttacataagcatttgtgctggattaggagtagaatctcttttgttctttctggcttaagagtcacttcaaacctgttcagatcttattttttgacgcaacagatatattatatgttgcagagcgacagtcatattatgcaatttttaagccgccatcattcaaatatatttgtaatggatcaatgtggaaggtcattgtggcagtgtgcccatcctgttgttttgcgatgagtaatagttttaccttgtgcactttttcaacagcaatagttttcatcatattgtttgtaaaatcattttgtagattttattcttgatagagttcctatattatttttaatgccaaaacaagctagatgtgaatatcagcatggttgccaaagatagtttcatcttaaagaactctctagttcttttaaatgtgtactcagaaaaaggagatgtaaaagaatgggaagaccataccaaagctcgcatttgttgtttctggaatgtccgtcaccaacctgtgtaacattcgcacaactttaattttgcttttattttgagcataataagcaagtgatttcaattccattcattgcaaatgtctcaggtcttaccaatgaaggtattctcttttggttggattgcttggacttggtgagtcaggatccaccatcacctattggtaagtttgttctcactctttgttagaagcataaactggagttcttattttataaataaattaatcatgcgaaacttgtgcttaaacattagtattttgccacttgtattgcaaaatcttagtatgtagtaataccttcacataaccacttatatacataacatgtatttaacaaaaccacagtatataattctaactgggggaggttttcacccaatgacttagcagcatagtgttgaacaccataatatctacctctttggtcatgaaccaaaggaactcctgtttggtttctaggggacagatgggaaagcatatatacatgctcatttcctcagtgaaataaatgcccatttctgtggttttatgaaacaagtgacgagaacatagtgacatacttatgttaaccgtaatttcctcagttattattaaatcagagcaatagtggtgctgaattatttatgcatgattagtttttcttgtcttctattaaggcaaatatgctattccttgaaattgttgtcctgtgcaatttgattattaggatctgagctatttgattgttatgaatagcgcttgtattcattacagggctctaggcctgactatatagatgtacaggtgtaagcccaaattcaaggaaacccctcacataacgtgggagggggggggtggaggggggggggatacaacacatactacatatcttgaataattgttcgatattttttacacaaaatgtagtgctgccaggtctactcaaatgtttgttatgtaacatgaaacatcttattgagtctagcaaagaatatggaatattcacattttatggctcagattgctgaaagcaattgtgattttttttactcatatataggcagatgtcctaaatgtctaggccaatgtgtataaattttaagtttaatctcttcatgcaaaggtgatgttatatgttctgacactagcaaatgcaaggtggtcatctttacgtcatatattcgaaataaaatatggaagcgcacaaggcctttctgtatcaagaaaaaacagcttctaaatctgtgcaaagtcaagattcttggttttgagtaatctatggatactgaaaacaactttgaaatggatgtactctaaattgttgtcctgcttgatgttttatagaatgccagtgatctgacttgggccctactattgtagcttaaggccatttgcttagatcaaagaaagaaaactttcttttaaattatattgaattttgaaatgaggtggacaggttgttatgaactcaccaaagtgtaaagtgtcctcatgtcacgaccagcaatctcaatccttggctcgttcgctacttgtgaaggcttgagctcagatccattagtcagttccctattgctgtaaagcactctgagtgatgctgatttgataaatgggtccaagatatccccaaccacattgcctacaacaagtggatcccttgacatagttagctacaattggtattttttcaggaaatgagtagtattgttctggggaggctgagaggctaacttggccttaactgtgaagttgggtgaagtgaagggttcaggtttgtgctctatatatacttgcaatcccaaatgctgaaccatttgtggacaaggaaactagtagctctggacgacatggtatcttactttaaactgtaaacaataatatgggttcccatcaaatgaaatatttcgggctgtccaccctcttggcctacaccattggtaagcagcgctcactgcaattccacgtaggtgaataaaatctgatggatcatactcacgtatcccctatacatagggtctaataaatagttgtccgtagtgaaaaggggattgccttttgacttgccacatggactgatgcatcatgttctttgttttcagctattaaattcccctcctttttcacagtgaagggtttgtagcaaacacaagcttcattcacctaaggctctttatctctgtttacaacttgctgtttatgcatgatagaaactaattatgtgttgatggtattgcagggatgatcattttttctaagtaagatgaattgctaaaggtattttaattggtataagcttggtgggatgggaatactattctgcaatgataaaaggtggcaatgggttttcgtgacaattgtatcaattgttggctgtcttctcttaagataataattttcatgtccctggatcgcacttgtatcaattggatgcttgagatgctagtttgtggtacaagtgtatggtctatatcattgtatgtcatcatccagaattcagaataatgtccagttcatctatcaaagattataatcagaactgtttgttttcacataatgatgatgattggggcatcgacatatatcagtctcctctccaattaactatgctgcaaatttgccactgataccggcttttccatatttctgtcatcttagggaaagccagaaagagaactgtgcctatgtttgtggtcaggtatgggtggacaccaaagccatccaagttttagtcctcttcggtgttgatttggatgcatttctccttaataaaaaaggtaccgacttgtcctattctctctctctcagagtcaggaggggattatattagagtttttcttatgccctaaacacttggaacatacttttaagatctattctgatctaccaacgtaagttgtggataaagtttcgattataatttagccttattctgtaattatgctctctctctctctctctctctcaaagaggtgtcattaaatataaagacatatactccgtcttcatttgcttttgcctccttgaattttctgactagcctatgttctatcagatattataatgttatcctagataaaacaaagcatctttgtagtgttccattcctttaataaaacaaagcatctttaattagtttcttattgatcaacaaccatatcttgctatgatcagctaatgcagtcgaagttaaaatcaccatatcatacttaaaagtttcacagtttcacttggagtaccggttctgttgtctaatgtgcatgtgttgccaatgcacccgcccaatcacaatttactcaactttaccttttctattataaattgatttgttcagatatgatgtttgaggcagtaacttcatgagttcttgtgaacacttgcagaaatttatttgttctttgacatatgtgccattccaattatgtgatcaaatatcattttcaaaagattcttgccaagttgctgccttttcttttaatacaaaaaactgccatggcaatttatatgtacttgagacaagagaggaggtaaaagcatgttagataaggtttacattgattttgactacttggggaccatagaatcttatttttgtatttatagttttatgtatactttattttttggatactgcatgctaccttaactagtgtattctgcatgttttctgctgtgcaagtttcggcacaataatcctgagactacttccacagtttgcagcaagttctgtatttgattagagaagtgccccacacgcttcaaatcaaaggtaactaacattatcgaacctaaatgttgaaacggtcatgccagcaagtaaagttgcaatgcatgatgatggattgatgatgaatactaaagctgatggaatctatggatgtcatttggttaggttatggctttacaatctttgatttttttgactgtggaataaagcagttccgtccttcacgtgggcatatcccattaatccagccactccaacagtgaatggaaacgtcccaaatgatggacaccatcacatgggtttccaaagacaacaaatggacgtttgacagagctcccagaatggaatttacatgaaggagacacaaaggcggaaagtttctttaggggtggaaaaaagaaaaattcctacaagggtgctgggcttattattgcaccggctacagcaaccacgaaaaggaaagctggcagaattttgacatatcactatctaccagtattagttaccacagaaagtgacacggcaaagctgtctactcccctgttgaagtgagaattctggcataccaggagcaaatactgttcaggtaatgctggtacatgctatatcttttggtggcacctacccatctttgtcactgtctgtagtgcaatgctagccactaactatctactatctgccttgatgaatggaggacgtaggctgccatgccatgaccgttgaaccgatcatatgattgcattccaggatctggaatccttccggaaacgactagctgtgtgtgtgcacttgaggtaagtcctatataccatctcttcttatgattggaagcattctgtctcttgctgccagagtagctgctagtagcaagtagatagcgtacgtgcggcattggtacatgtgttgcaagttgcactctgctctgctctctacctacctgcccatcaatggagccagtgtttttactcgagccgagtgccgcgcgccatggatggatatgaacatgatcacttgcccgtgctcacttcatccgatccagaattccagattccacagcgctcgcgtttgcatcaccatcttatcagtttcctgtagacccggagaaacgtcaatgacgtaaaggtaaggctgagaaggagagatcaaatgacaggtcggcattatgacactttgtgctcttctacatcaacgctcaaaaaggccattgcaatatatatatgtctgtgtttttggtttattgttacagttgtgacatgccacaattttttatttttggagcccaattataatatacttatgcttatgcctttttttcagaccttctattaggtaacgacttcgtgttgatcatggcttgacaaggtgtcacaatgttcagaaatgaacctgactatttcataaattggtcttattggctacatgccgaaagtgcctcctatttcccaaaagatgggctcatgatgatcgatagcgtcaactgcatggtaagctaatgtccaatctgtgttgcttttcttttgactggtactatttctggcgtcttactttttgttttttcttttggtttgcgtggttcgacttggatagttgggtttagtttctactctaccttaacttgcttgagacctgtttttgctgctgtccccaaattcctaacctagcagagaagctctataagactagagaaccagtcgatcgaagttttagagatcatggatacacatatgtaggctgcagacttatacttggcttgtttggcacaggttcaacgctcaattttttcggagctgatatttctagctcctaaaattcttaagagttgtagttaggatgaacgagcattattgagcgagatattctgtttggatgttggactagaattagcgtgtcgaaaaccactttattttattgtagaaactatattttctgaacctataagttagacctgtcaaacaccctacgtcaacaaatataagggattgctccatttatccacatatacaagggatgagttctacttttccttcaactgtctcatttaagcagttacaccaaaagatgttatttatcctaatcaagtactccctcaggacggagggagtaaagtttatgggacatcattgagtgaatagctaatttagtccctcaagtttcactgaaggctcaatttggtcttttaggtttcattttatccacataggtcctctaagtatttgttttggcttaaaattatccttgggcccacttaatatgccatatggttatttctagtcaacaattctgttagaaaatgtcccttccgctcttaatttgtatacaactatacactagaaaaaaaactaaaatgaataaacaacattgcatatgtacttcccattatttcaacatgtgcacatgaaacttgagcctaatggctatcgtatacacttgcaagtacttaatttattttgttttatataaattgctgtgcattatctataaaaagaattcattgcatgcaattttttctcttatatatgtgaatgaggggtataagtgttatttatcaagagagttgttggttatgttggtttaaggataagtttaaattaaaataaaaacttgaaggactaatatggataaattgaaatattaaagactaaattgattcttatatgaaacttgaaggaccgctttagccttaaactctactccctccattccataatataaggcatagcatgcatgcatgtaggcaattaactatgaccccttctctattaaattattacttttttaaatactttactctcatgttctctaattctattggatgcatgcattgtatttattaggatgatccaaactacaagatgataataattattttcttgatttttgggttaggggtgattatgccttatattttagaatggagggagtacaaaacagtctatcataaaatatattagtgacttaggattggatgggacacattcttataacttatagcgacttcttccgtcccatgaaatttgtcgttccaagttgtttagcatgtattaaggttagaagaaaaagactataatattccttaataaataatgtataatcgaatgtaggatggtggttaggggtagaatgggaagaaatttaaattgaaagtggttgatgtgacaagtactataaagcgacaattattttaggataattttttagtgctagaaagacaagtattgcgggacggaagaagtatatagaactggatgcgatacatcgttataacatggtaccatgatatatctatttagatatattttgggactgaggaagtagaatggatgtgagccgccgctccaactcaatattcccttggacggagcaacgaaagatcgcagtccgaacgcgttgccgcttgcatccaaccattttccatagcaatcacttcgtaacgtcggtgtcacagccaaattccgcagttctcgctcccatgcatggttcggtgtactaactggaaacaaccgatgatctccgccaatcagcagcaacttggcaaaggagaaaagaaagcataaagcccctcgtcgcggacgtcatgtgccagtgacatcaccgccaccaacttgtgtgagcgctttgatgacactctcgctgcgagaccgctgcagagcgaagcaacagcccgtggtatttaatccgagcttctgccctattagcatccagattcattccagcagcatcgtgtcctggactcctggcccttgctgccttgcattcctgatacgatctaatcctagatcaaccatcacttttctctctgctactccctccattttatataggggtgaaaacagagctgattcggactgatagtagtcataccatatcctaaaccatattttttaagtggattcgaagcggttgcggatagtgtgcggatacggatacagagcggattggttcggatgtcagaaatggagtggagtcggtgcggaatcggttcggaaacggattaaatttatcggatgttacgtgtatatgcaatcaatacaacatcgagttagcaatgcaatgaataataatacaataattaataaatgacctatcgtaataattatatgcttaaggctaaacaagtaaacaacatgaatacattatgtccataatataaaaaacagctacgtaagtataatatgagacggtgaaagtctcatattaagaaatctaggttaattgatgaattagaccattggatggaccaacttatattatatgtaatagatagagtggttacatgtgttaataatttcgtattatccggcaaacgttctatcggataatccgatagaaaagtcagataatccgcatccatcggatttcagaaataccatatccgcatccgcatccatatccgccggatttctaaaaactcctaccatatcctcgttacggacggattcggagcggatcggatcggatattatccgatccgttttcacccgtaattttatattatggagaaatttaacaatattccatctattatgttgctttgaatcgatcgctagtcaaatttctttaggtttgataaaaaaatagtaatatctataataccaacttagttttattaaatataatataatattgaatatattttgataatatgtttattttgtgttgaaaatgttactatgcttttttttataaatttggttaaactcaataaggttttgatatgaaaagttaaagcgacgatttataatataaaacgaagggaatattacataattaacgtgctgctgtattcttaatctagatcgagcatgattctggaaacgtcactctcagtctgagatatggttcggcctgtaaggaaattaagagatgattatgcactgttaggcacctgtaatttggctctctctagctccaagttgcagaaagctgggcgttcctattcgtaatgcagcattagttttttttttaaggaatgatgcagcattagtgagcagtagtactagattctattctagttaagcctgcatgcagtgatgcaggtcaggtcagttgaactaaagaattcaaagcagccgccctaagctagcttgaagcccgacactcgaataatgcacatatcattgacgagagtgagaggagtgtggtgctatatgcctttctttctttttctgttcctcgctttcagatcgccgggcgtgcattgcatcgaccggtttgcaggtcctttcccaaggtcgcatatcgcatcgatctctcaaaggtgagagatcaaatataatccaagcgtcatactactagtcaaagaacgcgtgcacattcttaaaaaggaagagatcttaagtggtgatgaacaagttgggggcagccagtgaccattggcttcctcgaaacggctaagggcccctttgaatcgtagggtagaaaaaacggaagaacggaaaaaacacaggattctgacaggaattgaagtgtaaaacagaggattgcaaaacacaggaaaaacacaggaatggttatttaattggagcacaggaaaaacgcaggaatcggatgagagagatagaatcaaaggaaatttttcaagagattggagctcttgctaaatttcctccaaaatccacatgcaatgtgccattccatagaaatttcataggatttgaaaagtttcaatcctttgaatcaaacgatttatgtaggaatttcatagggcataaatcctttgattcacagggcctaaatgggcattggctatgatatggcgcatggaaggaacattggccaggatccgtgtgcgcgtggacggcccaatcgccaatcggccgatcactcaggtcgttcggctgcatatgtaatgcccccgtttgcagtgacggcgtaatagtcaccacgtagaaacataaaccagcttccgcggcagcggttttggagtgaagagactcgtggaggtgaagtcgtcctctttcaaggggtgaaattattggatgaaatgcttatgattccctagcttccaaagtgtgctaaaaaggctttttatgtagaagaatgttttaaattcattttcaactttatggtatttatttcatttgtatccctttctttttaaacgaatagcaatagacaacaaagttcatattgatatagtaggagaaaaaaaaacaaaactacatcgccaagaggatataatcaggagaaaacaaaagaaaaatagccaaaaagactcggtcagtgaggccaaacacaaccagctaaccacaagttgaaggagcatagcattgtgttagttatcgttatgtgagaccgattgtcgctaggcgcacaacggaaccacaccacccaacaccagcaacgctagacaatcgaacagagacgtgtgtttccgtttgtcatcccagctttgaattatacagggagagtacaagagagaagaaagatccgcttgtcccttgtataacccattgctagtatgacaacgaggtgctgctcacaaatgccctcatacaaagtcaaccttggccattagttgatcatcgaaaaacgtggactcccggacgccaccataaaagagggttgcagaggaaaagagcgagagggaaaaaagatccactcatccctcctacaaacctgttgccatgatgataatctgagggtgccaacgctaatgagagaaagttgttagagggcgatgcgcaaagacatagcctccaatgaggtcatgataccgagaaatgctatcaccgtcgcccacccaattaatttggacaaggttttcatctagagagtcccatagtggaggagaattaaggcaccgtgacaactagaggaggataatgagttagctcgtctcgtttgagcttgttgttttaatgagccagttcggcttactcgttaacgagctagaaggttgactcggctcgacttgcaagctggctcgttaagctcgttaatgagctatatctcatttaccattttatcatatattaacataataataacactaaatagtaaacaaagaactcactaaatatgaatagttttgatgtaattaaaatactaagcactagttaaaacactaattatataaagatacgatgatatcttatactaacgagctaaaagactagctcaattcgactcactaagactgtaagtttgagccgatccgagacgagctctttacgaaaccaatctaagccataagtttcgagttttttatccgctcctatcgacgacacctccaatggaaatcacaacgcccaaagcgtcgccgttgccgttccggcggacttttaggctcggctttcgctgggagaagacgcgtgggggtgatgattcgtgattacacgaggggatacgcccgtgccgggctgccttactgctacggcccacggcccaaacgctcgggccacgccatctgattagagatttgatcctataccttcctaaacatttgaggatttattcactttccttgtctcactgttatgctcgcgctgcctcacctcccgggagaagtgtgaaaaaaatctttaatatagtttaaatggtatatgttgtgagatcatataatgtcacttgtcaattttcagggctaatttagattgctgtcaaaataaacctttctaaaatttgacaatactaaaattttgataagttggcaacattgccaaatttcgatagaatcgattaaatatgttattgccaaaattctttaggtattatatatgtttggtaataaactaaatgtatccatatgtttatcaattttactttaaaaaataatatgatttaaaataacatcaatctgaacgggctttcaatttaaatggaaagtataggatcaaatttcacccagatggagagtaatctcaattgttgttgttaagcttaaccattaaggcaaggtatcaaattgttctctataagaaaaaaaaaaagcaagccacggaattggtgatctggccgtctcactgccaagtgggccatcccacggatgcctttttttattactaattaacgccttcttttcctactaaacgctcccatccctcctcccgttccctcgatctctgcctcctccccccaccgccggagaaggtcgccgccggcgagcgagcgcgcccgccggagttgtagccgcctctctcccccccgcggcagcctgacgccttcacgcagcgtgatctccttccccccctaccgctggcggggatccgtgctctgtcggtcggtaagccctagcccccgcccctcctcgcagtcgcagctcgatccgttcccctccacctccggctagctccctgaacgagcgccgcgcccgggatttcgcggccgccgcggcgctgccgcttgccccgtgcctacgcgtggtggtggtggtcgtgtcggcaaaaaccctcgcgcagctctgtctcggccctcggggttctccctccgggtgtgaggtgtttgagcatggggaaccgtgggataaccgtggctaaaagcacttgaaatcatctagctcagcgttcacttccctgttaatgtagactttataggtgatgaggtgaatcaagtaaaatgtttgtagcatttcacccgttagagtgtattcctgttgaagagtaggagatccttgagattgttgatgtccaatcctttgtattttgtaacttgttcctgcgatacctattgccgagcaatatgttggtgttgggggtgtgttgggtaattggagcaatgcaagctggtctgccagatgtgcaactgtcttgttagactagcatggaaattagtttgtacttttgcacattagccagttaacacgaaacagatttaagtttggcatgctaggaaaatctgcgtcatagatagaggcttctataaccatggctagattttctgaaaatgtccgcatgcagtcggaagcttaaaatgttattgtgggaatccaacttttccctatttgttggacattattctactaatgctttgaatgaactggcaaatgttagagttaatctagcatccactcatgtgattttatcaggttgtactcactgaacatgcttcctgctggctcttactggccccaatgcgattacgcttgcaagctgataggttgccgcctgctcctattgccctgccccctgccccctgccccctgcttgcgttcatggataacagagtgtagactgagatgatactctgttttgtaccattccaaccagagcaatggcaaactggcaatgatagtcttagactcttagtcctagtcccctagacttctgaaacttttttataagaaatggaagaatgcccaagtacaactaacacttacactgggaatgtttgaagaatgatctagacatatgactaagttctttttctctacattgtctgacatccctttgggatttgcagagtgcagactgatcttctaatatttttcatagttctgctaaagttgaaatgtgacagactgacagtgccatggtgctaattttaatacttggacacattttcaagaaaaataatatgctggtatacctttttttaatatatgggtatctgaaactatgcaggttcagttggtggactggtgaactgaaacttattgcttggtgctagtgtgatggcgtacgagattagcgagatcaaaagtgaagttctattctcgaataagacttacatacagcaagcaatcgaaacacttcattggtctaatacttaggacaaatttttttgcaacatgtatctctaaacttttagatcaccccttaaactttggggtaaagtccatttcttaatcttacaaaatggacattttgcgcactaatcctgaggatagaattaataggtcactcaatatcccatgctggttttaaagttggtttttgccaccattcgaccatggatactggcaacaatttctttccaccagttttagaggtggtgttatgtgtgattataaaggaagatggacatatggtttgcagggatttggagtttattaatagtatagtaggtactttgtctacagcaattattttcacattgtaattgttcttattgaaattttaaagctaattgaaaagcatggcatacaagaaaagagagatagagaaagaacttggagaagggctttaagaatagagtatttcagtatagtatctacaatagtaattcaattccagtttcagaaagttgtcacatattcactcctgccgatctcacctattttacctctttcacaccttagttgagtactaataattttttaatttgtctatgtagaaattggcataggcctggtgggctttggcatcctattctcattctttggcgttatccttttctttgataggggcttgttggcgttgggtaatgtatgttacaacgaacaaccccttcgtctgttgtgtcagttaatatcaaataaaactttattgtggtgttacacttgctatctttcttcttttagattttcttcttgactggaatcggcttgttgcttggttggcaatctatgtggcagcttttcacaaagaaggcaaacattaaggtacttgagtcaaagactttgatagatacacgctactatccatttctttcttatctatgaatggataagatgtgacaccatgctacaattattgttttctacttttcttactaaaattagataataataactttgtagttggtcaagttttcaagttgatgcttgtcctaatatgcatggcaatgacataatagttctgcctacataattttgtagacaacaaacttgtttaggtgcatgtattctgcacgagtacaggcatgatcactagcctttaatctgttgcaagattgctatggaacaaagttgaactatagatatctggtaccggtctactggacatgcaaagtattgtagatcgcattctccaggatagcaatttttgtattgctgcaatacggcataattgattggtccaacttatttattgtttctgtgcatcacatggatttctctccacatacatgtccagaagaggtaatgagtttatttgggcagggatctgttcctttcttccttggtctgtttcttctctttgtccgatggcctgttgctggcataataatggagctatatggatcttttgttctcttcaggtcactgtctaccagccccaactttttgcccaatattcatttcttagtagtcctttttggcacttatttcgcttcccttccatttcttgtgcagtggttatggacctcctatccaggccttcctataccagattccagtcattggatggattctgcaatacccattccaggtaaagtttctcttcctatgagagaaggagggcgatcatgatcaaattgatgtttcatggttaatttttttttttatctttattctgccatgagtcctactctattgtcttcagattatggatatgccatatggatataactgatgttgcagtattcatctggtttctgcagctgtttggtcagttcaggcgtaaacgtgcatgacaactcacggcagaaattacccttcgtacgggagcatattttgtgatgttaatacggaaacctgctgtgtaccatctgccacgatgcagtttaattcttgtgtgcatattcatactttcgcctttctaatctggagtttatctggcttttgctcattttgctaactggcagtagtttagtgttcatatatagacgatgtagaggcttcaaatgattgttgctagaaatttgggatctgggtttagcaaaacatgtggatcttttagcctatttctaacaaattgtgagccagtaactattgcttgaaaggtcttacaccgatgattcttccaaagaaacttacgttgtactcccttcatcgtaaaataaataaacttagtatgggatgtgatagtccatatccgtagtacttaaaaaatgtcacatccaggtttatttattttgaaatgggtggagtataattgtactaggtgtctttattgggttaattcaatccatgccactacaatctctttgattttaaaaaatacaattactattcatgccattacattttgataaaaaaaatatatatgccactatatactccttcaatgtattcataagaaaaattggaccaaattacccactcttcttcctcctccctctctctcctctcttacctgggatccaaatgaagccatggtcacggagcttctcgcgctagctgtgttgtggcgtaagagcagtcccaaccctctatctagaatggtgtctatggcattaactacattgccatgtaagacttttagcttatgtggcaatatattaattaagagatagagagagtgaagagaggaagaaactgggtctcatgcaagacacagcttcaacacgagaacatatacactagacactatcaagttttgcattggaagataatagtgtcttcataatagatgaagaataaatatgattggtagagaataaatatgaatgtatttattaatggtccactttaagaaatcatgggttatatggtgtatttctattgtaatatcttattaacatggtaccatggacactgcttatggacactatgggttgggactgctctaatggatgagctgcatggtgtgctggcagttatgcttcggaaccttgccaccggcacaccattggaggtcgttagaccaacgggctcgatggggattggaccggtagaagagatgattgattagagagagagggagaaagaggaggaatggtaatatggtctaattttttctataaacgcattgaatgggtaagtagttgcatattttcattttctattaaattgtaatataatgtcttcaaatacacgaataagaatgatattttgtaaaaatcgaagaagttgtaatggcacgaatccctcgtttattttgcgatgaagacttagagtgcatgtcaggcatatttttcaatttactctttttttgacagcgactcattgagggttaaatgcatgtgattatgtccatactgcaatagataatgtgcatataattagtccctggacctaaccagcgatgatgcgctatgagctcatcgtggatctcattgataatgcatttgcgcctctcatcattgctgcctttgaatcttgcttctttttgttcttttggcagaatttgccgtcttggccagtgccgtcctttgatcgtctatatctatggagatttcgatttgatcgcggtcatctctatccaccgagtcactgtgaccccactagttttagacgttttgtcattagaatttgatgatggcgattggttgctgttagtagcgataaactagtaatttgtttgtttcttttgagtttagcatttgtttccaatgatcgttgcgttgaaactaaaccccaggccctagcagaatttctaccgttttgtttcttcaggtgcttgcctaactattgcctatataccaatcaccaagtttgcgtaggtgtatggccatgatttacctaaccaaactagttagccagatgtgtttttctaagctaagggaaataccatgtttttgctctcctatgtcataaaatatttttgattgttttgtttatttatttttatggcttatctgtcgtagcttaaatgatcagagctactccctccgtccaaaaagaatcaacctagaaaaggtcacccgtcaaaaagatatatcttaggttaggttgattatttttgaaacggaggtattacgcttgaattctgttggaaatttctctcaaatttgtgccttccttccaaagtagcccttgattgcatcagcgcaaagttgatgaaatagaaaattcctcatcattgcgagagtacaagtatcatttcgtttgaactatacgcctccgtttctttttctcgatccgttcacggggagagccaaaacacttccaattttttcctgccagagccttgcattctcatacgggaccaacggacagcattttggtagagtgacaaatagtaaattcttccgatggcaagggaccaccactggcaacacctgttactgctctgctgtgctcactacggacataactgattgctctgagaataaaaactagattgtttttaataaactagattggtagtcaatttataaaaatctagaaaaactgaatcttttttaagaatcatgaaaagtgggtttactggtttcttgacttctagttggttttctgcattagaacctaggaaagcgggtttctggattctcacctaatagtttgttttgtacattatacaattatattagaatctgaataaaaagctagactcttatgaattaggacatgcgttggagaaactccctaaaccggctctagattttatttactcggcctttgcccattgctcggctacactggtcctctcttgtgccacaagacgtcaaagccaacaatcatcggcagtgctgaagggtcccgcccaattactccgctttccatatgatttctccgagtgggggatagccactgctagggctagatgcaaaacaggaggaaatttcttgaatagtaaaaagaattactcatgtgtatcataaaattctcgcacagctatagtttcccttattcgcggaataagcgaaacaacatatttgcaaacgaaaagtaatttgtaaataaaactatatgcatgttcttagcgatctaaaagcaactgaaaaataaacttcgatgaaaaaaaaacctcgaaatcagctccaaatttaagattgaaaaattcaaattttggttcataagtataagtataaacgaaaagataaggcctttgagaacgggagatgcaattgccatcacaatttccatgtttttccctaaaaaaacaatttccatgttaagggatcaaatgaccattagttgatacactgaattcagaccattgctgctatttgatcgtatggataagacttgtagttggatccttactaacaaatgtcttctaaacgtttactttctggagtatatattaattttctttcatatatgtcagttaagtcatactccctccctcctattttaagtgcagttgttggtttctttgttcgacgtttgatcgtctgtcttaaaatattgcctactggtgttcgaatgagtaggatgggatgtgcttatccccacatgcaaaacgaaatgtctcattagtatatgtttaattaaatattatatataattgttttaaaggaaaatgaactaatatgagtttctaaaacagtttatctataaagaaaatgaagaaaaaacattgtttaattgttcactaagcgtgtacgtgaaaatggagtgagtagaagtcgtcgaacaaagccttgaaaagttgttgtacccaaattttccaaattgttttttttaagataaagtataacaaactgatactccctatgtcctataatatagcaacgaatctggacaggtatctagataggatatttcatataacaacgaatctagacatatgtctagattcgttctactatgaaatatttcatctggtctcaggttgtcacttttctatccagatttatcgtagttatttactactacgtcgtcactatagaagttggtaaacgcatgtaatttacactttttactgccacaaaaaatcccacctgttccaaatcctactcgtgttgtccccatgggaacaaggcaacaagcctccctttgcagcgccagaaagattcctagtcctcctctcctcctcccctgagtcccctcccctccccagctcccctcccctcccgtcacatctccgcccaatgtggcatataaaatcccccagatccagccctccccacctccactcccttcctcattgcacacacgagaaacacagattcacacccacgagtgttcgttcgtgcccgatcttgcaggtggctctgtgttccgttcttgttttgttccggtttcttgcgctaatccatcatgttcgcaggtgggggtggggggttggtggtgatgcctgggcgcagtggtttatcgatcccttccctgccttgtggcgctgatccaggagcggcgaatttctttgagagggtgttctttttttttcttccttttggtccttgttgcagccaacgacaacgcgggaatcgatcgataaacctctgcatccagttctcgcctttttgtgttcaagggcttgaggcagtagtactggctattgcttcttgcttcttggctgctcatggggtgtaaacatgtttactacttgtttaggcttgatatatatgtttatgtaggatatgtctctttttaatgacatgactatggtgatagaactgtaaaaatcttttattctgatggttgcatgatttgatatgtgcttctgataggttcttttattctgatggttgcatgatttccatgtttacatggtagctgtaggttttgcactacaaatttcccctggatatattgtctgagacttagcatcagccatactttgaccatgccattgctaatgtgtaaggataatgagatgatgcattgatgcttgatgtaatttgtgggctttggcctattttatgcttccaaagtattttgcaggtgattgtgtggttttgttttgtcttctaatagtgggaataagttccttgctctagagagattagttctcaattgcaatttgtatccattaatggaactacgcgaggtggattcttgttggatcttgcttgctgccgtcatgagtcatgactggaacaggttccagttcatgtggagtgaatcaaatgcagaatacgttctaatgccaatgggtcttcccttgtattcccaatattcttttgcctattgctatggtaaaaaaaaagttgtttgcaataataatctttaaaaaccttttaatttgtacttctattgaatattattgtaggtagtgaatccatctcttgtctctacaatataacccctccccccccccccccctccttgtcttctgtaattatatgaagattagccagcaaagttagatgtaaaataagatactttctagctaatgactgctagaatggagtaaatcggtaaatgctcataatgcattaggatttttaactttgaattttcttcatgaatacctttcaaatctaggaaagctcaggtgattgttgacattattcgatgcttcctacaggaatcaaaaaatgaaggtagccgtccttgattctgtcaattagatccctttattctaacagcgttgcctctaacctaaagaatgaactgagtgcacaatgtctctattgctgaggactcgttctgttcaccaaatgaaaccttttttttgtggttttgtagattttcagagactcagaccgatgcttgttcatcgccaggtgcccaggttttccgttcttcttggtgaagttaagtggatctgccgtttggtggctggtaatattgatctgaatctgatacatatcaattatatgctcggtgcttgttgattgccatcaataataccttgtgttcatctggaaaatatcatgtatagtgtatttaagaactctgtatcagagcagttcgaagattgaagatttcggcaggctactgtggcttgcccaaccttgctgtatcactgttttacaacttcctaataggagatgtgtttatgtaactctgattagataccgttttatttggagggattatataacttactactctctccattttaaaatggacgacgttattgacttaagacatgtcttttgatcatgtgttttatttaaaaatttagtgtaactttgcaaaaaaatgtaagtcatgcttaaagctttaaattacttctaatgataaaacaagtcaacaaaataaatgacacgtgcatttgttttgttttaataagacgaatcgtgttatgtcatgtataaaagttagcagcaccatacattttaaaaactaaaacgaagtttttttttgtttggaaagtaacattgtccgtttatattttaattatccgttctcagaggacgttttgttcgttcgtatgacaatcgtattacattgtcagatgttggcacgttgaaacattgctagctgaggtgactgccagttccatttttcttacaaacagaacaaaattgcctaattcctcgaaaaaaaaaaattctacttactggacggtacattaacgtgcccatggtacattaacgtgcgagggcccagaagcgacggtttggcccaatctggccccaagccatgtcttgtgtatccacgtgcactcgagttattatattcatgaaaatgaacaagaaatatcaacaaatcgagttatctgcatggaaatgaacaataatactcctatgtcaacaggtcagcctgctcctcagtaatcagcacatgcttatcctcattttggcacgatcgtcatgttcggtgatgtatttaggatttttatatggctgattcaacttatataatttttttaaataccctaaatataacaaagttagaagtataaattgatcatatgcgttttaaaaaagtttatttacacatatgtatatatatacattggattagaaatgttttgggtgattccgggaccatatcccctagatccacctatgaccatgtccgtgcgacaattcaccgtcgacaaaagaaatatcatattgagttgaatgcacgaggttaccaacgagcgcaagcatcacaagttcgagcaaactgtcaccttagatgtatataggttgcgtaggacccagaagcacaaaatctcgtgagcagatcgatcagcagcagagcagaatggctctcctctccttttggtcacgagaacggatgcgatcttggccatctcttttcccaaaaggaaaaattggcaagattttgctttgcgcctttgcctttatttttcgccgctcacgtctacatcggcgacgagctttccgggagcatattgatactactagcacagataaggaacctgacagctcaagcactagctgctgctgctgaaattatggcaattaaagagagcgtaaagcagcagcagaagttgttaatcacacttggcacttgcaaagaagggtaatcaagggagagtaagagagcgaagggtgtcatctgcatcccgtgacaatagatcagagaagccaggaggtcaggtgaaaatttgataggaaagcagtggccatcaaatattaatgtagttgtggctggattacaagacgatcagctcgaacacaaccaaccaaactgaactgaatgatgctccggttacaccaaccagtatgataagacaagagaaaattctctcaattcctacgaaaattgaaccaaacaaatcttactctcagtacatttctcctgcatttatttacagtaccatcaagttgtattgttttttgtataaaacttatatttaatttacaaaagggagtgaaagaaaagggtatccatatgctatgcttgcatttcggtttcgaagaaaatattcatacgttagaagtcaaaaaaatacggagaaatcttcatctctccctctgtcactgccggcctccggcgcggccgtctctacggccgccgtctcgccggcggcggcggcggtcgacgcagcgaacgcctcgtgcagcaccttctccacgtcgagcgcctcggcggcggcgcccgcgtcgtcgtcgtcgggcgtcgggatgaacggcggccgcgccacgtggaggacgcggtcccagtccacgccgcggaagaaggcgtgccgcttcacgccgtgcgcgccgagccgcctgcccgggtccttctccaggaggagtccgatgaggtcgcgcagcggcgtcggctcgccgggcatgtccggccgcgcggcgaggacgcggtggaacgtctcccgccggctccgcccccggaacggcgtgcgcccgtacagcatctcgtagagcaccacgccgaggccccaccagtcgacggcgtggtcgtgcccgctcccggccacgatctccgcgccacgtagtcctccgtcccc

SEQ ID NO: 68047 - DNA, 7600 bp, Oryza sativa
caaggtagtataaatgttacaggcttagagtaagtgttcataggccaaatgcgttattgattagggccaatttctcgaaaacgctcacctgagctatgccacattaccacattggacaaaaataggcgaaaaaaagagatgacattagaaagccatgggcattacctagcacaatggacggccgccgccatggttttgcggccttgcaccgcagcactctgttgctgtttcgaatcacctgggatgggaagatgcttcaaaaagaacaaaagaacaaatcaagtgagggcgggagagatgcgggatgaagcgagcagggaggagaggaggagagcagccacatcgtcgaccaagaaagaaggtgcgcgagtgcgaatggggatgagaggacgatgaccttatcccttctcctcgttcgtgtgctcgtctaagcccacgagatgatggtcctactagctacattgtcggcccacaagaggatgggcctccttgctacattgtcggcccacaagaggatgggcctactacaaaggcggcccactggatcggatttgctgaaacaggagctcaccggcgtcactgctcgtgttttgtggtgttgagttcgttcagcacacaaaaattcacaagacaaaaaacgaggagtttcagcaacaattaatcctatatatacatgcatgatgcatcaatggcgcatcgacaatggagaagaagagatgatctcaggatcgaagcgaggtccaggaggcaaagaggagaaggttccacgtgtcaggcagcccgggcaggcaccagtggctgcagtcggcgtacgatcccggctgccgcctttgctccggcgtcagcagcttccctcccctgaccgtgaacactgacgggtgcgcgtctcgccggagctccgacagccgggtgatgtccaggtaccccaccgccgtcctcgccctcctcacgttcctctccacgatcgacaccatccctctcgggaacgcctccacgtactcctccgccctcgccatcggagccgtctcgttgtagcaccagttcttgctgtgccaatgccaatcatgtcattgttttccaatgttaagatcaagtaattaagctgataatcagttgaaattcgatcgagtttacgaacttcttgtgctcgggggagatgctgcggaagaacaccatggtcttgtgagagtccacgtttcgatcgagccaccgcgtccatgtccggagcgcgcggttgaaggcttcctccgctcccatctccaccttctttccgttcctctccaggtgatcccacctgcaatgcagtagtcgtcaagtctgtgtcaagccatggacgcggatgattttgatgaggtctggagctgagaagccttacgccctgaacttgccggtgtgcgtccaccagtggcccgtgttgaacaccagcacgtcggcggcggcgagccggcgatacgtcgtcgccgggaggcggtccagcttcagcaccctggtctggtcgtcgaggtccaccaggaacgggctccagtagaactccaccgtgcagttgtaatcctgtccgtgatcgcaaaaaaagttcaactgaatttcggtttgatttgctgatgagtagtagtaaaatgcaaaagttttttttttttggtttgtctttagttaccaatgcttggaagatcttgtggtcggcgctggcgtcgtcgacggtggcgcgtgagcggtcgggcgccgcggcgtagaggatgcaggcgagcgactcccacatgttgcggttgagcgagtcgccgacgagcaccactcgcttgtcccggcactgctccagcatctccccaccacgcagcctgataaaaaagtgaagcattattcagtgcgacgtgtgcgatttgcagaggattactcatggagaatcaacacgattattccggtcggaatgatgcaccggaggaatcaggaacagtgaccggggttggttgtcatgtgtgcaactagtgtcaactatgtgtttcaaagtgaaaaataattaattactgccataacactagtagtactatgcacagggcactgtcagagctgtgttcccaactcaaaagcaacgcacatcgtcacaagttgacaactttacccacttttcatttaccttttgtatccaagaacgggccctgagacagtgcgacttgcacgggcttgttcattttagccatcgattacgactgtgtcacaggggatacacacacacaacggagagcattcatgaacgattcatgcgcatttcaaaaacaaatcagattcagaatctactaaagagaccagctttagtttgtctgtccaggatttaaaacaaaatgaagagaaatttcaaaaaggcagaagagatgcaaggtaggtagcagtggccacgcacctgagagcggcggcgcaccgcctgggctgccaccgccagtgctcgtagccggagtccggccggccgttcctccggcaggtgacctggtcgctcaagaaggggcactccccggcgtcgtagagcggatagccggccgggtcgtacacccagctgccgtcgaacaggtcgcaccggacttcatcctgggccggcgccggcgagccatcggaagcagcagcagtagctgggctcggcgcaggtgcagcagcaataatggcaatgcggtcgggcggcaatgagattgaggacgcctcgtccggtcgcttgacgggctccgggtcgtcttgggagaagaggagggcgcgggagaggagaaagagcgagaggcagccgagggcggcgccggcgaggcgcttgcgggtggccatggagggtggtttcagcttcaggggatccattgctagcttagctccaactgctacttcaccggttgctctgcctctgccactgcacttttcactgggatggatgtacacatctgcaactcggtagtagcagtgtatatactggagtggtactactaaaccataaaaagaaaaggaaaactcaaaactgaaaaacaaaatttggaatgtgttggttgagttgttgctacatggaggatgaagccaagcccccaagcagtgcattgtttggttggttttgcatctatttttatgtagttatgaactagtatgtggagtggacgagtggttgcgtttgggggcttgctgctgtctgtttgttccctcttcctttgccactgacactgtgtgtgtggatcttatctgagcttagctctgggacttgccatgtgccagcaaactgaaatcaaatgtattactccagcagctagtatccaattcaacagattgtttcaaactcaacttttttaaaaaaaactaaaccggcaggagaactgctaattatatttttaataagtaggagcaaagaccctagacgggttacaagagaagagtttcaaactcaactttgtagtacatatcttcctcttattcttaaaaaaaaagtgaactttgtacagattggaatcgtgcaaatcaggaatgggccgaaagtcattgtgggccaagcccctggtccaaagttcaccctccggccctggctggctaaggaataacgggcagcccaaactaaaatttaattcgctcgaaaaatagaagaaaaaaaaagaggaaaaagagagaggaaaggaaacccgagaccctcctcctcgacggcgtcggcagggagagggaggggcagagcggcggggaagagggagcgggatggcggcgtggtttaagctcggtggctccgctgtgcgcgccatgggcgctctccggggatcgccgccggcgatggtgcggtaacgccccccatttcccctttcttctcttctctagccggattgcacatcacaagcgcctctccacgatcgtgttcttccgttccgtgattctgcggcctcaacgttgctcccttaggacagcctactcatgcccatgagcccactcctctcctcaaggaagcaccccccagtcaccggcgcgcaaaaattgctccttttttgtttgaggaaattggggatatatttcgacgaaacccagtttcgaggatggcatatgtccaattttctcccttttggatagatggatggatggatagaaatctgtacatggctcaggaagccagaaacaacagcatctcaaaggcccaagaacatgtgggaaaaaaaatcacatcttctcttcaaaaaaaaattaaaaaatcacatctcgcaaatttctttcagttttgacggcccagcatctgagcatctctctagcaaattctctgcggttcccacaattcatcttaatcgtcagcttgttgttatgatcccagctcatcctcctgaattaaggaggatataacagtgggaaatagttaaaagccccccttaattcagcacgtttacacccaacagcatataacagttcacaacaatcaactcaagtacttggatacaaagtgtagcagagtggaattggggaattggggataagcaatataggatgggaattagataaaatagacagggaattggagaaacagatgtgggggttcaggtaagagcaaagaaggggatagagcccgcggccattcagttctttcaaaatgatcgatgatatccatcctagtggcgcctgtttccctttttgtagtggctgctcgatgccagcccattgggcctaacaagccatagcctatcttgtacactggcccagcccatatccatgacattcctccctctttaaggttcagcttgtccccaagctgatgcaattgagctacccaagccttgcctccagggtcccaagaaatcactatcattgtggttaagtcatcctgaatagcagccgactctttgaccacgaggtgcattggcaacactgacagacacaaggcaatgctgaaaagttggtaggatagttgcatcaccacaacaccatctatgtgaggaatagccaacccagaatcacaggtagtgtcaacctgcacctccatctttccagaattgtagtgattcaattggatctctgtaacaaactctcaaatattccaaggttctttccttaggaagtctaaacgagctggaaaatgttgaatcggagtaatgttggttctggattgaattccttcttgatgccataatggtctccagcaatgttgatgatgcctccatcacaccaacagaatagggaatggaaaatgattgtaattgtgattgctgtcgcatatttccccccagcagtagagggatctaaatgatgctgaatattcatagaagtctcccaggatttgcagcgcatccctctacatcttctctccagggagaatgcttacacgtacaacttacttgctgtaacttggagttggagttatactctacacttgactgcacttacacctacaatctttttgcagcatgaattgtaatattttccctttgtttcgtttgtatcaggcatcagtgttcaccggtggatggctcctggggtcttccatctccagctggcagacgctgaaggttgcggagcagcagatcgacgccctggcgagggagcaagaggagtacctcaacaagtttgaggccaagtgggtcgaggaacttaacaggctgaagctcgagatgatgaatgagctcgaggagtcggaggaacggcttaacagggagattgacgtcctcaagatgatggcgaggatagcgatggaggagaaggagatgaggatggcgatggaggaggaggctgcttctccaggtcctctccagggtgagtccggggacctcggtgacgtgtgactgatggcgaggatcatcggaggaggcttgcctgcgccagatgtggatgtgggtgatcgatatgtatctactagtatctaatctatcattgagcaatataacttgactactagccagatgtagaaagttgaggattacaacaacagtaaaagtaagctgtcttgcctgagacccagaaactaggaaccagcacagtcaactgctactagctctactcattactacatgatgagaaattgccagcttccatattatggtggtctcctccttgatgtttttttccaactaattgcatgctgaggaggcttcgacctctgctcaaatcccctctcttttcaagttagctaatagaccatcatgtacaatagtccatctactgcttaattcaggactagcaaaaatgcctgtgcgttacaacaggtgaaaattttttaatgataatatacgctttccatgcataatcatgtcaatgataataattgtatcgatcgttgtagctaagacatattataaagaaaattgaaacatcttcaatatactgatcttcaatataatgacccaatctcgacgatggcaaccttaccaatgcatgttttacccaaacgaattggattatttacgtagctggacacatgtaatctaaaatactctttcaatctcatttttgctattaataataggatcaatcaaatcctacattgtctcatattgtcaactatagacaaataaagcctcaatgcactcttctcttaataacaattaaaaatatgttatttattatctatacttaccagtagtctgataattacatacatagatatgtagggtctccaatacaggagaatataatcgtggaacacgagccatgtaggagatggaaaaatcgaggatcctatccaacccaaagcctcgatcaatttgatctcgttccaagaaaaccaagcctaagcaagacttcttttagatccgcacgtctgaacattcgatgacgctttggaaaacccaaaactaccaagacgatggacgatacaaatgatatgaatctttttcatgaaatcagatttttttttttgaaatcagacaatttttcgcattgcacagtactgaaccggaaatttttataaacgcaggtttttttctcacgttgggtcggtttattcggagcagtctattttatatatggcggttttttcttgtgtggagtcagacaatttttttagatcttttttctcgtgtggattcagatggtttttttggatcccctttttataacaatttttatttgacagtttatttcagagtggttttttatttcacgttgagtcggatattctttcgaacctttttttttaaatgatgcctttttctttggttgagtcgggtggtttgtttgaatcggtttcttttataaagaggattttttataaactacagtttttttcctccattttgagtcatacatttttttcttttttttttggacaagacgactttttttccttttttacggaagtcagacctatttcttttttacggatgagtcgtttttttcctttatttatgggaatcggacatgaaaagtttttttttcctttttagggagtcggacttttttttcgttttctttactggcgatattttttttccttttcttcagcagtcggaatttttttaccgatgggtttttttcctttttttacgggagtaccggagtaggacgtgagagttttttttttcttttttacaggactcggattattttttgtacggacaagttttttccccttttttacgggaattacggtagtcggtgatgaaatactgtaaatcatttgtcaaacccg

SEQ ID NO: 68048 - DNA, 597 bp, Oryza sativa
ttcaatcatacacaataatccatccaatgatctaaatcacactactctattaggacaaaggaaaaaaaaacaatagcaccacaagaagcataacagagtggaagtcaggcagaagatctgtccaaactccaaagcttgcaatgcatttgcagccaggattggagttcaccaagagagcatggggctggaagacgaacatgtggggccattcccaaaaattttcatagaatccctgcattgtctctcgcagtcactgctgctcatcagcctctcacagacctgtttgcctgctgctgctctcttttcatgcagtgaacctgttgaccacacacacacacacactgactgggccccgggccccacccacgcctgcccagcatcggtcagtgaggacttgtcgatccgatgatccaatccgtgtcgggcggtgtggcgccaccaaactggcgtgtgggccccacctgccccaaccctttgccaccatggttttagggcacggatcctatgccgtaacgggcccacgtgtaagtggctgtcataaactgtgtgtggacagtcgtattgtagagaatacttattaccggtagtttcaaaatg

SEQ ID NO: 68049 - DNA, 9788 bp, Oryza sativa
tcctgcagccctaatagatcgctccgttttccgtgcggagtcactatgttcccatcatccacatgcgaacacagccttagtcgtcattctccttcgccagtttactgaagaagctcccgtcgtagacggctctgacggtgtccttgcgaaggatgtcgtccttgtccttggcggcctcgaatgtcgcccgccactctgttgcagcctggagcctgcattttctcgatcttaggccgagtttactttcaaaatttttctctaaactttaaaatttttcatcacatcaaaattatcctacacatacaaactttcaacttttccgtcacatcattctaattacaaccaaacttctaattttggcatgaactaaagacacccattactccaacaaccacaggtgaataaatatatatagttataccatttatgattcttgaagcactaagttttctatttgatagactaagttcctaattaaaatagttgtatatatccggttggatatagatgccgggtaaaaaaataccctatgattcttgaagcaacaagctagcaaaagattaccatcctgagctgtctttgtgctctgtatgatctgcgtatgcatgaagcatctcgtccagctcgtctgatgtcaggccgtcgggtacagtttttgcatgcctggtgaatatctcattgaatttttcactaacaaacctgcatagcagaggcctagtctagtttagttctcaactttttctttaaatttttaacttttctatcacatcaaaactttcctacacatataaactttcaacttttccgtcacatcgttctaatttcaatcaaattttcaattttagcttgaactaaacacacccaagttgagtatagccgtatttaggtatttttttgtggggcttcctcggaatacatgaattttgcatgattctcacatgaaaaagtttaaatccttaaaaattccaaaccagataagcctttactagtttaataatcacaaaatgcatgtggcatctagtactcgtttataatctagacacgttcccaaatggatgaggagagcacggtgtaccttccttcagaatcgaatgcacccgtatcacttccatggatccctttatgaatgttctgtacatagatagaaaaccatgacccatctgcgtcttcctgcatgcatttggaaaagttcaactcttgaggttgtcatcttaaatatgaggtgaattatgcgttgaatgagaacatatatataatataaattatacaaaggcgtcatgcgctgtgtatatagaaaaaaatatgtggtgcaaactttatgtatattgtgcaaagctgaaaactatcgtaggataggaaaatggacgtataagatttatctgtctccatgaataaactatttactctatgtatgtatgtatatatgtagaggttgcactacatattttttttatatacgttcacagggcataagagagatcatacaggtctagttttggggccgatgtcgccattgatgaaggtagcactcacggtggcgccgaaaatcccaaatccgagggtgcggagccctggcaccatataaagtccaaaatgcagcctaaatcacatccctttatcaattgaaaaagcatactaccctcatttcaaaatatatgataccattggcttttcgcatatcgtgtgataattcgttttattaaaagaactagtataaatatattaaaaaattagtataaatatgtaaaagtgtaagttaatattatagttctttgatgataaaacatatcacaatagaataaataaatttatataattttttaaataagataaatagttaaatattatataaaaattaacggtatcatatattttaaaatagaagagtaaggccaagtagaaattatcgaatactctagcagagaaaatcaaggcagggcgggcgtggccacctctgtacgtctcgccaaaggtgatgatgccgtcgtggtcgctgtcgaagaacgccacgtgcttctgtagctccgttgccggggcgtcgccgcccaccgccgccggctggctcccttcctcgatcgtaaacataattggaaacgaaacgcgcgtgccagaggatgactagtactcccttcatctctaaatatttaacgccattgatttaaacacatttgactatttatcttatttaaaaaatttaaataattattaatttttttctaccatttaattcatggttaaatatacttttatatatacatatatttttacatatttcacaaaattttttaaaataagacgaacagttaaacatgtttaaaaaaatcaacggcgtcaaaatttagcgaaagggggagtattaattacaggggccttacgtacagaagcatgcggcggacaggaggaggagaggcacggccgcgaccgccgccatatcgttgtcgccggccagggacgacagccgccgtcgtcgagcctccgctgccgtttccggctgttccgagccacctctgcttcttgatccctcgcttacccgctgaaggctgtatatgtgctcctctccctctggcgccacgtgcttcgcgtgtttctacgatcggctaaaattttccatgcaaacctatcgcttgcaggcgatactcacccaaatagtcaaatactcagcatctataataatggtgccacaaatctaagctccacacagtcggattttagttcgcatgattaaaataacattagtaagttacggttataatcaaaggcaacacaaatcattaatatgctaaggtgaactttaaaaataaaagcaatctggttaaaatacacaacataaattaacttttatctagaaaaactatcaacgaatatttacaataaaaatatataaaagttattgtgtaattataaactaattacacatgtaactatagtgtaatttgtagttacatatataattactgtataaataatgtagttacattcactgactagcacgtgtcatgtagagaaaaaggactcgccaccttgggaacaagttgttcgatcggcttgtctagatgcactttgaagcttgcacgaatagtgaagaagattagatggcagacaaagttactttatttagccgaaaaatatgtcgacccgaagttatatgtgaaatatattctgatttttaagatctattttatacaaaatgggaaagtatttctcatgtttttttcatgtcacctagatagtaaaaaaaatacaagatatattactatgagatatataacttcacaaatatgtaagttgaaattcaacttctacaaattttagtaaaaataaaaaatacagctgtgaatccttgtccatacgaaatagaatatatgcatgaaattagagaggttgtgagtttaatccctaggtcctggcgcacttgtaaatttttttcctcctccacttgtaaatttttttcctcctccaccagcacgaatcatgaggcgatctgacagctacaaattcgaaaattttatggtagaaaatctatcgcaagtttttttagcagttatgttactatttgcgtgtaggggtgaaaacgggtcgggttcggtcggatctcatcctttccgtatcctaacccacattttaaaatagggatcgggtcgggcacggatattatcggatacgaatacaagcacggataatgtcgggattaaatacggaacgaatacgtaccaagtcagatacgaacactatcggttacgaatccttattcggatatcaaatcaaagcaataaccatatataccacataggcaatagtcgttcaatcattccatatacgtataatatgaatatatattagagacttagggaatggtaatacctatcagcacaacagatccaaagtaggcgtacagactcaaatactcaatggtgtagaccatagttcacggttcagcattttgctttacgttgttgctcctccacacttgtaactttgtccttgacacagatactagtgtttgcattaccactagccattctatcctaatcctacagccaaacagtaaaagtaaaataaaacactgaacttcaagtcgtaaggtgatgttgataaagcaataaaacactgaacttttgctcacctggatgacctgctgagaggtgactaccggaagagatggtcggcgcctcggcggtggtaggcggggccttgcgacggtggtcggcggcggtcaacagcggccagcggccagcgggcgcgggcgcgcagcagcgtagccactagcagctagcacagcgcctagcggctagcatgcacgacgccggcggcggcgccggctgtgcgcctgtgcctcagtgccagtggttggttgctcgcgtgcggcatgcggcgccctcaggctgatgcctgctcgtctccctggtggttgtagcagttcgggtcatatacgggtagttaactgggtaatacccgcataatttaccggatacagatactgtcctcccgaacccgatctcgtatccgctagaaaaaattcgtatttgaatccgatatccgtgaaagtactcgggtacccgaatttttgacccgaatttatcccagattaatacgggcgggcggcggacgggaaatacccgccccgttttcacccctatttgcgtgtgagaaataagaaatatttcccactaaagcagtgctctccactgaccacgtagcagcaatcttaactactaattgattcattgatttatgagtcctactatcagtaaaaaaagatcattctattatcgatagttaattatatatggtagtgtatattatagttaaccattgattcatcgatttatgagccctacaatcagtaaaaaaaagtcattctattatcactatttaattaattaatatggtagtattacttatgtggtattcttttctcccgtagatgaagattaagtggtttacgcaaagtgaggtggtattaacgtatgattaattgagttttaattattacaaacttaaaaaatagatttatctgatattttagaacaactttcatatagaaagtttttgcacgaaacgcgatgtttagtggtttgaaaagcatgacacaagtatctaaattttcatccatttctcatcgtaaaaactactcataaggagcatcgtaaaaactacatctttccactatgcagaggggatgaaattttggatactcgtggcacgcttttcaaactgctaaatgatgtgtttcgtacgaaaactttctatatgaaagttgcactaaaatatcgtattaatctattttttaaatttgtaataattaaaactcaatcaatcatacgttaatgccatctcgttttacgtaaaaaacttaatcttcatcttcggctgtgtttagttcacaccaaaattgaaagtttggttgaaattgaaacgatgtgatggaaaagttaaaagtttgtgtgtgtcggaaagttttgatgtgatgaaaaagttgaaagtttgaaaaataactttggaactaaacacggcgttcttcttcatcttcagaaaaaaagaacaccaaacattaataggtggattgaatcgagaggccgtttgtggattgaaatcattatactagtgcttgatctcccagtcagggagaaacaacaaacggcttaatccaaagcccagactgttcgtgtgaggaagccagaaaaggccatcaccgttactgaaacgttgttcttatatgccactgcttttccgccatttggcgaacggtttcaacgtttctgcccttacgcaaatgcaagccactttggaacatttcctgggtaaatatatatggaccattcattttagggatgccttgacatgttctatcaatttagtacatttttccttccaaaatcccaatcatgcttggtttgcagagggacccttcttcttcgacgccactttactgaagaagctcccatcgtagacagttctgacagtgtccttgcgaaggaaaccatccttgtccttcccgagcttgaacgtcgtctcccactccgtcgatgctccgaccctgcattttctcgtggtacaaaagtagtgcaagcgaatacagtgagcagaccatttgaacagatatacatgcatatggtttctgaagctatcagctagcaagagattaccatcctttgtagtccttgggttctctgtttgcacgaagcatctcgtccagttcggctgctgtcaggccatcgggtacagtttttgcatgcttggtaaatatctcatcgaacttttcattgacaaacctgcagcagagttgaatatactactagcatatcaaaaagatgattgtgaattatatgtgtggaagaacgtaaaagaataatctatgttgcaaacagttcagacaatccaaggcaatttgctgaactcgcttgtatcattactgtttggagagtctacgaaatgactaccttccttctgaatcgaatgcgccagtatcacttccatggacccctttgtggatgttctctatatagatagaaaaccgtgatgctgttgcattttcctgcgtgcatttggaaatttggaaaaagcacaaactgtcagtttttttctttatatcacgcataaccaggggaattatgcgccaaacgaaacatatataaagatgtgacagatcatacaggtctggtcttggtaccgagggcgccattgattacggtcgcgctgaatctggaggtaacaactccaaatccgagcgcacggaaccctgcaggcaccattaaaaaaaatatcaaaatgcagtcttagatctcccttgaattgaaacaacatattaaaagaaattatgctgtaacaatttaagggagatataaggctgcgtttgacatttagcaagcagaaaacggaggataggacaggcatggccacccaccttcgtacgtctcggagaaggagatgatgccgtcgtggttgctgtcgaagaacgccacgtgcttctgcagttccgtcgcagcgccaaccgccgccgccgccgccgggctccctttcctcggatcgatcgcaaattcgtaatggaaaacgtagcgatcgagtaagcaaattaacgagacacgagaccaacaaatcagacgcgcacgcacgcgcgcgtgccacagaggatattgtgtgttacagggcgtttacaggaggacgacgaggcgaacaggacgagagccatggccgcagccgtcgccggagacgaccatcgtcgacgaacctccatttgttgttgggtcactcgcctctggtgctgcgtgcgcgcgcctcgtttgtactctccgacgatcggcaaaaatttcctatgcaaagctttggtcgattcgtttgcgggccaaataaactcgcccaaatacaacctataattagccaattccgtctccaacagcctatctatgagtctatctatctatacatctacttagctagtatatatctatctttaattttggcgtctagtatttacattgattgctttgtgtataatcgtgtatgaaatatatttctattttaaaatatgttttgtatttaaaagataaactatatgaaattagaaactaaaagatatatatcaaaactaatttatagaaaaatatgcattaaatctaattattccttatctcaattgggtatgaaactccacaaaattaggtgtaactagtaatatatgcccgtgtattgcaatggttctatatggttagagtaagtttcacaagtttatatatgagatgcgagcatgtggtgggaggagagaataaaagtaggacggctcttcttcttttataccgttgtaaaataaagataatccgctaacttgcttctttgtcatttctagtttagtgagcccaacctaatttactactagtagtattttgcaggaaaaaaaagtctattttgtctctcatttgtatgaggcagaaacttgtcccacgtatggttcaaaggccgagccccacccttgtaataatgtctcttgcctctgtttaaatcgcttcccttaacctaaaaaccaggcataacgtttctcccatctttaaaaccactgtaaatcgactcattcgtggtttcaaaagcggttttattgtggtgcttgtaggacccacatgtcaataaaaattaaaaaaataatcacacatgtcaatcatccttattgcctttttctttttcatctctactcccctatctctttccgttctctctctccagttggcggcagcgacatgccaagtccttggggcccacaccctatagccggccgacaagcttctcccctgcgcaccacccatcttgccaccgccttcaacggctcttggcgatgatgccatatagacaagcccagcagcagagagggacgtcacgacggcaaccgcgtcatctcgtccatcagtccctgccctgcacttcgtcacactcgcatggcttcgcgtccttctccctggaagccgtcggcatctttgcatcgcatcttcctcttccatctcctgactcctttttttccccgtgcatcgccaccacccccggtgatgctagcctttgctgccgcctggagagagagaacggcagagagaggggtgaggtgaggaaatagaaaaggagattaggataatatgtggggcagtaaatttttttttactgatatgtgggtatcacgagcgccacgtaagatagaactgatcctgaaaccataaggagtctatttacaccggttttcaagagatgtatggttgaggaagtcgattcaaccaggtctaagagttgagacggaaaatagaccaattcctttacgggctaaacttagcccaaacagagcaaattcctacccatgaagcccatctgtagaaacagaaggatccagtgcaggccaactccacagccgccagcccaacaagcgctaatggttcacggaccaactcgacgccaggtcggtctcggtccagccggcgtgcctccctcgtgctcgcgcctgctgcacacttgctcactgcaccaaccgcgccgccgtcgggctcgggccgccaacccgcccgtcgtacgctgcgactccgtgacttgatcgtgtcaagttgccacttggcccccccggtccggtcgagctgcccccgcttgaacgagcccgtccgttcgctcggccggaccggagacgattcttcgctgtttctgcccgtaattttgacaaattgaccctctgagaaaacttattttaaaaataaaccataccaaaaacttattgcaaaaataggccgtcgtctcagcgccaaacttattggcgctgaggtataatgccttagcgccatgtatattagcgctgacatttcatctgagatggtaaaaaaatttgccaagtcactggggttagtggcatagcttacggcgctgagctattgacgttgaaaatgatcttctggactttttggtttgcatgttctcgtgtagtgtggtggcaggagactttgcctctcatctcattaaccacggttcaatccctatgttttacatcctttggatgttttttttatttttatagcatattttttattagtcttataaattaggaacaactaaatttgagaacataaattttatagcattaatacttatattcataaaattttgaaagtacgcagcatttaacatttcatatgttttatgtttaaaacaagatcattacacataaatgtaagaaatgtaattttaaaataaaaaattaggaggtaagtgttaacataaattacatagtatttatttttatagttatgagtcaaaagaaccataatagggtg

SEQ ID NO: 68050 - DNA, 10111 bp, Oryza sativa
ataacgctgagccgccggcctatttttgcaataagtttttgacacggcttattcttgaaataagttttctaaaaaagtcaatttgtcaaaattagtgtgtttctgcggcgtgaactgcaactactatacggcgagcgtcgttccatgcaaacatggcacacgcagctcacgaacagttaagaaaccaggcggaagtgagagttaccagcattaacgcctccttcatcaaaaagagaaaagaaaaaaagaagcaccaaaaaataaaatctttgtctagtggttttgtcttcgttgacatgtcacagcgtcggtgacgcaagtttatcgtcgtctccctctcacatacttacgtctctacacggtaaaaagcggattccacttccaccgcgaggaaggaaataaagcacacaccgaatcaccggcaccaaaatttccaccgatggttacaagcccgaaacgacagattaattaacacgattagttaaactttcacgcccggtgtggaggggtccaaacaaaacagagggcgccaagttgtttttatcatctactagtcctacttggctcgcgtaagcgagagccgggacttgtcactagtttatctcgcagcacctaacgccttgacagcgaggtcgcgttgcatacgtggaccagagcaacacaaggtgcccagattgattaatcatctcgtctcatctctttctaagcactgtattatgattatgattatgattattattattattgccccgtcaccgtgccgaccagccccaataattttacggccccagacaaatcttattgccctccctaagtcaagtcagtctacgcattaatccgagccgatcggggtcgccgtcgggcatgtcgccgtcgatcggcagtgcggcgaggcagcaaggcaccggttggcttttcttcttgttttttttttttttactcattggagcagagaaaatacaggggtgcacatggccccatccgttcttatctgcaggccacgcttttgaaaaatcgggggagcctagtgacagcccatagggcgcggcccgtggggcccagatgcagtcgccgtcgagggaaatttcggttttttggcagggcccggttgttccagatgagatcctccccgtagtaattaattggttattactgctccagaaagggagaagtgtgcggtgtcatctctctttcccctctgaaaatgctgtttaatttgaaaacgatgcgtttaaagtttgtgtatcaagatgtgagattgagagtgagagttcggtccactacgtgtcgtgatcttgcacacttgtttcaatcgagcaatgtagtagagagggatacttcttctgcaaagcgaaggaatctcatttaatttccagccacgggtaagaaccaagataatcgcggtacacacgctgagataaggaagagcgtgtccacatgtagctgtcgatgagcttaccagcaggtttatgagctgtctggtgtcagtagggtgagtaattgcttgattttctttttgctgaacacttcaattaccatcaatcagctcattaattgtaccgacacgaaatggcactggtaattactgcggttcattttgacactttttgttgcttcaaaggaagaatctcgaattgctttcgcaatgtggtgttttaaattaattggcttgttccagcttcgatctttttttacaagatgccgaatcttcaaactttctaaaattctcgcgccgttatttcgccgcgacgtacgtatacacgacgacgacccctgcaaccccaaatgaagagtcgtcgtcgtcggcgtgctccgatctccgcgcggggcattcgtccgccgtcgtctcgctctccggtgagggcggccaaaatatatggtgctcgatcgagatgtgatcgagcccggccggcctgccgcttcaccgggagagcgaacacgacgccggcgacttcgcgccgccgcccgtgctgtgctcgtagcccgcccgtttcccttctcgcgcgactcagctcgctttgattttggttgggtttacagcgcagactgcagcttgttggtggcgtgccgggagacgagccgctcgagcgcctcacgcatccaaccgtgctggcatccatccatcgcctgctgcaccgtggcctgcacaaaatcgaatcggcatttagacgcccgtgttcgttctttggtcgatcgaattcgatcgttctcgccgtagaatggcgaatttccgtgtatcaaagtgcgatgggggggtcatgtactactactactcacccaggtgcgcttgcgggaggacatctcgggccactggaggagctcgtcggtgacgcggagagggaacatgaagccctcgtaggtggtgtcgtagcggcggctcttgtagtaccagcagccgagggacgtctcggtgtcgccgcggacgccggcctcctcgagcgcctcgcggcgggcggcctcgtccatggactcgtcgagctcccacccgcccttggggaacatcatgccgtgccccttctgcgacgtgatcaccagcacctccatctcgccgccgctgcgcacccggtacgggatgcaacccaccacgatgcggcccccggcgctcgtgtaccgctgcagctcccgcccctgcctcgccaccagcacggccatcgaatctttgattgttggagagagagagtagggttgtcgttagggttagaattggtgatgcgagaggatggtgctttgcggccatggaggtggagctcgcgggtattagtagcgggaagcgcgtcaggtcaatggaacgctgtcgctgtcgcggccgaatgagcgatggggtaacatggggtatggagcatggacgagcccaactggtgcaaggttggtggacgcagcgtactgatcttctgtggctcagcttaagttcgaggagccagattccgcttggcctcatcatggcctggtcctagagtacctgtttctctttttccttataaaaaaccgggataacatctactctaagaagaccctgtttagttcccacacataaactttttatcatatcacatcgaatgtttggatacatatatagagtattaaatatagacaaaaaaagttaattacacatattgcgtgtaaattgctagacgaatcttttaagcctcatttcttcatgatttgacaatgtgttgctacattaaacatttgataatgatggattaattaggcttaataaatttgtctcgcagtttatacgcggaatatgtaatttgttttattattagtctacgttttatacttcaaatgtgtgtccatatatccgatatgacacgctaaaacttttcacccctgcaactaaaaagagcctaacatagagataacctggtctttcttgtgcgtcttgtgcagataagtaaagaaggaagaatgtgtaaaattcttctgggactgattggtttcctactatttttcttgaccactttagtgtatgtctttattaaagctaaaaaaagatgatgatttctttgcaactctaggtatttgatgttataggtcttgtggttaaccatagatgtaatttattagcatgaatgcaaattaagtggtgtatttcaccttatgtccgttgtccaagagaatattcagaattaagtggtccttctcatgaaacatgtcatgaggagactccctatcctaaaacagatcaaatcctgcgtataaatttaggccgagtttagttctaaagattttttttttaaacttccaacttttctatcacatcaaaacttttctacacacacaaacttccaacttttccatcacatcattttaattaaccaaacttttaattttagcgtgaactaaatacaccctaatacatatggttcttcatattcgtagtcagaatttatttttttatggaaagtaggaagtacctacacgtacatttcagacatcattgctatgtacttctcctgtgcatatctagaatcgattatatttgtggatagatgtaatactatatacacgtgtgaatgggtttagtgataaagcgtgtagcctgatcagcgggtatgcatgtgtccaaataaaagaatattcagatttgttttcaagctaatatatctctaagacattggtcatttgtaatccctttcattttgggtacaccaaatgaaggagtactccttttctttcttttatttttttattatagcacatttaacttagctattgtaatcactaaatcaaatgtcatcaacttttgttagatgattgattaagaccctcctcttatccttttccttttaataaaagggagtaccgttcattagaaacttccacaagaaatttgcaccccggttgcatcagctgtactgaaaagagtatatgtacaaagagtaaagtactatcagtaacttgcaagtaatgaatttttaccatagttttcaactttggaggctaaagttttaaagtaagcactagatgaatccttgcttccacatgtactggaccacaatgtgaaggataagaccacccagagaacaataaataggttctttggattaaattcgtcagatttagctatcaagatagactgttccatggaaaacaatttcatatccagaagatatcaacgtggcaacaatgttctttattctacgtttctactccctacatcccataatataagagataatggatggatgtaacatattctagtacaataaatctagacagacggtttgttcagactcattgtactagaatgtgttacatacacccattatcccttgtataataggacggagggagtatgttattgagaatccgtttgttgatcgtgtatatgtctatgttatttcatattgtagaaaggaaaatatatttgaacttgaaacaatagaaatataacgttgaagtgacaacgaatttttttaggagaaatatttctttttgaaaaaaaaacagaagtatatttaactctgtatgttaaaaaagaataaattaaatgaccacttatgacaaaacaagatatatgcaacgaggtgtctattattctaacgctacgtttcacagtattttttactgcatgctcaacacatcagattagcagatccacccatagtaaatgtaaggatatgagactgcatatatacttagtcacatcaagaaaatcgtagtgctctctgttaagcatggtcgacaacaaataaacatactacaactatctctctcctcaatctctcatttttcatgtaagtgaaaattcaacttggataaaattttactacttacatacggctgatacaccaattgtacatacccttaattaatactctcccgttcctaaccgcttttataaaatggccagcaaacttacttcaaagaatagtcaataaccatacccggttgtgaattggctgctaataaagtaaccttttcttaaactaaagaaaccctactggaacatgcacccttcctactactacttcctactccttccattttatattccattttatattacaagtcatttgatttttttccttaactaaatttttttaaatttaatcaaattgatagaataatatgctagtattttcaatacaaaataaacatattatcaaaatatattaatgttaaatttagtgaaactaatttgatgttgtagatgttgctatttttttctataaacttgatcaaatagcacggtacaaacgtatatgtccacgtgtaccctcacctactgtgaacacatatgtacactatgtgtatatctgtatgataatttccaaaaggctaggccgaaataaaggaagtacttcctactcaagtagaaagtggagtgccctgtccatggactgcgtccacgcaagtaggccggggaaacggcgtccgtgttgccgatcgagagcccgagaggtggagatgaagcggacaaagcgcgtacctacgggctacggctgagtggccgcgcccgctcccgcgcttcgcagtcgcttctctcgttttcatctgaacccatggatggattggcctatctcctcctccctctccggccagtcacctgcgcgtccctagtgtacacatccatcgctataagttttagccgaaaatcccgtcgatggccaagtccatcttcttctccatcaatttaattcccgcgcttaattaattaccccagcttgctctagctagcaccttgttttatcgtatccgactatccgtcggtgtcgccactgacgtcgctacgttgtctccctcctcccgttgagttaaattaattgcttctttttgttttgtgcctcgatcgacgaagtaaaccaatctgagctattgtgatcgtagtacaagttgcgtgacagggctgttttgcggcgacgttcacacacgcacactgcgtcgtcgtgcccgtctctgcctctcctcctcgtccttttcttgttttttttttcccttttttgaatcagtggccatctttgatctcttccattatggaaggcgacgacgacgtggtttaaatacggttcgttctcttgttaacaatctggacaaacgtacatacatacgagtaaagtacgtagcaatggcgcaagaaatacatggcgaccgatcgtatcacgctaatttggccacatgagaaacgccgtacatatatactgtaaatcgccacgtttccaggagaatgtgaaaattacgtgcgtacccgtgtgttttcacacggatataccggtgcgacggtctaattctgctgctttggatattttgttattagtgattattacaccatcgtcatccacgatcccgtcggtcctgccattgtcgccgacgcgaaattaagaagcagcaacgacgacgacagaaggggccgggccggggttaagctttccggctatgttgcaaccaggttttgttaaaggcgaataaaaggtagtattatttctagctctggttggcggacagtgtgagtcgccaggactaccaaccaacctacggttagttgtagttggttcttccaaccgatatcgtcaccatcccgcggcgtggtgattcgcacggaagtttcacccaatcatgctgcccatactgcgcaagatggacgtacggatacttgtcccgccgaaaagtcgaaaaatgcaactatagtttgatgcatcgaatcaggaaaacaacttggtttctgtaccgatcaattcaggtttctttttacgaaatcggatctgactctatgtcagcacgtactactattcctacgtgcaatgaacccacttacttttcgtcgaacaggccagttttattttttttttcctgtagtgacaggtagcacgtttgctcgctgttcgggaccaatccggtcacaccgccacggccgtgtccagccgctgtaacccaacgccgcgaccgagcttgacgcccccgcggcccgcgcgcgcgctcaccaaccgatacaaatcgctcgccaccgcgccgccgaggggagcgtggtggtgaccaccgcgccgaaccgccgagctcgacaggccatggccccgcgcgccgtcccgccgcgcgcgcgcgtcagtccagcgatgcgtgcggtgcgcatctgccgtgccgcgcacttgcctcgtgcactgtctccaccaacatgggcacacgcattgatggctcgcgcgtggccgtgccgccttgcctgtttgcgcggtggctgccatatctccgttttgtttttttcttggccccgcgctcgctcgctgcgctgcgctgctccggcctgtttggtcgaataacgcctcgagaacgtcctcatcgtcgggcgatcgatcggtttgatgatcaggtttcgtcggtttgcgactcgcgagcggtcgatcgaccgaatgcgatttcgtgatggcgacagaggtgggtcgtcgtgtcgctactaatcgggtggttggggcgtcgatgccggccgtgtgtatgcagttgcggcgagcatgcctgcatgtgtgtacgtttatgtctatcttgctggggataatgttattatgggttcagatcgaccatactggttgttagctagtatgggtgcaagcttaatttgcagctgatgcaactgcattttgatatggcacaaactgtgttcatttcgtgggcagcgttcagacttcagacgtgcatggaggcatggagagccaatcgatcgatcaagtgcatgcatgcagcatgcctcaaagtcttccatggagcaattcatgtgcagccttaagcccttaagtcgttcactggtccatcacctgcatgctgacgtgaaacgcattgctccaaaataattttgttgccatgcgcatttttatcgccctcttttcgtttctctctgttttccggaagtttcatcgtcaagaacattctccggacggtttggtgaagtttggtctcagttccatgctgaatcttctttactgatcggtcctacttagtactgaaattgtactgctccatcagtgtagttggtcaggatgcttaaagtgctcaactttcctgcgtttgaatctatgttacgactacgaaatgactacatagcgaatcagaatttcgcaaatttgatgcgtgtttgtcagttaaaatcaatggcgtcttctacgtgaaactgaaagctttagtttcacgcgtctctgtccagttagaatctcagccaacccgtcgttcagttagatgccaccaaaaatgcctttctttcaaactagtttatgcagataatcgtccattatttgtacgaatttatgatcctcaataatgcatcaaccgtcagcccgtattagtgagattcggtcagaccatcgactaaagaaattttctaatcgatgatagatgccctcgaatatttctgctgcaatgcatgttccatgcatattatgaacaactaagtgcttaattaatctctacatcaaattccccctgtatgattaaattgaacagtgacaccatgcttactaatatcttaatcagcaggtcgatttaaagtgcacgtgagctacgaaattatcatgtaatttggcataaaaccacttgaactgcagcagagaagctctgtaagtctgcatatggtcaatagtttcttgcctgcttctgatcagaaacctgctacctctagctcgtgattttctaagaaactgcagcatatattagcctaacaaacactaattaatggagaatcaaggagtatagtgtacactaattaatcaaagtcgatggagttgtttggcgacgaaacagaatcaatagataaataatcgacgacaggacgtgatttactattcggtcgatcaaccgatggagcaatatatatttttgacaaatttggttgattgcatccgcggtcgacgtggacatgtgcaattaatattgtaagatccggggagtaacatgcactgccgatcgtcgactgaccgattggccggtttgtcaaatgatttgcttgggggtctcaagatagtcagacaccgatctgatatcttaactgagcatgtgtattacttggaaggtgaggcttgattattcttctctgacgacttcagagtccggtagaatgtgtatcatatagttaagaggagtaccctgcagaaaaaagtatagttaaggggagtaagtacgcaatgcatgtgatggatcatgcttgatgatatatatataaacactaatcaaatcatatatcgttttgactagcctcacctgacgtttagctcttcgaatatttcagcattgctgattatttcaacattgctaaatctaaaccactgattcgagttaaagtactatctcaatctcaaaatatattaatatattaacttgtactctattatatttaaaatataatcatttttagagttagacagatgtactacgaaaatagctataattaaatagaagattgttgtgaatgagaaaagagaatagacggaggattaaacatgggagatattgtgattagtttagataagaaggtatatggagaaataactatagttcaagacataattgggacactatcgataactatattttagaatgtagggagtagcattcgaaattatcctataatatagtactccacctactctatcatctcttttcttaagaccctactctattatctcaatca

SEQ ID NO: 68051 - DNA, 7097 bp, Oryza sativa
  unsure (1)..(7097): unsure at all n locations
cgctgcnngggttgacgatcgatggancanncancagnatggtagttaaaaacgaccncccacaccgnaagaaagaagaaaacaggnggccagagcggaggcccaccatcccttttatccaatataacagcttattttcatagtagatggaatgggcagtcaaagcgctattgaatcttaattacacaatgttcctcataagtgattctgtagaaactaaaaaacacaaactctggaatgcacatacagtcttcactggaacataccataattagagggttagagggctccatttacctcaggatctgttgattcaatgatgtcaaatatgggatggcctagtggaataatgtcggggaaaaacatccaagggcgtttttgagttatagtcagcatcagctccaatggaatctccataatcacctgataaagtgaaatgaatttttatatatatgccaagaagattatgcataagtgtgtgattaaacttaactagttcttaaaaagtagtgaacacacgagcaagctgcctcatgatttctgaaatagaacagttctatgtggtatattaaagtgaagcactagcaagctttagttgcatccagaaactgaatgtgagcagtccttacaccatatttgattatttgcatagcattataaaaggcagcagaagatatgtaagcgtaaagtacctaacaaattcaaagattgacttcatttcgtactattcagtagaattcatatttgttctgatagtaggacatacatacgctaaccaactagcagtaaatggtaaagtaacaaccacagaatgtagaccatatatatgtactggagtggagtgagtactggctgtggctggctctacattgtacttgtacatgctatttgtaatgcccctttgtaagtatagtacttatgtccaattgcagtgaattggaaagataatgatgggatagttaaagaaaggctcactctagctctgcggagtgggtcgacgtcccgggaggcatagacggccatcccatcggggccttccaagaactcaaccccgtacgcccgcatcatccgcgcgtaccctatccggtagaagtcggggtcggccggctccatctgcacacgacgacattgttcatcatgcatgcatgcgcgcgagcagaagagatgtgagcaacggaagcaactaggcgggaagagattgagcacctcgggcgggaaggggtcgtcctcctggggcggttcgaggagcctgagcgggggggcatcgtcgtcctcttcctcctcgccgacctcctccgccgccggtgggggtgccgcgggaggcgggtcccggaggcgagggcgtccggcgcggggaggccgcaagacgaggcggcgggcgcagggaacggcgcggcgaggcgggaaggtggaggccgggagggggagggggagcggcatcaggagaggggaagcggcgggagtctccatgggtggcgatggggataggaagcgcacctcctgcgatggaagaatacgttatctactgctgcgatggacgagacgagattttagcccattcaaatgaatggcccatgggccttaaaatctataacctcgcgaggaataagtgtatattagctcccttatcgttcgctcctaattgaatcacctccctcaaccacacaacctggtatagcgcatctcccatcttcaaaaactgatacaaattaactcctttatggtttggaaaacggttttctctaacgtggtaggttgaccgtacttgactcgttgagttagcaggtagaactcacatgtcagcaacttcctcctcatcttgttttcttcctcaccttccctctatctctctttcctctcttgtgggcctcgttgggtggcgacaacagagtgagtgacagcggtggagagtcgaacccgaggagagcggcagtggtgacgactgaccagccgaagccctactctcctctagtgaccacagcaaaggccagccaagggcctcatatattatctgtcttgactgtaaggaatacatcgatgagattctcggagatagttttttcttctatattttaatataaaggttctaatatatccagcagagctcctgccgttcaatgtttttaaaaattaatatcagggttgacccattcattcgtaaaaagattcagagtttacaagatcctttatacaaccagggatacattgttagtaaaccaagtgaacagcaagctagcttgttctagctaacatatgaaccacctcatcagctctgcggcttatggcttacgcttacatgaacaaaagaaacttaagtaaaacatcttgccaatgatttcatctcagcagcaataaagcccgttaaggacctatctctggcaacaacattcaactttgaggcaggggagggaatcaattaatcttgtttcataccaatattatctatctatctatttttatctttttagaaatctatctatctatctatgtgcgcgcgcgttttgtgctcagaaggtgatggcagatctgttctaatcgagaaaaccatgtggaacatatattaagatcatgtggagaagaaaaaagaaagagagaacaataaaggattctattatctagtcatatactcatatatgaagaaattaagatttttaatattattataacattattccaaaaaaaatattcttatatcagtgtccatacgatggtaaatatagatattatatggcacctaaaaacaatagatgcactacatatatataatttgttgtttttgtgtatttagaccgggaatacgtttactgaaagagagagatacatgaaaacatatgcacattgtattgttgtctgaaaaaattgtcactgctacactatccgttataagacaattagaaatatttcactcttttttaatatatttgctccagctatatacattatattttcttgattatatctcctattccatgatttttaaaacatacgtcttctatgatgatatgattaatttgtatgggattcatagtgaatattcatgtggaaagaatcattcctgatcgggcctaactgtggtggaaatgattatacgactttcatgatgtgcgctagccatcatgagcacgcccatgttctattttcattgagctactattcattttccattcagtgtacatgtgcatagaaatgtcgttaaatttcagacaatttcctccaaaaaccatgtagaaactcatcaatcatgatttgttttcttaaaagaaaaactcagcgttgctgaaaacggtttaacttaggagtgttatacttatacctataaaaacacaaagaataatacatacctgaaaaaaatgaaacattacttgggcagcgttcgtttggaggacattgagggagaaagcatctcattttccacacgcacgtttcccaaactactaaacggtgtgtgttttttgtaaaaaatttctatagaaaagttgctttaaaaaatcatattaatctatttttaaaatttaaaataattaatactcaattaatcatgagctaatggctcacctcgttttgcgtatcttctcaatctactcaatccacttcttctcaaacacacccttgagcaagttttgtgggagagtttgatatgcttttttaaaaaaaagaaagatcagagactgataatcgatcccacagtccactgacgcgtggcccccaccccgaaagcgccggcccacagctcagccccgggcccagcacggtgcgcctcgtcgaactccccaccgtgctctgctgacgccctgggactcctctcacctactactacctgacctatatgtacccaccccactcacagttggccccactcaacctgcacccaccacgtcagtgactcactacccgtcgcgcgaggcccaggtggtctcgcctcccgaaccacgtacgcacacattcaaaaaaaggcaaaagaaaaaaataaataaaaaacgaagagaaaaaaacacatctcccaccgcaccgcgacgcaggcgcagacgcctgcttctcttctctcctctcctttcacgcacacagcacagcacactcatattctcttcctcccgatcgctaccacctcctatgcagctcacacccaacccccacgcaaatctagaaccttgtggattgcgcccttgctcgatacgatcgccctacccgtcagccgtccgatcggatccccaaagtgaagctcctccctcctacccattgcgttcagatagctccatgtttggcatccgtttggacccatgcgcgtgctccattgaatctgagctcttcgcctgatgctgtttagggtttccggtttgccgcccccgcgatttagatggtttacgatggcgccgtgaaggaccaggagagctcggctaacccggcgtcggcatcggctgctctgtcggaggcatcggcggcggcgtcggaggtaacagcggctgccgcggcgggggcgggggctggggcggcggaagaaggggctgctgttagtgggcgaccgccgaggcctccccacgacaagcggctcggcgtgcggcatcccttgaagcaccgcaggttccgcgccggggggaaggtgatggtggagcccggggatccgccgtccgcccaggaggtggcggatgaggaggccagcgaggtggagcaggaggcggcgccggtggagagggaaccaccacaggaggagggtggtgatgtagaggtgtcgtctgcaccggcagagatggaggtggtggagggggatgcaatggaggtgtcacctgagccagcagtggctgtgggggagtcggagttggaaggccgaccaggcgaggaggaggaggtgtcctcgcctgtggtttctcaaggggagaggaagcaggagactgctgctgctgctcctgtgccagcagtggaggagaagaaacacaaggatcaagagaataagcacaaagagagggaaagggagaaggagagagagagggtggatgaagtgggctacatgagtggtggatggaagaggtaatacttgcttctcttttccctattggagcttgcagataatcggttctgtaggcaggaattctcgtttatgcatttaattcaaatacaccatacagcttctgttctgatatcgttcatatcaagtggcgtaatagacgtacgttgagagcatgcttctgttctggtatcgttcatatcaagtggcgtaatagacgtacgttgatcatgcttctgttctggtgtcgttcatatcaagtggtgtaatagacgtacattgatcataaaatagacattgcatgcccaacatagctttgcgacagtaagcggatgtggctttttagtagatttgcaatgctccattataaccagaaatgtaatagtgattgacctatttagaattgtgcatttcagtggaccagaacctcaagctctatgatctcttagactagcatgtgtgttctaaacaaagtgtcttgtctgaaattgcatgcaagagtagcatgtgttatgattgtgctgaagaagcattttgatgtatttatgtagttccactatttggcagcatctttctggattttttatgaattactattcatggaatattgtaatgtcatcaggaacaaaagaaagaacatggttttaatgcgtacaaaagtaaatatgatagcacattaaaaaaaaattgcttacgtggcagtaatgtaaacattctaccatgctactttagctaaaatgttcataccgagttctggcaagctataataacaggcgcaataacatatgataccggaacaaatttcttcacagaagggtgctttcaatgctaaaatgtttgttgttatcataacttagatcttcatgtgatatctggtcataatatcaacacatcagatcattaagtaggccacttcattattacattcattaatcaaactaagctaacttctcctagaattttttttatgtgtgcctctctttgttatgctccatcacatttgccaaataatgaatattttgcacttcgtatctatttttgtatttattagtatctttggtgatagaaaattagacatcaatccattctgctttgctaatgggtaactttgagtttggtgcttgaaatgtagtctggtggtttaatggctggtccattattggagatgaagcaactcaggaatagaatattttcactttcttgtttgatacagatagattatatagtttagatggagtgaaataaactttaaatggttttatggtagtagcgttatctagccaggttttgcaggcagaaaatcctttcttggtacttgctgattgacgtgataaaaattgaatgggatttctcacgctcaagtaactgttcggaccctcagcccccatattattgaaatccaactgattcaaatacctgtaactaatttctattgacatatggcttctttttcttcatgccagtagattgttatttgtagaagaataactgaataggcactgtccttttatcagaatgtaaagttaattttaccattatattacatgaatatcataagcattttcatctatttctttcttaacattaggccttgttatttgactgatttgcagtgaggatggatttctgagttgtggatattcgagttttagaggaaaaagagcaagcatggaagacttctatgatataaaatcatctaaaattgatgataaacaaataagcctctttggaatatttgatggttggaaaattttccttcagacctctttgtgtctatcagntggtctattttaaacgtttcttttcttgtgcaagtcatggtggttcacgtgctgctgagtatttgaaggagcactttgtttgagacctcattgaacatccagagntcatgacaaataccaaattagcaataagtatgatatttgttcctagctgtaccactaacctcttcaaaaatcctgtggatattcttgtgatggagtaaactgatcaatggtattccacacgccgaacatataaaaaacctgttcaaagtttttgtatctgaagcccactcatgagatgatgatccaccgcttgacaagccgtttggttgaaa

SEQ ID NO: 68052 - DNA, 35976 bp, Oryza sativa
ctgggcaatttgataactgatttacaccagttcatcacaataagtatgatattgttcctagctgtaccactagcttcttcaagatcctgttgatatttcttgtgatggagtaaactgatcaatggtaatccacaggcgaaacatataaaaaaactgattcagagtttttggattctgaaagccacactcatagagatgatggatcaaccgcatcgacagcggttttggttggaaatcatctctatgtggcaaatgttggcgactctcgtgctgtaatatcaaaggctggcaaaggtgcttctgtttacaaaagatgttgttcatttatttaatactggatgcagttgttgcattctttgtggcggtgtacctgctgaattgttgttaaacatttcgtttccctcctatttatagctattgcactctctgaggatcacaagccaaatagaagcgatgagaggaagcgaattgagagtgctggtggggttgttatgtgggctggtaagtcctgcttccatcaacacctagagtacacacaatactacaatatctgtgttctaatctgagatggcatagatcgtgccctgttattttggagaagcactgacatacataggtggaggagacttgcaaattgcgactatcatcttgctgatgatggtaaatggacttttgcagaaacttgaagggtagtgggtgtacttgcaatgtctcgggcatttggcaaccgcttgttgaagcaatttgttgttgcagatcctgagattcaggtaacatgagcagcacatatatataaatatggcaacacattgatcctctgtggcttatactttactatgaagtgtgaactcttcaactattttatcaggaacaagaaatagatgatgaattggagtttctgattttagctagtgatgggctgtgggatgtggttccgaatgaggttagtttgctaatctatagcttccctagaggtgcagaaattcatttgtttgcattatatacatgaaatatactttattgggcttcaaagattggatttgtggcatgtgcaacatgtggcggcagtgaacagcattagggcgatgctctgatatactgtgattttgctgtccaactactgtgtgctactgctgtcccataaaattatggtcataacaatataaacaatgatgcatttgactaggtttatacttaattaagacattaaggtcctaattcaggagcacaacctactccttcacatctgagttgcttggtgcataaatttgttgtaacaccactatcatgttcgtgtcactatgaagcttgcattcatggaacttgcagcatctttactctgttatggaggtgcagtgtaacacatgattgtatcaacatacttttacagggcttggtatttatttttcataacacccttactgattgtactctcttggtcataaatagttgatgtttaggacaagattccgtcaaacttctaaagttccgacgggagtgaataacattattctcgtattgatttcttgctcatgtggcttctattttgtcttgaacatacacatcacatattgcatttatggaatgcggtttaacacatgacactgataataaccatttacacttatatagggcactcttactgactatagcgttatttctctgattggtgtcttgctcacatggctgcaatttttcttgaatatacacacatcatgtcataatggataatctaattatgctcccctcttgttcatagtgcattttaaaacatagttaattcggctcatcgtgtttctactatgttgatgcaggatgctgtttcactcgtgaagattgaggaggaacctgaggcagcagctcggaagctgacagagactgcattttcccgagggagtggtgacaatatcacatgcattgtcgtgaaatttcaacatgacaagatggacggtgattcctcaccaacaagcgataaaagctgattccatttgttgtttgttatacatgttgtcggtcgtttaacttcagctggattttcccggcttcatatggtccctacaatggcgtagctggtactaaagactcgcttcatgttcgcctgtctatatatccctaattttggtgcctctggtggtttacaagttggtattgctatctatacttctctttagtctgcaattttgtagatgttatagaatgaaatctttcctgggccgaatacatccaagccaatatgtgtgaagtccatggatgagcttgttgatcaagactgatcccaggccagtggagttgcattacatgagctcccaatgctgggctaccatctttctggcactggaggtttaaatgggctcatagtctgatccgtggcaatggcatggctcaaacttgaaatacatttatgtcatgtgcgcagaagcacagacaggattgccaaggctggcaagatctggagcagaagcagcactatagaacgtgaactacacatggttgctctattcccatgggccatggatcgaccatccagagaggaagatgattgatggtcctgctcctgctcctggccctatagttctacagagatgctgctttagccttgggggcaagtttacaagcttgagcaatgacatttccatttaattgtttgtgtggtacatccggcagagtaatagtttgagtgagaatggattcgattgcgttggtagctacggcgtgtccgtaccgtaaacaccgtaaggctgtgtgtactgtggatttggttccagtagtgccgttgggagatggagcccattggaccacctctacctgttccatccctactgtttgtacagtagaactacagaccagacaaggcattcgagtactcctttaagttgccagttctacactatttaagtactcctatgctctaaccagaaatactgcctattgaatgctgtattgtgctccaacaaatgcacaccgagaaggctatcacttgatactacacaggcaccaacctggattcagcttggtgctaggttgttctgaaaagaaaaaaaagcttggtggtaactggtaagcagccaggtattcttgtccagaattccatgcaaaatgagaacactaataactagcctatgttaaaagaagacacttgtggcttgttcactttgctttcattttcaaccatacaagttttgggcattgccaaattttagaaaggttgccaaattttagtaagatttcatatgtactcactaaaatttgacaacaaattaaatgtagtcatttatttttgggtaactttgccagaaaaaggtaatgttaaaaatggtagcaaagtgaaaagccgttagatgagaatgtgactccacctacttagtcctgaggccacgtggaatgtgagaacaaccacaattcttaccgaaattgagctgcctcatttgagactcctatggcatgccttgatggagcaatcgaaaagttgcacacgtgaagatttgctactccattaataaatcaggatatgctacttttgaagaattgaacatgttgcaaaaaaaaaagaaaaaaagataaatcctcaaataataaatactcgaggaaaatattgaccccaagtaacttgtcctcttgcactgcatatttgcatgccaccccagaaaggacgagagaggcagtgagccacagtgcaagaaaccaaaccataatactagctcgatccatgacaactacacataattgcggaccacattaactccactccacgcgtacatccagccacaacacgagggacaccaccttttcagtgtgaccgtgtccacttcacttcacttcgccgtgctcgccatcatcgccgctgttgctgctgctgctgcttcttgccaagaagcgatcgatggtggcgtcgctgcgcctctccctcaccgcggcggcggcggcggcgctggcggtggcggtggcgctgctgttgccaccgctggccgcggcgcagggggagacgacgtgcccggcggacgtgccgccgcgcggcgcgtggatgtccgtggcgagcttcggcggcgtcggcgacgggcgggcgctcaacacggcggcgttcgcgcgcgccgtggcgcgcatcgagcggcggcgcgcgcggggcggcgcgctgctgtacgtgccggccggggtgtggctgacggggcccttcaacctcacctcccacatgacgctcttcctcgcccgcggcgccgtcatccgcgccacacaggtacaggcacagcacagacgacagctcagctgctaggccatcgccatggccatgtccttcttttacctccaagacctctcatcttcatcttgtcgagcatttgtactggatcaggacacatcgagctggccgttgatagacccgttgccatcgtacgggagaggacgcgagctgccaggaggaagatacatgagcttgatccatggtgatggcctccaggatgtgttcattacaggttctaattctctctacatgatgacacctcacttcttgtcagttgtcaccttgtcctcaagttactgtttcactgcaatacgtgtactacacatggcccagttaacttgcagtcggcaaaataaatcagacctgcaattttaaaaagttcacattttctttgtttgtttagacttctgaagcaagatgatgagaatgccatcgaacttttgtgtcgttgggatgttcaagattccgtctttctgtgacctgtgcaggtgagaatggaacaattgatgggcaaggcagcgtgtggtgggatatgtggaggaagcgaacactgcccttcacaagaccacatctattggagctaatatcctccactgatgtgatcatctccaatgtcgtcttccaggattcgccattttggaacatccatccggtgtattgcaggtgaacacaaacagatcactttgttatacttcagagcctacactccaggcattattgtgaactccattgctcacatatggcttttggacactccgttcaattagcatattgtgcttctgcagcaatgtagatccactttgatggatgtagaggctgggttttaatccattatctaaaaaattagcatattgtgcttctgcagcaatgtagtaattacgaacgtaaccgtgttggctccacatgactccccaaataccgatggaattgatccaggtacaagagttgtttcactttgtaaatctgtgcgcaaaattccctatgcctattctgaatcaagatcttggactcaaacactgcagattcaagcagcaatgtctgcattgaggattcctacatttcgacaggagatgacttgatctccatcaagagtggctgggatgagtatggcatagcctttgggcgacccagctccggcatcacgatcagacgtataacaggatcaggaccatttgcaggctttgcagtgggaagtgaaacctccggtggtgtggagaatgtccatgtagagcacctgaatttcttcggcatgggtgtcggaatccatgtcaagaccaactccggaaggggaggattcatccgaaacatcacggtctcagaagtgaccctcaatggagctcgatacggtttgcgaatcgccggagatgttggagggcatcctgatgcatcatatgatccgagcaagcttcctgtcgtcgacggcgtgacgataaaaaatgtctggggtcagaacatccggcaagccgggctggtaaggggtatcagggactcggttttcagtcggatttgcctctcaaatgttaagctctatggtggtgattctgttggtccatggaaatgccgagctgtcagcggtggcgctcttgatgtgcagccatcgccgtgcgcagagctgacaagtacatctgagatgagcttttgtacaaattagatcagatacaaaagtgaatgatagtcatataatccatcctgaaataaaattcgtcatgttccttttttttggcaaaaggttgagttgttgtgccgattgattaaaaatgtaactgaaacaatgaattgtacttatccaatataataattcagtaccatatgtggcataaaagatcaattcctgcgttcatatgtatctgtaaaactacgtcaaatctacttccccaatagggaaatgcatacaaattacaattgtatgtatggattaaaaaaaaaagcaagagacgatgcatatgaaattcaattcattttttagttctgtatacaaatcgtaatcataccgacatttacagaaatagaagttaagtatctggctctgcaggagatcccctggttaattgatgttttaaaaaacattatagaatggggaatgcggcggcggcgaggtcgcaggcgcaacaggggtaacctgcatcacgattcctggagaggccgaaccagagcttgtgttcggcgaggccggtgaaggaattctctgtgacttgcccccaggcgcgccgcgcgagacatcgatcggacgcgacgcgtcctcagctcgtccgagaacaagatactgtcagcgccgccgacggcgacggcgacggcgtgggatcctcgtcctccacgcgggaattggtgacagacagctccaatcctcgtacgaaaatctggcgtcctgcaattcgtccctgtccacaagatcgggcacgaccgcctgggattggcaactagcgacactagtccttcttgtttgctgcccaagtgccgacgacgtagaggtggtggccactggactacggagaggtggtggaaccctacttagctagtactagtagctcaatgcccagacagcctgaattgcccaatataattcactattcacagatccatccaacctatactgaaagtaaaagaactgagaggtcattttaccttcctctcctccttctccatcttctccttctcaccctcttctcgaactggcacactcactcttccgcgtcatataacctggatgaagaaagccgataagagccagtaatggtgggtgaattgatcagctagttcagtgttcaccagtaatcattgcaagaacatttcccatccacaaaatggtgaaacctaacagcatcacgaagaataatttgtcgatcacatagagaagagatatgctttgccacctcatggcagtcgttgcacatcctggtgttcttcatcaccctgacaggcgctctacttgcatctgagcggatcagcccataagtgatagcaagcttctcagtatggccaaggagaagcttctctttctcttcttcctgaacattatacgctatgcagctggtgtctggcacatatcctgccttttttatttgaaacaccagacgaataagctcttcatatatctctgcagtttcaggatgcggcttcccatcgacctcaaagacatggataccttgctcaatctgtatccaactccacccaggtctactatccactcctcttgctttcattgcatatttcaggctctcagcttcatcatacatccgttcatactcatacaaattcatcatcaacaaatagttggctgaattgtaaggctccagtatgaacaaattcctcgcagccacctctgcaagagcaagattcccatgtattgagcatcctgtgagaagtgccccccagtggcttgctcctggatcaatcggtgacctctcaatgaaatccattgcctcatcaagataaccacaccttgccaagaggtcaaccatgcaggcataattctctgtcgttggctttacaccatacttagtctccatactgtcgaagtactcccacccttctgtaaccaagcccatcgatctacaggcagttagaagtgcagtgaaggttatggagtccggcttcaatcctgagttccacatatcatggaacagttctattgcttcgcgaccttgcccatggactgccagaccagttagcattgcattgcagagcaccaaattcttctgctgaatgctttcaaatatcacttttgcactaaccaagcttccacccttcgagtacatgtcaattaacgctgtgctcacaaccatgtcacagtcatatgctcttcgcagcgcgaagcaatgcagctccttgcccttcttttgcagagctaatccagcgcaagcccggagcaacactgacatggtaaccaagctgggctggacaccatccttctgcatctcatgacaaaagtagaatgaatcttcatactccccattgtggcagctacccgagatcaatgacgtccatgagaccacattgggcgtcacaccagctgccttgatctgccggagcagcagcaccgcctgcgagctctggccgttcatggagtaaccagtgatcagaccattccaagtggttatatccggatcaagcctgttcttcttcatcaattccacgagctccagcgctatgtcgaaccgcccggcgttggcgtaccctgcgaccagcgagttccaggtggtcaggttcctgtgctccagcgcgtcgagcaccttctgggcgcaatcgaggcggccgcacttggcatacatgtcgacgagagccgtccccgtgtagacgtccggctcgagctggttcctcaggaagaagcagtggatttccatgccatggcgaagcagccccgtgttggccactgatttgaggaggctcgacacggtggtggcgtccggtcgcagcccttgcttcagcatgctggcgacaacgccgagcgcttcccggtcgcggccgtgccgggagcagccggacagcacggtgttccacgtcgcgacgttgggctccggccccgacctggacatgcgcgccgcgagctccagggcgtcgtccacgagtccgagccgcgcgcagcacgcgacgaccgcgttccacggcacgacgctgcccgcccccatcgcgtcgagcaccctagtggccgccgcaacgtcggcgttctcggcgtacatgccggcgaggaatccgggcacgagcgggtgcgcgtccagggcgagcttgagggcgtacgcgtggacggccctcccctcgcggagcgcccccgcgcggccgcacgcgtggagcacccgcgcgcaggtgtacccgtcggcgggcaccccgcgcgcctgcatctccctgaagacggcgatcgcctcgtcccactcctccgcctcggccagcatggcgacgtgcttgttccacagcacggcgtccttggcgccgtcctccgccgcctcgtggagcaggcgcgcgcaggagggaccccggccgaggcgcgcgagaaggtcgacgagcgcgcacgtcacccgggggtcccgcgagaggccggtcctgaccgccagcgagtgcagctgcggggccaggcggcgcgcgacccggtggtcggtgtcatccccgtggaggtcggcgcagtcccggagcagggagacgaggacgccggcggagtagggcggcacgccggtgcgcagcgccgccgcattaaggaacggcggcgcgtggcgggggcgggcgaagggtggcgcggtaggtgggaaggagagggagacgagctgcgcctgcgccttcgccatggaaaggaaggaaggataaggtcaacttttttttttaagagagagaaataaggtcaacatatgtggaaagatgggcctatttagatttcatgggcctgtccagatgggcctggtccgtctaataagggaggcccgaactgcaatatctactcgaaaagaaaagaaaagaagagagaaaaaggaatataaaaccatcaccagaaggggagagcggcggcggaagggagagaacagaggtgtgtgccggtagagaagggggaaaggggggaaactgatttaatagctcgggtggacgtacgtctacccgtttatatatgtcatctacttcctcacattaatcgaagaaaaagaaaaggcagagtccatatagaaaatacaatttagaaatagctgaaattcaaaattaaaaaaataagaaatattagaagaggagaccagagtccatatagaaatacaatttaaaaatagttaaaattcggaattaaaaaataaagaatattagaagatgagaccagagtccatatagaaatacaattaggaaatacctgaaatttggaataaaaaaaaaaaataaggaatattagagtagagtaccaagtccatatagaaatacaattaggaaataactgaaattcggaattaaaaataaggaatattagaagtagagtatagagtccatatagaaatacaattaagaaaaaaaatagaaattcagaattaaaaaataaggaatattagaaatagagtatagagtccatataggaatttaaaactaactaaaattcagaataaacataataaaattaaaagtagagttttgagtccgtataaaaatacaatttacaaataactaaaattcgaaattaagaaaaacatgaaaagaagagtttaaagtcaatataggaatacaatttagaagtaactgaaattcgaaattaaagattaaagaatattgaaagatgagtttagagtccacatagaaatacaattagaaacaataaaaattcagaaataaaaataaataatattggaagaagagcttatagtctatatagaaatacaatttacagaaaattcgaaattaaaaaaaggaaatattaaaagacgagtctagagtccatatagtaatatatataatttacaaataactaaaatttgatattaaaaataattaataactaacacgtatataaaatacaatagaatattacacatttgtagtttcgtaaacttattgcaaaatttaaaatatgatgtcatttttatatatttgaataatataatgagaaaatatatatgctattatatgaaagaaaatataatgatgctagccgcgcaatttgttctggccaccatgctagttcatattaatgtggatgaatctagacatatatatctatctagattcattaacatcaatatgaatgtggaaaatgctagaatgacttatattgtgaaacggatgaagttgataattatgaaaaaaattaaaaaatatatgaacaagatagattaatatgtaatatagcaatccacaaacatgaagttaaaattcaacatctacaaatcataacaaaaataacaaacaaaactcaaattactatatgcatatttacaattaaatttgttatttttgttacaacttatagaagttgaatttgaacttacatgtttattgaatgatataatacatattgatctatcttgtcattttttttgaaaatttttcgtaaccatctagttgacatgcaataaacgagtggacgtccactcgaactattagaattcatctccggaaaggggagccgctgcaaggaagacatatagaatacgcctccatatgtggaaagcctaatgtgccaatgctcgtgacatggacatctcgcgaatgctttttaacaatgtaacgataaatggctggttagggtttcgaggtgggatggaaggggggaggtggacgttgtgaaggaggaagtgggggatcgagcttagatggatggcttgggaagctgtggaacggtggtgtgtggcggacaaaggcaggcgacggtaccaccgtaatgcggggtcgacaccgtagtcattggtgacgcaactgccactcttacttcttaactcctctcatttccctgtcctcgcctttgatgccaacccaccgctatcctccatccctatagttctatccttcatccccataactctgacattgtcatccaccgtctcgtcacccaccagtgtccaccatccaataccaattcttcgtctcttacaaccatctctctggaccccaaaaactcccatctttcctcttccccaccaaccctcctatgttgaccctaaactcaaacccgaatgctaaccgattgagatagctgaaaagctcactcgagcacgaatcacgaagctatatccaatgatccaaaacctacaagatttgatcttcgattttatatggctggttagttctcaaaaacttttcccaaaaaaatcacatcgaatctttagacatatgtatagagtattaaatatacataaaaaataaaaactaattgcacaatttgtatgtatatcgcgagatgaattgtaacgctccgcttttcgcgtgacgttaaaaactaattcgacaaaatcctatatgcaaaaatttcgttctttgagtgagagtctaagtcgtgccatggatctcaattcaatctccatcattgttccctctcatcgccatcaaaatcctccacctcaagtttccaatcccgattcaggtttccgaaatcaaatcctgaaattcaatcgcctcctttgaatcctcgccaaatacttgtcccgattccacaaatatccgagtccaccttgaatccattccttgactcctccctatttccctgagtccaagtaatcaaattcgaaattcaattccaaatccaaatctcttccaaatcatctctctgcaaaagtctattttgcctcccccttggtcggtgggccgattcttccttccttggcccatctcctccctcagactcacacgtgcgttgcacgcgccgagccgagccgagagagagctctctcgctctctcgttctttctctctctcgatgctttctctctttcacgcgccgacgtcgatttcccgccggcatcgctcaaacctccaccgccttcgctcgttcccgcgtgcgctccctccgtggtggctgaccgcccttggtcgccatccgccctggcccgcctgcgctgcgcagccgcccgcgcccactctgccgccgcccccacctctgcgccgcagcgcgcgtgtgtccaagatgcggaggcagcgcctctctctcccacgcgctttctcctccctcagatcgcccaaaatcggcaaggagccgagctcctttctccctccccctttttgctttttccccgaccggcgccaccgtcacctcctttgccacccgtgaccgcctctgtcacagcttgaccgtgagtctgccaccgcctctccttgatcgtccgtgctcggttccttcccctcgaagctcgacatcccgcgcctataaaaccacagctgagcccctcccctccatctctctcgttttcgccccccaccgcgccattacagccgaacaaccattgccgccctgttgccgctcgacccgatctcgtcgtcgccgtccgccgctgagcaccggaggaaccggtgcgtgcgtgggcgcgtgacgaggagctccgggcgccacttctcctctctttctccccggccgcgcccactcggtgccgcaccgtcccaccgtcgcgaccacctcgccatgactccctccgatccgcgacgccgtttcctctcgtcggtgagctccctgccgaaccctttcctcctaccgcttgctatgccgcgcccgccgccgcacgatgcgccgcgcgcctcgccgttgctctgtttccgctgccgcgcgcagtcgcgcgccgtcgtcgggccccagctcgtcgaccaccctcgccaacactgtccttgagctccctaggacctcctcaaaccattccctagcaccgccgtcgcctggcatggcctcaccgccattaccgtccgctcccggaggccgctgctcgtcgccggccctcctcagtgcttctccgccccatccgacaccggaaacggattccttgaaccctggagatgctcccacccctttgaatcgaatcctcgtcgtctcgttgtgttttcacctttttgctcgccggtgattgccgccgccgcaatccaccaccgtcggcacctctcgcgccgattcctctcgccgccacactcccggggatccccttgagctccccctgactgtccctaggccgccggccttctcctttgcctccgcgccgtgtcgccccttccgccgccgcataacgccaccgcacgtgcatcgccggtgaccatcgggtcccgcgtcaccgcgtgcgcgtcgcaaccccataccggttcggctaagtccgagcccgcgcacccttcgctcttctcgcgcgcggccacgtcggcgcgccagcgagattggccgccgccgccagccgtcgtcgcgcgtcgtcttcccgatccgagcgatggaatgagttccccttctcctcctcctgccgccagtgctagccgcccctccggcttgccgctgttcgccggatcccgccgcgcgccatgagccgcccgacctcctctcccttccccatccgacgtgacgtccacgttggcgccacctcagccgtcggccccgcttgaccaagtcagccgacgcccagtcagcagccgcctcctctctcttgctcttgggcttggcccagtagccaccctcctcctcggcctgataagtaagacaaacaaagtccacatagactccctttgtccaagcccagtgtccatcacccaagagctaaaagtccacaattactccctccaattgctcctctctctctcaccttcttgttggccccacgtgtcaatgagtcaaagatattcttgggaatatctttttcaatactccacacatatttctcttttctagaaattcaataaatcatttcctatattccaaattccataaacccatcctcttaatccggagattccaataattcgtcccctcgagcccgtatgtcagtggatgtcaataatattcttgagaatattatttctataaattccataaaccatttctcgtattccagaaaattccgacaaatcatctccttgtccagaaaaattcatttaaacttccaaaattcatatccctcgatccgttcatccgattgcctccattccacttccagtaattccattgaattgtgatctatctaatggcactattaattagcctaaatcggacattttatttggtctttgcttaggtttttgattgtttgcgcctagttgcggttatcggatatttttcttcaagcggatttctcgaagatttgtgaagcttcgtgaagaccctgagcaaggcaagccacctttgaacatattgagcctatatttgaacttatttatgttacttgcaaaatattatgcattgataggattgcacttaatctgtttgccccgtctgcaaggcagaccggtgggcctacctaatttgttgcatctgatccttctattgttaattgttatatcatgtttccttgtaaccatctagttgcgcctcgataattcgtgcactctgtgcgagtatcgatggtcgccttcaaacttaaaatttgagtaacttcttgggtaacacttggtttacaaaagttttggaaaacccgacgcctgggtcggtgccttgtgaaagaaaatgagttttaaaaatgaaactcgcgacacaaggccattcctgggtggaatacttgtgcagtcgcatttaaggaccgattccttcggaattacatccgagcatacaacagtgcggccacatgggtgtaatgggacgcccctggctgagtaattagctaatcaggagaaccatgatgccaagagacatgtggattcaacggggtggtgtcggggagaaccctcgggcttcctggcacagtatggtctgggacctaacctgttgttggtctgggacccctctcgttggcatatggcaaccctgtgtcggctttggaaatgccttgtcgtgaaagcctcaaagtcgccagacgtggctgttctgcacgggctgggtgacctaggttagtaacgtcgtgtgggtaaagtgtaccccctctgcagaggttattaaactgttcgaatagccgtgcccacggtcatgggcggatgtgaggtgattccttaacgtagtttttgttttaccctgttttatgaaaatgtgttaaggtttgggaaacctaatgcttgggaagcatttagttttccgggggacagcgggaccgggtgtccctagaagtgattggtcgtttggggaccactattatcgagaagtttggaaaattggtttggtttgggaaaaccagatttgaagccaactctgggagttgtgcaaatcttgataaataaatttgttacttctcacctcccgaccgagctgagacttgtctcgctctggttgtggaaagcacacacttagattgttgaaaacttgaaaacaaaactgtttgcaaaataacagccttccctttaagcttgcattaaccacctaagttcccctggcttgctgagtacgtaagtactcacccttgctctctatataaatatagttctgccagctccgaagatgaagttgaagtgaagtgaagattagggtttcatcctagttccctgccgttgcctgtggcgttgggtgttagtccgttggttggttccgctgctgctgctgttgttagtgtttgcctcgtctgtgtcgccggttgcattctcgggctgtctgagctgcaacctaagttaaggtaaataagtcctctattaattataaggatttgcaatgattcatgtttgtcactgtgggtaccagcgctatgtcctgggactggtactgagatcgcggtttcgtaggacgcggttcacgccgttttactacgacaagctcctgccacgtgccgttgtacggcggtgccagattgaggtgtgacacaaatcttttaagactaattagtccatgattagctataagagctacagtaacccatatgtgctaatgacggattaattaggctcaaaagatccgtctcgcggtttccaagtgagttataaaattagtttttttattcgtgttcgaaaaccccctccgacatccggtcaaatgttcgatgtgacacccaaaaatttatatttcaccaactaaacagaccctaaagattagcaattctcgttccctatatttgtcaatcctcaatccgtgtattgtgacccttgaataaacacgtcaaaacaactaaaatctttgattactattagatcccgtagaattatttcgtcactgacgttaggggcaacattgaacttttacagcacacggggctgaggaagaagaagaagaagatggttgccatcagcgcagctcggcgggcagcgcaaccctccggctcctagcggcctcctcccagttgagcggcaagcgtccctcccggtcacggctcagccgctcctgcgcgccgccgcgcagcttctccagccgcggcgcgtcgctctggtgcatcacgaacaccttccccatgttgaacaccgccgccaccagccacagcacgctccccaacacgcacatcgtccacgcccagctccgcccctgcgtgacagtcaaaccacacggttttgtcatggcgtcgtgcatgccaacgccggcggcgaggttgctcgatcgaatggatcgcgcgcttaccactagcaccggcggctcggggcgtcgtcggcggttgacgacggcgccgaccaggaagagcaggctcccgagaagcatcggcacctgcacgctcgactgcagcagctgcgcccgcccgtcggcgcgctcgtacacctggcacgagttgagtatcgaccccagcagccacaccagcgccgcggcgagcagcgtgttcgccgcgtgcgtctccctctcgccctgttccatgtcaaagcagagtgatcgccatgcgcgttgtgcacttttgccaacgatctagctatttgaaacgcacctgggagagcagaaaggccatggcgacgacggcgaggacgcacccagccacgtgcagcgccggcacgaggagctccacgaggccgagctgggcgttgtacctgaccagccccacgcggcagtccacgccggcgaggtgcgccgcgaggtcgtgcgcgttgacggcggcgacgagcgccagcgccacggcggccacggtgagcgccgtcctgctggccccgcccccgcccccgccgtccgcggacagtgccgtgagcgccacggccaagagcagcgccgcgaacacgtacgccccggcgttgatgtactcccaccgccgcacggtcagcgccggaccgtacatgcgcgcctccctggcggtggctagcttcaccatggccgccctgggactcagctcctcaactgaacgcgacgccgatcgaaagcaaacgctcgctgatccgctaagtacgagtaacagttgcggttgcgcgagtgcgtcaatgcggtgggcgggggggagtttgttggatgcgcagtcatggcatgcgactacgtggcgctatgcatggcatccagagcttgtgtgcctcccgacgaaatctctgaaagctagtggggacttggagattggcgtttctgcctccataatccagatggacattttgctcgccgggaactgtaccagtgttacatctggcaatggcatgtctgcaaattcaggtgtcacctgctcttgattcatcgagacgatgaccgataatatatttagatattaagaaatggagggatcgggctcagcatcagttcaatgaatcaaattaaactatagctagttaacgtatattcatagttaaatttgttttttacgagttatagaagttaaatttaaacttacatatttataaagtgatatatcatgtgttaatatatcttctcaatttttttcataatcatttaagtgacatgcgatcaacgaggggatattctctcaagggattaaaatagtttcaactcccgggttcagagttgctactcaattcttcaggttcagacttcagaaagtattatacagactgagcatcagttgatagaaaaaggaaatgtcttttcttttgaatgcacagcgtatgagctaagctaagcagggatcggatcatcccctgcaccgtatctatatgctaagtaagaattacttacatctgaggtgcatatgtaccgcaacctcacttggaaaaaaaactcgtggacacacacacacacacacacacacacacacacaccgttcctgtatctataacacggaatcatctcagtgtattttgtatctgtaatctgcaatgcagaggggatcatgcagaaattatatacagcagaatatgcagagtagaatgaatacctgtggttgttggtatttgctaatgctatgcaggtttggggaattagtaagattgctaggaatacatgcttgtactacatgttttatgcacagcagagagacgagacgattgcatggtggttttcacatgtatctgcgcaggtattccactcgcgtggggtgcttgagcttcatgagcgccttgagctcgtacttgcgcaccatctccctcgagatgttgaggtttccggcgatctcgctcagcgtccgcttccccctcccgtccagcccgaacctctgccggatcaccacgctctccttgggcttcagcgaatccagctgcacatttatacatacattcgattcgaatcacatttcaaaggaaattcaagaacagaattgttctgttcatttacaacttacgaggtcgtcgattgcgaagcggttgagggtgttgtggctgctggtgtcgacgccgatggcgtcgtcgtcggtgacctcgttgatgagctcctcctgggtgaccctgttacgcgcgtggagggagtaggtgggcctcgtcatccgcaccacgtcgcggtacctcgccggagacagccccacctttttcatcacctcctcctccgtcggcgccctccccagctcgaacgccagctcctcccgagccctgtggatctcctgcctctcctgcacccaatcaatcaatcagccaatctgaagattggacaagacgagatcgagctgaagaagaagaaggaggaggagtacgtacggattccatggcgaaggggaagcgggtgaagttggagagggtgatggcgcggacgatggagtggcggatccagaatagggcgtaggtggagatgcggaagccgcgcttgggctcgaaccggtcgatcgccgtgatcaagccgttggcgcccgcctggcagatgtcgtcgaacctctcgtcgttggacatgtccgggtagtacttgttgatcgtgtacagcaccagccggagattatgctgccattattatattattcatgatcagtctctactgattgcgtacgtgacagtagtgacactagtttagtgagtaactgagtaccttgatgagcttgttcctggcagctcggccgacctcgagatggcgcctcatctgaagaacggacatgttcatggcctcggcgagctgtgcgtcgtttggctcgctctgcacttcgttctccaggttctccttcatttccatgatcgcctgaaatatgttgatccatcaaccggatcctaattagtcaatttctccaactaatcaaactagctaaaacagttagaatcatcaaggcaattggcaattaccttcatgggctgcatgatcctgaagaggcggatgctctgggcggaggtgagcacgggagggatcttcatccgcttccagtcgaggctgcccatgtcggtggacacggcgtgctcccggagcagcatctcctcgaacccccgctcctcgtcttccaccttgccggcgccgccgccggcctcttcttcctccctcctcctcatctccaccctcttccccaggtccatcctctgtccccgcctccttctccggctgctcctcaccgtcaccgtcgcgttccggctcctccccttcgatgacacccatacgcatgcacgatcaagatcgatctagctagcaagcgagaatccattctttcgatttgatttagaagaagactagctaggatgctcaccactctgccttttctcttccgcttggtctgtttgctcttctcgtcctcctcgtcggcgtccttctcctcgaccacggcggggctcagcttgtagatgctctccagcgcggcggccacctcgttgtagtccgtccgctcccgctcccgctccgcgtcggccgccgcggtcctcgacgccgtcggctgcggcggagggagcttggccgtgccctgcttcgccggcgacgcgagcgccgagcagctggtggacgacggcgtgcgccgccgcggcccgccgccgagggagagcacgacgggcgctgaccgccgcggcgagcgccggtggcacccggcggataccggccggctcggcgtcgtcacagtggacgccatggcagaccagaaaactctaaccgaaccttctagaaccttccccgctcgttcactcgtgtgtggaatggaatggaatggaagcaacaagcaagcaagcaatggcgtcgacggaatctcaggcgagaagatgctcctctcctccccgccacgccatataaggggccggaggcgaaggcgcaacggccgccacgagctcccctccggcgaatcggacggccaggaacccacgggacgacggatcggacggtgagggaggcggcggcgtggcgcggaggggcgcacgaggttggcgggagatatgcgtggatgaggctcgcgccacgtgggcgatggccataagccgcgtgatattttcgggatctctcgcttcggcttcgggtccctgggcccaccgatcagtgacacgtggaggcggagaaatcgggaaagtctgcatgggttggtgttccgctgtaattcagtgggcctgtaaatatttgggctgaatttgtggccacatgattttttttttggaattatattagcacaaattcttctgcaatttctgaggtccacaagattgtgagtttacgtgggcctaattcggccgttttttctcgctgaatggtcatcttgtacgactcgcctacggaaatctacggtgtccaccaagtttgcactacgcaaaaaagagaaaaaagaagggaagaacataatttgttcgaatctggaattttcaccagtgttcatgaaatttacaacacaacaccttagtgaactttcttcagcacacgcgtctttacgttttttggccttttctttttcttcatgaatcgatgatttttcctctttctcttttacaatgttttttttttgtgaaacctaatgaatacaaatgtcaatagtcaaaaaggcgccaaaaaccaagcactatcgctattcgttaggtccatttcagtccacgacgttgccgctgaagagcttgaactggccggcgtcgagcacgagcttccgtacggaggcgacggcgccgatgaggccgacgccggtgaagacgaccatgatggcgacgttggcgaggtacaccggcgaccgcctcggcggtgcgagcgccatgttgtacatgacgacggggagcacgaagtcgagcgggatgaagccgacggcgccgacgacgccgacgatgtcgccgaagaagggcagcatcgcggccacgaacgcgcacgccgcgacgtacgccgtccggagcgccacccggggcgccacgttccgccgcgagaaccggccgcgcgccgcgtcggccgagctcttctccatgatctcgtacgccacctgggagtagacgagcgcgatggcgagcagctggaggaggacgagcacgacggcgaggccgagcagccacgtcggcgccagggaagggcccttgtccggcatgaggctctgcaggacgttggactgcacctggctgccgaacgcccagtagccggtgatcgccggcaagtagaaggtgaacaacaccaccgtgtagcacagcaccagcgccttcatcatcttcccggccgccggcggcgccagcgtcgcctgaaaacattgccatcacgtcgttaaatcagtcacacagcttgcagctgtcagattctcagaaacaaacaagctgctagtacctggatttcaggcagaatgccattgccgaagacggaggcgaggatggaaatggagaggaacgcattgaaggtcttctccgaattggatgagctcagggagtaatccttctccgggacatcgctcaaagcacctgtcagacaagaacaacatcgctaattgttacaacaaaaattcagtcacaagagatgaggttaacatggtgtcgtgtcatgtcaatcctgtcgtttcttgctgtcacagtgtcacttgtcagtacgagattacactctaatacacactcaactctgaatctgaatgtcaagtaaataaatggcaggcgattacctgctcggatgcaggcagctgagacaaggatggtgtagccgaagctgaggaggagcgagccgaggttgatgtaacgcagggagtggaacgacggcagctgggagagcaaggacagaaccacagcgacgacgatgatgaaatggtacagtttcaggggtccatttggtgcaaggtccgagtacattatctgcacatatatgtgaagtgaaatcatcatgtctcacaggagtttcagaatgtcaaaaaaaatatagtaaacattcctaattgacacataaatcagcacaccgatgaaatgaaattaccaagcattcgtaattcaccacaagtcagagtggctaggacatacagtagtagactcttcagggtgtgttttggttcacgctaaaattgaaagtttgattgaaattgaaacgatgtgatggaaaaattgaaagtttgtgtgtgtaggaaagttttgatgtgatgaaaaaattgaaaatttgaagaaaaaattgggaactaaaccagcctcagtaccacttggacaagttggattgcgtggtcaaactcagggtttctctgtccttgtcgtatataaaaagtacggcttggtcttccattatctacgaaatataaaagtacaacttgtctaagctatttcaacttctgaggtgagatcatggtattgcacaatgcaactctaagtcaactcactgtagccaatattgttgacaaaggcaaacattttgttaggagtatgcagaattaattcagttattctatttctgtatgatcccttcccacaaagaaaagatgataacaacttgaatacaaagtccagattttctacataatcttgacagagaacgatgaagtgcaacataaataaacaaataaataaatgaggacttattattcagtttagtgtgaattcagtttcgtgggaagccatgcatgcgtgcacgatttatacatacttgtaagcagtcagccgcaagaaggatgctcccgatggtaataccggcgttgatggcagtttgcacggtgaccaccaagtagaacacccatccagatcctgccaagagaagagacaaaattgaattaatgacactcttaatgatgaggtaattaatctctacatttagaagaagatgaggtgcatgcggaccgaggacgtcggcggcgagctcgcggaagcggatgtggcggcggccgtgggcctcgcagtggtcgaggaccctggacatgaggtagtaggcgtagaaggtgacggcggcgacggcggtgagcgccaccaggccgagcgcccaccccatcccccgcagcgcgtacgggagcgtcagcaccgtcggccccacgatcgccgtcgtcaggtggaacccggcgtgccaccacttccctggaatcataattcaccaacaattaatccaagatatatactcctccggccatatgtgatgtgatcaggtagtagctaggttaattaggtgacctttggactcgagcacgaaggcggcgccggcgtcggcggcgggcttgatgccaaggcggcgagcgccggacgcggcctcgacgtcgaacaccgcggcggagggcggcgtcggcatggtgttcatcaccggagagggagagcggagcagagggctgcctccggtgccggccatggatctacgtcgaggtcaagaagaagctcgcatctcgctgaacacacttacaccttacagccttacaggggtatggtatgagatgagacgagaattgaattgtgtgtgcgttttgatttgagtttcttgtggattacaactacaactacaaccaggacagcgcgcgtgaggaagagaagtaggcctgaaaccgttgacctttttctttttgacaagaagattattgaaggagtcttgactgtatcccactcccaccccacggcgctggagacacgtaccactcaaaccgtgacgcttcagtttctcatcaagccaactaaccgctcatgcgttgcaggagacccaaggcagatacagatattatctactaacagcaggcagcagcacacatgtagattataccaacaacatggaacctatactgacaataaggatttctaaactaaacaccactagcctgttttgtactccctccgtttcaaaatgtttgacaccgttgactttttagcacatgtttaaccgttcgtcttattaaaaaaaattgtgaaatatgtaaaactatatgtgtacatgaaagtatatttaacaatgaatcaaatgatatgaaaataataaataattacttaaattttttgaataagacaaatggtcaaatacgtaataaaaagttaacggtgtcaaacattttgaaacggagggagtagtacattagataaatgaagttgaatatcactgtatttatctactgtgggtaaagtacaggccaatggggaaactataataaacttttgaggggatgtcccctagttatatttgcatgccacttaaacaattatgaaaaaaattaaaaaaattgagaagatgtattaatatgtgatatatcacttcataaacatgcaactttaaattcaactcctacatatcgtaacaaaaaaaacaaattaaattataactagttaacgtatatttatagtcaaatttattcttttttcgttttgacatgtagaaattaaattttaaattgcatgtttgtagagtgatatatcatatgttaatacattttctgaatgtttttaaattttttaataactatttaagtgttaaataatatggaagtagagattttaaaatccactctccaggcaaacgctacaatgcagcccaacccaagatattcagagagattatctataatcatcttgcttagcgtgcaggttgtactaacagcggcacacatgtagagatgtatagtacgtagtataaacgcaacataacacaacctgtactgacaagaacagtactaaaataacactagctctgggatcaccacttgcttgttttgtacagtacacaaatgcagcgataataaactgttcgttagttcgtacagactagagggatcagtggggcgtgctgaaaaaactgtaggaaatatacaggtcaacgctgcaatgcccaacgagcaacgatacacatgcaagatgcatggtactgtacgaaaaatgcctccagactccagccaactgaagatggaattgttctggcagataagcagctgtgcaatgtgcatatataatgcgaatttccatattactcctcccatcccaaaatataaatatccaagtacttttggctttccatatgacatagtagaagtttgttcttaaaaaaaaaatctactaacagatcctttacaatgtataacatgttgatttcagccccccaaggtgttcatgtgccaaaacactgttgacaaggaaaatacatttatcgattaaaaaaagcatattaataaaaactggaatcacaacagagtagtacgttattaaatatttcgaaccatgcactggtaagctcatgcatgttttccatgattgagtaatataatggcgcatttggtcagccaaactagagttgagtttcagtataaaaaacaaatgtaatacctttgtaaatgaaacctcaagcccaaatcatcaaacattcacatctgccacctagcaaaaggtggttaagattaaatatttacaactttacatacatgtgtaatataatgtaaaaaggcactggtatagcagacatattacaagcccacaacgatacacacccagaatattgtctatactctattgctctgtatcaacaacatatgcaggggacaggaaacaacatacccagacacatgaggaacttagagctgttcgcatgcttaggtcatatatacctaaagaatgcttcaaatgaagtaatggaatttgtacgacaatttgtcaactttgaatgagtaagtggtaaatatatataaaaaacaggtcgtcttaggtactcgtgtattactgttgctgcacactcaagcttcaagaagtacaatctaaaggcttcttccatgccacaatccaatttaactcccttgacagcttttacgtggaaatgagtttttgcaaagcaagggaacatcatcagagccagagagctaacttttctcttcagggacgtgcatgccaaatccacgttttaacttctcaactctgatcattaaaatttgaaattgttagtgcctggttttaagaaatctgatcaaaacgtagttgctgataaaatttatgttactgagtctaagcgttgacacgggagtaatcattatgaatagaagaaactagtaacacaaaactctcgtaatttcatccaaaggaacgatatgatgagcttgcacaatatcatctgatgatttacttctacgtatacaatagactacaaacaatgaaaatactgaaacaaccacagcaagatgaaaatagctaaaagacaaggttatgcatagagcgctctattctttggagggcaaaagatccgatgcccgtaaattgtggacaatgaagcttggataggacataacgaccaatctagttagtacaaacaaaaccggaaatctaattaaagaaataagaccagacaggttggaagagttgtaactactatgcacgcaagctgaaagtattgatcatgtcatgctctagtgttctatagctaaggtggtgtttggatccaaagactaaactttagtccctgtcaaatcggatgtttggacattaatttggagtattaaacatagactatttacaaaactaattacataaatgagaactaattcgtgtgataaattttttaagtctaattaatccataattagcacatgtttactgtagcatcacataggctataatcatggattaattaggttcaatagagtcgtctcgcgaattagtccagggttatggaatggtttttgtcaatagtctacgtttaatacttctaattagtgtcaaatatccaatgtgacagggactaatccaaacaacccctaaatttcctctggcctgttatgtgagatgcattagcttggcctagatgtccagagaggcagagactacagaggacttttcgtattctgtgattagagttgaggtgaaaagggaaaaaaaatcatgtacagtcgttggctgcttgttattgggtttttatatttagggtgtgtttagttcacgccaaaattggaagtttgattgaaattggaacaatgtgacggaaaagttggaagtttatgtgtgtagggaagttttgatgtgatggaaaagttggaagtttgaagaaaaagttgagaactaaaccaggccttactttgaaatgatatactcctattcaacaacaaattaactaattctttggcatagatgatacggtgcattggaggccatgatttcaaaacgtgggacacaagaacaacaggtgcaacatgaaaacaccactgcaattgactgaattgcctggtattcatgtttgttgatgcctgatttttttttttgttaatctggcaacataaagatctggttgtctttagctttgtcagaagatgctgtgaacctgtgactacactagagctatttgactagggttgtttaacttgaaagatattgctgctagatcctgtccagcctagatcttctgtcccctggcacaacatctttatttatttaaaattttgcatttttctcatgcttttttcagttagtaagctcgggcttttcttctcttattggttatgttggacagagttgtttcaccagtttggcatgtgttcaatgccttaccaatttaatacatcttaagccatgatctgaaccttctcctggctcttctattcttgttggatcacacactcaactcccaacttcaataattagtcagactctgttcattaggttgttctttaaaatgactagtgtaaggaggccaaaaggtgaaaatattgtgcaagaaatgaatggacactacgtgaccacaaaattctggaaatgctatttcacatggtgttgttcgaactgagctgaagaagaaacttacgtaggagcaagctttccaagctttcgtaattttttgccagttgtttcatcaatcacatttccattgatctcaacagaatatgattttccagatatccgtgggagacctcttcctgcaagcaattcaaagtctttctgatgaagttctctaccattgacaataactcctgtgttcccaccggcacaatttttcggcattggataattaaattcctttataaatggctgcaaaaacaaagctctgtcatgacgtgctaccacaaagttctagagaaagaactacgagaaaaataatcatcttacagggatgatgccactacactcatgtcccatgacaccccaaaatccagcgcggtagtcatacctgaatcacaattagagaatacggaatgttaccttacacggaaattcccaatgccttgtgaatttaagttggtgaagatccaacaaagttgctttggaaagtacattaggtagatgatattcccagagtaatttttactgtactaactttgcattttcctcgtctttgtatactaatcagattaattttaaaactgtagctggtaaaaggcagaccattgaattatggagcttgcatgtcgcaagcatgcagatgtgtgaaaataaattatagttcacactgtaccattacgattaacaataacagaacaaaactaatgttgcacatagttactgaatgccgagacaaagtaagaccgtgataataaattaacagatgttaatacatgaactaggccatgcaagaaattttttgagctactagcatttaatgggagcaatcaacagccaaaaaaaaaaaaaaaactctgcaggacaagaatcttccaggtatctcatcactgtacaaaatgttctagtaatcaactcagggaagtggttgatttggctgagaaaagttatcaaggaaatcaggtacataggttggttaatatgcaattgagaattacacagtcatttaatcaccgctgtgcagtataagtcatcttaattcctactgttaagatagattcttctgaagaataacaccaatctcttttgcctgtagttgtgcgtctcttgatttcaaaggcaaatgataaaaagatgctaaagaaaacaatgacaagtgccaacacggtagatatcaaacgctaagaacatcagtccataacaatttccaaatttatgaagggagaaggtgacttaccaatatgaaccagggccaactggaccagacttcttctcggccttccgtaggacacgttcggagattgaatggccattgattgaaaccttagcactgtccactgattgattgaacaaagaaatgtccttcaaacctttcttcaaaaaaccagcaaaaaactttgaatccccgttcttagtagctgcagactgaacttcgtctagttcagcctcagaagaaacacgagaactagaatttgtgcgctcattaactgatgactcaagcttcgatggcattatggcatgttcagaatttggggagagcaattcactataacaatcatctaagtcatcttgtttgcatatcgtagctatagtttcaacttgaatgacactgttattatcttctttgctgcatttgctatatcgctcagtaatgaattctgattgaaagttgttgtcatcttgtttgattttttcttcatactttttgctcacgtctccatcttcaaggctgctggtatcatcattatcagccgtcagcttgtctatgttacccatgcttccatcatcacaaaagccacttgtactttctttgagcttttgctcatgtctactgctgacagtttcttctccaaatccttctttatgatctttgctgttctgctcatatgtcacgtccgatctttcatccctaacattagcatcaacagaatctgccatgatatttaggctacattccttgcttgtgcgatctccaccactacaatcttttagacgactggaaaatggatcgacacatttgtcctctataactggggcctgtagattgcctgtattaaatgctgaagtttctacttgactgtatgcatctccttgacatagtatatcctttgggatatttgcaagtctggaccttctaacagatactgatagtaactgactgctcctgtttgatccacactctttgtctattctgtcataactagaagtagaagacacagaaatattgtctgcaagatccttgttctgctgccatctctcttgtgcttgcagcttatggaaactagaatttccttcatcctgatgttggtaccacccaaaacttttgttaacctgacgactggaactccccactgtttttgatgcagggaaagatgtcggcgcaaccaaaggatgaattttcacttccttaagcttgaaactaacgatctccgagcacgaaccacaccgaacttgaatctgcttccgagctgtgcatttcccaggaggcagctgcagcagctggttacaagaactgcatacaacgaaaggagcggcgcctctcacaggacgacagaaactctctgccttcttcctgaaaaactctgtcctcctcttcgacaccgagaaatgagagtacaatgacgaagcgacagacctccggtcaagctccgatgagactgatggggacctatcgaacaggtgagacccctgctggcctgcaaagtacctcgtcatgggaatgtgctcctcctgcatcacagctctctggccatgaaggcactgtgcacactggcaggtgctctgatggtgattccccccaagatacccagaattctcccactgcctctccggccattgccggaaccgcccactcggctgcctctcatacctatctctatgcatagaccgatgcagctggtcattcggactgtgcggaaagccagacccgtaccttcccgtgtagcgtgagcggtagtgctccggcccacggcctagcggcggcggctcggcgtgcgaggggcgcagcgaggccgtgcggcggctcatgcggtggcgctcccgcggctggtcggtgatctcgcaggacctggtgatgtggtcccgcagctcgtcgagcttccggagcagctccacggggttctccttgagcgcgccccaatccagcacgccactccggtcgccgccgcattgcccgtaatcgaagggctctggaaccctagcccttctcctgtacttcatctccttcgcctcgctccccatggcgccttccacgggacgagctttccccccccccccccccccttcgccgaatcgaaaaccctgcggggaaaacttccaatgagtcgctcgaaattcgtagccaccaaacacgaaatgggaagacgccaatgtagatcagagcagcgaagcttctgaatgctacggagaagcggaggaggcggcggtggcggttacctcgaccccaatgttgcggagcacacggcggcggcggagactctacggcgcggggatgcggagaagccaccggcagcggctcgccgatagggctacgcggcgaggaggaggcggtgggacgtggggttcgccattgtggtggatggagtggcggccgcgcgctgcggcggcgagaggaagaagacgagtgggggtgaagtggaaaagagaagcctaaatcggcgggaatccagggactggtttgtaattatcaactttctagggggtttcggcgcgatgtagctttgggtttcagttggggatgacctggctgagacgctgacgaggtgggcccacgtgacagctggtctgatctggctttgactagaaaagagcccccctttcttaacgcgccattgcttgctttatgtcaaacacagtaacagcgtgattagtggctgtgctcaacaacattaatactccaactaaaagtaaccaaaaataataataataatcggcctgtctatctatatatctatctaggtgagtgaggctgcttgtgtatagtttgtttgtaattttaaaatcttttcttttcattagcattcgaaggttcatctcataatttggaacgcataacaaccacatgcttttcgcaaactatgcaggagttagcttgctaaatatcatcctaaggggagttgacagagatcaaataattcgattttaaatctacatgtgttgtacggcgcatttttgcgatataaatttgtgtatcagggggcagccccttgtaagagccgcaataaacagtggttagtgcacgttaacaaatgagctctcgtggacctcatttttttagtgaggtatatatctcatttcttcaacaatactacttgttcttctagctatagtaatatatgagagcatacagtgtgttataatccaagcaatcagtttgtcaacgacaaaccagacgaatatatggacctaaacatgtggcatgttcctgtttctttattagaattttgtcaggttatattccatcagcatttgatcaatatctgacacaagaggctgaacattcattacaggacgttttagccttcaaacacaggcggcattgacaagagcctgaaaaacatgcagtgctacgaaaatgagaaagttcagagagatccaaaactgtactacttgagtatttttttttcttctggcattgatctgtatatctattgagttttggagtacatacataatagttaaacctgaacttacatttttcagatgttgaaacctgaaccaaaattgtataattgggtatatcttcagacagggaactgtaatggctgttgggttctggagtacacaggatagttaagcctgaacttacatttattcagataatgaaacctgaacctgcatgattgtaaatgtttccaaactctaaatgcttgcatgctaattaaatgcaatctagctgtagctgcctaatgcaggatacaattaggcaagctatgtggacaatgaaggttgagattaattagcaaagtaatgaagggagtggggactgaagaaaggctgaaaagtggcgagtcatgtcatgggtgatgagaaaacagcgaagcaatgcacctaactctcgaggtcggaagtggccaaagaagatcgatcaccaaacaaactagttagggggcgccaaccaaccaccgtcaaccacagacactcggacagacagctccaaaagatgcagatgccagtgctgcacatttggccacatgaaagtcgcattcaatttgcttaattaaactagtaatttgcctgtcgaatagcccatgctacaccgacgaccgtcggtcctcttctagttttcagatgagtgtgtcctcttaacaggagaagatttgcagctttttcgtgctgaaaaaacggtacggacagtccggtttgtgcgctgtttgtatccaagaacatgacgaaattagttgaaaaaaaaagtggtatctgaatgaagaataaggatgtgtttgtttctgtccataacattaacattttcttgatctgaaaaaaaaacattagtattttctttcagacatatatgtattgtaagatattcatacgggaccaaatcaagtgtacatgcgattcagatttgtagcatctgtgaaacgactgctctgcaatcatattcgtttcagtgtctccttttctaactgtatccatatatgttcatgcgtgaccaaaattaaaaataaaaaccagacatgcattatatctgtttcactgtttgcctaacagcaaaacagttaggcaaacatcacatgggtagcccactgttagccttccgctgatgggctggaaagtcgaactgaattcacggcccaccccctgaggttggacggggccggaagcccgcgtgtggagatgggccaggccggttacttcctctgttccgagatcaccgcctccaagctcctcacagtcacagccacaagggaattgaagccgccgccgcctcctcgtcctttcggccgtgtgctctcacgcagggcgcggcggcggcgatcttctgtgctagcgtggcggcatcgccgttgctttggaggtatgagctcctgtcctcctgtgcctcactttccccttcatatctcttggcttcttcaattttttcccgtgcaaccattcagaatttgtttttgcctaaacattcccatctgtcatagaactgctcctttttctttctttttctttttttggctcaattgctatgcagcgataggccgggcattttcaggactcaacctgggccgaacacgaaacctacaactgggctctgtctgcaggcctaatattacaaacttggaagaaaaaccacacaatttcggcggtgacacggcggcatacatacatcatcatcgatatgtctttaacgcagtggagaattatcacgggcgagcggcacatcaaccgatcaaattatcgatcttgacccatgccatgcaatggcgagcttcacatgtccaacaagcaaaagcagcgaagaaaaggcatccgacgatgcgaccacggagcagaatgctaacaacaacatagcagtatatgcatacggaaggagaaagaaagaaaagaagaaaagcagaggcgaggagcgcctcgcatgtgaaaaaaataactcaccggccgggagatggaatggatccctagctagcttggcggtcgaattcatcgtcctccatcgccgccgccggcagctggctcctctctccgctcccgtgcatgcatcccccatccctttttaattaaagccatctgtctagctagctcattcagaataatcctctttctttctcccatctttttagtttttagctagctttgcaacagctagagagcacagttcagttcagttcagaaattcatattcactgagattagcaaccatgcacacgtacgatgtgtgagcctcccctgcatgtgcccgtcgtgagttcatca

SEQ ID NO: 68053 - DNA, 11086 bp, Oryza sativa
  unsure (1)..(11086): unsure at all n locations
tgcttactatactattaatacccggtcccacctatcatacactcgttacgtcttggagtccgtgctacagctggctacagatctgtagcctgctgctcttctctctcttcctttatctctttaaaatatgtttatagctggcttatagctcgctattgtacctgctctaagggggccgcttgcaaaataaccatggctggccatttataggtagaccccttgccgtccttctagaaagatgcaggggggcgtttgtaaaatatcgtatgtcgttattttacaggtagctcactagagagctgcaagagtgccgtctataaaatgtttacgtaactgttacaacacaccaatgggtgtgtgccacgccataaaaaatgacctttgggagggcgtttttgtagagcgttagatgtgtagatttgtgaaactttgaaaaaaaatattttaataaataaaattaatttaaattaaaaattttaaaaattccttgtacttggggctcggctcacagctcactctatacaacctgatcaatcacagttcacaaccagtaatatttgcgagactgactggaaaaaaagaagaaaatgtagataaaactctggagaaaaaatagggtcgccataatgcatcatttcacatgcgctgaggtaattacagagaaattaatctgacacaactgctaatcgatgggaataaacagcgaacatcgacataagttcagaacatggtgatgagatgaaaacagtaaggcccagcaacatttcatttcagccttagtaccaaattatggattaaactacataacacaaagtcaccaaacaagaagacgtgcagcaacatatcccaattttagcaatgatcctcgttttggataaggtttttggcgaaattaacattgctaaacagcatcaacatgttttcgccgtttggcagagcagcacaacctccagctctggtgagaattagcgatcttttatagcggtcaggggatcatgcctagcgtgattgatgcacggaccacgtaacatgtgcttgcgaagtcgcggtcaacataacagacggtggagatactcgccgacattgcagtgctgcacgcatggaacagccatcccatattccccatcttcatcccctatcgaacccgtgcggttgctcggtcctcgtcgtttgagcacttttacggtacaatatattggtagtatatactgctagtataattaatctaacggtatagattgatttgatctttcacttaattaaattgcattataaaatttgaaagggtaaatttgtctttatttgttctaacgtttcctctgctctagctcagccaaaaaaaagtctctgttcgttccccttccaagattccttcgtcttcacgacgggcgaccgccgtcgccggcgcatgccacgccgcgccgttgccgccagccaccatgaacactagagatattgcaatagacaaatagtagattagcagtctcctgccttatggcttgcctagcgcccgatgatctatggatcgatctgcctcttgcggctcgtgcacgcaccccggattctccgcatcgccgtcgtagtcgtctcgctcgtcaggctactgctacgcccgcgcaatcacatgccccgctagcgccgtgccgccacaatcgctcgcacttacgcaaaggcaactagccagtcattctccagcactccgcagcctaattaggctacatggccagaccaaagtactatcgttctctgccattttattctgaacaatttaatctgaagatggcaaaggtacatgcagcaatagattagtacataatcagcgcatgcttaagcatggactagtcgtcacttgtcacacagcttgatgacacaagccagtgccagtacatgaccatcaggtagagatcaaacattaacactttaacactgacaaagctaactatctactgtactatgtagtatttgataccgccacacgcgcctagtctctcgtgaacacagtagcaagatgcaagggacgcggtagcagctgaagtgctgaacgggaatcgccgttgcgcgcctattctctgtcgaatcacgctggcgccgttgccatggaatcgcgcaggcgcacgtatgagaaccaacagcgcaggcgaacgagtactaattaataggattggattaactctgaaccataaaattactaaaaaatacttcctaattttttgccaaattcctaacatgctcttacaaatactgctagtatatactgacagtataatgtaccgtaaaaagttctccgtcgttttcgtcttgccacagtcctcgtgtgtcatcagcgatccactccgacgacgacgattgatgttgatgtggtgtagatgctgaacctgtgacagagctgcatcgtgtatgtgtagctcaggttgactgttaaatatgtgatcttaatttaggtctacaacatattcggattaattttctagtaaaacatgtgttttcctactaggtgtttttcttttatatatatatatatatatatacacacacacattagcaaaagtgcccgagcattgcaccgggtgattacggagtgtatatattaaccaaaagtgttgtttggtttagcaaaagtgcccgtgcgttgcaacggaaagaaaaaatgagaaaattaaattaaaacatattaaattctaatttaatgaaaaataaattttctacaatattaattacacactttgaaattttagcaaaagtgcctgtgcgttgcaacagaaaggaaaaaaacaacagttaaattaaaacatattaaattctaattaaatgaaatacacattttctggaatattagggtatttttatgttggtaggtatataattaaattaattttcaagtaaattaagtgtgagaaataaaatatgatggttggatttaatttttgttaaattttctatattaattacactctttgaaattttcttggaatttacatagcttaattggtaattttgataatacaaatatcatttcagcatttatttaaataaaaatcatttttctctatgggcctttttcaacccattttcttctttagcccgcaagcgtaaaagtctacttaataccccatactcctcatctcacttgctggaccaccggcccgcgtgcggcccaaaccctcgatcgatttgagccgttcgttttgatggacggctcagatcagttagaaattgatgaaaaccataaccctaaccctccccctcccccctacccgagcccgncgncaaccccgcacccgacgccgcctctccccctccccgtctccccatcggcgccgcttcccctcccctcccctccatcggcgccgctccctctccccatctcccgcctcttcccctctcccatgccggccgcctcccccgccaccggcaccatctctctctggcacggcgcagcgacgacggggtgcgccggagacagcggcgacggttgtccctcccactccccctctccctctccccgtcggcctcgacggcgatggcgccctctcaacggcggcgtcgatagcgacgacggcgtcggcttcgtccgcgggtgaatccgtcagcggtggcggatcctgcagcggtggctccctccgccgcctctcttctccctccagcggcagtggtggcgttggcggccaccgtttttttttttttgcaattttttccatggctattgctaactgagacggattgcgtacgaacaggacgaaaattagatgtgacgaaaggaaaaatacgaatatttatattagttatatagatatggtttagttaacatgaaattagatgtgacgaaaggaaaaatacgaatatttatattagttatatagatatggtttagttaagatgaaattcatcgttttaatttcgcttggatatatattttgttagaaaatcatgagctgcaatcgcaattaggagttcgatcgtctcaaattaacatgcaactttttaaaaatgatttcttataggattccttatatatttttaaaagcgaacaaacttaaaaactgactcaaatacggatctgtatttctaaaagcgaacaaatttaaaaaccgacctatacatgaatgacgtatcaaagtaccggcaaaaacatcttcaatttttatattatatatttttaaaaagtaaagtagtataagtggaagagaagattacggacgataatttttttttggtagtcgtagcttttctcaaggagtcgacgttttttttcttttttttcacggtagaagttttttctcttttttttttctccacaggggagtcggacgtccatttttttttctcttcgttttttgttttttctctccttttttttctaacagaggtgtcggactttttttttttgccgattgatgtttctttcctcttttttgtttttctcgctttttttttcccaaacggacgatggaaatttcttttattttttattttttataagtagtagtagatatatatatatatatatatatatatatatatatatatatatatatatatatatatatatatatatatatacacacacacacacatacactcttgttgtaagctgtaaaaaagggtgacgttactattgttattcctctacatttgtaatcaactcatcaatactgataattgccggtttgatgctcgtggttttttaccacaatggttttccacgtaaaattcgtctccgttgtgcatctattttcgtaataataatccgcacgcctcctttttgggttcacaccccccccccaataaccgctttctttttactcttttcgttgtaacctcctagccttcatggctattgtacagcgtttccctctactttaatataaatatatcccgtggggtttaaacaaaagtgtcggcggcaacggaggaggacgtctcggcatagacggagtaaattcttttacaacttgcccaaacctgcacctttttacattttagtcttttttaaaaaaatatttttggacccttcaaaaagtcttattccaagaacggacatttttctggtgctagtgacccagacgtcaaggccgaccacaccctcgcctcctacggaagcgaagctaagtcactgcggtcgtcaccaatggcattcaaccgatttttcttgcaaaaaggtatttggtgttaattcattgatattgaggatctatttataaaaaatcatttatatttcaatttttctgaatttttttacaaatagatcctcggcacaatgttattggcatcgacccctcacattagtgacttagcttcccaagggataagaggtaagagtgttggcaccaatgtcattagcgtcaagacatttgtcagcgccaatgaccctaacgctgagaaaagggtgtatttctaaaataagtttttccatatacctatttataaataagttttttttaaaagaactaaaataaaaaaaaatccagttctgcaaactccactgtacggctagccaccggcatcgttcaaaacagccgttcaaaacaccacaacgatgcagcttgtccgccctcttatcatgtgctgggcaactgcccatggtggttgggcattggctttgccactgatcatcgcactgtaagaataacgataagccatgtagccttgtattgctaagtcaacccaagccatctttgaaaaatatataggaacaagccattaatttttgttaatggcatacatagaatatcttgctcgttacatcgatagaacttaaagatcaaactgaagaagaaacaaactaaagaagatacggtccaactttttttttaattaaatatagagttttaatttatagctgcagactaacgttgatgtcggcgaaaatacttaataaattaagagccaacagacaccgcagaaatacaccaaaaagccctcagtttttggaaggggaaaaacgacatgtctatgaaaactctgatttgcactagaatggagagtagccattgtactaaaataaaattttgcccattccatagttcaatcttttcataactatcacgcaggagaatgatatagcacataccctaggagctctttttcatacccgtgcttttgcaacggggttaggagaactatgggtgaatggttttattggtttcagttttatctctcagtttctaaaaaaaaaaaaatctctccgttttattaatttttgattattttttcgtggaaacattgttttcttatgtggtggctaatatggttggagaagagaatgacgactctactctttacagcagtagagaaaagtataacttttgtctagtaaactaactagagaacagagatacacataaagccctattttgtgggtgttaagatttaaggtagaatcatgaactcgcaactccaccttcttcccacgctctattgggtttaaaacgtttttttaggtaaagttacttaaagcactttttctccgtcttaattgtgatcttgtattattgttagtttggcgccctttgccaggtccaaattaagaattacccccctgttgcctaacccaaaacacccgacaagccagcaaattaaatagttaaattttgagcataaacctattcttttagacaattaacatacctattcctttcacagagtttaaattttcgccaagcttgtacctttacgcggcatttgatatatagcgggttaattacttagtcgatcgagagctgaaattccgtggaggagaaaacgtacgaaaacgctttaaatcgggcgtccgatgccagcactctcccctatcttctctccccacccactttccccctttctctgtcttcttctctccaccattccccttttctctctcacctagcaacgagaggaagcgagtgtatgcagagcgacgaggcggcgacggtgccggagcggaggagggcgacgttgcggcggccgggggaggcggcggcggcagcggcagtgctggagcggaggagggcggcgttgcggcggtcggggaggaggtggcggcggcggcggcggagcatgtcgttggagctgaagttgcaggacttcgggttcaccttctccgaggacgacgtggacgccgagctcgtctccatcgtgagtgggcttcggcggcagcgctcggatgaggacgacgccagaaaggccccggccttcgcggtggcttccgccgaggaggaagcagccggtcgccggatcggctttgctccgaccggcgcctcctcgtcctcctcaacgctgaggaggccgcacctgtcggaggtgtgggacgaggaggaggaagaggtgaggaggatgctgcgcatgattgttgcacacacgttttttttttttttttttgcacatagtgtattcgtgatgttgcaatttgtctttttagatgtttctcagtactgtggatgttgcatttgatttctttggatgtttcacatattgtgtttttgttgttgcaggcagtgttctttgagtgttgcattcgattgaaacattttcgataaaacggtgaaacattatttagtgaaagatgaaacatccagaacaatttatgttgaaatattttttttcgagtaatgaaacattgtaacattttttaacgtatagtgcaacatcgtccggacgtccgacccatagtcctctccttaaacgtacggtacctcaccgcgcggcttacgtacgatatagaatgatcgtgcgtatatcgaggaaacgatcgatcaatcgatagccaataacgcgcgattggtatgcgcgcgcgcccggccggcgtggcgccagcgctcgcgaccggccatgtcgtcacggcggcgggagcgggacgagcagcgagaggcagccgacgagccaggccacgagcgccgcgaacagccgtggcagcggcgtcacgggcgccccgacgcccgcggcgccaacgatcacggtcgccccgaacagcatgaggtacagcgcggagaggcgcatcggcggttcagcacgccgccgtccgcgggcaacggcgagctgctgcggcggcggcggcgcatggtcgtcgttgctgctgctgccattgccgctgccgctgccagtgatgttatcctcggcagccatcgcgcggtggatcagaacgcaccggccacggcggctgtggttgtctagctacttaattaattttgtggttaattaatttttggaagcgagcgcgaggcaagctagctagctagcggagccgtatagaatttataccaccctgatcggcggttgctatcgatcgatcgaccgggatgatgatcgataattcgatattactgaccaggtgcggatgaatccgggacatcaagatggaagggaagaagcttcatcggaatttcgatcgatcgaggcgtatgtgggtcatggccgggtgaggtggccagggacgaattttctttgttttggtttacttatatctatctatcttctatctattatatatatatactaaataaaagtccattaaacttcctataaacgctctcaagccgccacgtggcactcctacaaacgctcctagaccgccacgtggcaatgtctaattacatcgtcgattttcacttaatcggtggacccaataatttagaccattagattagattagatgtattatatatttaaaaagaaagaaataccttactgttcaccagaaaaaagaaaacaaagcacatgtactccatatatccatatataggtacgtacgtagtatgtaaagactaaaaaacaatcaataatcttacctactgttcatcgtaaggaaaaaaaatacacacacacttactataaaaaaaacaataaagccaaaaaaaaactacgtacgtactaccattaaaaatctattatttttaagatagatttttttctactatttaaagataaaacctattactctataaatttaagcaaatataactgtcgattttaacttaaatgggtgaatctaatattttaaccattagattagatgtatattattttaaaaactaataccttattactatgtctacgtaaacgggagaaatatataactgttaggctagaaaaagaaagaaatcacataatcttatcgtcgtttttcacttaaataagtggacccaataatttggaccattcggttagattagatgtattttatttaaaaataaactaataccttactgttcaccagaaaaagaaaacaaaaacaaaagtatatactccatataggtacgtacatacataagactaaaaaacaatcaatcttacctactgtttataaaaaaaaaaactatgcacagacttactatagaaaacaataaagctaaaaaaatatacatacatagtaccattgaaaaaatcaattatctttaaaaatggagtattctactatttaaatataaaagctattactctgtaaatttaagcaaatatcaccgtcgatttttaacccaatattttagaccattagattatatttattttattttgaaaacaccatattactctatgtatgtatgtatacgggaaatataagcagtcagtacgtgcaaatgacctgggaaaagaaacgaggtttacctactgtccttcggaaccaagaaaaatctactcacggtggttttctgaaatagtattttcaaaatcacttactataaaaacaataaaaaaatatgtatcattggaaaaagatcgatggtctttttgaattagtattatctactatttgaagataaatatattgctctacaaatttatgcaaatatacgtagttaaactaaatttatattataaatataaaatattccatcaatgatctttattcgttctatcttaacatacaagactaatatatataataattaatgctatgatattttttatttcatatcatattttaaggtgtcaaatatcacttgatgaatatacaacgctaatttaaatgaaaacaatttagttgtttcattttacaccattagattagatttattattgacaaataatacaactctcctatatacggatacatgaaaaatatataactgttgatcggaaaaagtactctgtacgtagttatgattgaaaaaaaacaataatgcttacatatcgtctgacggaaggaaaaaaaatacttatgataaagtaaaacaatcggaggtctttaaaaaatatttttctacaatttaaggataatacctaaaaaacaatttaaggataaaatataataatcttcaaatttacacaaatgtaaatataaaatatccaatcaatgattttaagcgttctatcttttaaattattttaaaattatatatctaatttgtgattcagttgtattcctttaaataaataaactattaatatctataaccctaaatacatcacaaatatggagccggcatgtaataattaatgttatgataataattccacatcacattttagtgtaagaaaccacttgacgaatatataacgctaatttaagtgtacatatgtattatccaaattactaaaggtgtctcatgtgattagaacaataggtgctgaaaacaaaacggacactgaactaacatgcactaccctatagatatttgtcaaagtatgataccgtactttggattatcgtgatagtatttaaaaaaaatcactttctctcagttacatataaattcttctattattttgggataaaagttaactccttcgatttatgtgacggtggtaatataagtctatgtttaattagatgaagtagtatcatcagctatatttttaataataaatatctttcattaatatatagtaaaattaaaatgttactttaagtcatctataacatacacaataaaaaaagttatataaagttgggaaactccaaaaatttaaaagaaagaatcacacataatacaaatagatatgaactaactccattattgtgacatattttttctaataaatttgaggatatacattttcaagtaatacgcccaaaccagttattaacgaacatacatttcaaatagagacaaaatttttttcaaaaatatgatccacacataaacattcgtaataaaagttcaaacaagat

SEQ ID NO: 68054 - DNA, 4773 bp, Oryza sativa
  unsure (1)..(4773): unsure at all n locations
gggtactcgcatgatgcggggcgtcatctccgggagcggcagcgcgatgtcgacggacgcgccctagccatcgcctccccgagctcgccgtctcggccgctagtcgggggcgctcgatgatgccgacggcagtggcggagacggggatggctgcgctcggcggcggcgcgaggcgggaggcggaggcgctcggagacgacaacgcgacgacggcggcggcagcggcgggggaggtggaggcggcagcgcgagccgacggggacgacgatggctacgttgcaaggcggaggcgggggcgcgaggggaaggcggaggcgacgacggcggcgcgagggggaggcagacgcagcgggagagggagagggtgggatgagaggtggcggcggctagggttttttgggggaggtggacgcggccgcggcggtagaggtgggcgcggccggggggcgcgaggggcaagaagcggcggcgcgtggcggcgacggcgggagaggggaagggagaggatgagggtgtgtttagttgagaaaatgaaaatttttgggtgccacatcggacgcttgaccgaatgtcggaaagggttttcggacacaaatgaaaaaacacacctcataacccggcnaaaaacgccacacgaatctnctnaaccaaaaaaacccatcannagnnaannangcncaaaagattcgtctcgtaatttcctccctaattgtgtaattagttttttatttatctacatctaatgcttcatgcatgtgtctaaagatttgatgtgatatttttgggaaaaaattttggggaactaaacgggcctgaggagagacgagagagaagagggcggcggcggctagggtttggggcagttagagttagtgcgcgtcgctttgcggaaaagcccctcgtcttttaagttttacatcgctgtccttactcgcgatttttccctcgttttaatgtatatccgacttttataagggtctcgacctaaaataacatctcacaggtactgtttggagggagctatttcgaattacaaacaaattggagggctttttcgaaaaatcaccaccgcgcgcactgttcctatcctacgtggcatagccgagcggacgccccttccgccgctcttaatggtttctaatgtgtcatttattccatactttgcgctggtaaaagttgctttttgatattttattattcttcaggcatatgcgcgaaccaaacgcacaaagcttcagcctgcctgatgaggcaagtgttacatctcccaacgctgcctgtccggcgtgagtttttctcaggcgtggccctcaggacacaaaccaaacaaccccttaggccttgtgtattatttacaagatggaaaaaaaaggaaaaagttcacttgacgtccctcattttgtcgtcgagttttgtaatactggatataatgcatcccgaatatttgcaaaacggtcacattaggtctgaagacagtatagctcccaaatttagttgacgtggcatgtgagtcagtgtgggacccatatgaaccccacatgtcagcaccacaagtccacaataccctcttccattcccatcccctctcttcccatatctctcatcgtgcggcatgggcggagccctagttgacctgatgaagatgctgttgctccttcggtgaggcccgtgagaagctttgctagggtttatccccgcgtcgccgccccaaaagatgagaccaccatggccgcggtccagtggtggtgttgttccagaccaacatcaccaaggctgcgcgaggctcggcgccacaacctccatcatgtttgccatcgctctacaacattgatggcaaccagcgcgccgtcatcttatatcggttccgcggggtgctgccttggacagtcgagaagaagcaggtggcatagcaggaggccgagagcgctccaattgcctcatcgccaaggctgagcaagaaaggcgcccgtgcatcatgcacactgaaggagactgttaataaccaaatttagtaatctaagtatcggagatgaggatgggattgaagcggaattcgagatggaaatcgtcatgaaaacagagtacggatcggctgaagtccgaatcggctgcggttggggtaggcagagttcgagtcggacgaggttagccgatcgagccgaatccggcaacgtgacgcggtatgcgttgtcgggttgagctaacgaacttcatgaggattgccacccatggatagagttttgagaaggcaattgtatatattaattaggatatttcatgtaatttccttagagatatgtttgggcaaaagtctgccgcaaagacttatggtatcttagagtttgttagaaataagagtcgtgtccgacatggacatattttgtaatctcaggtataaatagatcccgagccctatgtaatcaatctaacacacgttcaatacaatctcggcgcatcgccacccttttactttcgttttgtttcgacgagttcttgcttttgggttgagcccgcatcggtttcgatcttcaactagaggtaaaacttgttatggcggcttgcgttctcggtattagtgcttacatctttatgatactctaatattgcttatgtaaatcgtcgagttatcatatattttatgtaatctccgtcaatatcgctatctaaccttcaatcggctaatgtctgttactagaaggcagtcgattaggttaaataccgacgttgacttagattacataggatatcaaccactctatgaaacatccaacggcttgattgtctagatattgtccttattttcatacttatacctgcattagttgagtttgatcttatgagtcgtgattagaatctcaacctctagcctgtctttggttgccgattagggtagcatcgggtttcagccaatcttacctgatttaactatatttttcttatatgcttgattgacatgttaaatctgccctttatattaagatcttgttgcatttaggtatattaggctttcgtttggtatattctacttgctttaatatcttaatatagagtggtatcggagtattagctgatacatgctagatctatatgatcagctatgctatgaacatatatagtcttgttgctaatatatctttcgatctaagtaatttatactgtctcggcatggcgaccgatctatcccaataacttgatttaagtatatatcgacataaggattatatattgttaatatctacagccaatcgagtaaatttagttctttcttacttattcacgattgccgatcgatctacatatgacatcggctcaaagataaatgatatgtcatcggcaactagccgatcagctatcatttatggatttaaccgcggttctttgtctttatttcttgttgattgcaggatcaaattaactggcacggtcatacacttaaaggcaagcttttggacctgcactggagttaagcagatctccaaggcctcgtgtttttacatcaacagagacgtagccgatgatccttaatcccggcgtcccagcaaaaaacgctttccgaaccattgaaggagttattttgcactagttttcagagacgggggagatgttataccggttttatggttgagggaggaaattcaatcaggaggaagatgagggatgacttattccaaagggatggggagagcccttcaagggcatggtctgtctgatgggccgcgttagtcaaaaacctgagcagaagtaaatgggccaatcgttctgcatttcacaggttctgggctggaccatagaaattcaccgagaagcgactcgaaagcagtagttcgtgtcctcggaacgaacacgtattttctaatttacgtgtctcccaatcgtagccgacgacggtcggtagctctctttggctcctcggctcctctccatttcccatcacccggcgctcgcatcgcttcgcactcgcccaacatggcaagcactgaagcacccacacaccctacctccacacgccatagctcgctctcccagcgtggcgcttgccgccgccgccgccgccgccggcgggatgatccccttcaattccgccgtagccgaggatgtccgctccctggtgcagggcgtggacgactccaccttcgactccacccaccgcgagctctgccaggtaaacgcgagccgccctgccccgccccgcccgggcccgaaatccacggcccgaggtgcttcgtttcggcctggcgttttgcgcggcggcgattggttcgtgccgcggtcgtagatccgccccccccccccgtcgcttggatttcgtctttttgaagcgcctcaatcttgagggctgatctagggttttggcggatttatctgtcttgtgggtattgacgaggagcgatactagggcatcgcctttgatgctcttctccgcgacttaatctagggtttcggtgggattcctcacgattggataacgtgggatgtgttggttggtgttttttttttgttgcatagatccctcaatgtggtgcacgtgttccatggttcaagtttctcagtttgatggtcgtgcaaaatttactcttgggttggaataggacacttaagctttggattgttttgaatttagcctgacttgtggtcagatactcagatgagaattgtgttaagatgcatatgtttgtgaatttgtacaagattttgcattctttgtcattgcagatgtcttgggatgtctgtcttatgtttatacttacacaatcaactccgctggggtgcagg

SEQ ID NO: 68055 - DNA, 43805 bp, Oryza sativa
cctttactggtaaagcaacacaactgcagaatcttatggacatattgtccatggaattttatcttatcattgtttttttaaaaaaaaactttgggacaggtgcattttccgtatttgcaagtacaacaaggatattaaggcattggaggagactgagaaacgcctcaaggaagagtagattaatcacacttacaggtctgccaataacttagacaacacgttttcaatggagcatatggctgttgatttaaaatgtcgactcaacaatcttttcaaaaatcgagatttagtttattggaatccttttactagatagacgttgaagattcttgttttagacttgtgttgatgtatttcaaggagtaggcttagctgagaacctagatcttcacctaataatttggtggtgatgaaacttggacatattcaccattcacctcattcctgtcttgcaaattataaagctaggaaagaaacaaaatcatttccatttcaattcaaaagaatctgatgtttgataaaccatgctggcatgccattgattctgatcaattctgctctgttgttcaaagttaagtaatacaaggggttgcatgaatttttaaatgactttgttattggctgccatgcttgcgaatacggaaatagaattacattgagcactggcattcatttatctttccttcataatcacttgctgcaccaacaattagtctattagacaatgcttaaagattggttccagtaaaggctgaaataccaggtgctagtggtgccatacttatcttgtgtcaagtagatgaatgtgatgttaccatccaactgtgcacaaacttgcaataatttgacatgggaaaattgatggatcgttccttctataatttattgatgcaggtggattttgtgctattcctgtccttcagatgtatgcagatagttatgtgggattcccagtgtatattgttcgccttgaggcaaagaaaatgttacgctgtttcggcacatgattttcagtacgatttctcgtttaattgtaagtcgtccggattctctttttttgtgttttaacttgggatgatgtcagtacgatttctcgtttaattgtaagtcgtccggattctctttttttttgtgttttaacttgggatgatgtctaccaagaatacatgagaaccactgaaccctggtcatccttcaattcaaccgtttgaacatttgcctgcatgttgtctgaacatccatttactggcttcctcgtggtcatcgttgttgaattagtctggtatgtgtttagaattgtacatgggactgctcgatgcatctagtatgtacggcgtcaaggtttctgaacagttgaaccaagactcggtcttaaacctacggtagatatgtactttacgttgcagcttgcaaagggcaaaggtttggagtaccccatgtatcagggcaaatgtttccagctgttttacgtttgccaagcccacggatttattattatctcgtagactctgttatccttttcaccattctgactaattcacggagctttgcaatggaacggcggatgagaaggtatgctattcatgtgcagactgcatatgtccgatgagaacaaactcgctctgtatctgtaaacctcaaactgcagagaaaccacagtagatactctcttacattgcatttggaaggtcttcttacatcgaggcaggtacgaactgtttccgttgtttggggttaggaccgggttgatgtgaaccccttccgaactgcacgacacggcggaggaaagaacagcttgcttagctagctctacctgtttgcacaccagaaagagagcgtacggtggccggaagaaatagaggaaaagacgccgtcgtcttctcgcgaacacgcggtagtcgcgtacccgcgcgctggagaaaccgtgttgccgcggcggacacagcggcagagtcatggactcggactctcatgggaatgagtataaacactggcatgaacaagttctctctgctgcaatttcttcaaaaaaatgccagaaacaaattgccagcacctaacatgaacaggcaaataaacaagtaaaaaatgccacacaaatttctgtagtatgagaatacacgcaacgaagtagttaaaaaggagaaaagaaaaggaatatagcatttttgtttctctaaacgaaacgtttcctctcatatgaaacgcattttgctgcctactccagtcacacaatgcgtgcacgatatggaatagtttatgtggcgcaaaggagcgtgtgacggtgtggagcgtgtcggtcttagttaaaactgaatggcgtttggtccgtgcctacctccatcagagaccaggaattgactggaacaaaacaattcagttgctcaaacataaatatatttataaatcataaaacattcaacctattggacgggcaatcgagtgaaattgaatgttaggtgaattcacctaaatttcggtttccacgtagcaggatagaccgagcatgggaacagagaaaaggggcgcatgaactgaatcctgttgacccctcccggttttgtctaatgaagctaactgttgtctgaagctttggcattttcagtcgtttgaatttgtttgtcctttaacataacttctggcaatctagaatcagcatcagctcttgcaactcttcacttgatatgcttctagagaaagaaaatgcaaacacaaagagatgttcacagaatttaaaagtagcaaatgaattcatacatagccagtcataaagtccactggctatgtacatcctctcatgaatgcagagtccgggtttcataatcctttttttaaaaaaaaaaatccattgttagatatttcctccgtcccaattcagattcatggtaatgatttgatttttttaaagacaaatggtgtatcttccaaaagaaatgctccctaaattgacaaacttagctagcttagttgaatgatcacactgatgtggttaaaaaccataatgaccattactcagtaatctgtaaaacacggattaatgaaacatttcaagtggctgtattaacatgtcaccatgtatttaattgctaaaagaagtcagtgatgtatagcttgtattaactgagttgctttcaggcaatccatagtggtaggaaaagtacagctactgtttggtaagtagggtctaatagcagtacctgtgatttgacctagctaattaccagtataagtttctagagtagctcacttggtttgagttagtcttaaaaattgaagaagttggtgtgagttattcctaggtttgaaaatgcgagatgtccacacatattttaccgccgcctacaaatctacaaccaccagtgattattctgaatgatcggtggtggcattatgaaagctgcagcgatcagctgaattactcagatgaaagaattgcaactgtactccctccggttctataataattgacgttttagataagattgaggtcaaacttttataactttgaccatcaataactttaaaaatatttagtttaaagaaactcgaacaacatatataaatttgtctttcaaaacactataaaaagtaaacatatatttatttattgtgtatattataatagaaaaataaggtcaaagttatattttgtaaaccgtgtcattgtccaaaatatcaattaaaatgaaaccggagggagtatttctcaaaagaaatttcacagccactgcataagatttacttcgacttagccggtattccgagcgaaagttaccgtactgttcgcgcaagtgacgaactgaatacaatggtgacaaaagcaagcagttgcataaacaacgactggactttgaataattctagttttataggatgaaccggtccttttcttgcatgattatagatcccggttagtatcaccttatcctagtcaagaatgtggaaaaaaacaattacaaaattgaaatcaaagtgacacacaaaatcaattaattattccacatgccatttggtatgaactcatgaaccataaaaaactggacctatgtatgaactacattcacacaggatcataaactcctaaatccttcaaatttaaaagaagaaaaaaaaagaatacggcgtacggttaagttcattatggtggaaccaacccacccaaattttaatcatagacttaacactgatgatcatacttacagctaattatttttttagtgacaaacatatctgtcgacagcaaaacacccgtggtgacttcatccacatgtcagtcagtcttctggagataatatatgagtaaagtatacatgtgcgttcatatgggtgaatatatgcgtgatatgagcacctatgtctatattattttctcattcaatgctttcttcgtaaaaaaaacatattgacggagggagtactacctcctttctaaattagtggtcgttttgactttcttcttgcaatgtttgattatttgttttatttgaaaaattagtgcaaatataaaaaagataagttatacttaaagtacttttgataataaagcaagtcacaaataaaataaataataattctataattttttgaataagataaatgatcaaacattacgaacaaaaactcacaacaacaaatattttgggacggaggtagtaatacataagaagaagaagaaatgaatgtgagttggcatttactttctccgtcccaaaaataagtgtacttttacactgttcacgtctaacgtttaaccgctgatcttatttaaaaaaaatttatgattagtatttttgttgttattagatgataaaacatgaatagtattttatgtgagacttacttttttttattttttttcaaataagacggatggtcaaataaataatatttctataatttttgaataacataaatgatcaaacattataaacaaaaactcacaacgataaatattttgagacggatacagtagtacataagaagaagaagaaatgaatgccgagctggcatttacttagctaaagcacagcgtttattaactcggtagccgttccgaccgtttcctcccctccctctcccgcggtttgcaaggacgccctctcgttcaaacgttcgtctgttcaaacgtcaacctttccaattcaaacaatcaaacccctttacccttctcccaacctcctcctatttgaacccttcccaccacctccagtctcccgtattgaactcttctcagctcaaagccttacaccacaacacgcagctgttctcgctgggcttctcttcttgcgctgcggtgatcgatcgagagcttgggatggcgctgctggcgcggagggcgcggaaggcggtgatggcgaaggcgccggcgccgctgctgcagaagaggggtggcggcgcggcggcggagctggcgatcccggcgcacttccggtgcccgatctcgctggacctgatgcgcgacccggtgacggcgccgacggggatcacgtacgacagggaggggatcgaggcgtggctggacaccgggcgcgcggtgtgccccgtcacccacgcgccgctccggcacgaggacctcgtccccaaccacgccatccgccgcgtcatccaggactggtgcgtcgccaaccggtcccgcggcgtggagcgcatccccacgcccaagatccccgtcacgcccgtgcaggcctccgagctgctgttcgacgtcgcggagtcggcggcgcggcgcggcgcggcggggcgcgccgccggggcggtcgccagggtccgggcgctcgcgagggacagcgagcggaaccggcggtgcttcgtgtccgtcggcacggggcgcgtgctggccgcggcgttcgagtctctcgccgccgccggggaggcgggcgttctcgaggacgtcctggcggcattggtctgcatgatgccgttggacgaggaggcggccagggtcttggcctcgtctagctcgatgggttcactcgtcgccattgccaagcacgggagcttggccggaaggctgaacgctgtgctggcgatcaaggaggccgtgtcgcgggacggagcgttcgtggacctggcggatgacaaggtcgacaaggtcgtcgacgcgctggtcgtgatcatcaaggctccgatctgcccgcaggccaccaaggctgccatggtcgccacctaccacctggcgagctccgacgagcgcgtcgcggcgagggtagcatccacggggctcgtcccaacgctcatcgaggccctcgtagacgccgacaagagcgtgtccgagaaggccctggcggtgctcgacgcaatgctcgcctcgaaggaaggccgcgcgagcgcgcggggccacgccctcgcaatgccggccctcgtgaagaagatgttccgcgtgtccgacgtggccaccgagctcgccgtgtcggcgatgtggcggctcggctgcaaggcctcctccggcgacgaggaggccgccgcgacggggtgcctggtcgaggcgctgcgtgtgggcgcgttccagaagcttctcctcctcctgcaggtgggctgcagggacgcgaccaaggagaaggccactgagctgctcaagatgctcaacaagcacaaagggttgggggagtgtgtcgacgctgtggatttcagagggctcaataggctgtcatgaattgagatcagtgttcagaatcattgtaaaaatagttgcgagcagctaggaaatgcagattgtaaaaatagttgatggggatttttgcggatgtgctttccatgctagattgtaaatctaattgcaaaaacaagtttcctactttcctcactgtaaatattttgcatgtaaattccttcttttactgcccatttgacttttgcacgatttttttaaaatatatctgtcgttgtttttgtggatgagatttttcacatttcgagccaacaacaatcaaatttgatgcataacgttcatttgtcctagtgtaaccaacaccaaccggatcgccgttttcaattaaaaaatgaatttgagtttttattatccactaaaatcaacattccagtcgtaagaagaatcttaaacgttgaacacctgttcctccaacccaacctgcatgaggcaggtacaagttctcagttctcacctttgaaaacttcggttcaagcttggacgaaagcggctgtggtcggtcgatccgagcgtgacgacccggttgacctccacggctcatccaccgcgcgcagcgctcagcctctcggtcaggaccgcgcgacaccatccagaattttgacctctcctcccaacctcgagcacgcgctatgcatctgcacgtgaaaccgtgatatttcacgccgcggcgcgccgcactatgctcctcgacctcgacggctggctaagccgcgttcaccgatctgctctcctcggccggcgcggcgctagtgtgtgcagcgtactcctcgacagttgtggtggtggattgggtggataagctcatacgcacgtacgcaacgtgaaacacgaccccgggggggggggggggggggggagtgttgccggcctggacgtccctctcggcacacgcggcggctctccccgggaaattattctaatccctcgaggggatgttccctcgtttgctcaaaaaccatctaaacagttatgaaaaacttgataacattcatacaacacacacatatatatatgtaggtaaattaactggtgctacatggagtatgggctccaagattcaaattgagtatatacccaatttgaatgagtatgaatttttttttgtaaatgtttagatatgaacattaacttctttactaacaagttcaaacaagtttgaactaagtttaaactttttttttgttagattttggttctagatatataacatccaaacatataattcattaggtatgtaataatgaattgtgaaataaagttgagtttgagttgttttgttgttaggtatttgtatgaatcaatttcatatacctaggtatatactcacaatttgaaaatttttaaaaatttgagagaatttgtgtgttttataccttggcccgggcaccatggagtcccatatgggtatcatatatatatatatatatatatatatatatatatatatatatatatatatatatatatatatatatatatatataactccataaaatcttaagtccaaactcaactcacacgtcgacatataaaaaagacaaattcagcatatgaataatatcgtactgtttatatttaaatttgcctttttttttctcgatgtgtagatcaaatttgaatataaattttggtggactagtaggtatcattatactttacattgccaattttttatagaaattttcatagctatttatattaaatttgaaaaaaaaaattatgtacgagggatgtcccttcaagagattagaatccactcccggctctccccaccgcgccgcccgcgctccagccagccgaaccgcggagcggagtctggtcgaccgcgagtagaccgcccgtcgccattctcccacgacgcggtcgccggtggccgtttgggccgcgtctcggatctgagtcagaatgggcctaatggagagatgggctgtacggagatggacgttcgactcggtctagttagactgggccgcaggtcaataaaaccttttgcctagttgtagtccggtattcgtccgaagaaaaagaggtaaattgcagtattgcaccaagactactagagtaataataacgtaattacagatcaaggttgggattttgtaattacgtccaaggttgaaaatcccaaccatattcccgtgaggcgttgctaccggaattcttccaattttacttgctgcattcaatgttttaatacaaaaaaaaaacttatgtgcactcaaggttttaataaaaaaaacttatgtgcactcaaggtgtatgataaagtagatttacatgagtagaacagaaggccacagctctttttatcaacaactcaacaacaattccaaaataaacagctctaacttgtcgtctcagagagctgaacccaaccaaaagaacaagcgcccgcaggcccagcccgtttagcccacaagaaaaagcaaaagacaaaactagaaaaaaaaaagagaaaaaaaagaggaagagtgaagaaaagaaaagttcatctcctcctctccttatcccttcccttcaccaaaacccccccgacaccgagcccctcctcctcgacctcgccgcaaatcctccgccgctcctccgccgctagggcataaccgcccgcctctcgccggcatccgcatctcccggtaagcattccgtccgagtctccacgtggtcctcgcggccgccgccctgcgccctgtccaaattgggtcggggtttctgatttgattggttggtccatgtgttaggggaagggaagggaagggaagggaaggaaggaaggtgagggcggatatgtcggcggcgccgataccccgcgagtgggtggggctgcagcagtttccggcggctacccagaccaagctgcacgagctcctcggcaagctcaaggaggaggtattacacgcctatgcaaacgcttcttttatggactggttaatggattggcgatgattatatatatcccgctcttgttttacgttgttagtaactggtggtaattgtgtgttttgttactccgtctgtgatgtgattgtatgttttactgctttgtttgtgatgaagaatgtgagcacattgacaattctggtgatggggaagggcggggtggggaagtcatccaccgtcaactccatcgttggcgagagggtcgctactgtcagcgccttccaggtaatgcttcttccaggtctgatttctattgagcccataaccgaagttgcgtacttatgggtgtgttgatgaatgttttcctgtacagtccgagggtctcaggccgatgatgtgttctcgcaccagggcaggcttcaccttgaacattattgacactcctgggctcattgaaggtggatacatcaatgagcaggctgttgagatcataaaaaggtaccaatcttgagttatagcgatacttgtctttaatcaatacagttgcttgcatgtaccacaacatcttgtttaggatttgagatggtactataaccatactaaggttgccattttgacctagggtcaagggcggatcgatctgtagtatattttcttggaattaggagcttttatgtactgaaatcggcatcatatttatgggcgacacatctcagaaacattgttttagtttgtgtttccactttgccatcctgtggtgtaagaacgagacaggaggtgattttatattattcttgattttacaaacagaatctagggtgctgtctgaagagtcttgatccaatattcatgttaaactgtttttttgtgcactatactcacattactctgaagataacctgttggctttgtaattttgttatttttttaatatttgtatgattttctggatattccagtttctgtaaggctcccatcagatggcctaataagccaaagaaaaagccaaaatttgaattttcaagcttaattttgagattgattttgagatattttcaacgtagtttctttttcaacattggcttttaagtcacaaagaacacatttataaaagttttacccacaaattcatttttatttcctaataagccgttttggcttattaggaaataagccaaacgatggggacctaagggtataatagtctctaggagcaaaccctgatggttgattggttaactactgttgactgcacatcaatgcaaaagggaaatggatgactagtaatggaggcgaaaaatagaagtgcaactcacaatgttagagagagtgaatcaggttgcaaggagtgacaaaaggaaaattctcttaattattaacaataactattatgaatcaacacaacttttctttaggttgctgctcataaatttgaccttcgcgaagttttcattatgctgtcttcaaaagttctattcctatacaagtcatatgtgttatctactgtatcgcaggtttcttctgggcaagactattgatgtcctcctttatgtggatcgattggatgcatacagaatggacacgttggatgatcaagttattagagctgtcaccaattcatttggaaaggccatttggcgaagaacattggttgtattaacacatgctcagctctcaccacctgatggacttgactataacgatttctttacaaaaagatctgagtcacttttgcgatacattcgtgctggtgcaggagtcagcaaacgagaacttggggtaatgtatacctcacttgtcttttatatgggtattatcggcatatcaagattttttttttttttttgcaatttatctgcagcttcctctgtctaaactaatattttttcttcatgtgtattatttgacatgctctttcagaacaattattcattttctgtcctgtgttgttgctgtttctttgctgatctggaataatagaacacatagtaatctgtcatttcccttctccttgggtctatttattttgctgtgtaactaacacactctcttcagttcatctgtaggttatgtatttatgtgttaatattattctatgaatcaaattatcttttgaagtcactgattttgcatgctaaccgacgtccaatgtttttttaccttgaaatttagtattcatgttatgaacctgaacctccgcttgttttggttacttatagtgtctcagtcaatgatactccctcatgggtctactgttgcttcaaccttctgggttcttgagtggctagctttaaattgtacactttcttatgtttccaacttgtctgtttgcaaaatgctacaacaatatggctgtttgggtgctaagtttctggggaaacgtggtactttccagtttgcactctccaacacgagatatgcatatgtcacattgcatatggcaagtatacaaaattacagatggagttgaactctgcagaaaaaagaaaattctcatcactagctaaatgtgcatcagtcttaggttacacaaacatctttttctccaacctgcctttttgctttctggcatgctctcagctaaatgtatatggtgcatcactcttaggttacacaaacatctttttctccaacctgcctttttgctttctggcatgctctttcattgcaaatggttgcagaattaacctgaactttttatttctctgtgtactacagaatctgtttggaaatatattatttcctcaggtgtcacaaacagttgtgcttttaaaatctatagtcctttttctatactaatgttaattgtaataacattctgctccttttaggattttcccttgccaattgcattggtggagaacagtggaaggtgcaaaactaatgagaatggagagaaggtttgactatctcatcatcatgtttggcttgtatttgaacatgtctagcttctaggtaattgaggatgccatacaactgtatcacaggttctccctgatggaactccatggattccgaacttgatgaaagagattactactgttgtctcaaacgggagcaaatccattcatgttgatcaaaagctaatagatggtccaaatcccaacaatcgctggaagatgttcataccgctcatccttatggtggaggttagctcctttaaaacaaaacagttctaaatctaagcacagcattttcatcttttgcctcaacataatgcctcacttatgtttaccatgctcttctccagtactttttggttgtaaaaggcatccgaagggccattcatgctgacatatcaaacgggaagctagatgactgggaacagcgttacagagacttggttggaagcaaggacccggtagaccagaaaggttcatcatccggcaaccgcaaggcttgagctgaagaatgataccgcatgcatcgtgacccattcaattctctgtgcttttctttttgcgctctattccagtgatctatttgggaagctttatagagttatctgggacaatttgagcaaatttgctcttgtttttagttgctaaaaaaactgtactgaatttttttgtgctgtcgcaattttgcaaatgttgttgatcgaaacttcagttatttgagttccttgtgatgttccatagtggccgcctgaccatctggcacctatgtattgttgtgggcttatagcaacatggcagatccaacttcgaagcagaggtgggcttccattgcatgctctacaacgaggtgtttccaaacttccaatggaggttggctcaggcaagttagcccgtgcaggtactggactactggttaatgctgagtggtatcacaatataagcaagcaaaattgactgtaatcacaatatacgcaagcaaaaattaggagttcacttcaagaaacacagtgatcgccaacaaatctagtcaggtactcggggtcgtatgggcaactatgtgctttatattgctatcaatatcgattttaaaactgtatttcggcataaagaatggccaaagaactagcttcaaattgaaaccataaagcattgcaagatgttagctaaagcttacaaaatgattcaaaagtcaagtgggttcatcctacctgatccaaatacccaaaatgataatatgcaaatataggggcatactccagatcaggaaagaaatactttcccgaaacccaagtctttctaatgcaatattacaagtatcagcataagcaaaggcctactgcggtggcttttgtatttgatatgagttacaaaagtcttggtatggcttgaaatcgttttgccatgctaaaaattgcttcttcaagcatttatatactttttcctcagcaggctgtatgtctatagctggagactcaaatttcatcctcactgggctgaaatcaaacaaattggatgcagcttgctcaggtccagaatgaggaattccagctcttccacaaacaaatgtcataaagttttcatccataggtggtgctgtaggagcatgcaaacatgaagggtcatctagcttctgtgtttgtttatccttctttctagcagcctcatcaagagtgggcctatcagtctgaggctcataaacaaaatatggtttatcatctttcacctcttgtgaagcagaccatccattacagttatctgtattagcaattgatatttcaggaacaaaggcttcaataacttctctgcaccgatggcttactgagctggaatcttcccgagaagggctgtctatacccttgttgctatcttccatcgcgagcagaacaggtatggggagtactggaccaacaagagaatttccagattttgctttgctcgtcagattccaactaatgcttgaagattttgccaacaggtaaggccgaagtttattactatttgggaaacatgcaggaacttccagatattcatatatgcgctttttattggtgcttgcaagcatgtccttgtatttggagaaggcaacaagaaggatatctgaagatagtctgctcaatatgctttgacatgcaatttcgaaaatgttcatgggcgcactagcattgcataggaaatctgaaactgactgagaacaagacgcagagttatcctttgcaaatactgatacatcttcactaataataatatggcgggaacgtttgttgacatcagaatcatgattctccaatgagctgcgcagattgcccttcagaaatttagataggtaatgcaacttcagaaactcatatctttcagaaaaattttctccgtgagtgtcaagagaaatggatgagctagaacccacagacttatgttgtgattcatcacaaatggcatcatcatgtaaatctccagaggcacggaacctttgcatctctaacttccccgatgatgttaaacggatcaaagcaaagccagtgaatgatgactccaacattgtgttcggaagcacgtggtaaccaatgatgtagttcctaattagttgagatgcagagccatgtcctggaacgacccccttgaacacctcttccataagtccaatgctgcagctgcagtgctgacctatcaaagaaatccgtgatggaagatcccaagcatataggggagcattttctgtagcgtcttgctccttagggccacaaaagaatagattaaattcagtgctccatagcgaaccaaccagaatggcaaagcctgaatttgatgcccactcatgctccttagaaggcctcagttcagataatcgaaacatagcaatatgatttgggttatcaagcccatgctgccaagccaacacgggtatcaaaggccgtctgatatcaaagaccatcaggtgacgctctgtcaccaccgatataagaaaatcatcaaacggagccttgcagaatgcaaggtaacattgagtcttgacaaaaggatcagtttcaaacaacccttccatcccaactcttgctaaaaccttgtattcaccatgatccccaaatctcatatcaaccaaaaggatggccgccgtgctcgcaacgatcactgtccacggttgcgccccgtactcgcagcttagccagtcccccaggtcatccttgctgccaaaaccaaccttcatcttgcctccacgccgtgtatccagatcgaaccagcacagctgcccattttccagcagcactacacactccgactgcaaatgcttgctccagcacgcgtgcacaacagcagcgtcgaacgcctgcttggccgcgggcacgagcgcgggggagccagaaccccgcgactcaaccttgaaccaattcaccgagtacaacgtcgcagcaagaagaaacccctcgatagagctgtcgcgtgaccgcgacggccacgaggaccaggacgccgtggtggcaagctgctggatgcggtgcctggggtgcatgaacccatcgctctgcacggagtgggagagcggcgtggtggggtcggcgacggggtcgagggtaacgtaggagacctgctccgcgttctcgccggaagggaagaagacgacgagggaccgcgaggaggagggggcgcggaggacggcgagcaggttggagggcgccgggaagggcggggacggcgcggtgagcagcgcccccgagagggggtcgaggtcggcgaaggggaggaaggaggtggagcggacgaagtggcggaggaggtggcgaagcccgcgccgggaggggtgcggcggctggaagggggaagggagggcgaggagcgtggcgttcggcgggagcggggagaagaggaggggcccgtatgatgcggcggcggcgaagaacgtggcgagggacggcggcgcgaagacggaggagacggggaagaggaagcgccagtcgtccgagaggttcattgccggcggcgccggcggacacggccgcgcgcgcgcagcgcttcgaagggatgcaggcgagtgagtccgggaggtcttctgtggggagttggggagaaaacgacggcgacggcggcgcgggagaaagatggggaaggttttgggcggtgcctcggtcgatcgccgccaactctacaatatcgttaataaataaaaaaaaaaaagtaaagtccatcaccggtccctaagcttgtaccgttgtgtcatcctggtccctaaactcgcaaatcaaccgttcagttcctcaaacttattcgattatgttattctggtccctaaacttgcaaatcactcgtttaggtcctacaatttgttcagttgtctcatcccggtccctaaacaggacggtctaaaaactttatatcgaaaaataattcaaaactttttcatgtgaactctagtgaagataaactttatatcaaaattgtagccctcgacgtgacctacaactttgtagttgaaaagtttttgaattaaaactgtttagggtcccaaaatattgttgcatgtttatagattttgaaattttaattttaatattacattttgggacaaaaaatgacttaaaataaaaaaaattcaactacaaagttgtagatcgcgtcgagggctacaagtttgatataaagtttgtcttcattagagttcacatgaaaaagttatgaattatttttaaatataaagtctttagaccgtcctatttgatctagatgatattcaaatccaagttaaggaccggggtaacacaactgaataagttggtggacctaaacgaccgatctgcaagtttagggacccggatgacacaatcgaacaagtttgaggacctgaacggtcgatttgcgagtttagagaccgggataacacagcggtacaagtttagggaccagtgatcactggactttactcaaaaaaaaaaaactctacaatagcgatgaaaagttgaaaatggttagaaaaatcacgagatttcgtgaaccggttcgaaaattgatcctgaggggattttcgaatggttttccataaatttgaattcgaaaaggaaaattcgaatgaaatttgattgaaatatgtaaaaaaaaattagttcagttttcttgtgaaatatgtaaaaaattagttcagtttttttgttgcggttgaatttcgatgtagtgatacttgtgaaccctcacgctaatgaaaagtttgtggttttaagacgccagaaacaattttggtttgtacacgacactttatatgtaatgtttttatctttgtactataaaaagtgcccgtgcgttgcaacgaaaaaaactaatgttatgataataattatggatattttatagtttcatgggaattatatgggatactcctagacataaacaatgaattaaatctatacctaattctgattctatatcatgaaaaatgaataattacattatttgttgactccatttagctagaaataatttttttgacccccttcgcaagcgacaacggcagggcccttccccaccgtgagcggcggcggtggcggcgccctccccaatgcaagcgacggcggcggcggcggcgccctctcttaacatgagcggcagcagtgccctccctcaacatgagcggcggcggtggcggcgccatctcccactgtgtgcgacggcggtggcacgtcctctcgcggctttcataggtggcacaggcagcgtcggcagcttcccataggcggatctggtggccacggcggtgtcggcaccctctcccactgtgtgcgatggcggcggcacgtcctcccgtggctttcatgggtggatcaggcggcgtcggcggcttccacgggtagatcaggcgatgacgaagattaagataagatttgtgtgttttttattattttttctgttcctttctctttctttggattgtctgattggattttgtatctatatttgaatttgtgttttatccatcttacgtgatgtattactcgcgcgtgtgggaacggaggccatcgttcgactggactcattgacgaaaaattgatgtgaagaatggaaagttacagattttttaagtagttataagatatattggttcaattccagtgttgataggttaattagtcacggttcattagtagagtcattagcgtctagattaccaaaagtaattagtgttttcttgattagccttttccttagtatgtttcgagtccgaaccaagttagagggaaaaattgctaaacatctcccgcgtgattttttttcttggcatttgacgtttttttagccacatgatctttgcgccaagatttgtgcagcaattgccgtggatgaggtcgacagggagttaaggtgtgttattcttgtcgtgtgaataaaatacgtgaagtatgtaattttcatatgtctaattaagaaatatctctatgttaatttacatgtcaaattaagtactaatcgatacaacaaatttaacatatcttaaacatctaaataaaaattgatttctttaaccattgaaaaattaagacatttgaaactaaaataaaaaataaaaaaaataaaattacagccctatataactaaaattgcatttgtaaatttaattgatttgacatataagtgcactgtaatttttgataaaaataatgtgtaagtaaatatgtacttattattttctttaaaatataaaattatattttaaaattacagtcctatataactaaaattacatttgtaaatttagttgatttgacatgtaagtgtactgtaattttgataaaaataatgtgtaagttaatatgtatttgttatttttcttttgtagtccgttggatataaataaagggtaaaaaaaattgggtgattttttttattagaaatcacccgacaaatagatacatgctggtaaaagaaatactttgaattccacgtataattgcagaccatctgttatatggtctctgtataacctgcatacgtagcaaatggtgggccgtgcaactggcttcgtgggctgtgtcttgggccatgatcgttgctgccacaaaccgatccaattaattttacaaaatggctttgttagttttactcggaaatcctgatccgactacgaagcgtttgaaaatggggaatcggatgaacctgatgaatgatgaaggggggcgacggacgaaatcagtggcaaaaacatcttaaatttttataatactaaaaaaaataccggtgcgttgcaacgggtaaatacattttttatgatacaacaacaactattaagagctaagtcattggaatcactatacactataattaaaaaattaatgaatttttttcttggttttaaaccgaaagcacaatattttttctttgttagtcctaacccagtccactaaaacctttgttagtcctaatccagtccgctacctccctccattcgccccgcctttcttcggtcgtcaagctccaaaaggtaatcccgggcttgtacaatgccaaattcagttgaattattctcgatctcccaaaattaaattggttgaggattttttgatccaccaaatctccttttttccttgtttttccccaaaatcgaagcgaatcaaagcttgttgacctgccatgatcaacgacttttaaatagggattaaattcagtaaattaaagtccaggatatggaaaatgatgatggaggaatgtgaaatcgatttttgcaatcagttagagtagaaaacatacgggaggtagatcgaacgtggcagtggcgctagggttcggcccagaccagacgagatcgaaaaaagacaaaaaaaaaccggacttactgcgtgcgaagaaaaaaaaccatttcgcgtgcaaaaaaagcaaaaaaaataaaccgctcagaccaaggaaagcggaagcttggcggctcaggcggggcacgctaagcgcgtgcggatcggatcagagatcaggaaaaagacaaaaaaaaaaaagaaaaagaaaaaaaagggacttcccgcatacgcggagaaaaaaccttttcgcgtgaaaataaagggtgacaaaaaaataaactgcactgaccaagaaaaccgcacgattggcggctgaggcggggcgtgctatgcgcatgcaaataagagcagagaacggaaaaaaaagacaaaaaaaaaaggacttaccctgcgcgggaaaaatcccgttccgcgtgaagaaaaaacggcgacaaaaataataaccggacgaaccaaactaaaaccggatactctttttttttattcgatcatcataggcaaaaaccgaggtaggtaaagtagacttattccttccccttaagttgacagcccatattatcagtttggccagctttctacagcccaattagatttgcacacataaaggaatttttttttatttttaattttttttattaaaagttttacaaaaataattttccattttgaaaattgacggaagtagtcgcctaccgccctctgggagggcgatttttaaaaatcgccatcccagagggcggcgaaaatgacgtggcagacggccgttcgctctcgggcgacggccgtcaacgaaatttgcaagcggcccccttgccgccctctgctagggcgattttgtactgtgcggggggccgcctgcaaatgggcggcgagggggcatggaattttgcaggcggcccccttgccgccctgggggagggcgattttttcctccccctataaagcccagtcccccctctctgaaatttcattatattcactaaaaatccaaaaaaaaacgaaagagagagaggggagggcagcagaaggggagcggcgaagccctgctggttcgctcacttcatcacatgtttgctcccatacatcttttgcatttgtactaatatgttatgtttgagtatatatgttgcgtttttgttttagttccatatattttagcatatctgtagcacacagcacatatgtgtagatccagagcatagaatataatagtatgaattgagacatagacaatagtgttaattgtaagatatagtttagtttgatctagagaatgtaacctacttttagaattttggagaacaatattgtagagaatgtaacttagggcgtagtacagaaatgcgaggttaacgcagttattgttttcatcaggcacaatgtcaaataaggtcacatttcagatagttcacggtgaaggaaatattagatttggtccagatggtgttgatctgtcagattttgtaatgacatctaagggcatcgataggcctgcggagagaacattacagtcaatttatagttggttgttgagaggatttagaatagaccaagaagtctacacaatgtcagtatcagttgtagtgagtcgtgcaacagaaggttatttttgggaactaatgccgatggacatcactgctgcttggagacggtatgtggaaatggcttttgaacggtcatggcccctcgttatatttgtgtcggtacaagagaaagatataaatgtttcaatgcaaaccgaagatgtagagggtcctatcaatgcaggggatgttgttggaccatcaatgcaaaatgagaaaaatcaaccaagggaggagcaggccatgggcatggcggatgagggggagagagtcggtataattgttgatgaaatggagagggaagattcggataatgaggaagcagacgacgacgcatcatccgatgaggaaggtgatgtaatggccactgattgggcaaatgaggacttctctggacttgttatatcagagggtgatcatgtaccctgggagtataaggagaacgaggtaattgacggtgcaaggtatgctcataaggatgagatgaaggaggcagtgaagcattgggcagtttccttgcagagagagtttagggtggtcaagtcaacaaattatgtgtatgaagtgaggtgcatgaaggaagattgtccgtggcgtgtccatgcatataagggtaaatgtaatgattattggaaagttagcattgtgaccgagcacaagtgctacttacaaggggtggagaagtatcatcgaaacatcacttcagcttttgtggcaagtgagatgtacagcagcgttgttggtaacattggctttgaaccaaaatcaattattaggcacatcgagaacaaattcaagtacaccataagctatgcaaaggcctggagagccaaacaaaagattattgagatgaggtatggcacatttgaagcttcttatgataatttgcctcgtttgttagccaccattgcccagaggaataataatacttactatgacctacatacatttacatcggttgatgatcgaacaaagagtgtgctgcaaagagcctttttctcattggatgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattacagtggtgcgtatgaggcccaacgtttgccttatacatgatcgtcatgcgggtatgttgcgggctattgactacctgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcagagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggtcagggtcgtccatcaaaaatttcactcagtggattgagaatgagcctaaggagaagtggtctctattgttcgacaccgatggatctcggtatggcataatgacaaccaatttggcagaggtgtacaactgggtaatgcgaggagttcgggtacttccattggttgctattgttgaattcatccttcacggcacgcaagcgtactttagggatcgatacaagaaaattggtccgtccatggccgataacaacatagtgtttggcaacatagtgacaaagtacatggaagataaaatcaaaaaggcacggagacatagagttgttgctcaaggcacacaagtgcatcggtatgaaataatgtgtgttgataggagcaggcgtggtatctatcgcaagcaagccgtgcaggaatgtgtcttgaaggcggatggtggatgtacatgcagttgtatgaagccgaagcttcatcacctttcttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttacattccagatccatctaagttaagggtgaaaaagggtcgacgccaaactagacgcatcagaaatgatatggatgagtcagaagcaggtgggaggactttacgctgcagcaagtgtgatctgcgtggccatacttacaagaaatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgctatcgatttaggaaataaaatgctgttgtgatgtgatgagtgttcggactaaatacttctatcgtgtaatttcaattgaatgttgttgtaatgagtacctccgactattgttgtactagtagtattgcgaactattcggtgttgtatcataatgttaccgtgatgagtgttcggactaagtactcatatcgtgtaactgcagttattgttgtaatcagaaatattccgtatggtgacacttttgtttgtttgtactcttgtttaatatgtgttagtaattcgcttatgaacatttattagttatgttgaactaattatttatatgtttctgatcaatctatttgatgcaggcatgacgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttcaactcaactttgctttgtgttgtacttatgtttgaagtttgctctatacaggttgcgtgcggcaggccttctaccactttgtaggcttgttgaggcggcggcggacgaccgtgacccagcgaagcggtgggatgcagaccggtcactccttgccgctctggtagaccgctggagacctgagacgcacatgttccaccttccctgtggggagatggctccgacactgcaggacgtgtcgtacctgctcgggctaccgctggcgggagcaccagttggtcccgtggacggtgtttttgggtggaaggaggatatcactgcgcgcttcgagcaggtgatgcgccttccacacctaggaccggccaacacccttcctccgtactctacagtcgggcctagcaaggcttggttgctccagttcactgtaagtaaataagttgttattatcatacatgcttatttgcgatcaacagagtgttttgtactaacatttcattcttaattgtaggcggaccttctgcaccctgacgctgatgataactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccataggtcgaccagtggtggacagcgcaccctacggggttggtcgcagcgcgcagtggccagaggacggtcccacgatggggacttactggtgtcgacgtggggttagtgcaacttcgctgcgttataagtttatcagtcgtcttcttttttttcttcacataacatgtctaattccgatcatgtttattgcagcgtcgttacgctcacgtccaggtgagacgaggttacccggacttcgtgttcgagtttgaccgtctccagccgagcgacgtcatctgggagccgtacacagaagaggccgtcgctgcgagagcaccgctaggactttcgtcgttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcctccctgccgaccactcgtgagttcggattgttcatttctaaatttttatgataattacttcatcgagccatataatttacctctcttcacaggttgactcgacggggacagctagcaggcgcactttgggctccacgtgtacagcagtacgttgacgactgggtgttagctacagaggaggtgatcaacgagctcttcccacacacggaggagaactactgtgactaccttcgctggtaccttcctcgcactcgtgcgcgtgtgaccttcactccagacgccccagagccgcacgttgccgctgtgacggacgcgtatcccacgcaccgtgactgagactacttcgtgggggtacgtcgaatttgtattagttcttacaattatttcatttatcttgcataatataggacaactactgaattttttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgcgtgcggtcatgcgcgtcttctcctgtcgcagcgccgtggacgtcgtacctccagctggtccggtacaaccacggcctcgcgcgcctaccgtcggagcaggacctcgacctacggtacctgtttcgcacggtactgctcagcccagaggtttcttaagttttgtttctgtttttgtacgaaaacatcaccccgtcgtaacttgatgttccatcctcgcaggacctcgtttgccttcgagcgcccctagcttcggagcagtgcgacctacagcaccggtttcgcacggtacagttcagcccagagattagttcatttttgtttcagcttttgcacgaatatgtcaccatgttttaacggcacgtttcctcatcgcaggacctcgtctgccttcgagcgcgttcgcaggcacgaccggcgcttccgcgagctccgcaggggcgttcgccacctcttcgggcgcgttcgccagctcttcctctcacggagcgtcgatccctcgcccacacggtacttaatttttattaatactattaaatacctgtatgaaactgatggtccttgtccagcaggatttgcagccgggatcttcggtactggggcctcttcgtctcacgccggtaggactggtcctactagccagttctacgacgacgacttgcacggtgcacaccaccacgacgtactaggctcctctcagcttggaggagctccagaggcgcacactcaggagcagccagaggtcacacctgtacaggcaggacgggttggccgtgccgtacccccagaccgactcacgtactcccaggggcacattagggcgcagggtaggagggacaggggtaagaggcctcgtcagtagtgttctacctcttcagttcttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgcttcacggtagtgtcagatccagtagcgcgcacagtccacaacagcacacatgaaaagcagcagctcgagttgtcactatcaactttcggcgctgcctgttgacataaagtgaatcacgcccacgcgtgatcgtcttgtcacatctaatgaataatgtatctcattgagttcacatatattgcagtgaaaatgacgctatataattgacaatctgaaggcaacctcttcatatcttctttcccactagcacacaacacacgaaaatggaagcgccattccttgagcgtctcaactggcgaagcgatccttttgctggttggtttccaccatggtgtgaccgtcctttgtgcgattgtggggatggatgcatactcaagtcttccctcatgatacaaactcggggcaggagattcttccaatgcgcgaactttgatcaggtatgcttcatctattcgaagttcaaatggataaaaaaactaacttcttcgtacacaattgtaacatcttacgcagacatatcgtccaatgtgcaacttcatcgagtgggtagacatggagaacccacaaaacgacggaacccgtgcttacccacgtagtgaaacaagatcggactacctaaggcggaaggatgagcatgaacgtcgaattgctgctgaggctttagaatggcacgtaaatcccctaggactccccacgtggcgtgagcgtccggagtgtcgttgtggtgaccgctgtcaggtcataaggtccgtaaggcaccgaactcgaggacaaaggtgtttcgtgtgtccaaacattgtcgacgatgatttcgtggtaattacaactattcttttcatcactcctcagtactatcattaactcaactatcccaaaatggatgtacataggaggatgtaaggaaatgtcaattcgtacaatggattgacacagtcagagttacttcaagtggcgggccgataacgcaacctgaaccgaccatacagttcattcatgcttggatggagtacgaacgtcgggtggaaattgcaagcttagactggaggaacaatccattagggttacctaaatggtccgagcgtccaaagtgtgggtgcagagatcgctggcaggtggctacatcctttgctgaacaaacatttcgaaggagatattttgtctgccctaatgtagacaacgatttcgttgtatgtctaaccatttacaaaatccgctatgatttgcacaaaattactacccaaactgaataacattactatttttacagggcaatccaaggatgggtggatttactcgatggatcgacaatgtcactccatcatatcatggccagaagataacagagtcagaaacacaagtagagtatcaacgattgaaggaccacgagaatgcaatgcattctgaccgacctagaaggggccgataggttaccgcatgcttgattcgtcgggatcgacaaatttgttccgtgtatcgatggcacttcttatctatcttatcattacaatgtttaattatggtggtgattttttgtatgcgtaagactaagggcctatttggattgctaccaaaaacatgccctaccaatattttggtaatttgaatagtacttgtgtttgatttcgattgaagcctattcattggtaatacgtaatctagatttgagattatgtagaacattcttcactacaattttacattttggcagcaaaccaaatatgatcaaatgcaattttaccttaccaaatatttggcagtgccaaaacttgcttatattttggcactaacaaaatatttgtacggtaacattccaaataggccctaaaaaataataaaattgtattttaccagtcttggagattttaatcttgtatagttttcaatataaaaagatttgataactattgatatttatacaaaaatataaagcacagtataaaatcgccctcccccagggcggcaagggggccgcctgcaaaattccaggccccccgccgcccatttgcaggcggccccccgcacagtacaaaatcgccctagcggagggcggcaagggggccgcctgcaaatttcgttgacggccgtcgcccgagagcgaacggccgtctgccacgtcactttcgccgccctctgggatggcgatttttaaaaatcgccctcccagagggcggtaggcgaccacttctgtcaattttcaaaatggaaaattatttttgtaaaacttttaataaaaaaaattaaaaataaaaaaaaatccacataaagcaagaaaagaatcctcgtcttcacatagctcgattcaattttcatattcagtccgagcgagcgaacggcggctgagtcgaaaccgttacgacaatggaaatcggacgaggattctttatatatatatatatatatatatgaaaatgcttctatacacccaggtgtacatactcctagtttcatccaccatccgttcgcaactagcagagatcgagtctgctagcggatccacataccgcgacccattttgatttttgcgaggaaaaaaatcatcgtaatatttttatcccgcacatatcgggagcatactgaatgctcacataaatatctcgttctcacgtagtgctaaaccgaacagaaaatcaacagaccgatccgatataagggcaatttggaggtgacggcgaggcgatacatcggcaagggtggctggcttgggccacggcggcgagtagcagacaacgacggcgatgcgcgcgatccaccggcaaggccgcaaggatggctcaggccacggcggcgagtagcggacaacgacacagcagaaatccatcatcgtcaagcccatgcagctcgtccgcctgccggagtgccggcggcgtgattccatcgacatgatcggcttttgcaccaccattatttggatattcccaggtgattgattctggtatgtccatcccgttttctctcgttttgtatttcttgcagattgatcaaggattctctctttctttttcttgcagatcgatcgaggtataagccagcatgaaggtcgccagctgcctcgtgatccatcggcgactcgatcgtcatcaatggcggcgatttgatcgtgatcgatggccacggccatgttgcgtcgacaatgcaggcgcgcagcccatcggcaaagccggaggcgacgaccaatctattggctcactgaaatcatacgggaacggaaaaaagcggcgctggagacatcagacagcacagcaccaagccaccaaccgaagatcatggcatccaacgaatgtatacatcagattatagtaatcacagtatatatgtgcacatcagctcatgtatcgatctggttgcctgcatatacatctctcttcttaattatactccattgaatctcttcctgattatatactactacaagatcaactaatttcatattatttgtcagtattacatactactgtgaaaagcgcatatatatgcaacagttaggaattaataaacccaacgagtatagtcgagtatggctagttttggaaatacatgccgcttttctgaatctttgaaaaaagcatgtattttatactactgatacttttgcatcatcaaatcatgaatgcagccagtagcccagtagtctgtactgctacagtgtaaaatcaaaatgttagactttgcactaggatcacctaggttagatctagtcgggtggttctatttgggtttgatgaacgacattgtcgatgaaagggagagggtttagataccgaccggttgaggagttcgaggaggaagaggcgccggacatcgtcgttgtcgtcgcggcttgacgtagatgcggcgccggtgaggtcgacggcgatgacggctgcggcagtggtggtcgtagacgtcccggcgatgaggcgtggcgcggcggtggcgtttcccgtcactggctgccccccctctcgatcggattagggttttgtggggtggagttggcggcggcggtgaacttcgtacccagtgccgtgccggcctccacccctcttttatatggcgcagtgtgacaggggcccaccagccattgggctgggcgcccccgatcagggcgcggtcaaggcccccttgagccgttgggctcaaggggagggagatctatctaacattctcccccttgatctcactttttcttttagctttttctattccatcacagatttgtaaatagagcatgtttcatcgtcacggtcaatcaccgatggattcgacagccactatacacaactctattcagaaacagatactttacttttgggccctgtagtccaggattcataaggcttcccttaaacccatgccggctacatgttccttgaacacgttgggtggtaggcctttcgtgagcgcatccgcgagcatcctttctgttttaatgtgctcgagactgattgtttgatcccggactttgtccttcacaacatagtactttatgtcaatgtgtttggcagcaccacttgactgattgttgtgagcgtacattactgcgggttcgttgtcgcagtataactttagtggtttctcaatactgtcaaccacctttaaaccgggtatgaacttctttagccagttcacctgccccgttgcctcatagcatgctataaactcggcatacatagtagaccctgcagtgatagtctgttttgagcttttccatgaaatagctcctcctgccagggtaaacacgtatcccgatgttgactttgtattatcttttgcaaagtcagaatctgagtaccccactatctggagtgattctgatcttctgtaagatagcatgaggccttttgttccctgcaaataacgcaagactttctttaccaatttccagtgctctaggcctggattactctgaaatctgccaagtaacccggtaacgaatgccaagtcaggtcgtgtgcagacttgcgcgtactgtaggcttcctacagctgacgcatatggctttgttttcatttcattgagctcatactgatttctgggacattgcgatgccccatacttttcgcctttcattataggagcaggtgtagcactgcatctgtacatgttgaatttcttcaacaccttttctatatatgtcttttgagaaagtcccaatgcatactttgttctatctcggtgaatctctatgcccaaaacatatgaagcctcaccgaggtctttcatgtcaaagtttgaggacaagaatttctttgtttcctgcagtagactgacatcactactagccagtagaatgtcatccacatacagaattaggaaaataaatctcccattcttaaactttgaataaatacagttgtcctcgacattctctttaaacccaaatttctttattgtcccatcaaacttcaagtaccactgtctcgaagcttgctttaatccataaatggatctctttagacgacatcccatattttcgtttcctttcatgacaaaacctttcggttgcgccatgtatactttttcctccaaatctccatttagaaatgccgtttttacatccatctgatgtaattccaaatcataatgtgccactagtgccattataatcctgaaggaatctttacaagagactggagaaaatgtctcattgtaatcaatcccttctcgttgcgtgaagccttttgccacaagtcgcgctttaaacttttctatattccctctggagtcatatttggttttgtagacccatttacagcctactgttttggctcctttaggaatttcttctaaatcccaaacatcgtttagtttcattgatttcatttcatctttcatggcttccaaccattcagatgagcgagcgcttctcatggcctcttcatatgaggtgggatcatcctccatatgcgactcttctatattataaactttatagtcatcacggatagccgatcttctgactctttcagaccttctaggggcctgcacatttggcacatcctgtacctgaggctcttgatgagtctcctgtactggcacattatctatttgaggctgttgcagctcctcctctggtgtggcaaccatttctgttgaatcctgtataacaggttcttcactctcattcattggtacctcaatgacaggcattgcaggcacaacatcagcaggtagagagaagaaaggttcctgagtcgacggagcgggtacagacacccgcctctcctcaagatcaatttctcgaactaccgagctccccctaatcatttcgtcttccaagaagacggcgtgtctcgtttctacaaactttgtataactgtttggacagtagaaacgatagccttttgatctttcaggatagccaataaaatggcagctgactgttttggggtccaacttcccaatatttgggttaaatactttggcctctgcaggactcccccacacacggaggtgagttagcgagggtactctccctgtccatagctcatacggtgttttgggcaccgatttgcttggaactctgttgagaatatgaatggcggtttttaacgcctccatccataaaccgagtggtagtgtggagtagctcatcatgctgcgcaccatatccataagcgtacggttgcgcctttcagctaccccattctgttgaggttcgcccggtgttgaatactgggctactattccattctctagcaagaaccttgcaaaaggtccagggacttgcccataaggcgtatgtcgaccatagtactctcccccacggtcagatcttactactttaatctttatatcaagctgattttcaacttcagctttgaatatcttaaatttatccattgcttctgatcgctctttaattggataaatataaccatagcgggagtaatcatctgtgaatgttatgaacgagtcatagccatccacgctttttacaggaaatggaccacaaatatctgtatgaatgatctctaaaattcctgcgcttcgttttgcaccctttttgatgctctttacaaattttcctttaatgcattctatgcattgttctaagtctgagaactccaatggaggaagaatttcattcttaactagtctctcaattctccccctcgaaatatggcccaaacgatagtgccataatttcgatgagacatcgggagttcgctttcttttcttgttttcttttgtcaatgaggacacaacattcacattctcagaaagagataacaaataaagctcgtctcgcaacacggcaagaccaatacatgcattattatgccatagttcacatttgccacttccaaagcggcaatcatatccatcaaaatccaactttgatacacttattaagtttctttgcaaagaaggaacataaaagacatctcgaagtaaaagtatgaagccattcgcgagctctagaggaagatctccaacagcttcaactttttcaactccattggcaactctaatggtgctttctcttctttgcgtagtcctcgtcgaacggaatgcctttaaacaattacaagcatgaatagttgctccagaatcaatccaccatgtggatctagagtaaccaacataatgagattcatttacaaatgtaataatgttctcacctttctttgccatgatcattttcaaaaagtcaggacaatctttcttgtagtgtcctgtcttcttgcagtggagacattgatctttctcaacagcgaactgttgttgctgaggcagatgctgagactgtttaccttttgaggtgggagacttgtggttctttttcttatctttaacatagtttattgaaccaccatttgattctttgattctctcctcctcttgcacacaattagcaatgagcttctcaaagttccatttctctggacttatgttgtagttgacaataaaattgtcaaactgctttggcaatgaggccataaccagatggaccagaaagtcatctgttatgcccaaatccattggcttcaacttggaagccatgttgctcattctaagtatgtggtctctaacaccacctccatggtacctttctgtcacaagctgcttgatcagctgtgtagcataagtctttgaagagtcagtaaactgactctttattctttcaaggtactctgagacagcgtcacactctgggatcgagcccaatatggtaggctcaatcgtattctttaccacagccaaacatttcttgttggctaagaaccatttcttttgttcaatgtcatacgacatgacgagaggagcattgtccctctgtctcttttgccagtcagcatctgactcattttcacctctgacaagttcagcaggttctataggacatggggtagtcaatacccagtccacctctcccaagataaaagcaaggtcgagttttcttttccattctgcgtagttatctccttttagggtcggaatatctttaatgcaacccatcaaggagtagccacctgaaataatcatgtgcggtgagaacaaaattaacatcaaaatattatgcattaagcctacatcaccgttgggcagaattagacataacacatataaccataactataatattgcaattaacaacgttggtcagaaaattacaacatcatagcacataattaatgttcctaaaattaaattctcccgttggttcgaaatttaattttagaaacactaattttcatcaattacatctatttgcagcggaaaactataaaaatcatatgaacagtagcaaaatctctgtaattctctctctgtgaaaattctcccgttggttcaaatttaaacagaggtaaaacatgcaaaaaactattcaaaattctattgaaatttgcatgaaaattgacaaaataaaatggaaaatttctactgttctcttttattcattttcggcccccgagggacctaatttgaacttttgccggcggcccacggcccttttggcacgggcgggcgccccctttccccaagccgcaacctgggcctgggccaggaaaaccgccccccgcgcgcgccttcttgggccgatttcggcccggccggcgtcgaccgtccgatcagctagggtttcgatcggacggccgggcgccgagatcggaggatcaaaacccccctctcccggccggccgccgaaaaaccctagattctcttctcttctctctctcacgcgaccgcgtggacggcgtcgccatcgccggcgaccttcgcgcccgccgcgccatggccagcgccttttctcttcttctccgctccccccaccgtctctaacccccaccgtgtgagagagagatggcgacgacggagatggcggcgccgccgcgggccccctcgccggtacgcgcgtgcaggtgcgcgcgcggccgtcgagtggctcctaggcggcgcctctttgcccctccccccctccgttgccggcgtcggcgacggccggcgacgaggtaagattagggttagggttttcggctcttttgatccgtgcggatcttgtgcttttctttctttggatttcttttcccgaaccgatctaagccctagggttgctctgataccattgttagactttgcactaggatcacctaggttagatctagtcgggtggttctatttgggtttgatgaacgacattgtcgatgaaagggagagggtttagataccgaccggttgaggagttcgaggaggaagaggcgccggacatcgtcgttgtcgtcgcggcttgacgtagatgcggcgccggtgaggtcgacggcgatgacggctgcggcagtggtggtcgtagacgtcccggcgatgaggcgtggcgcggcggtggcgtttcccgtcactggctgcccccctctcgatcggattagggttttgtggggtggagttggcggcggcggtgaacttcgtacccagtgccgtgccggcctccacccctcttttatatggcgcagtgtgacgggggcccaccagccattgggctgggcgcccccgatcagggcgcggtcaaggcccccttgagccgttgggctcaaggggagggagatctatctaacacaaaatagataacaaagtatataccgctagtaacttaaaaaatatgttaaaaaaggcatataccgatactaactataaaaaacagtatataccgatactaacttaaaaaaaaaagataccgacactagcttaaaaagtagcatatactactactaactgaaaatgtagtatatacatgatcagtatatactactatactactaacaaaaaaaaacagtacatactactactaacaaaaaaaggtatattctccttcaatgagtatacttaaaaaatgagatatatacatctctgatgattattgtagtatatatagtacttattaactaaaaaatagcagataatacttatattaactaaaaaaggtatatacttccaaacaaaaaaaatagtatatatcaaacaaaaaaagtatatactgaccaaattaaaaaatagtatgtgcagtatatatcaaaaacttagtatgtctactgaccaaacaaaaaaacagtatatactcattcagtacggacgtaatatatgctggaaagaaaattaaaaatttgaaagcaaatgcataccaacgttatcgtttgagtgagcaccaaatccggtgtcagctgtgcacatgcatacggtggtttcaaattaataatttcactttaatttggatgctaatggatcatccattaataagggggagtacatacatctaggtgtacagaagagtcgtcatgtatatatatatatatgtgtgtatatatatatatatgtgtatatatatgtgtgtatatatatatgtacatgtatatatgtacatgtgtatatatatatatatatatgtatatgtatatgtacatgtgtatatatatatacatgtgtgtgtatatatatatacatgtgtgtgtgtgtgtgtatatatatatatatatatatatatatatatatatatatatatatatatatatatatatatatatataatgcccgtgtgttgcaccgggtaatatcacggtggataaagttcaactaaacgatttacgtagtctagtacataattttgtttggacaatattaactcgatctacgagtaggatattcaattctcgcattgcaagcatgtgtcttactttcaaaatcatatatggactccgcgtagagatttactcaaagtctcttggtggccacgcgtgctttctcactatgtcaaaactcgcgttgcaatcatgtgctctcgttttcaaaatcatgtgtaatttttaatccttatgtcaaatctttaattttttacaatcggttttttatgtcaaacaaatattaattgtgggaatatattgatttttctatatattgtatttgcgagagttgatggcacatgtgtatcataaaaatcgatgtctttttgaggtattatgttttatttctaaatttcatttatgtcaaatatcaataaatataccggggcataaatggaaaccgaacagacatggaggaaaaatagaaaaattaaattgaaagctgaaccgactggaggtgggaaaaaaaaagaaagcagaagtttctcgtttcttcagggctgtttggcacagctccagctccacccctcctggagctggagctcagccaaacagttttagctccaccaaaactgggagtggagttgggtggagctctctcacaaaatgaactagagttgtggagctgggtttaggtagctctacaactccactccagacccaactcctagagctaaatttagaaattggagctctctctctcctcagcctatctttctcccccagtcccccgtgcttatcctttttacttcacactttctccatccttagcagctcccctcctcccacatactctagggccatgtttggcaaatgggacagagaaatgatttcccactcaccataagacatctttaaatcctaaccattcattctcccccttccatttaatcctaatcattcattcatttcccaatcccaatcccaccccttatttcctattatccaaacacaccctaggccctagctgctgatgctggacatggaagtgaaggggtcagaggaggatctggaccccctctccggcgacctccctccccaagcggcagtgtccggatcgcgagccatcggcggagggccccatcgtctctctgccccccgctcgcacggatctaccgccggcgacgacgggaggggcggagcctccaagctgccgttgctgctcgcgtggatccgccgtcgacggggatgggagtggcggatccgacgaattcttcccctcccgcatggatcctgtcgtctcttcggccccctctcgtgcggatcaactgtcgacggcgatgggaggggcggatccggcgacctcttcccctcccgcacatatccccgtcttctctccacccgtctctcgcgcggatccgtaggcggcggcgacgggaggggtggttccggcgacctcttcccctctcgcacggatcccatcgtctcttcgcgccggcgacgacaggaggggcggaagcggcagcctccccactgctgtcagttccggccactgccgcacaggtactttattttctctaagacaatatatcatgttttttatgtgaaatcttgggttcattttgcataggagcaatcctgcagggggttgataatgtgccgatgcttcagctacatatagtttggtgctattttgtgcttcgtgatgtatcacgctgtattttttgtacgcgctgcttaggtggtgtttgatccagggacttaactttagtccctgtctttagacactaatttagagtattaaatatagactacttacaaaactaattacataaataaaagctaattcacgagacaatttttttaagcctaattaatctataattagagaatgtttactgtagcatcacatagtctaatcatggattagttaggctcaatagattcgtctcgcgaattagtccaagattatggatgagttttattaatagtctacgtttaatatttataattaatattcaaacatccgatgtgatagggacttaaaagttttagtcccatctgaacagggccttactctcactaccctataggaaaattggatatggaactgcaagtgaggctttggcctgcaagctgcagtttatttttgtccgcagagattattttaatgaagagccattcttgcggattttacttgaggttgaatcatttctaatcaaattatgctaggaataacctatgtgcagctgtgcgtaaagtgtcgccatgtcccattctatttcagcactaccagagcagtattgaaatgaccagaagggagttccttaatgggtactggaaactttatctactccgtgctctcacacttgaaccatgctatgatggtccaacaaatggtggtgaggtaatttttcaactgatttcccaggttattgcataagttcatccgaacgggccaaagttcacaatatttatgtggttaatgcaataacattttattaaatgaaaaggatagatgaagtcactgacgcatggcttattagtcttattataattagcgtatgtttgtgcttatctggctggagtggtaaaagataggtcattcaaagataggaattgcaaaatggaccgaagtgctctctctgtgtttttttttcttataccatctcaaataccctatttagagattcagtggtggtagcatgaaaaacatagattttccaagtatagatgatcgtagtacgctttggagttcttgaaccttctgtgcatgttttatctgacaatatcagtacttttatgtgattctattggccatattacttcaaaacttgatgttggctgtgatttgagaatgttgctaaacgtgcatttcctcagttgtatgttagttttaatttcttttctaattttgtcatgaagatatgagctcggtaggcacttcaatgtcttttcatgattaatgttctgcattcatgtgaatgtctgaatcgaaggacctgtctagaacatccatgttgctatgtgccactgaacaactgaaaaatatgcctggttctaactggctatctgttctgcatcgacaggaaaaagaattagatacatattggtagatgcgtcgacacaactgcattgcccttcacaggtgaaacgaatctagacaatcttaccactatatgttaattaattagatggtactgttagttcattcataagctgccttagaagtatttacaattgaaattctattaggatatttttattattaatggaagtgcttctgttagtaattgttcaaggaccttggggtagttatattcaatattaatcccataaatctgatgaaattgaaattgcatccagggaagagcctgggatccacattgattggaggtggctaaatgccctagaggaagagccttacgatctatattttcttttgtgcttctattatttctattgcctgtgattgtatttgtgtattttggcctgcgacagaaatatgtaaaaacacgttagtgggcgtgctagctaaaaatagcggaaagaaaagtgggatagaatctaactcggatagagtcgagatagaatctgacttctgccgtgggctggctaaactggagtaggaaacggtgtgagcggcgaaccaacctgactcctgcgattttttttttgtatgtgatcttttttttttggcgtgaacctggactcatgccttttttttctttgtgtatatgtgatatttatttttgggtgaaggcttgtagattgaaactacctagaattctggaagcagtctgggcttgtgggcttgtggatgtctggaaggtttgtgggcttgtagattgacctgtaatcctttttgttggatgaaactggagcatgggcttgtcaatggacctagaattctggaagcggtttgggcttgtggacatgtggatgtatctgatcggataaaaaaaaattaccgcgatgacggacgaaaacgcggaccgaaaagaagctgacgactggaaaaatccgaatatatatatatatatatatatatatataacgactcttctgtactcccaggtgtacatactccctcttccatattggatcatctaataggatccaattaggacctgcttagccggtgggaaattttttttgaaattcctatttttcagccgaacagggaataagccaagtaaaaaaaattaacttgaaaaatttccatgcatgtcggcttgggattggttgcacgcctgcatctacgaatttgaaatgtagtatttgtgcaccttgctgtagcatggaaattcgtgacttatatactgttttattttacattagctatatacttattttttaggaacccatatatactatatctctgtttgaaagagtatatactttttatttgaggatccagtatatactaaaagctggtttgagaagtatatactacttaatttaagactattcgtatataccgttatctctagagtctattagtatatgtaaaggtagtaccagtaaatactttttttaagttagtaacagtacatactttttctatttattagtagtagcagtacatactgtcttttatcgtagtgtggtagtatactgttatttggtcagtacatactatttttgttggtttagtagcattatatactgttttcagtttagtagcggtatatactattatttggttagcgttaagtacatactatttttgttagtttagtagcagtatatactgtttttcagtttagtatagcagtatatactgtttcttttagttagtagtaaagtagtaatacatactaagtaacagtacatactttttgtgtatcgagaagtggtattatcaaataaatgggcatatatatgctcaccgattcattctttgtataagcgtacaagattaattcttaagaaaagtgagtagtatattgcccaattctgagtgtcgtgcaacaggtagatctgccggagccccggtgtagaagatgaataatcgcactgaccgcagcggccgcgcacccctttgcgatcgaggcca

SEQ ID NO: 68056 - DNA, 600 bp, Oryza sativa
ttataggacatgatatgcacgcatcatcaataatcacactattcaaatgctcacctgcatttccttcttccgatcaatcaccaaggctgtatttgggccatacaaacgaacagtcacagaagacttgttgcccttgccatcttctacggagacactcagcactgcaagcagtaaattacagttgttgtttccactaagttctcggtaaattggtagtacttcagtgacagaacattatataattttctatagcaaacaacataagataagatgatttaggcattaaaaaagcaagaaagaaatggtaaaagagtccctgatctcacaaaagttcagaaatgcaattaagttcataaatgttcagaattcagaaatgcaatcaggttctggtaatagccataatgttatgtctgccgctatccaaattgctttaaaatgtgcctaaaaccaattttccctttgtttgagcagcagcctgacctctgttttcctctacttacaacgagttgcttaggtgaagcaggaaggaaaaaaatcatgacaacgcgacaagccatgaaactgccaaggagcagggactcacacatattcgtgatgctg

SEQ ID NO: 68057 - DNA, 1387 bp, Oryza sativa
ggcccacatgtagtgagaagaaaaaaaatataggtccgcatctcctctcttttcttcaatcttctctcacggtcccgacaaaataaggcaggccggcgcaatctccagcggtcgccacggcggacggcgggagcatgtgagcgggcgacgacacgggcacgggcacttattcctttcttataccaaagtagttcatgggccaaagtcgctttctctgtatattcggcgggtgacatgcaccgggatattttggtgttaatcatgagttgggtttgccactcggggttccagtccttctggcgtaatttattgttgagaatagttacttgtgacaaaataaattgcttatattacttgtaacacgcagcagcaaaattcccaagcatagttccaaaccagcaacagagtccttcaaaacctaaaggcaataaataaaggtaacaaaaggttaaagttcaatttgcttacattcgattaatataataccaaccaaaaatccaaaatatatgttacactaaccagaaacccaaacagttcaggcactaccgtaagtacatggtgattatgtacatgctttctaatcaccatagatttactaagtataaaaaataatcagaaataacctacatttccatggtgctgattataaatgaggggggggggggggtgttgcatgatggaatataaactgtgattatcatagatgaactaagcttttacaacagtactttatataaatttggaaaaggccgaaaataatttaggaattaatcgtagaactgacacttgaattagtccaactataactgagaatgtcgaaaatatacataggagaaatggaaagtttgtaaatgcctaaataaccccttaaaccctgccgtttgaaaatgccaactacaactagatgtgaaacacatcaggataaacaatcatggcaagtaaataaatccacttataatttggttacaatttatgtatctgtttacaattgcataacttcactcactaatggccaacaaggaaataataatgtttaacaagctcaaatacttcccattagaatatgatcaaaactatggtgcatagttgcacaccttttacagcaggcaatgtacatttagacacaatcaggatgatccacgctagagctcaaatgttgtctgcaagttctaattcatttagtacaatgatgcctgaccaaaattccaagccaagcagctttgcatgaaagcccagcccccatcaattgcatatttgcatccctcaataataaaagctctaacgatatcacgttatgtgtgtatcatgtaatggacccagacacttttctagacataggaaatctggatgtgttttaccacaatattaaaccaagtgccggggtgca

SEQ ID NO: 68058 - DNA, 651 bp, Oryza sativa
tatctgtaccgttgaatctgcacttgttaagtccacttgtttgaaactcatggtcactatgcgccaagaaaaaagaaaagagttgattgccactgttagtgccactagcaattaacttctctgcatgttactctgttcttatattcttttatgttgatagttaaggatttggtcaccacttatgtttgttttttcatgcattttgtgtcagtcaaaaggaggtaggagacccagatcagatgatgtggatgccgtaactcatctttcagttctggacaatccatattactcagatcgtctttgtgaatttggtgctatgtttgccgttgcgaacagaatcgatgctgttcacaagttaccatggataggtttccagtcatggcaggctgctggaagaaaggtataagttaatttctcatagaatcatgtgctaattttggtcatattggattggcaatttggcattcttcctgctgaactttttttttcacagatccactttttgtcctttcattcaaactgtggaaattaattcgttcttgtattattgtccaatgctattattatggatatgccttatagtggctaaagctacttaaatttgtggtgttcgatatttttctgtactatgaactagacataatttttcac

SEQ ID NO: 68059 - DNA, 845 bp, Oryza sativa
  unsure (1)..(845): unsure at all n locations
agctcctacctgaattngactggtagaaacngcccanccnngntatgaacgcgctgatcctgatgcaacaacctgcagctatgcatactgatcgatcagaggattgcccggggaactgggttgtttggctctgtggtcaactggaagagcgagcttattaaaactgagaagcatgtgcattagatcgttccaaacatatgatgagaaacaactcatctacgcccagacatccacatgatttctagccggggggacggctgtgtccttcagcggcaagagaggtcaagaagaacatttaacattttgaaagacccagctttgccggcaagaagaacaaactcgtccaaagagctgttgcatcatcaaaatgcaagaggcgtaagtcttctactctaaaaactttacctactaccagcagcaagctactaagcacgcccactttcatctagttgttgagaacgtgtttagtcatgcatgcttagccatgagatgtgtcatgtgtgcaaatgtgaaatattggtgtcatgcatttcccctttttccacctcgcaaaagaaatacatttcctctgcgtttcactgaatttatcagatattcacaactgttgcatgtgtctttttttcccttggtgcgatattccaattcagacatcaattgagttgccgaagcaaggtcgtgagggagcaaaaagaggttgtgagtcccattgtgacactggaaaaatgaaacagaacctttttcagagaaggtaaggatcctttgacagaacgatacaaatacttattggttccaccttttctgcattataaaatttctttaccaagaaaaaccgcctttgtaaaacg

SEQ ID NO: 68060 - DNA, 741 bp, Oryza sativa
tgatctatcccttccccaccttctcactctcttgtagcgcccattcattcagttgtttgtaacaagccacacaataaaataaaacagaatgccgaaaccaactttgtctaatcttaatggtataaaagtgaggacttaaaaattaagatcttggtatacagatagtggttattcagatgtaagatgatcgcatgaatgctgtgcaatttccataacataaaacaattccccaactttctatcagtaatttggtcctggtttatcaatatgccaggttgtaatgagttgtgtcagaaaaaacaatcaagacaaaaatgagcggtcatatgagtatcacaaacaatcacagatagagtcgcatagctcaagactgacagtaatggccatggttcatgtgtcatgattgagttgaggaacttcactatgaaaagagaaaataataagtcattgagtggttgagttagatgacacctagaaactgaaaacatgccaattgagtattgtggtattagatttccacctaggacagcttttggtacaagtgtccaaaagaagtactccaaacaaagaggttcttccaaattgtccaaacctagcagcaccaccaagctgcttcctagtgcattggtcctttcaaggtatattattatgcatataagtgtacaatgtgacgagaaacattaactaccacttaagccaagttcacctcatatattgtgtaaaggaaaacaattatttttt

SEQ ID NO: 68061 - DNA, 10755 bp, Oryza sativa
ttatacgcgtgcactctccagggacaaccatctttttccttaacacaccgaacttcatattgcgaccggttcgacttggcaacccaaaactctctatgaagtgacactgcaaaatattttaccgcctccttcatatcttctgctctactataaatcgctccctgaataacctcattttctttgtactcccatctcacactatcctcttcagagacgattagcccagaaaaatcctcactagcccattctgctggattaatatccgtctcatcatctgacgaatcaccttcctctacacgctcgttgtcagaatcctccctctccatttcatccacaatggcaccgacagtctccccctcgtcggccactccacctggttgaatgcccactggagctactacgcccccgtcctctcgtgcgttgacctcctccacagaattctcatttacttcagcacttggtccctcgccatcatccatgttcatctgcacacttggatccttcgggtgaacaaacggaaccaaagctagaggccacccgcgttgcaatgcattttccaaataccatctccacactcgagagttttgaactggcattagttcccaataaaaaccctcggttgtccgacttactataacattgattgttatgtcgcttgtctgtggatcaattctcaagcccctcattaaccatccttttatagaaggtacactcctctcagccggtctatcaattcccctttctgatacaataaaatctgacagatctaccccagttggcccgtaatggacgtttcctggtccatggtaaacttggaatatttgtttgttcgacatatctgtcaacaaaataactagatcatattactctttcatgcaataaacatctacaacgtaatatcttcttgtgtaagccaatgcaacggtaatgtattgattccaaactagcagatctacgtagttaccgatatctacaatacgcacttctagattagtacaactaaaaccctaaaaatataatgcatttattcaaacaaatttttaaaaaatacacactatttaactcaatagtcacatataggatttatgaatattacctgaaatcggcgtctgaatccagcagggcttcgccccttcttctcttctcctcccctctcttcttttttttttcactggatttgaggagggaggaatgagggctgggggctgggcggcaggccttttataggcagcgagacctgccagagggcggcaaggggctttcttcaaaatggcctgccccgactggcttttttgcattcgggccccttgccgccccaccagagagcggcaagggtttttctgcaaaaaaaccctccctccgtcaccgcccgtacctcccccgtttgccacgtcagctgccaccccagaggtgggtggccgggtctatttttgtaatttttttggccgatagattatttctgtaaatatttaaaaaaaatctaaaaccgaaaaaaattcgtcgggtcgcccacgacatgaactcttcttctctttctagtacagaaccgggggtgttagaaaaaaaagagaattctccctaagccaagccgaagatccggcggcatccatgtcgtatcgctccctgctgcacaagaggatcctccccgccgccgccgccgccgccaccgccgccgccggagctgctctccggcgaccggcggccggctctcgccttctccaagcccgacttcaccaggttcgcctcccgctcacgaatccgtcttgtttagtgtttaccactagtagttttgaatgcggctaagattgatcgattatacgttgccaaaatcgacctgcgtcaagtcgcacaatatcagatcgatctatgcgcttttcccgggtagaatttggtacctcaccagcgtggtgagctagcgacgattggggattggggattccatccacattcctacagtgacaggtcttgtcctgttattactacattaagatatacattgagatatgcatcaatgaatgctatatcaatgaatgctcttgatatcttgttaggttatcaatgaatgctcttgatatcttgttaggttttggattggaacatatattcaacagctactgtgaatcgatagttcagggtctgtttactttgatgcaaaaaaaaaaaaaaccttaccaaattttagcaatgccaaaacttggcagcaaactaaatataactattttttttgacaactttaccaaaatttggtaaggttgaaaatggcatcaaagtgaacatgacctcagttactttcaaaaagaaagcatacatacagagtgcttcgttgtcaaattgttaatatcttagctcaaattggtgcaatatactcacctctaattttgccactatttgtttgcagggtaatggaaggcaacgcagcagcagtgcatttctgacgctggttttagagacagcgagaaggatatcgatagggaaatagaacagctcgctcaaaagttcgaagaaaacagcaaacggtggaagcaagaacgggaggagttggacaacctcaggaggtacacctcctcctaaacatcttgcaattttcttttcgtcatatgattcaatttaactccatcgaattgactattatatacactacttcctttgtttcaggttataagattttctaacattgtccacatttatatagatgtgtctagattcattaacatttatatgaatatgggaaatgctaaaaagtcttataatttaaaacagaggtagtaacaatcataaattaatctactgattctctttttccccctccatgttcttgtcggagaaaaggttggatttggaagagatagagaaatccagagagagaacacaaaagattttagacgtcgccactggtgttagtgctgggtttttcctcgtgggtattgcaagctataataatctgatatagcttaatgagatgttaccatcggaggcatctgtttttcagtttatattgtaactatttattgtagtattaataaatgttcagtgttgccaggaaggtggaaatgccttgtcttctttacctactttatttatccgtcctaaaatataatggattttgggtgtacgttcttgtgtatgtggcgcctcgagaatcaagctacttgtactcttgttgtatgaggtaatataggaatttgccaagcatcatgtgactgaccatgagaaccatcttaatttagcgatggctagcttctcttctcaggtgacggtgatggcagccatcaatttctcgaacaaatgacccaaattagggttcagagttagggtggaggaaggtaagtagggactacggattgttcgggtgtctatactactccctccgttttctaatacatgacataattaatgtttgatacgatgtttgaccatttgtcctatttaaaaacttatgtaaatgttgtttattttgttgtgacatgtcttatcattaaaaaaaacatttagacgtgttttatactttaacatatttgtcctaactttttaataagacaaataaccaaatattatttttataagtcaacatcgttagctattaaaaactggatagatgtagtataggaggttgaccagcggtaggtgatggacacggacatatgcttcttgttccatcttgatcaccgggactgcaactgaatcaccttaatcctcttactcgcacaaccatggttgcctacttgcccaagtatcttatcactaacgctctaccactagctttgggctcctcccttctattggctcataggatgaccgtgacttgaataaaacgaatggtcaaatattatgtgaaaagttaatggcgtcatacattttgaggaggcactagttattacaaattatacgtatgacacggtattagtagttagcgctgtctatgatgtctggccttgcagttgacgtgggcaatgaagagaagcagggcggtctgtaattcgttgcttgtatgaggtaaagtatgtcttagttcctgttttatagaacttttgatccaagattttagagctggttcatagctttataaatttatgaatatggatttacaattacattgataatgaatcattttgttcccattttacataaaatataaaattataaacctctgcaatttcacatctattatgcaatattgtttccgaaatcttttgatatgtatgtatagagggtgcattagcatataattaagcttaatttctgaaagatgtgtttggagaaaacggtctgaagaagagacgcgccttcaacatatattacgacgactctccttttccttttgcttacttaattcttgttggtaatcttcaatgcatatatcaaatagtttgtaataacgtatggcttgaacttgtcgtcacagctaaaaaacaatggcacgtggaggtttactgaaagttactaaataccacgaaggacgggctgcgatttcgtgattgtctagctcggagcgatcgagttgaaacataaaacagaaaagcaaatggacaactcgctgcagcgtaaaattgtcgagcttattcatttggactctaaacaatcttttctaaaaataaaaagaaactaattgattctgcctaattaatagataaattgctatgccatatccttcttaaatttggtctcttccagataagctttctttattaattgattaatttacttaaccaaatccactaagaatatgactgctggtgaccttcaatcaaccaatctctagaactctaatactctaatactggtactgactctaaccgatgatgactttggaggttaattactaaatttttgtattaatacgtacaagccaggagtctatctaagacttcttctttaaaaagcttatatgactggaggaacaaatattgagaaaaatgaattcaaccatcgtactcaataaatcatatcggaaaatgcaagtggtacaaggagtaatataataggttgaggttttgcataaaggcaattttcaaacaggcaaggtttaaagcttcaaagcacgatcttaatctattcatattattaatcagcacacctgcacgaactttgctttaactcatgccatcaagttgtagttccaaacattctagtttaacatagtaaaatctctaacttgggtatatttatttttagggttgtccataaccgattgttaatacattataggatccatcaaaacgtacaaactgttgtgctaaatgttagccctactcaacttcaaaacgtacattttgacttaacagagttctctctggtggtctgtcctcacaggacctgggagagagaatggtgatcacaatatctgcatgttttctgcttgatctatctatgcttatgcatgtttatacttcacatcctgcaaactatcccaaagcatttgctgtacgtagtctgcagctcgatctgtgcatttcacctcgtattccatcacatgcatgctttatcccattatctctatgaaaaaaaaaaactggcaagatagtcctcaagttatatatatataaatcaacatttgttccaaactaagtgcgcatagatatcataagtatatagagtgctcttacagaagagatcgagtgcatatcagatacatagccacaacaaaagatcgagcgctctcccacacaagacatcagagtgttcttacttcttacttagagctgaaccataagacaaactggctaaccagagtgcaagctcttacatgatcatattgcttaattttacatagccatagaagcaaattaattgtagcacagaaaataaaaccagatagatgtttgtttgctgctcgcccttctctgcttgactactgtttgatggatatttttaccaaaatttatagaaaaaatgataaatcattggtcattaatttcatattcgaatataatttgccgcccaattttccaaaatatatgtgaagggtgtctttgacacgtgggcccaagaaaatcaaatacaaggcggcgttcaaatatattaaatattggactcggtttgttgtataatttaaatagaaaataatggttcaaacagattttaaatccgatgtacaattcaaaagatttgagccatggaaagaaaagaaataagcaagtgctatcgttacttgctttggtacgtgagcatgcagtcattatctctaatttggagattaaacgcaggaggcccactgtcattagcactgttaattctaggatgatttaatcggcagtagttatctcgtgcagatcggtggattagtacgcctgtttgctgtcttatccaaggaaattcacgcgtgatttgccgttgtattcggacgtggttgagagtcccagcctgatctatccatccctacatctgcctataaagcaccttgactcccactgctcggggggctggcagatgcatccatgcagaagcgctaaggcgctgcacatacacgccacgccggcgccgccgacgctatgcgctgcgcagggacgcaggccctgcgccggtggccggtggcacatgcacccactcaattctcggtgacttgccggcggctcgcaagcaggcgcgccgtgcagtggagattaaacattcccccatcgagctgatgtcgcaggcggagatgatcgtgctaggcggtgagtacgatgaataatttcctccaatcctgttgctaaatcggtcgttctaatggatgattggagtacctcttttctcctcaacaattgaagtgcgatgaaaatcaaatcgcatctgctttcttgaaacataaacttgggcatgtctaatctacggatcggactatcctcgtatttttttataatcaaaacatatgttttacggtgcacatgccgggagcgagccccaaattataaaacaagggaaggagatgggagaaaatctctggtgctgaggcggctgacagaggaggagacgtaggcaggcaactctgctgcgtgctctgatctgcttatagttccacaatcccatatccaacatctacacaatttacaagccgtcaccggggcgcacacatgtacacgccgccgccaagcgctgcgccaagatgcaggccctgagctggtgatgataaacattatagctacacaaatatttgggaggaatcgggagaaggcaaagtaatcgtcaaggagtctgcttcatcatcgctggtgcaactccaaattaatcattcgccttctgtcgagccgcgcttcatcaacataatttctccgtcaagttatttgtcatcgacaacacaatggcgccgtagtgctgtgcagatattatgcatagcccgacattgtctcctagagggagcaaatatacaccgtagcgttgtgcagttacgcagtccggacggtaaaacagtaaagtggagtactggtgaatatgtcatggatacgttgtgaacttgtagccatggatataagtatccccaacggcgcatgcacatgcacacgtcatctttgtcaagcaattaacatgagctgcaaataaatacaaggcgagcctgaccctcgtgagggttggaccgtctaaattatcaatatcaaatattggatgtggatatttatttatataaacttggaatgagtttaagtcttattggcatcagaccaaccatgatatatacatatttatattcatgccggatgaatcacacattgcctcgtgcatgtcatgtacgagagcaatttcttctctctctaaattctatcagatggatgggggtgattctcaaaattcttgaagacaacaaaaacaatgctagccaggagggcgaggcatgcagattaaaacacacatctacatcatggccgagtgtcgacgagatgaaatggctaatttatcaatatttgtgctatgtccgagaccgacgaggccggacaacatattggctaaaagctaacaaagctatagccattcactcatttcatttgtctatgaccgacgaggctagacgaaatcatggctgagtgccgacgaggccaggtcactatactattaacacgtctaaaatggacggagccggatacaccgttgctgggcaccgacgaagcaaaagcaaccacaaaatccatgtttgatgaaggccgggatacatgactgagcaccgacgaggcaaaagtcacccgcttcaccaaattccctccacacaccgacgtgatggtagtgtattgtgattgggttttggcaaaacaaagccacccattacatattcactatattcaccattaaatctgcaccaacctcaatcttgggcgagcaaataattttgaagacgacgatcataaagcgcagcttaatcagaggtattccataggctcgtcctatggatgtaattaaccggcagcctcattgctaggcgccgggaatcagcagactgcacgcaatctccagttagcatacctttccattaagcattcctcgcgaaggcaaaaggcgaacttctgtgggagccctcctatgtattttgtaaacattcatgttaatgaatcatgattaataaaatacagggtttctctattttctgtgtgttcgttgatttgttttcatcaaacaactacatgtagacacgggcgaaaagatagcacccaccacaaaacccaaggaagttggcaagcctgcaaccaacgaacagatccctcctcatcctcttctcaaatgcacggacccgatctttcatcagccttaattaaagagagggaaaaaagaagaagccatgagtcacatttgtatagttgtacccctataaaacagatcttggcagctgagcaattgtacctctataaaacagatcttggcagctgagcaattgtacctctaagtttatctctaaaatcagacttcaacaaacatactccctctatagatgttaatgaatctaaatacacatacatgtctagattcattaacatatatatgaatgtggacaatgctagaaagtcttataatataaaacggaggaagtactaaacacacacacatcaagtttcagaaaagcttagctgctaaagtcatgtttgctgaagtaatgtgtgtatatcatagtttatttttgttgaaaagagcaagtcagaaatctgcatattcaccaatatggttttaaaacagcaatatccaaatgctactcttaagtttgaacatactcgcattccaaacagtgaatgcgcgcattgaaaagagccatagcggcacagaatttataagaaaaatatacttaattattttaagtcttaagcagtgttgactgaatttaaaacttgttacaaagaaatctttcaaggttaatagaacagatattaaacaggtactcacattagagtccagttcttcagtaatttatctccaaggtctgagactcactgtacttcaaaaattagttgcagcccaaacactctgcagtaatgctgagacggttagaatttttcctagcttgacaaaagattaagcctgctatttgaactagggaaacatatgcagataattaataacttattttctcacacatgcagaaaataacctttttttctcacacatacaaacaataactttttttcttctcacaggtggcatagtactacttatcagcttattcagaaaaaaaaatctgagaaacttatagtgtgaatgatcgcattgagcaaagcttaagtgaacgtatccgccagcaggatttaggaactgtaaagggcacaaatcgtatgtacaataaaatttaatctttttaccaaaatagatatgccaagacgtatgtcgttcatagctagcaaggtcaattttggtagcacagaaaaacaaaaggctggttctgcatcattaattaaccaatgtatcaatcacacaaggaaaacaggggaataaaagagtagaacctacaagtcagaaaaaaaccgacgtcgacggtaaacagcaaggggtcccaagaagagaagcggctggttggccaacgccgatttttgaatgggtggcttgttctcctgccagatgacgacgctagtgtgcaaatcaatcatgactaaaataaaaaaaatgattatattgaaaattcactcagaacaacccagaaatgatatcgccaaattcagaaatattcagaggaatgctcactcaggcatttttcattcagccttgtgttctgatgatagaagaaacatggtttatagagctgtttcacaatgaatatctgctcaatcaagaggaagcatttctcattagttttagtacacaccatgtttagagaggtgatatacgtttttagaagctgaacttcaactgaaataatacatcaaggggttagaactgaattgagtatttttttattattattattttacctatgctgcaatctaaacaggcaccccattctaaataatctgaaaactcaacaatctaaacaggtttcccattataaaattataaaacacatgaaattggttgtaccttcaattcagggaaggaggttttgcgagtgcgaaacacctgttcgtagtgatatgggaatagataatggtggcagcgccgtaggctgaaatgacggtgagacggccctcttgacagaagagtcttatactcaagcaattccttacactgatgagatgaaaccaattcagggagaaagcttaaaaaataaaatactgatgacatcccatattttagtggtgcaatcaatatagaaaacattgtcattatattcatcagaacttggacatgataatataccataatgattgtttt

SEQ ID NO: 68062 - DNA, 24894 bp, Oryza sativa
agggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgattgaagttctggtactatgctcacggtggaacgctcaacccagctgatggctcactggtcttcggcgatcagatacgagaggctgcgcgacgactaacagatgcagtggaagcctcctctcagggcacgttccgaccagacagagatagggacgagctgacactcgccctgcagactccagagcatccaggacgaacacgagggaaaggggtgattccttggaagattggtttcaaggaggacatccacacgtacaggagtcggatgaggagcaagagagataccgaggcaaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcatagagcatggacgccatgcaaacacaggacgaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactcgaaggtcgaagttgagttggtggaaggcgcgtacgaggacctcgagctggattaccctggaggagacggtgagacgcatctacgagacacatgccatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccacctcaggctccagcatcgactcctcctcaggatcctgcaccgactcctcctcgtgctcctacacctactcccccgcaagctcctcttccggcaccttcaaagtcaagggcccccccagctccaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcgaaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagaccatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcgaacttatagacaggtaccgtcataagttcctttgttaattaaaaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatgaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttaacttctgagctagcagcgagtactactacgtcgaaatcgtagctagctaggacatataatggattgtaattaatacatgactacatatgtttctatatgcatgtgtacacattttctataatgtaaatatattttggtcatatatatatctatatacatatgcatttgcataacatatatatgtataaatacatatatattatgcatgtatatacatataatataatataatatatatatacatatatatatgtatgcatatatatgtattgaaacatatatatgcatggtttatatatatatatatatatatatatatatatatatatataaaccatgcaacaacagggccatgcataaaaaaataaggtcagctcgatctttagtcccggatggtgtaaccaaccgggactaaagatcgatctttactcccgattattttacccgggactaaagatagcgatctttagtcccggattggtactcccggtttggaaaccgggactaaaggggggttacgaaccgggactaccgagggtttctccaccagtgcgtatgtgttgcgaccgaagaatcttatgacggtagtgcagattaacaaagacacgggctagctcctctgtttattgttttggccgtcattactggccgtatgatggcaacacgaccgaaattgccgacacttttttaatggcaacttgctgtgagaggacttttaatttgcatattcactctgtccattaaaaaaaacaaatctaatggttttcttttcttaatggaactatgcccattttttgtgattattaggaatttctattacttactttattcttctatgtgattaaattgtacatgttgctatctcaacacatacgacaagtagtcgcttgtatatattgttagggagaaaaccgtttagcatgaaaaaaaaaaagatgatgtggataccttctttgtccggcgccccaaaatattgtagcctctttactactttactagtggtggtccttactagacaacaaactcaaactcatatcatttttatacaattcgaacctctaaaaatatattcatgggtaaagctttggaagttggacatacgacatgcaaaccgaatgttttttgcgatcccaaaataggagcatctatcacgctttaaactgagaaaactcaaacaaaactaagaatcttgcatacttcaattcacgaaaagttaagacatccaaaattaattaacttcattttttttattttgtgaccaggaagactgctgtggttaatttgagataacgcgcacatgatgcactacatggaggttcaggcacactacttaaatgcacgaaaagttaacttttggaggaaactgcaactgcaagttggcaagttattgggacccctgttggctaggaatttctgtcaacttattcttttccgtgatgaaattgggttgtaatctctcaacgcaacacgacaactggtcctgtatgcttagaaaaggatcggtttagcaggcttcactgatgtggacaacgcctttaattagtttgtccttacacattaggttaattggcaccccaaattttgtagccttgagtggtacacgtccttattatatatccaagttttcagctagctagctctactcataatgatctagtataatgcatgaggtcatgacatactccttccgtaaaaaaaaaagttctagtattcacaaaaatcaaaaaatataattctttttagataatttttaaaattgtacttttttaagaacaaagggaatgctagttaatactatcatgcttaattaatctgcttgcttatggatgtagaggatcccagcatgtaatgaactaatgatatgatgctgatatataactccaaatctatcattttaattgggtagcagagtactgtatttgcctaaatgttatactaatatgcggacagtgatgacgtgttcagcccagcaatttaacattttagcccttttacaaacattattctccaaataaatccccatacaattataactaaaaatagagctcaacattagcgtcaggtccatggcgacgaagtctaacatctcagcaccaaggggcaatacaatagtaagcaccagtatattttgtacttttctatataggacagctaatataattagaacgctttctacagagttcgatcagctaatatcaccagaacacttcaattagaaaagagaatgaaaaacagaggcatgggaagtcgatcatgccagggagagattgcataagaaagccactaagctactccctccattttagtaggttataagaagatttaattttggtcaaagtcaaactactctaagtttgactaattttataaaaaaaaaatagtaatatttttaaccaagacaaatatattatgaaaatttactcaattataaatttaataaaactatgctggtgttgtaaatattactatatttttctacagaattagtcaaacttagaataccaaagtcaaaacgtcttataacctgaaacggaggaagtacttaacatcgtatagtaaaaaaatagcacattcatatttatcaagtactataaagctgagcttcacatagctaagtggcaagactgatgacgctgagatgttgggcttccgcgtcataggtgtgactgctgaggtttagctttagtatttatgaggatctatttatagattaaattttatgaagggactaaaatgtaaaaattgttgatgttcagtcagagatgatatgttctacggagtatctacgacctggcaaccaccattggtgatgctagctaggcgacaaagcagcactttcccgggagagactgggaatctaggctatctgtactgtagctcccggccacttgctacctgccttcttgcaccttttctagcccttctgtccttttttttttgcttgtcagaattcagaaagaaagatgcactataatctatgcatatccaagtcaatcattcattgtaaaagtgtgtgtggttctatttgtaactaatcgttgcaatttcttatacaatctttagccctttcaaagaaaataaaatagaagtctgtttagagaagccttaaattctaaaaatcaactagcgagaattcggatatcctgagaaaaccaatttaagtttggcttgtagtttattttctaaattctgtaaccgagcatttttatattttaataaggcagctatcaattggttacttctcaaaacagagggctatattaattgctagccctcaattttgttgacacaaaatcgggctggcatttgctgagttcctataaatacaggcgtacgtggttgcgcagtttactgcaccagcttaagcttattagctcctgagagtgaagcccctatagctgatcgaagctatgaagaagatgtggcgcgccaacgcgagagtggtggaaaggagaggtggtcgcgaggccgaggagagagggggagtaattagcgtggtgcttgcccatggctatggcgcgagccaggcggtgtgggacaagctcgtgccctccctctccaagagccacaacctcctcctcttcgactgggacttcaccggcgcaggcgccgggaaggacgacgacgagtacacttacggcaggttcgccgacgagctcatcgcggtgatggaggagcggggcgtgggcgcgtcgggcgcggtggtggtggcgcactccatgtccgccatggccgcctgcatcgccgcccaacggagacccgacctcttcgcccacatcttcctcgtctgcgcctccccgaggttaattaattatcgatcactagatttcattcatttttgctgttccttaattaattaagcccctcaagatcaaggatgacatatatagcctaattaccgttattattattacagctatttaatttaattagttatttttaagcacaattatattagttagtcgttgtgcaacacgtgtttggttcatccagataccactcccagtagatagcagctatgctagcttttgagttttatcattgtcaactttgtgtgttaattgtcagcgtgtgtacgtccacgtcagcacactaatcgcgaccatgcagcagcagtcacgttcactgttgctcacgactcacccaacatctagaaacatcatcaattgcatagcttcattcacaggaagaaaacaaacgcctccttttcgattctttttccctagatagcgcttgtcaaatctgaccaatgaacagcaattaagatttggccggatcgaaccgggacgtcacaacaaacacttgctgctagctactctagattagatcaaagctagctctagtccggatgagatgaagcaggatcgatcaatcgtggcctcatgttagttagtccataacctgtacgtgtggctaaaaaataggaacacaagaaattatccatgtatcaatcagtcaagatgtttcagatccttgcaactaactaattaatattctattgccaaaacatgcatgatcaagcatctaattgattacttagcatttctacgatcgattgcatgcaagtacctgttgaaaattcaattgggcatgcagctgccagataggagtaagctactctgacagtacaagaaactgatgaacaaaattaaaactgaactagagaacgtatagctgatgaaaacgggtggtggatcgatcgatcaggtacataaacttggaggaggaagggtatgtaggaggctttgaggaggcggcgatccacggcatgctggcagccatggagtcggacttcgacggctgggtcaggagcttcctccccaacgccgccggctacgcgtccgccgtggagcacctcctcaagagcttcctcgccatggacccgaccgtcgcgctcaagctggccaagatgatcttcctcggcgaccagcgggaggtcctcgacggcgtgaagacgccgtgcaccatcgtccaggtgaaggccgacttcgcggcgccgcccagcgtggcggagtacatgcacctcaggatgaagggcgccgccacggccgtcgagatcatcggctccgtcgggcacttcccccagctcgtcgcgccgcagcagctgctggacatactcgccggcgtcctgcgcctccgggaggcggcggcggaggcggagcacgacgacgccggcaccgtggagattgccggtggcatcgatgttgccatataggttgtgcatcatgcatgcatgcttgtaaaaagtctgcacatatatgcgtcagagctagctgcatgtgtgctcccttgtatgtatgtttgtttgttttgttttcagagcatgcattagttgtactattatgttttcctgtgtaaacatatcatagaggttatgttacttgtacacctgcatgcatggtttgggtatgctgatggatgtaagtaccattttcaatgggacatataccttattaaaaatgtgtttaatttcctggggctgtacattaatttcttagccggctggctgaaatttttcctgaaatttaaaggacataattgatcgaagattcgtcagcgagcagcctccagccacagctacaccgccacccctcgtcccctcccccattagccaccacacgcaccgtatgtgtcccctccaccctgcctgcatattaccctcctatcttctctgattttacatcgtctcgaaccttatctacgtactgtgtaattgcaatctcttcctccttacacttttaaggtgtccttgagagaggccaggcccttagccacccgtcactggctttacccttgtaagagacaatattattacataatggtggtatacatacagggaagagcttttttattgtccttgagcctgtgcagtatcgaatcctcgccgtccgtctagcccaatccaatagctgagcctctgtaccgcgtggtactgcagaatggattgatgcggtaccatgtatgggagggtatttttgtcttttcgcatactctttcttctcctctcccctagcggtcacacctgggcggcggcatcggcatcggccgctcaccactagcgtcgtcgtggcgcgtcggctagccaccagcgcgccccgtgcagctgctagcaccacgggagccaccgccacataggccccagctgctggtcgcaaagacaaccaggaactcctcgtcaggcaggcggcgtcatcttcgtcttcgttgaggccacagcaaacatcgaacaacgagcgaggtcgcgatggaaggttttttatggacagcaactggagaggacggacagcaacacacgtgcttccaaaagcaacacatgtgaacagcaaactcgatgcgacggcgggcgcggcggcggcggcctcgatgcgacggcagccacgacagccttgatgcaacgacggtaatttctttagcccgatcatacccatttctaaaccaacggttagattatattgctacctcatggtaccttttcaaagatagtaaagatgctctatagggaaaatgttttgtactgttaatggagtgtgctgtttcttgtagatgatcaaaatagttacgagaaaatctgaaaaaaaaaacatgacaagatagattatactcggtatcatatacatattatgaccagggttggaaattccggaacaaaatttctaaaatttcggtcatttcagacccctccgatacgatattatttcagcctaaatttttaaatttttttgtgaattttggtaatatccgaaatttcagaaatttcggcatttcggtgaggaccaatcaaattagctaaaccgaaaagtttaaccctaattatgacagcacaaacaccgagatcatattctatctacacatggagagaaaataagaaaagcaaaacagatagcgaaatgcgcggtcacgcgacatgtattgatttttgttatttttgtttctttgcagttacatgtaagtttgaccatgcgtaaattaagcgagaattcagagttatattaagtttgatcatgatgtttgtggaaaataggtgatgcatgtagtcaaattttccacataattaaaccacatgaaagaaaaaaaagggtacacgccctcaaggcctttaaatccactgctgattacatgtacactcaattgtcagctgcacaaaaagtttataactcaagtacactagtacaaccttttcctctgtcccttttaattagtttagcttggccctttttattgacgttatttatctatgatatgagtagagggaggcaaccagttaatcttgtatacttacattacttttttttttcttggataattcacccagacggcgatccatggattgagagacagactgcaggaaggcagcttcatcaccaacatcgtcttcaacctcacggatgatctcctcgatgacagactccttggtgagcgtctccctgcacaagatgctccccatgtcgaacgcggcgaggcccgagtcgacgcccttcttgagcagcatggtggtgacgcgcaggacgcgctcgcacttggctggcatctcccacccatggaacctcagaatggcgatgtcctcctccgcgtccagtgaccttatgtactccaccgtctcctcgctgaatggctcccgacactgcggccagtagagccactcgaatgtgcaatcctcaaactgatcgatgtgcatgcatcatcacaaaatggaatcaggatcattagctaaatcattggccggcgtgttttgtcagtgcttacactctcaggaagacagtatccatggtcgatcggaaccagggtgaggccatggccttgttcgtctctgcaggtgaggatgttgccggcgtgcctgtcggcgttggccagcctgatgtccagcacgcagatcttgtgaacttcgtgcaccgggaacgcacgaggtcccatgtcctcgcagctgccgctgttcttcacgaacgcttgcaatgaccccaccttgaacaatggaggaccttgttcggaagctgcaggttgcttgaagctcctgtgcatgcaacggaccagcgcggttggcgcgacaccggcgaagcccacggtggcggagccatgatgtcctgcgaacgaacggcggccaccgggagggtggtcgaggatgtaagcggcgacctctctgatggcgccctcgccgacgcgtgtccccttcttgagcccctcgccggtgggcgagggtgggaggccgcgtgggttgttggccgccatgggctcctcgtccaccggcttgaacacggcgacgtgctcctgccccgacgcgttctgcatgaaatacgcccccccggtgccctccgacgacatgatcggggcgttccccttctccatcccggccagcacggcgcccaccaggttctcgatcactggcggaagcgcggccttggggttgacgatgaccggctcgatggcgaagtccctctgcaggtgcaacgtcggttgagcagcgtcggcggcggcgttgcggttgcgcgcgacgatggagacctcgaagtcccggtcgacgggcctggcggcgagcttggcggagcggtggacgagcaggtggatgacggcgccgtcggtcctgcagacgtcgtggatgaggtgggcgtcgtcgagcacctcgccctggaggacgaggctgtggtggtcgtcgtcgtgggtggagttcttggcgatctgctgcttgacgtagccgacggtgcggccgggctcgacgcggaacctgaacttgttgccgtggacggtctggacggtgatgaggcggaggtcggagatgcggatgacgaggtggaggacgttgccgtgggagacgccgtagtccatgatgcggctgtcgttccgggcgagctcccggccatcgaagacgagcttctgcttgcggacgacgaagcccttggaggtctggacgcggagcttgacggaggcgatggagtcggaggccatcacccgcatgggcatcatggagagccccggcgcggtgaggtagatgaggatagattccgcggcgcaatgcggcggccggatgccgttcacattcaggcgggtggccaggagctcctgctcctccctcgccgcgcacagggtggctccgccggcggccgtcgtcgtcatggccggccaatcaacctccgatcgatcgatgtgtgttggatggcgcgtccgtctggatgagaaacagctaatggctaatgggatgaagtgatcagtgacagactaattaacatgcatgcatggggcctggcctccgatcctgttcttggctcaggcaaccgcgcgagggggagacggcggcgccggagcgcaagaaggatcgctttgtttcctttcgtttcgtttcgttttgggaattgcgaggcacctctcttgttcatctgctctgctggggacgaccagtgccaaaattaggtgcctctggcggtttgtcgcgctcgccatggctgccatttggtaccaatttgagatgctttcgccggaattgccggggaagatggagtcctcgccgatccacccgcgccgcggaacatggactgctgcgattggttgccgtcccccagttttgcgctgcgctggacggacgacattgtgggccttctgtcgtcgggaccacatgcatttgggcccaaaatgatgccatgggccaattagctaacttttcggctggtaggcccaacgggagattgccatcatggtgtgtgtcctgaaacaacggacacgcacgcacacggcacatctcgctctcccgattcccgaatgcccagattccttgtagactgtaaactgctgctggtaattaaccgagtgtgtgtacttgtgcaagatccaggcagcaagtgatgattttcccagtgcatccttggtcgaattgaagtcgctgcagtgaagtgcggatcgatctatcgatccagtagaggacgtggcagccgccgctgttggctttcacttcaattcaattcactttgatcgatcagccaccgcgaagaagaagaagaagaagaagaagaaacaacatttaattccccagctagcaaccgccggccacctctctctcccaattatcctctcctcctctgcttcatctccaccacctccgatcgagatcgagatgctcccctcaacggcaatggcgttccatgtcttcctcatcgctgcgctgctgttgctgcctctccccgccgccttctccaaggccgtgcgcacccaatcccttctcgccaacccgctctccccggatcctatcactcaggagcagcagctcagcctcgccgcgccccgcaccaacgcctccacgctccacttccgcctcgcccaccgcgagcacttcgcgctcaacgccaccgcctccgatctgctcgcgcacctcctcgcccgggacgccgcgcgcgccgccgccctgcttgctgcacccaacaatgccacgcgcccgcgccgccgcggcggcttcgcggcgcccctgctgtccggcctcccgcaggggagcggggagtacttcgcccaggtcggggtcggcacgcccgccaccaccgcgctcatggtgctcgacaccggcagcgacgtcgtctggctccagtgcgcgccctgccgccactgctacgcgcagtccggcagggtcttcgacccgcgccgctcccgctcctacgccgcggtggactgcgtcgcgcccatctgccgccgcctcgattccgccggctgcgacaggcgccgcaactcctgcctctaccaggtagcctacggcgacggctctgtcaccgccggggacttcgcctccgagacgctcaccttcgcgcggggcgcccgcgtgcagcgggtggccatcgggtgcgaccacgacaacgaggggctcttcatcgccgcgtcgggactcctcggcctcggccgtggcaggctgtcgttcccctcccagatcgcccgcagcttcggccggagcttctcctactgcctcgtggaccggacctcgtcggtgaggccctcctccacccgctcctccaccgtaacgttcggcgccggcgcggtggcggcagcggcgggcgcgtccttcacgccgatggggaggaaccccaggatggcgacgttctactacgtgcacctcctgggcttcagcgtgggcggcgcgcgcgtgaagggcgtgtcccagtccgacctccggctgaacccgaccaccgggcgcggcggcgtcatcctggactccggcacgtcggtgacacggcttgccaggcccgtgtacgaggccgtgcgcgacgcgttccgcgcggcggcggtggggctccgtgtgtcgccgggcgggttctcgctgttcgacacgtgctacaacctgagcgggcggagggtggtgaaggtgccgacggtgtcgatgcacctggcgggcggcgcgtcggtggcgctgccgccggagaactacctgatcccggtggacacgagcgggacgttctgcttcgcgatggcgggaacggacggcggcgtctccatcatcggcaacatacagcagcaggggttccgggtggtgttcgacggcgacgcccagcgcgtaggcttcgtgccaaagagctgttaattacagtactccactacggagtattagtattactaagcaagggtgttaaaatcgaactctctttttttttttcctttttgtgaatcgattcactgcttaatttgtactatcgggtatcgttaatttgttaatcaaagcctcctatgcctttggattttggcaggagggagctgcatgtacgtaacgttgttgttgtgaattgtgatcgactgatgatcgtaggcttaatttccatcaattcaggataggactaggaccaaggctttcatctgagactcaggctagctttccctgccgttgggttggattctactgctgcatccacgcgagtgtgttcatcatgatcacggacacatggctgcctcaccggctttaatttccttttgctccagctcctttccccggccggcggacggtggcggcctcgccggcccgcagagacacagggagcgaagcgttacgttacgtcggcaacggtgaaaggcctccgatatgcatgatattgatccccagcgaggcggtgagctgccggccggccgacatgttccccttcgtcaacattaatgccccctcctttaagcaatcaccgtcaccgtcaccggctaacaaagcaagcaagcacgagctagatcaaatgagatgagatccgccattgccggcagcatgggactctgcgcttcactttacttcctactgtgcacagcccttctatatctgagctgtgccacgtactaataagttgtgtgccgatttatggaggagaaaaacatgcaaaactttgggccatgcccggttaaatctaggctgcttatatactcccttcggttttattttaattgacgctttgaacaatgacacgctctacgagatatatctttgaccttatttttctattataatatatacaacaaataaatgcatgtttacttttattataatgttttgaaagacaaatctatatatgtttttctagtttctttaaactaaatatttttaatattattgatggtcaaagttataaaagtttaacctcaaacttatccaaaacgttaattaatttagaaccagagggagtactcccccgtttataaatatttgataccgttgactttttaagcacatgtttgaccgtttatcttattcaaaaacttttgtgaaatatgtaaaactatatgtatacatataagtatatttaacaatgaatcaaatgataggaaaagaattaataattactcatttttttaatatttaaaaaagtcaacggcgtcaaatatttaaaaatggatagagtattatgttgggaataaatccactttgactctccaatataggtccaatttaattcatattcctcaatcgtgcagcatatttgcaaacaaaaataatttgtgaataaaacttttatatacatgttcttagcaatctaaaagcaaatgctgaaaaataaacttcgatgaaagaaccccaaaatcaactccaaatttaagattgaaaattcaaattttggctaataagcataagcgaaaagatgaggcaagtaatactggatatctcaatcaggtggagcttggggagccaccgattgccgggaaggaggtttgttgaccttgttgcccttgatcgactggcaaagaagatgtgcccttcctaggtctcctccttgcggatgctcacggcggcgagcttcagtgccgcctgtttcttcatccccctccttgtcggctgccacgaccctcgccatggacaatgggtggtggcctcgtcgccctagacctactggcgaggaatacccgcccaccctcggtctcctcgtggaggcttgcggcagcgggctccggcacaatctgcttcttgaacgccacaccccatggccctgctcgttgaacgctggatgccacggccctcgccataggtggggaaaggaaagaaagaaattgataagtgagagggagaaagatagaggtcgctaacatgtgggccccacatgctaacttgaccggttagactaggtcaactagccacgtcagcgaaaactaccataaatactgttggggcgattttaatagctaggtggtcaaaatatatggtatcgcaattgatggatacgaattagattgactctatagggactcaaagtgaacttattccttttactggacgcgcatgccaagggccctcttatggatgcaaagaccatatatgcaaaaaaaggtccatatttccgcacccaaagcttgggctggagcctggtgacctgccaaagggctctaactttaaatcatattggacctgggccatatagaaaccgtgcaacctcggtggacgtttcagcttattcctttctttctttcctgagtaaattccttacgattgcaaatactggctaaattaagtatcaacttattataacatcaacaatctattttagattaccgcaaaaattaacgatgaaattaccacaaaactaaaactctattactagtaccaaatactcttgtgttactaacaaatcagacccacttttcatacaggtggttatcggcgtgggtgaaacagtccatgtcatcgtgtgtactgaagtagtcccatgatagtaagagcaagtttaatactatagcccactgctagctccaaattatctatagccaatgtaatagctaattcatacaatatttagttactatactattaatatatggtctcatattcatacacacattacgtcttgtagtccgtgctgcagctggctacagatctatagcccgatgctcttctctctttttctttctctctttaaaatatgtttatagctagcttgcctgctattgtacctgctctaatacttctatgccatatgtgggctacaactcaacgagcatgggcgggaaaccaacgcggtcggctcacgaggcataattaaccaatttctttgttagagcaagtttaatagtatagtccactactagctccaaatcatctatagccaatgtaatagacaattcatacaatagttgcttattatactattaatacatggtcccacctattatacacctatcatacacccaatatgtcttggaaaccgtgctgcagctggctacagatttgtagcccgctgctcttctctctcttcttttatctctttaaaatatgtttatagctggcttatagcctgctattgtaccagctcttagggtgtatagttgctggccgcgaatagatttgggcgtttaggcggctttggctaaagtccatcaggggaaatcaaggccgcttgatcattctggcagtttgctaggtattgatgttgcatctgctttaaagtcagagttgatgtgtcgcttatggtaatcattgaggattataatagagttacagttctatgattattttatctataatcgtcgaaatatcattgcggtaaggcaatttaaaaatatgtcgataatatcgtagcaaagttataatttagtcgttaaatttgaatcgagagtcaaatgatatggccataggcggcatgcacgacacaacccgacccagtaacccacccaccgtgggctgttaccataaccaatatcatccgaggttaattgtgttgaaccgaattgagcgaccactggtggagaaaccatctttggtcggtcggccgaaattcacaatagtcccggttccactaaaaaccaggactaaagatcaaggactaaagatgatctttagtcccggttggtggctacagtggatatatttgatctttagtcccggttctaaacctgtcaggccccccgggatctttactcccggttggtgttaccaaccgggataaaaatcctaactttacttccggttggtgttatcaactggaagtaaagatctagaagatttttagtcccggttgatattaccaaccgggactaaaattcaacgcttaatatataatccttctttcctatccactcctccacaaccgcctcgcatttatcctctcagatcgatctccctctcctcctccccctccgcctcctccccttcctcctcccatctcccggccctctcctccccgtcctcccttcccatccgctcagatcgatctccctctccttctcccctcctccctctcagatcgatctccctcctcctccccctccgcctcctccccttcccctcccatcccatccccggccctctcctccccctcctcccttcccacgcagcaggcggccggctaggccgcgcacgggcccagtggcgagcggcggcaggcggcagccgctgccggcatttttttttttttacaatttgtgattcactaagatgtataattttgtgatttgttgcatgatctgagatgtataatctgtgatgtatttggtttgtgtgtaatttttttaagatttgtgatgtatttgatttgagtgtataagtaataagatttgtgatgtgaatgttttgggatgttactttgatttgaggtttgatttgggatatgtatcccacttgatttggggatatgtatcccacttgatttgggagaaaatacaggattaaactgtagctaaaaaacaatgaaaaaaagactgccgctaccctctctttattcgcagttggtgttaccaaccggaactatatctttagttctgggactaaagatccaaccgggaccggggttaccaaccgggagtataaatggtttctccaccagtggaccgtttattacagtagcttattatggccagcaacttgttatatatattactacctccatattttaatatatgacgtcgttgacttttttgtccaacgtttgacaattcgtcttattaaaaaaatatgtaattattatttattttattatgacttgattcgtcattaaatgttttttaagcatgacataaatattttcatatttgcataaaaattttgaataaaacgaatggtcaaacattggtcaaaaagttaacagtttcatatattaaaatacggagggagtagatcgatagatcgtactactatgctcacgtgtgttagcttgtcgtggcggccgcagacaagcagcgagcgccccatatataagcgtgaccactagctaatcaaaagaatgcatgcatatgcatggatacagagatgagatcatgcatgggatgaaaagaaagaaaggaggccggtacggtgctacagaagagagatccatggctgctgaccccaagatcttgaggattaaatgtccggccggccatgccatcctgccagttgatagctagattcatcagacaaattgatcagtgcagtgcagtgcagtgctagctcaactcctcatctgatcatcttggactatataccgattctttcaagctgttcgcctgccccgctttaatttggccgggcctccatccgatcgcgattcgagcacaaggctgcatcgcgatctcatttcgctatcgctttaatttgatagccactccgatccgatgatgaggacgagcttgcatagaatcaatatgatatctcagcagctgcatgttagtatgttaatttccttcgctgatatatgatcgatagatgctacttgttgcccaccggccggcagcggaagacagatccatgatccatccatcatacgccgatactattagttggtgcaggtgatggatatactccatattgcagccagccatgcaagcacaagcacggtacgacgattcatcgactcgggcatgctagcttgtatctgaattcattctcaaatctcaacagatatctctctccttactttctactaccccttaatttatgggagtagctatatttatggccccatatttttcaccaaaaaatagtcggcatgtatttacattgtaagttactaaattacatatgtaattttagtgtatttacaatgtaagtaccaaaattacatatctaagttctaaattacacatgtgtaattactgtgtaaatagagtaattacattcgttgatgaccaacacgtgtcatgcaaagcaaaaaggagtcgcgaacttaggaacaagttgttcgatcagcttatcagatgtactttgcacgaatcatgaagaagattagatggcagatcgtcaaactgactgtatttagcctagaaatatatcgacataattttagcaaagccgtaatttattagcggtctgcgtatggtttatctccttaattatactaggtgataccccacgcttcgctgcgggattcatcgatgaatatatgttaaatattgtcgaaatgatgaaggttgaaatgttgagaaaataatgtgaggaagatgatttgacacatacttgttgatctctaaaatataatattgtagatgatgtatcatgcttgcatgagatttaaataggctagaatagtaattgctagtgagtgaagatgtggcatacttgcatggaattttaaatgggctaaaatagtagtaattgctagtggatgataatgtggcatgctttgcatgttaagttttagtttctaataattgttagtgggtaccaactatatagaaagtatatagaaagtatagatttgaggtcaaaatagctacatggcccgttaactttgtggtctttaattaattaagcatgcatctaataaagtcatactccaaactatttttttcgagggcaatatatactccaaactaataaactaatactcgatcgatttatttggcaaatcaacgaggcgacaactcgatcgatccagcttcctttttttttcgaacaacgaattgaaaaaataaactatgttccctctgtcccaaaattcaaataagtttattttttatccatcctacacgtaacaatacaagttcttttcctagttgcgtttagccgctgtagtagctagtcttttcctagtttcatttttttattttgctttttataccttcccgacataagtcggtctggctgattgtattgtgtagcaaaattttttttccttctaatatattgtcgtgcaatccttttacacattcgcaaaaaacaaacaatacaaaacaaaaataactaggattgtatttagttcagcgtaaagtttgaattttggttgaaattggagatgatgtgattgaaaagttgtgtgtatgacaggttgatgtgatggaaaatgactgaagtttggatccaaattttagatctaaacataacctagaatacgcccactttatcaaatcccaattcaatcattcctctctttatctattcccaattaatacacttatctcattatttcacaaactccagtgatctcattttatgacgaagagagtatgagatcatatatcgatcagtccataaacatgaaatgttgaatttgatttctacaagttataaaaaagaaacaaattaaacagaaactaattaacatgcattcacaattatataaatttcttgattatttatatgcagcctataaaaattaaatttgaccttacatcattaactctttagaaattagtttttattgggacggagatatcggtgggtgtctcttgttcctgatggactttctaattaagtcgtactcctaccattgtcttgttcccgtgacgacccaacaacacccatcgcttactctacagatcaatgtgaagatgtgttggaattaatagatgggctaaggcccattcaaaaattaattctttagaaaatcacaaaagcccatctcatggggtggcatgcatgtggagtttagtatcaccttgcttattctaggagagggggacttccttaaaagggatgatgccctcttagccacttgaagcatgtatggtggagagaagaggggaaacacgcgcgcgctcgctcgcctcgcctggtagggcaagcgttgcggcgcgcgtgcacgacgtacgcgtcaaatggtccataaaattggctcctcacccttgcgcagatgcagcctccttttgcagttttgttttgctacaggaaaattcggatttgttttgttttggaaacattccgaaaaatccggtgcgtgaaaacggcatggagtccggataagttacgcgcgacttatccggttcggttacgcggactggagatcgtgcgggcgccctgatcaagtgacctatcctatataaactgagccgccgccttcacgcaaaacacacgaaatcaatctagggtttgcctcctcctctgtgctgcgccgtcgctcgtgggctactccatcccgctcgccagcgtgcaccggcgatcgggagggcaggtctccggaacctctgccttcgacgtcctgcaccgggagaaggtagcaataaggtttttgggaagcgcttcgcgcaactgctccctgttcgtccgcgacagctcgccttcctctccgctcgcgtgctgcgcgccttcgtcgacgctcgcaaccgcgagtagttcctgccgagcaaccggtctttccgccacctcggtacgtgttcgacatgttacgcatatttgatctgtccatgttttactgcttagtttacatatgtagatctaatgatgcgttaatgctagtatacatctgtaatgtcatgatttatttatggaatatattaaatcattatatgcctatattatcaacaattcaaaaaccttactataggcgctgtgattttactatggctggttttgccgatgcactgaggccggataaatttaccggtgtgcactttaagagatggcagatctgggtcattctgtggctgacagctatgaaatgcttctgggtgagtactggcaagtctatgggcgttcttaatgctgaccagcagaaaaaattcgatgaggccactactctctttatgggatgcattcttagcgtgcttggcgatcgtcttgtcgaggtgtatatgcatatgaccgacgctaaggaattgtgggatgcactgaatactaaatttggtgctactgatgctagcaatgatctgtatatcatggagcagtttcatgactacaagatggctaacaaccgttctgtagtcgaacaggctcatgagatacaaaccatagctaaggaactcgaactccttaagtgtgtcttacccgacaaatttgtggccgggtgcattattgcgaaactacctccatcttggagaggtttcggtactgcactcaaacacaagagacaggaatactccgttgaggggttgatagcgtttcttgatgttgaggagaaagcattgggaaaaagatgccgcgtctaagggcgatggtgggcagtccactgccaatgttgtgcacaaggcccagaacaagagcaaggggaaatacaaagctcagcagaccaccaacttcaagaagaataagaacaacaacaatcctaatcaggataagaggacttgctttgtgtgtggtcaacctggccatctggccaggaagtgtccacaacgcaaggggatgaaggcacctgcagggcagacctctaattctgctaatgtgaccattggcaacactagagatggaagcgggtatggtaatttacctactgttttttcagttaatcaatctactaattggtgggttgatacaggggccaatgtacatgtttgtgctgacatctcattgttttcttcttatcaggtcgcacggggttccatcgtcctactggggaatgggtcacatgcttctgttcatggtgttggtacggtagatatgaagtttacttcgggaaagatcgtgcagctgaagaacgtgcagcatgtcccttctatcgacaggaatcttgttagtggctcccgtctgactagagacagatttaagttggtttttgagtctaataaagtagtcatgtctaaacatggatattttattggtaaaggttatgagtgcggaggcctgttccgcttttccctttctgatttctgcaataagtctatgaaccatatttgtggcagtgtggatgatgaggctaatgtatggcactcacgtttatgtcatattaattttt

SEQ ID NO: 68063 - DNA, 1651 bp, Oryza sativa
caagattcgtgctgaccatttaacctaactcctccgcctcctctccccggttccagatcgcgccgccacccttctcctcccgtcccacgcgtgaccgccgccaccaccgccaccgctcccccggccgcctcgccggcgccgttgaccttttccagccagccggcgaggcgggcggcggcgcggtggcggtggtggcggcggatcacgcgtgggacgggaggagaagggtggcggcgcgatctggaaccggggagaggaggagaggagttaggttaaatggtcagcacgaatcttgaagcacatctaatgatccaaaattcaaattataggaggtgggattttctgtcacatgatatatatatatagatagccccaaaaaaattggaaatatgacctgcacggtgggcccaccgggacagagagacggcccgactcatcaccgaagtgccaggcggctgggcctagctgtcagtgacacgtcagagcgccggcgtaggggaaggctaccccacccgaccacgacttccaccgtcttcttcctccacgttcctatccatggcgccagttcatctcgtgacgtctcccgctcccgctcgcgttgctcccaaaaccctagcggctagagccgttgctgcccgatcgcgcagcgagatcgatcgggcgcaggcgccgcgccacgccgcggccaccggcaaccggtagtacaaggaaggatggatgagagcggctgcggcggcggcggcgacgacggcgagtgcatcacatctctcccgtccgaaccctagccgtatgcggaggaggagccgccacgcggcgccatcggattcgctgcgtccgctcccaccattgcgcgagtcgcacaccggccggcctggttcctctcgctcgccgaaaccctagcagacgaggcgagcggggatgttacgaggctacgccatggcggctgcgggctttttggtggcggaggcgagcacctcgagcgcttcggttgtcaaggtaagggtattcctcaggtggagtcgtggtccgtggaccttgaggggtttggggaatttgtcttcctagtgttttttgttacgagggtaatccgtgattttggttattcgactcggaatttcactggttctgatgcgatatgcttgatcactcagttgaattatggggaatctgctctggttttgatgaaatctgcatggcaataaggcgattttggagattgcgtcggttaattgggtcatgctgttggattcccaggaggttgatatcaggccacctgaatgtcacgaagcttctagagcgagatagaagttcggggaaccatggcttggatggagccaccacaacttcacagctaccgtccaggttgcctgctacagcgatactcaccttgcggtggtaaggactcatggaaactttgtcgcagttaattttaattgcactcattttcttaatgtgtcattgtaatcatgcaatcgtattgttctggtctgtctgtgtatgggcatatcactttctttatgacatctctaattttgtgtcggcaaggatttgatatatcgttatctacccgtggaaaaactatattgtgatatgttcaacggttctgctactcttttgggtccattcgtgataactgaggggatcggggtgc

SEQ ID NO: 68064 - DNA, 20211 bp, Oryza sativa
aatgtgcataacggacaccacagctatagttgcaaatgcaatgtgggtcatgcagggcgagaggaggagggcgcgtgctccgtggggaccaccagacacgggcggtgcactcctcgagcgttggatcagccgcgagagacgatccgacagccgagatgcgtccggttcaggtatttaagcgcgatgctttcttctccgtgcgcttcgctgcacaaccacttttccgcatctctctcctctctctctctctctctctgtctctctcgcaacgtactcatctcaagagcagtagcggcgaaaggtgcgaggtgagttgtgagattctcctcctcctccatccctaaaccctacgtcctcccaaagcgccgtgagattcttctccctttccttcgatctcgctcttctggtggtgttctccctctcctcctggtggtgtggtttctgcgtgcttgggtgtttgggggcgtcgcggttttttctggttcgatcatgtctttcgctgttgtggcatttgatcgagcagcaaccgcgtcttgacctctctttgaatcttgaggcgtttcgtcatccgaaacttggggcaaggatcacagctgtttgatctttttttccctctcttgtaggcttcccgtaccgtgcttttgttgcttcgatggttttgaagtttgaggtggagtgtggttttctgagttggaggaggaggctgatgagcaccgaagcttcatggtgtattgatcttgctgtgtgtgtctcaaagtctctaccagtgcgtgcgcaaaaaattagaccacgtcaattcgtttctcttgtctgcttgtattttccagtttgttcagttaattttggtgtgttgcgggagttcagtttctgaaaatttattaaccagatgccgccttcggccttcttgttcttttcgctgttcctgatgcaggatgcttcttctctatgtgtctctctgacgtgttctcttggtttagtttctgtttggaaagaactccatgttctctctgacgtgttatcttggtttagtttctgtttggaaagaactccatgttctgttcatacaatgatttctgcatgtgtagcttggttaaactgcttgtttttttttccctttttgatgagaaatcttctgattctttgcatatcaaagaagctttcatctcttgaatcttagatttgggatccttctaagcccaacggttttggttctgcaagattgtacaatttcttcatgtttgttacctatattttacttctcagtgacgctgtcatgttgtattctccttgctgaattctactataagtgcacgctgctgtctctgtttttcttcttctgttcacttcatactctgtttcgaattattgaagttttaatacaccaaagaggtggccatatcgggaggaaatttattgtccttgtacaatacgccttttctgtttgtttcctcttcatttcactttggaatttggtgttatgatttgtgtcagaaaagcttatatggcgttcttacaaaaccttgtatgcattttgttcacagtaatattttattttaattcttccttgcttgattcttgtataagatataagattaatgtgtataattactgcagcattgcaactgaagattgatgatctcatgttatatgtctcaaaaatgcatttaggggccctgataaatagtgtcatatcatgttatgtctagttgactccttttcgtgtttttacgaaagctcttatgtatttaattgatctgtagtgttttgtaattgtattcactttactctttctccatatttgtcaataaagttattgtatatttgtattcatgttataaattttcagcaaaacaaaggtctgctatgggtaacagccttcctgtagaatcaaagttcactgatgaaaaagagaatgacagaattaagtatgttgtgtcgtctatgcaaggatggggtgagaaaatggaagatgctgtgagtaaacttgcagccttttgtatgacaaaaaaaaggatagttctgcaaaaatttcttactgatctgtaagtaattgtgtaaaatactgtgactgacatatgccctctatattctctagcatgcagctattctaaatcttgatgataccatgacgtcattctttggtgtttatgatggccatggaggtttgatcttcattcttttttttttttggtttcaaatcctccatattgtcggcataactgtttacatcatgctttgtttgtctttgtgtgtcatgtgtttatctatgtgcatgtttcgagaactttactgtttatgctgaaacttttacctgtcaattttcaaataaatattaagctacagttctggataatgagccaagtttgctaattagtactaatcacctatgtgcggtgtgctttctaggataacatgaactgcgtaaacagaatattaatttacgagggataaaacactgcatgggtgtgagttaatattaacagtcatgataattaaaaggatagccactgatgaacatgttggttaatttatgtgtggtgctatttttcttatgatacctatgaagtgctgatctgctgtgttcatcacattgttttgctttataagcttctatatgcacataggagtaatcttgagccaccattctgagttgtttattttctatctcaggagctgaagtagcatcatattgtgcaaaacgatttcatattgagctttgcaatcatgaagactacgacagcaatctaagtaatgcgatgaggagtgcgttttacaggttattttcgcctagtctatatcattttgttgcactgaatgatgctgcacttgcaaatttggaatttcattgttcctgtgtaatttctgcagcatggatgaggacctgcaactgtccgatgcttggagggagttagttattcctcgtaataatggatggatgtattttctcaaggctgcagcttgtacaagcatttgcaaggtatcttttaaaccctgaacgtcttttaatatccatatattgaaggtactcaaaactgtatttgttggacagtgcatattgtatctatgaaaaaggaaatggaagaatgtgtgtgatatcgagactattgttctttcttgagatgtactttggagttggaagagatatgtttaaccctaaccttgactaattgctcctattaaaaaaggttcagttagttacatatcaattgtctggtttactgcgttggaggccaacaggttcttaagttcacattgcaccttggttcttatcatactgtggtactaccctaaattgaggtattgtttgcggcatctcttctatggtaatctctttcatacactggtttggctttcagaaatgtttttctttgtctggtggctttggtgagctatttcttgcttgacttgtatttctaactatgttgggattccctattatgtcctccaattcatttcttctttttccaggcaacttatactgagccagcatatgaagggagcacagcatgtgtggttgtcatcagaggtaaccaattgattgttggacatgctggtgattctcgttgtgtactctcaagaaatggtcaggtatagtgactatttccttttcgaatttcttgttggtacctaatttgcatgttctcttattttggtgcctaacatttgtgcttgtttctgttgtgtcaaaaggccagtgcattatccgtcgatcataaaccagacagtgagtctgaaagagagagagttcagaatgcaggaggagtagctgttgggcatagttatcgtaaaataatggggaggtgggtaaccaagaaacaatggggctttactgattttaagggaagagtatcaatctcaagatcaattggtatagtcttgcctggatctgtttttcgtttattgcagataatagcaccgaaaaaaaacatattatgttgtgatttgctgatgtgttttacccacttacatttcaggggactttgcttgcaagaagaacgaacgtttacctcctgaagatcaaatgctgacatgtaatccggacatcctgactgtaagtgccactatgtttgtttagtatttggttgaatatgaagtttgtgctgctttgtggggtctgatggaaaatccccctttctgcgtcagatggacataactgatgacatggagtttcttgtgatagcaactgaaggcctctggtaaattttgaacaaaaaataactgacaataattattatttgatcattttgatgtcactagtactctttgtgatgctgttttctttctcctgctgatgcatatatagtttcatttatagttgcatacctactgtactatgttttttccatgcaggtgcaacatgacaaatcaaaatgtggttgatcacacacatgaccgtcttttggtgagtccttttcttttgctcagtttgtcttcttggcaggacaagagatctcctactgtaatagcaaaaatattttgtgtcaaattctaggaaatgacttcactcaggcaatataaagcatccgattttttaaaaaagaaaaaaacaagtgctaataagtacactgtcatctgctttgtgattgttcgattcttttgttgttaaaactgctgttccttttgccttgatcaatattgctgtgactaatatcttgcatgtttacgtcaaaaaaatatcttgcatgctcgattgtttcgttgttaaaactgttgttccttttgctgtggccaaatattgctgacttgctgtgaccaattaatatcgctatgcaggagggtgcagaagcgcgtgtcatctgtgaggagcttgttcagtttggcttgccatcgggcgacaacacgaccgtcatcctggttctgttcaagcccggcgccttccctgctgttccgccggtcgacaccgacactgacactgacagccacattgacgatgatgtcgaccccaccggcagcaacaatgccaccgcgtccgacaacaacgaccccgccaacgaggttgatcccactgccaatgccgggtctgacgacagcaacaccggcgacgaggtcaaggtcgacgccactgccactgccgtcggcagcagcagtaccactgccgtggctgctgacgagggcactggcaatcctcctcatggcgcactagttgacaccgacgacgaggacgggctgacctactcccaggacatggacttacccccggcgtcgacgtcccccccaaccttcccggacgaggacgacctcccccggtctaacccggacaagtcccccccgcacgtatcaatcttattcagagtttgagtccagatcaggaaaggccagaagctatagctatgattcggaaggagtagttcgtttccacttgatttttgtctagcaagtcgaagatgatgtgtgatgatgcatgcaggatgatacttatcgtaggtggtagtagcactgtgcattgataggagtagtttgtttctgctaccttgatgatgtgtgatgatgcatgcaggatgatacttatcataggtggtagtagcactgtgcattgataggagtagtttgtttctgctacctttggtttgtggtttttgcctgctgctttgcataggagattaagattttgcttgtcagactcagataacttcaattaactgtctacgaaatctcgctcactggtttttgagttgtgaaggtgattgatctagtgatgctttttgttgttgttcattttgaatatctgtacatactgctgggttatgacttgccccgtttctgaatacttagcttttaaccaaattttctcttcattcttctagttatcttgaatatgtaatcagtaatgtgcttggtttagcggggaagtctatttgtccctgaaggacaattccttctgctgcatgccacccaaaaactcatcaaaaagtttgaaaaaaagaaaaggacgagatagatcgaataaataatatcactccacaaatatgcaagcttaaatttgacacatataagtagaattagaactaagtaatttgattgtgaataatacgaaaaacttttttttatgtcaaagacaaaaagctagggcgaattctcattgaatctcggttgttcatgatagtgatgaccatccattcaaatcttcaggtagcacccccaaatcttcaacaaggcggaaagttcgtgtgttaaaattgttgttttttgttttgtatatgttgaatttgaacttacatgtctgttgagtaatatattactcctacatgttaatttatctttaaaatctttaatgaattttcggatgacatacatacataaataaaaccggagacaaatccacctctttggttaagttagctctgttgcctgctgagaccggctctgaatccggcccatggggaccgtatctgaatccggcccatgggctgttaggccgtagcgggccgcactcctctttcatcagttcggcaacagcaacagactcggcatcactcacccacccaacccagtacccaagccccaacctcgcctcgcctcgtctcgagccgacctaaccgcgaacccccaactccgacgagaacgacatggacgccggcggcgaggaggcgaagcaggagcgccacctggtgctggcccacaagctcttcctcctctcccaccccgacctcgacgacctcgccaaggtcgccctccgctccgacgccctcgacgccgtcaagtccgatggcatggcgccgctgttcgagtcgctggccgccgcgggcgtcctggagccggacgacgcgctgctcgccgagatgcgcgcgcggatcgacgaggaggtccgcaagctcgacgagaagtgagtggattcttcctctcttctgattttattttactagcaaatatgcccgtgcgttgcaacgggtgaaaaaacataatgataatatacatttttcatgcataaccatgtcgataacaatcagaaaattagaactacgaaactttattttctagcgcgttttcttttgtgcttttttctgacatttttccctcacgtgtttttttaaaccgtttttattttctcgcgcattttttccttttttaatatactgtagaaacttctctttttatagttagattagattagattagagataaagaagatatataaatggactaaaaaacgacgaatataaatttgacttttttcctccgcgcttttttccgtccttttaattttttttctcgtgcatttcttttacgaagggtttttttcaccactttcacatagtgtcaaacctttctagatataataggattcgattttttttaccgcatcacgtataattcctttttctttagaaacagacaattttttcgcccttttttatcgcgtcaacggagtcggaatcgttttgattttttcccctttttttggatcggacagatttttttttgcccggtttatttcgcccgatcgattttttttaccgcgtcacatataattccttttactttggatttttttcgccctttttttaccgcgtcgacggagtcggattcgttttgattttttttctccctttactttggaattttttcgccctgttttcaccacgtcgacggagtcggattcgttttgatttttcccctttttggctttttttggataggacagatttgtttttttttcgccccgtttttttatcggacttttatcttttttttcgcatggtttttttattttttttaccgcgtcacatataattcctttttctttatcggaaagttttttttcgcctttttttaccgcgtcgatggagtcagattcttttcagctttttccttttcttttatcggacaaattttttttcgcccatttttttttctcctgtttttttcggatcggactatttttttcttttttcgcccggtcgatttttttaccacgatatatataattcctttttctttggaataggacagttttctttttatttttttaaactctttttaccgcgtcgatgtagtcggattcgtttcgatttttttcctttttttgctttcttttttgtcggacagatttgttttttttccacccggtttttttccgcccaggtttttttatcggacttttcttttttttttttgctccacgatacatataattcatttttctttggaataggacagttttctttttatttttttaaactctttttaccgcgtcgatgtagtcggattcgtttcggtattttttccttttttttcctttttttttgtcggacatatttgtttttttttcgcccggttttttttcgccaggtttttttatcggacttttctttttttttttcgctcggtttttttctcccgttttttgacggacgacagaagcacctagagaagtgttttttttcttttctccaatccaatacagatcggatctcttccagggaaatcagattttttttctccagggaatcggactctttttttttcgctttttttattcattaaacggtttgtctctcggactttttttttccctttttaagggatcgggtgtttttttgccagggaatcggacatctttttttttcctgtttttttcgctgtttttatttatttgtgacggacgatggaagcacctcttattttttaagtagtagtagatttttagccccccaaaaattaggccgccccttgctgtgttgcgtatgcgataagttttgcgataactcaggtgttgatatggtccgtttgccttagctaacctagcttactctgtgttgcgagatgtagatgctaaaactggtagatagcttgcatttgattcggtagttgtaatttatgaattatgtttagggccaattaattcacctctatgcaaatctatactacataataataaactttttccacatttttgttttagattcatgtacatattcatgattttgtacattttctctgcaatgtgtaatttagcatgtagagaagtaattgagattgctaaggatcacaatacgcaacttctcgagacaaaataccagtgtaaactaatgtgaaggaagaacggcatgttgaaatttgttagaaatagtttccttgagaagttgaggttccagtcaagatatgtccttttggtgatttgcatgtttcattgtttctactttctgatcttgctcttcgcatctgtatctaatatttcagttactagaagtttgataagaatcatttggttcctctggaagtaactaagtaattatgtttcatgtatgaagaattgctgatgctgaagagaatttgggtgagagcgaagtgcgtgaggcccatctggcgaaatccttgtacttcatgagggttggagagaaggtataaacttgtgtgcttctatactttacattaagtgtgtgcttgagatttagctatttgcattctttgaaatcaatattgcaggaaaaagcactggagcagcttaaagttactgaagggaaaactgtagctgttggccagaaaatggatcttgtgttctacactttgcaaataggccttttccacatggactttgatctcatctcaaaatccattgacaaggcaaagaagtaagttatagctttgattgtgcctttgtgaagttccattctgccatctatactggagcaatgacatctgactatttattgtgttgattgaagcctgtttgaggaaggaggcgactgggagagaaagaaccgattgaaagtatatgaaggcctatacttcatggcaacgagaaacttcaagaaagctgccagcttatttttagattccatctcaactttcacaacttacgagttgtttccatatgatacttttgtcttctatacagtcatcacaagcataatcacattggatcgtgtatctctaaaacaaaaggtaatttcacttcttacactctcttttctttttcttaattgactcactaacaagaaatatggcaggtggtagatgcaccagaaattttggcagtgattggcaaagtacctcatctatctgagtttctgaactccctttacaattgccagtacaagtcattttttgttgcattctgtaagtgtaaagtatcttgataagctgtctatagttttactgttacagtctgtacggctgggctatatgaatatatggtctaaacttcttttcagctggcatgacggagcagattaagttggatcgctatcttcagcctcatttccgctactatatgagggaagtgcggaccgttgtctattcacagtttttggagtcatacaagagtgtgacaatggaagcgatggccgcagcatttggtgtgactgttgatttcatagaccagtaagtgctgtcacccatccgcattagttttatgtttgtgattcctgtgtaggacaaaacattcttttctgttcctgtgctgtggagataatatctccctttcatttgttccagggaattgtcgcggttcattgcagctgggaagcttcactgcaagatcgataaggttgctggtgttctggagacaaaccgacctgacgctaggaatgccttctaccaagcgaccatcaagcaaggggacttcttgctgaaccgcatccagaaactgtcacgagtcattgacttgtaaattcaatggtctacgttggacgttggaggtgtgatccttctagatccctgcaaagctccccatggacataaaccgtactgaaattgctgttctacttgtactcctaggctcatgagaacatgatctttatctcggtttgattttattgcggacagcaaaaaggttttaaagagaacctccgtgtgcaatttcagtaagtgtgctttagatttgtagaacgagaagagtgcatgtctttctgagatgaatctgttcgttcatttcaagtcttgtggcgatgtctttttggggttccgcactgtttgatcttatgggtctctatatgcttgaaatagcctgacatgctagtctcaaaagagaactgcaaaatagaaccaagcgtaattccttttgttctgagcctgttttcagatgcaacatttcagaaaacagataaacagcattcggtcatacgcaatcgcgcgcacacactgtacagccactgtaactcatcagaaacgaggtcaatatacaacagtaattttcgccgttccataagtccataaaataccgatttctaatatcccaggagactctagctgcagatttagtaaggaagaacaaagcaagttactcagagtcacaggcaagctacacattgtttgttgcaaaaaaactcgaagtattgaggaactacacagagctaatctgggacagggaaatgagcacactggaaaattacagccggctgttcacttgacgatctctggtatgctgcgctttacaatcagctctccgtttctgcagatcagaaatggtaaccatgcaggcaggtcagaacgtctgtgtttgatggctatacaaaggcctagagattcacacaagcaaaatcacaggaagcagtaatgtagtttagtgtaggagcattgtctctctttacttactgatcccctgcttctggttctgcttctccttctgtttccgcttcctctcgtttcgcctcttcacccagggcttctcttcctccactggcgcttctgcctctgcgctgacagatcctgtaatctgcgcaaacgactctttggcgccagaggttacgtcgccgaagaagtccttcaccttgtcaaccacagttttgagctcttctttctttgggagctgggataatcaaaacattttactgttagtgacttgctacctttgctcaagacatgcttactgaaaacatggtcatttgtacatttactataagaaatgcctaccatcctcacttaactgcatagaagttcttttccaggacaacattttctgagctactatctagtactaggccaaaataatttgaaggttgtgctctagaaaatgtcagcctaggataaagcaagatacaagtctgaaatgtacattttcagagatttcagctctaatgttcatgagaaattgctactcctacataacttgcagagaattcgacagggagaggagataaaaggcgctagcgaaacgtacttcgatcacattacttgtcgtcagcgcagacctcaggttcccattctcctgctcacccaaatgagacaggtaaattgcaattctcaattttttcgagtgcaacaacatacaatcacgcacagaagatgaggactgagaaaattaccacaactttgtagccatatcgaaactcattgtcggtcttcagcaccctgtactgctcttttgctgtgtctattatgtcatcctcatccttcagaaatcaaatcatgaaacacgcacatttaaatcttctcttttctacaactcttcaaacacgattgtgtgacaatttgtgtaagcaaacagattgtgctgttaattactttgtagatgacagcggcaaggttcctggcgagcgtgtccttgtagatgtactttccgaggaagttgtccttcgccgcgagcatgatcttcgccgtcgtgccgccggtgacgatgttgagcgggtaccagaagtacacctgcagaaaccagaaaaaaaaacccacacaaatcttgatcacacgcacgcgaagcattgggatcaggaatggagaagaagaagaagaagaagaacaagaatcagggcagcacggacattggcggtgcggatgaagatgacgaagcgcgggttgccgtcgtcctcgatcttgggcagctgcggcatgcgctgctgctgggaccgccggtccgaccaccccctccccctcgcctccaccaccagcgccgcccgcctcgccggcctcgccgccgcctgcagcctgctcctcggcgccgtcctcatcagcaggaagctccccccgccgctcgcctcgccgggcgacagctgccgcagccgcgcccgcgccggcgccggcgaagacgcgctcagcgacgacacgccgcccaccacctccattgaaacctcctattccggtctcgcgccgctgtgtggtgtacgtgttgtggccgccgacgaggacttgggagaagaagcagtggaggggaagaggagggaagataaagccgtggaggggagcttatctggtggtggtgagatggctgtggggtcgctgatgtgtgggcccgggtgggggttctggacccacttgtcagtgtgccagtgagtggaccgggattatgcggatagtttttgagatggtttcgtgctctcggcatacgtggcgtggttacggacagctgaaataaaggcacagtagcagtcgcgtggcttctcccggggacgccacgttgcacatggaacggcctcccagtttatatgttggaacacatcaaatttacaaaattcttgcaaaaagataagtttaacagattactcgttggattattgttactgccgattatatatttgatttatgaatgaattaatgttttaaaagtaaactttataaatggcttcgaacaagtgatctatagaaaacatatttaagagacctagagtaaataatctgtgacaataatccaataaagtagctaaaaagcccgtttaatccctaaaatttacttatatgaaaactatctgttctaaaaggaggcctaaaaggctaaaacggagtgtaaacaaagctagaaagatgtaattattatgtttaaatttaaatggtattatttgtagacaatgaaaagcatttttttccgaaataaaattttagaagtaagcaaatacacgtcatcgagaaattgaacttacgacgtttccaaacatctcatttcacatttcaattaaaaaaaacttacgtacagatgctaagctacaattacatgcaccaccttttttacgggcgaacaaggcgttcgtcggccaagagaaatttactaagatcaaattaatggttacaaagaggtttaccacaatcaacaacatcgttgatgaaacctcacacgtttgcaacggacttctgcttgtagcatcgaaatgccggcaattttttccccttccagatcaaccccttcttttttctgctacctgattctcttgactctcctagctaatcgtcgatcccctatatactatgaattaattaaaccccttacgatgatcacattaagactaagggcaccacaagtctgcaaggaagcaacaggtagtcaatggcgaatctgctcttcatctcgtcgtaacccggccacaatgacgccatctcatgcacgtcgtacatctcctccatgcagcgtgccaggtacacgacgctgtatcccgtcaccgcctccagcccgtcgtcctcccacggcagcggcggcggcagcccggcatctgccagggtggtggccgcgtaccgcgcgaggtacaccgccgacgccgccacgacggacggcgggatcctcaggctccggcggtcgagcagcgtgaggtcggcgaggtggtgcgccacggcgtgcacggcgtcgccgccggagtagccgtacctggcgaggaagtggtcggcgaaggtgtgcgcggtggggcggcccagcctgtacccgagcgcgtcgagcaggtcgagctccctgtcgagcacctcgctcctggcgatggcgagcccgccggcgccggcgccggcggcggcgtcgccggcgctcagcctctcctcggggaggtcgccctcgtacttggccgcgacgaagacggccgtggcgccgagcagcgcgagcaggcggtggctcaccgcctccaggggcctcaccgactggtagcggtcgacgtaggcgacggcgcggtggagcgtgccggcggcgaggccggcgtgcccccgggtgatcccctccatccacgccacgagcgacgcgcgcgtccacgggtcgacccggccgcgctgcaccgcggtcatgtagtccggcgacgaccgctcgccggcggccatctccatggcccggaggctggcgtacaggtcggcgtcgtacgtccacgccgcgcaggcgcatctctcgccggcgcagtagctcccgtccgtctcgtcgccagcagccgctccgccgggaccattggcggcgacggcggccgcgatctcccggagcatagcctcgacgtcggcgtcggcatcatccagatagagataatccatggcgcgctctgggcgcggagctaggccgcgagctcggtgatggattcttggaagatgggaagagagggagacgacgtgctcgctgcaaatttatagcgccacggatatgatgatgaacccgttgactccgacatgatcactgcgatgcgacgagctcaagagtccgaattggagttgacctggcccgcaagtccgacttgatcccgtactgggccgagggatacggcctgtgggccggcctgctccggccttgggctgcagctagctgggccggcgactccgtggagaccatctccgggcaaggaatttttttcatttttaatttttttcttttaatatttacagaaataatctatcggcgcaaaaaattacaaaaatagaccctgccgccctagtggtgggcggcaagctgacgtggcagacggcggctcgacggcgccgtctgcggccgtctgcgaaaattgcatttagccggcaaggggctaaatgcaattttcgcagcatttggctcgtacattttgcatctgggtcccttgccgccctactagacgtaccagccaaaaagtactaggcccgggctgtcttttttgcatgggggcccttgccgccctaacagagggcggcaatggttttcgtgcaaaaaaaaaccctccctcttccgtctgccgtcaccgcccgtccctccccgtttgccacgtcagcttgccgccctagtagagggcggcagggtctatttttgtaattttttgcgcccatggattatttctgtaaatattaaaagaaaaaaatttaaaaatgaaaaaaattctccgggcaagtggcagtaaaaagaaagaacctaacacgtgcatcaggaacatgcttagatctgcgagcacagtggtcagcttagccatgtggttcatgcactaatcggagtacataatacattagtacatgaatggtgattattctgtataatttactgttatatacagcgtagtactccgtactagcgagctggatattgagttcttgtttatgggttcgttgagacgtcagcgagattaggacgaagacgtttagtttatcataagaccatttaggtcatagaggtgtcgaaacatgaattcggcaataataaaagggggtagcgcacgagacctaaaagtggatggatgcggagacaaaggatttagacaggttcaggccctctcaatgagaggtaataccctactcctgtttggggatttgaatccgccgggtgtattatagatctgacgatctagtttgtgtcatcatgccccctagagggcctcctgcccaccttatatagggtggggggcaggattacaagatagaaaccttaaccaatacggtatcggtttcctaaatctactttacaatattatcaaaccaggactttaggccgttccgtaatatataaggaaacgtaatacccgagtcatgatctattacatattccatagatataagttatcccctatgactagtcggataaccatgccgtatgggtatggggtacccataatatccacagtagcccctgagaccttcgcagtcgaaaagataatcttctctcgaaccagattactccaaagccgagtgcttcaatcatctttgtcatggtctcccgagtacttttaccaaatctgaagactgtggagggctggaaaataaagtcaggtgcaccgactagatgcacctaataggtgtagcccccgacaatgtggttaattgaacaaaccaagcatatagtcaaggaataaataatccaaccaaccgagtggttttgataatcgtaatcaaccaagtgacttgatatcaatatatagcatatgcggtgtgaatcctccaaataacatgatccgggtgatataccaactgctttgtaaaatatgatgagtgatatagcaaaatagctataaagaagcttgaatgctgtgaataaagaaatttccaaagtattgggcatacgccatgcgcacactgctttaacagatgtgcttaagtccctaaaagacacatggtttcaccacacctggaaatatatggcatatgtggtataacatccgagtaagtaaactcataaaggatttaccaaccgcctgacaaatgaccataatatataatcagcctaagccataatattggtcaataaaaatgcacacttacgtggcaaaaagcaatgatattgtatccaatcaattgcttgataaacccaaacagcaccttgactatataaaaaagtcagcgggacagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgataccctttaaaggatgacgcatgtaacatgctcccgggtaacaaatcttctgggtaatatagaccaagtgtagctcatatgaatagcttctgatctgaatgattatcccttatgggatactccaaaataaatataataattgaatcccgactggcgcaagtattcggttgatagcctttacggggaataataattggtccagtctttgagcatagaagatagactcatgactatgaatccatgtggaatgtatccggaacaagtcccaattggagatataatcctcacgcttgagttgatgagcccctgagcatatagcttgtcattttgtcatagtcaaaattgtctattggcaatagctgacgcagtcggcatggagatgaaatgaccaacatgaagacgaaattgctcatcagaagtaacggaagatgtcagtggtagtaaaaaacagtgacaccaatcaaaggtaatgaagttgcataaccatggaggcgaagaaacagtcggtgttgacaaaagcaaaccgacgatgaagacgtagacgcgcatcaacagtgatggcgaaatccactaatcatgaagatgaagaaaatagttgacgacgacaaacgcaaccgacatgatgaagatgacgatgtcggtgatccagccaatagcagtgtagcaaccaatgataatgacaaagacgctcatcagcatttgcatagtaggtcaaccgtcaaggtgaaataataagtcggcgaaaacataatcatccattagcaacagcagagatgtcagggtcgatgaagcagaggtgctggtgatgatgttagtgacaataatccatcaaattaatgttatagctgttgtagatgcttcacttggaggagagttgatgttgttgcccaactcgtctaaaccgaaatatttgaagttgttgaagtagaatgtctgctccgaagcaaagatgaagataatgactcctggagttgactcgtgggttgatgaattgatttcttcagcttgacataaaatttgtcaaattttgagccttgtatttgtgtagcccccgactctttgattagttgggaaacaactgaacatagagtcgaaaactgtagcctcttgtcgtcgaatagttattgcttgattgaagatatgtgttgaagatttccaagtagaaatcatgaatgttggagagcctcttattgtagtaaaataacatggcatcgcatgccgagatgtcgaggcatgatgacaaagacgtcgtggttggtgaagtagtaaaacttgcgaagtagcagcaatagagtttgccagtgccgaagataataaagatgaagtcgctccaccatgatgacaaagttgcatcgccgtgatgaagtgaacacgagtcggcggcaacagaagcaaactggtagcgaagacgcgcagttgtgaagataaaagcactagtcggcggcggcataaccagtcggcaacggaagacgatgatgtccatcagtagtggtagctgtataaaccagacgtagaggcgagggcactagtcagcagcagacgagacgaaaggcgatgaagatggtaaggccaatcaacactggcagaatcatgcagccatggaagtgaagaaaccagtcggcagccatggcaaacgtaggcagcttgtgttgaagatactgatgcctataagtagtgacagcgatgtagccagccgtgaagaagatagcatcagttggcgttataacaggccagccgtgcaagcgatgacaccagtcagcggcggatgcggcggccggtcggtgaagacgtagacgcccaacaacggcagcataaaggccagccgtgcaagcggaagtaccagtcggcggcggcgaaggcaagccggtcggtgaagacgtagacgcccaacaacggcagcatataggccagccgtgcaggcggggacaccagtcggcggcggacgaggcaagccggtcggtgaagacgtagacgcccaacaacggcggcataataggccagccgtgcaggcggaaacaccagtcggcggcggcgaaggcaagccggtcggtgaagacgtagacgcccaacaacggcggcataaaggccagccgtgcaggcggggacaccagtcggcggcggcgaaggcaagccggtcggtgaagacgtagacgcccaacaacggcggcataataggccagccgtgcaggcggaaacaccagtcggcggcggcgaaggcaagccggtcggtgaagacgtagacgcccaacaacggcggcataaaggccagccgtgcaggcgaggacaccggtcggcggcaacggaggcaggccggcggtgaagacgtaggcgcccaacagcggcggcataataggccagccgtgtaggcggaggcaccactcggcggccacggaggcaggccggcggtgaagtcgtagacccccatgaacgggggtgtgaccaacccacccgtataggcggggacaccagtcggcggcgacggaggcaggccggcggtgtagatgacgatgcccatcaacggtggtgtggccaaccgaccgtataggcgaggacaccagtcggcggcgacggaggcaggccggcggt

SEQ ID NO: 68065 - DNA, 25333 bp, Oryza sativa
agaggtctatttattaaatatgtttttcaaaaggaccaaattgtgaaacatccaggatgggagacggcctcgagctgtcgagcatgccggccggtcacctactagccagcctcggcggtgcgcgtgaagagcttcttttatgtcctcgagggccatttttgctcgcctccacctcacccacatcgttaacattttcttgcccattccgagtgaagcttctgctgcttcgatggttcaacgtgctcgactaaggcgaggtggtgcgtggcacggatgtttgcgagacggcgttcacggcaagcactagatcagcgaggatggcatgttcagcaccctatgctgcaatatgcgtgccacgcccggtggccggtggcggtgatcgccaatcgtcatggcgaggatggcgagcatgcggacatgagcagcgagatgacaatcgaagacgcgctctggagtctagactcgctcgacgacgtcggctggcgcgcgcgtacacgtaccggaatcgcgcaaaggaacatcgatcatcgtaatggcggattccatatccccacagcgcgttcaacgtgctcgacctcagcgtgtctgacttggggctgatcctggccctccttgttggcgcgcgcactcgtgaggcacagcgctgccacatcggtctgggactgggatggcggtcggtcgttggcgtctcgttccacttccacgctctcagaacggatcttggggaagcagagcacgtacgtgccagcgcccggtgaggtgtgtgagtactggatcaacgacgacaagttaattaggcaccctgtccctgtgccggcgctgtgcgcccttcgaaaatgatcgacgtgctgcgccaggtgccggtgatcgccactagccgtgcatggcaacgacgatgagcagcagctatgcaccttaaccggccggtaatggtgcaagtggagcaggctacgccgccaacacggcttcaattattttcacataatcactgccctagaatggaactaatagggttgacattgtagtttttagttcaatcgtcatgctaccatataattgctgcttcagtaattgcatctcaaacagcaacttatatggaaatgaggcccaagtcaatactagctcaatacagaaaaatagaatcaaaatgctactccatagagcaaaacatataaccaaatttgtttaatccataaacaacaatagctcagtacagaaacgtatgctatagagcaaaacataagaactacgcagcggttgccaccacctcctgctcacgagcgggctcgctcctcgcctcctcacgagcaacacgatatcgtcgctgcatctgccgcatccaccttacgaccactgcagcagttccctagataaaactagttatcatttatgattcatcgctcttcttgccaccaatagaagtcctatcattgtcaactagtatttaatgagtttggcccagtcgatcgagcccagtagaagataaagtgccccatgcccgaggatcgtggtgaaggtacgggcgaaaaccatgcgtcgcatcacgacatggtaaccccggagcttggccctcatgtcgtcgtgggagtgaaggagaagatggaattttttttatcaaataccctccattttcattaatagaacgtagatcaggctacagcacataaaagagaaaaggaaggtaggttctgctacagcgactaggccatataaaaaacaaataggcgttcacaggttttacaacaaaagagcacaaagaaatgaagcccatctaagctaagaagcaaaagactcagtattttctaactatccagacactgcatttagtcctctctatcagcaagtttcaccccttcccaatttgtacccgacattttaaatttgttggatgaaatagattctgattacaataaatttgaaatatatatgtttgaaagtttgttgatacagtctcattcacatagtagcaaaaaagatacaaaacgggaaccttgccatgataagataacccctaaaacaaaactaataagaaaaacctgcgaaaaacaataaaaagaaaaaaaagagagaggtcttatatagagcataagaagtatgaaaaaccccaaaaaaagctaaagcacttgagagagttgattaaataaattagggtggactagttaggcttacaagaagcaagattaaaacattgaacgatagagaagtagtttttgtgtgggagaattttgattgggttaaaggaggaaatatttgggattatagagacaaaaataaaaaggaaaatatttttttcaaacaaacaattgtgaataaaaatgataaggagtgggatttgatgattgaggctgcctagaaagaaaacaaagaagatttcctaagagaattgacacatgaactgaattgggaaggtaagtataaaagagaaaagaaagaaataatttcacaaatagaataaattgacagaaaaactaaagtccatgggatgaattgggaggacagtgaactgagaagggagttcgaacagaagttaaattatacaataagagaagaaagggttaaatggtttcagagatgcaaggatcaggaaactatagacggggataataatacaaagtactacaatgccaaggcaaatggtaggaagaggaagatccatatatatagcctactgcaagagaggaatgagcaataaaagatcagcacaatttggttgagtacatcaccaattattataaaaatctatctggtcatgctgagacaaatatcatgtcccttaacatggagggatgctcagagcttcaggaagaagacaaagaagatctgattaaagaaattttcaaagaggaagttttggcagttgtgaaagaaatgagaaaaaattgggaccctggtcctgatggtttcccccattgaattctatgaacatttttggggcttgattagtgctgatttgatgaaggttatattagatttccaacaagggctcattgacataaaacctgaattatggtgtgataatctagtctcaaaaactcatttacagatttagaagtataggccaatttgcttgttgaatgtgagttttaaaattataactaaagtgttaatgatgagattggttacaatcattcaatacttgatagccaaaaaccagacatcattcataaagaacagaaacataatggagggggttttggtcttgcatgagagtttgaattccttacatcagaaaaaacagagtggtttgttattcaaggtagatttcgaaaaagcatatgacaaagtcaattggagcttcatttttcaagttctgaaagcaaagaaatttcctgacaaatggtgtgattggattatgaaaactgtgagaggtgataaggttgcaattaagatcaatgattagattggtccttatagtacatataaaggtctcagacaaggtgaccccatgtcgccattgctttttaatttggctgtagaagcactgactatgatggtgtagagggtgttggtgatatgtcctagaggcaatcatagagatgattgtatcgcatattatgtttacatatttatctgacattgttccttgaaatagataactcattattgattaatgaatatgtgattctttcatgagactttttatgttgtatgttactatttctaaaggatctctgatcaaatatcatatgtggaacaaatatgtttaaatgatcagcacatgtattaattgatgatcatgtctcatagatcatggtataaagataccaaattaataatgtggacacatgttggggaacatgttgttggatagacccaacaagagactgcaagagccatatgtgttgtgtcatcagtgatatctcatttaatgttggtgctgaatccttagacctgagattatcatggttctcgacatgtgtagtagcttacttagagactgctaaacactactccgtaattgggtagttataaaagtagttttagggtatgctatgaaacatgtagtgggatatgaataatcaagatgggatttgcccctcctatggagagatatctctgggcccctcgatgttatagattatggaagtgtatggctatgccaaagatgattgaggagtcaatcacaaattatataatctatcacaggttcgagtgaatgattgagctaatagaggatggcacatatctagccttgagcttaatcgatgtcgtgaggcaaaggggttcatacaagtatacactagaggttcagccgatgtgatctttatgtatgcccgatgggtcaatacgttctgctaggggccgctgttgacacgtggaccgaaaaggagtttttaggttacagccgagtgtacgtgaacctatagggttgcacgcttaatgggccggaataagggaattggatggagatccaatatgagcttaattcggatagggatccaaataggagtcctacgggccttggaggcccgagtcattggatcctatatattcgtgactggtgtgaccgacggatgtattgcatcacgtgagaaactctagccgccactcccctctccgagcaaaccctagccgcgtgggggtgctagcacatctgcacgtggtgttccgtccctgtacgtgtggataccggtagaggcgccgctgttttgcggtgctgatcggcgtgggagaacgacgaggagaacgcacgaggaggagaaggtcgagccggtgcgatcgactacttcgtctacatcgacgcgcgctacatcgcgagggttccttcacctacttagcactttcttccgttgtgcagcgcgtcgagtggtaatgatctatgatctaatacttgcatggttcctagtttatacggtagaaaattttgatttatgctatcgtagcctctgcatatcccaacagagggcagaacagaaacagttgattcaagggttggagataaataatgagtgtagtattccaattctgcataatgcaatatgcagatgacaaaatctttttattgagagacaagctggaagatgcaaagaacctgaaaaacattttgtgtttgtttgaacaattgtcaggactgaaaataaatttcaacaaaagtgaagttattttccttggaaatgatgtactgaggcatcaggaatacagcaaaattttcacatgcaacaaaggggacctgcctatgagatatttaggaataccaattgatcaaaaacacattctaaataaggattgggggcagacagaaaagaaaatggagaagaaagtgggttgctggcaaaggaagttgcagtcaatagggggcaaagttactctaataaattccagtctgagtggaacacctcagtatatgttgtatttttatagaattccaaaaggggtcaaagaaataatggatttctatagaagaagatacttgtggcaggaagatcgaggaatcagaaagtaccatatagtgcagtggcctgtggtgtgttcacctagagatcagggaggcatggttttgttagatttagacattatgaacaaagcacttctcgggaaatggctttggcctttggaaaatacagatggtatatggcagcaattacttagagaaaagtatctgataaagaaaattcttgcaaacaagaagttgaaaaatggtgattctcatttctggcaggggatgatagatattaaggaggcattcatgcagttcataaggaaaaagccaggggatgggaagaatattcttttttgggaagataattggttgggtgggagacccatagctgaacaaataccccaggtttacagtgtcactcattcaaaaaatataactctagctatggtaaaagaaaaaggttggcaatcaattgtttttagaagaaacttaactggagacaggctgaggagttggaatgaataaaacaaagttacaaagatgtgataatatcaaactgtctatacaaaaaagataaactaagaatggggaatacactctcaaaactttttacacttttttgaaaatacaggatatgatcccaagattgccagggaagcacaaaaaaatctggaagttaaaagttccattaaagataaggatctttatctggcttctgataagaaaaagcatcctcacaaaggataatttaatgaagagagggtggaaaaaaggagctgagttgtgtcaattctgtgataaaaagaaacagtaaaccatttatttttagattgtccacttgccaggtttacatggaatgtggtgttctgtgcttttgatttaaaacagatcacaagtctcaaacatatttggggagattggatacagggcaaggacaaaacaacaagccaattgattctagtgggggttgcagcagtactttggtcaatctggaaacatagaaataatgcatgttttagtcaaatttatcctattgatccaactgaaattattttttgtgcttgttactggatatcaacctgggctgttttgcagatttcggaggaaaagcgaagaaagctgcagtggggggtacaacttctaaaacaggtcacaaatgagatcttcaaatcacagtatggatggagaacaggatcaagaagattggaggggtgaacacaactggacttccagatggggaggagaatgaacaaaaacaccaactacgtgcaatatctggatagttggaaaatactaaggcttttgcttcttacttcctccatttcatattgtaagactttctagcattgctcacattcatatatatgttaatgaatctagacatatatgtgtgcgtagattcattaacatctatatgaatgtggacaatgctagaaagtcttataacctgaaacagatgtagtagcttagatgggttttcctttctttgtgctctttttttgtttgcaagacctgtgaacgcctgtttgttttggatgtggcctgatcgctgtactagaacctatatttcatttttctcttttatgggctgtagtctcatctgggtttctattaatggaaatggagggcgttgtcatttgataaaaaaaactccaattgtatagtgagctgattgaccatcgtctccttcactcccacgacgacatgagggtcgagctccgcagttaccacgtcgtgatgtgacgcatggtttacacccgaaccttcgccacgatgctcgggcacaattgttttgctttgctttgtattgctttacaagttatatatgcccttatattggaatcttaatcatctaaatatattaagcttatcatcggtcttgttagaattaatctaacattagatacatatttgttcaaaaaaaatattccagtataaggttgtatcggagctatagccgatacatgcttaaatttgttcatcagctatgacatgaacttgtataatctttatttcatagaacttcggatacaagtgatttatactgtctcgattaagtttgatttatcccaatcactgttatttgaagtaatgacgattcatagattatgtaacgttcatctttacagccgatgacacgaatttagggtcttaattttattgctacatcttatagccgattcaaaccaggttgcatcggctaggttaaagacgatatgtcatcggccctccagccgattggctatcgtttataaatttaactgtttatctcgtttcttgttggttgtaggatcaaaccaattggcacgccctagaccctaaggcaagtttttgcactagagttaagcaaatctctcaggccagtgtatgtttgtttgcatcaacaatgtgtaaagtgctagatcggagaccattgatcctaatccttttgtatgtcgtatgtatttgtatatagagacttatgtgtattgttggtacattacatttcaatatagtatcggtgaatgatttacctttttctattatggtttctgaattacatacaatatgatggaaaacttgcattacatgtgcaatatgcttggtttaaatcatagcggttattacgtgtgttgcacgtgcatgattacttaagtaatagtagtattgttgcatcaagcaagaagatgccaacactaaatctatcgatatcttaactaatgaaaagtggaactcaaaatgaattgaggatgagtgacatcatttaatgaattgagaataaataaatctggaccgttggattagatggatgataaaaataataattaaagaggcttccggtgataaagctactagaagaggaaagaaagagtaaagggaaaaaaagctagagaataggcatatgatgcaaataatttacgaaatgctcctataataaaataaattattttacaaataaaccctcatcctaatcacatattcacatgtcaagattcggctatttaagaacatatacaaatgtgcgttcatacgattaattttgtttctaacaattaattgttaacatatttgaggcaaaaattgctacaataacatgcacaatcatatcgtccgaatataggtttaacgtttttcacatgaatttaaaatgaaatcaaattcattccttaaaaacctacaaaatatttcagcataggctataaatagtgcgcgcctatacgaaataaggggtcatgcagccgtgaaaacctataaaacaatgactcacgcagatataaaatttgtaataaatattaagctatctattgtatgagcataatattagtcatcctgacccattttttttcgagcgatgagaaacccataaaaacagattgccactcatgtgtaccatgtaacatgaggcatagagtcacgcgaatgcgcaatatcataggctagtaaaccattatgaaaagtacgagtattagattgtgtgttctgtggtaggggctggaagcttctttcccgcacacgtaaaatagggtggctcattagcgcatgaataattaagtcttagcttaaagaaaaacatagaaaggaattaatataaatttttaaattaattttgctatatattttttttgtgaaaaaatgtgtggtacatctagccattcgggaagcgtactcagtgaaaacaaatgagtagaaggtaggaagaaagagtatagataagtttgtacttccagaggggttgataatacttcatttgaacaaagactattgtcaaagttttaaaaacttggactatgaatatcaagatctaaagtatgtgttagatataaggagaactatatttgttttagtctaaaaaaacataaataaaattatatgtttattaatatttctacatatattgtaataaaaaaatagggatgagtccattttacacccttcaagtcttgtctaggtttaaaactcatcccaaactcttaaaccgggtatccaactgttgatgcgaaaaacacgaggcctgaaagatctgcttaacttcagtgtaggtccaaaaatcttgcctttaggttcgtaagcgtgccagttaatttgatcatgcaatcaacaagaaacaaagacagaaaataacaattaaatccataaacgatagccgatcggccagtcgctgatgacgtatcatttatatttgagccgatgtcatatttgaatcgatcggcaatcatgaataactgaaaaagaactaaatctattcgatcggctgtaggtattaacgatatataatccttctgtcgatgtatatttaaatcaagtgattgggatagatcggtcgtcatgccgagacagtataaattacttaggtcaaaatatacattaacataaagattataaccgttcataacatagccgattagatagatctagcatgtatcggttaatactctgataccactctatattaagatattaaagcaggcagaatatatcagacaggaagcttaatataccgaaatgcaacaagatcttaacataaagggcggatttaacatgtcaataaagcatataagacataaagtagttaaatcagataagatcggctgaaaccccgatactaccctaatcgactaccaaaaacaggctagagattgagattctcatcacgacttataaggtcaaactcaactgatgcagttataagtatgaaaagaaggaccatatctagacaatcaagccgttggatgtttcatagggtggtagatatcctatataatctaagccaacattgctatttaacctaatcggctgccttccaatgatagatgttagttgatcgaaggttaaatagcaatattatcaaagattatataagatatatgataactagacgaattacataaacaagattagagtatcataaagatggaagcactaatcccgagaacacaagccgccataacaagttttacctctagctgaagatcgaaaccgatgcagctcaacccgaaagcaagaactcgtcgaaagtaaacgaagtaaaagggtggcgatgcgccgagattgtattgaacgtctattatttgattacatgggttcgggtcatatttatacccgagatacaaaatatgtccttgtcggacacgactcttatctctaacaaactctaagataccataaatctttgcggcagacttttgccaaacttatgtataaggaatttacataaaatatcataattaatagatacaattgccttttcagtactcaatccgtgcgtggcaatccatatgaagcaccctaattcaacccgataacgtgtaccgaatcgtattgtcggaatcggctcaatcggctaaccttgtccgactagaactctaccgattctagttgcagccgattcggactttagccgattcttcctctgtttccggaacggtctctatcttcgattccgcttcggttttatatccatctccgatacttaaattaccaaattcggtcgttaacaccaacactctctaactatcaaaacagttcaatttaccctcctttgacgggcggcacaggagcacggcctcacgaggcatacggcgcagtgccagagcatgggcacactgcggcgcaacgcaaagagaatgatttgagacgatggtgttgcgagtaggaactggcaattacacattccaatatcctacccttttaaaatggacggttagatttgaatggtatatacttggtacctagtggtacctcctcaaggatggtgaaattcctcttaaacaaaacaaaacaaaacaaaactttattgcatattataaattaggagtcgaaacgattacaaatggagattttttactgtccttgaggatgtgaggtaccaaatcttgaccatcgatcttgtatcatcggacggctgagattggagcgtaccgcgtcgtaccgcacgcgctggtttcagcggtaccgctgtggggggaaaaggtattttcgcgttatcccgcaacagcgagagagaaggggtcctttgattccgctcgattccgccgagcggtatcctctctgggctctctttccttagttcgtcttcatctgcccatctctttcgttctctcggctctgtttccttctctcatctttctctccaatttcgttgtgggcgcacgcagagggaggagtgcagatgatgggggatggcagatccctagaccccccccccccccccccaatctggtcgtgctccccttcaagcaattgaggcaattctgccgcaagtagggtggggctggtgctgtcaacagcgcaacagcggttagattcagctgctgcgggagtcgtggcctggaaaacggagaggaaccgccagatcgtagggccacaccgctacaccgccagatcctggagagtttggccaccggctggaatcaattggttgatgccgaagctgtcaagatgggtgatgtatgtgttttccgtttcaatgactctgatgatgagcttactcttgaagtacatgttcttagttagtgtgatggatgaacatcaccattttgcctggcactgtgtaccgccactcctaagttagtatatatgatgtaatcgtgaagactatatgacgatgtgcttagtcttaatgttcctgcacttatgtactgtgatggatgaacatcactattttatcaagcaatatgtactgccttcctatgatgtaattaagttagtggatgaactatctacacatctgtttaatcctaaatggatgctattcagtttgctttgaaaattgatgttctggctgcttcggttctggcggctatgaagttctttcggcattggttcttccgtgtaattctgttgtgtaattcggcacccagttacacacaacttcaactccaggcgtgtggtacatgcatatttcaaactaacaaacatcttcaaatccaggcacactgcatggatattttgcacttaaacagaactgattaatagctactcgtacagtttagctcaagtgaaaaaaacataacatgcaagtacttctgctccaatacaaataatcttgccagctaatctatacatacagcaacacaggcgatggcgtggcgacgaaacgattggatcaaccggcgatggcgacggaactgacagaaggagaacacagtaggggattgcgctgctctgtccgggatggccggcggcggtgggcggtgggcgaactaaaaactcccagccggcattggcgccggcggcggaactaaatggcggcaacgacggatgattaggggctacggcggcggaactgctgcggcggaggacgaaacgctccgccccgagactcgcgctctgacttgacgggaagggattgcgacgacggctcgctgcttgagcgtagccgacccagaggcccaatcagcgaatacctccttttttatcctatcgtgcccctgccaaatcaatggctagatttgattggtatctcatagtatcttttcaaggataggaaaagagctcatcaccgcctcctcctccggcgtgaattcgttcttaatcgaaagcgtctccctcatctgttccggtgtcttgccggaaatcgtgcccactcggccgacggccgctgccggcactgcgccgcggctcccgcctccgccggtgcgcccagccggcggccgcccctgccgtgctgcccccgtgctggcgtggtcttcggctcgccgcgccgccgccgccgcacgccgcgcccgccgcccgcgccgcaacgcacgccaccactcgcgccgcaacacacgccgccggctgtggctgtctccaagcaaaattagggttaaggtcttagggaattggggatttttgggaggaggggatttttgtttggaaatgggctcagttccagcccaaatagaccgcgggccgagtggaaagggggaggggagtgtaaaatttaggcccaatacaacagaaatggtaaaacaaggcccaaataagtagtttaactctttttctttatctttttcatacatttttttagataatggaatataatcccggcctttactcaaatagctacagccaattattatatcaactcaacaaaaactcacacctgaataaacaaaagcatagacgaactaataaaacacacacagcataaacgatcacaaaaattattgaattctatttgtgaatctccatccaaagttggcgaacagctgcataaccaatgactcaagattacgacatgcagctttcattgacttgatttcttcatcacacttttgtagctgagcccaggatcggagccaatatgttgtcctgaaaagaacctgcatataggatatagatggtgatttatcaaaaaccatatcatttctacacaaccatatagcccaacatatagcggatgctctaacaagaataagtttggtagattttttataactcccacgagccaattctcaaaaatataagatatactatgaggagtatataaaccaacattaaactgtagagctctccaaagaaattttgcataatgacactctacaaacaaatattgaatagtctcatttctcatgcaaaaacaacatttcaaactaccatgccaatttctcctagataagttatcctttgttagaacaacccctttaagtaggtaccacataaaaatcttaatcttgagaggcatcttaagtctccatataatcttattcctctcaatgttgccattattaattaaagctaaatacatagaccaaaccgagaatacaccattttgatggaaattccatctaaaaatatcattctcctctgacaaatgaatatgaacaattgaagcacataaattatgccaattgtttaaattctgtcctactaaaagctctcctaaaagaaatattaagtgaaacaagagacataacatttgcaattgaagcattcctcctacgaactatagcatataacgacggatacctatctttaaaagaataattccctacccatttatcttcccaaaatttgacttgtacaccattattcacaatccaggaacccatatttagaaacttactcttaactttcataagaccagaccaaaaatgggaatccccttgtttcttctcaacctgactttaggattgattataaagatatttcattttcaatagatcctgccacacaccctgctcgtttatgagcctaaacaaccatttactcaaaagatattgattttgaatttcaagattatgaactccaagaccaccctaatctttgggttgacaaatcatatcccatttagtaagcctatacttcttcttgtgttcatccccttgtcaaaagaaagtgatctataataatcaatttttttgaagacctccttttggaatctcaaaaaaagaaatcataaacatggctaatctagaaagcacaaaattaatcaacaccaacctccccccctccccatatgtttacctttccaactactaagtttcttttcaattctttcctcaactgttttccaatccttgttactaagttttctaaaatgcataggaataccaagatatctcatagggaaattcccaagcttacaaccaaaaatagtagaataaagctcttgacattcctttgcctgaccaaaacaaaataattcacttttatgaaaattaattttaaggccagataatttttcaaaagtcgatagtaacaattttagatttttggcttgtagtagatcatgttcaaaaaaataagagtatcatctgcatattgcaaaatagaaagaccatcatccaccaagtgtggaataatcccactaatttgaccatcatccttggccctcttaattaatatagtaagcatattaacaactatattaaaaagaattggagataatggatctccttgtctaagacccttataagtttgaaaattagaaccaacttgatcgtttacttttatacccacatgtcccccctagataaaagaggcaatccattgacaccattttgaccagaaacccttcatccttaaggtttgttgaacaaaagactactttaccttatcataagttttctcaaagtcaatcttaataattaccccattcttgtttttgcgatgcaattcatgaatagtttcatgtaaaataacaactcttttcatgatatttctcccagtaataaaagcagtttgagtactactaatgactttttgggcaaccccaattattctgatctttttcatatatatatatatgaactatatagtatatatacctattttttgtccaaaaatcttgggtatacatctgaatgccctttaattatagctgggctgcccctggtagaacctcgtgtggttgtatttattgcttaaaccagcgggagataattaaactccgagtaggagtcgtattttaatctcattttacttctgtaataatgtaatttaatatcgagaaataattagagtagtcgtttcgaaaaggagtccaattagaccatgggagaaggtttcgaaaatgagtccagttaaatctcttcacgacgtacgtacgtttgtacgtactcaaaactaacgcggaaataactgaaaatcaattgaatttggatcagattcggactccggatcaccgcatccgtcttgtttttgcgcggtttcacgcaataaaaacagaccacctctcgccgtgatccaagcaccaaacgctaacgttccaagagtcttggggtccaagacaagacaagacaagaaacagttgagctttgcaatccgcgagttctttcgtccgtgttcaaacttcaaagtagagagatcaatggcggcagagaagaaggaggttgccgacgccgccgccggcagcggcagcgacacaatcctcctaatcagctccgacggcgagcacttcaacgtgccgtcggcggcggcgagcctgtcacagctcgtctccaacatgatcgaggacgactgcacgacgaacggggtgcctctccccaacgtcgcctccaaggtcctcgccaaggtcatcgaatactgcatcaagcacgccgccgccggggaggaggaggagaaggatctgaagagcttcgacgccgagttcatcgatgtggacaagaacatgctgtacgacctgctcctggcgtccaatttcatgaacatcaagagcttgctggatttgtgctgccagcacacggcgaacctgatcaaaggcaagtcgccggagcagatcaggaaggagtttgggatcaagaacgacttcacgccggaggaggaggaggaaatccgcaaggagaacacatgggccttcgagtagattttcctttgggaaaatatttatgctaattaattatgtcatgttgctgcgaattactgctctaattagttactactaggtagtagtactagtagaggttcagataagaaattagaggaatattttgagtggcttttgcttaattgtcagtaacatgcatgcattgcatgcttatatatattacctttgtactaatagtttcgactcccctacttatattctgcaatatatgaagtgctcattaagtcattagtgcaaactgtttccttgctcttgtggttgtgaaaaggggcttctaattagaagccgatctgacgtagggactaatgtggaatattttgatccaaagtagggaccaatgtatgaattgaacttgcaacattacacttcataggggccgatttgaaaaattcttggatcgtgcatgcacggcgtggattaaataatactcgaagcggtacgagcaacttatgcagaaacaccctttaaatatattactgtttaaatgaacccccctatttggaccgctaaaataaaattggtagcgatccaatcctcgggtcgtcgtacaccgtccgatcaaaactgcgtggctcagatcggcgaccggcttccagtgggtttggtgcatttttacaaaatagcccctgcgtgggttttaccaatacgaattctctccgcctcgtcgtcccgttcatcgccggcgccgccgcgccgccgccgccatcgtctccaccggccaccgccactcctagagcctggatgcccctccattcgcagttcgaatccacgcatccaccgccgcgccggaggtaattttctctccactcccttcccttctcgttgctgcaatgctgctactaagggcaaactcgatggcaaccatggatctgtacgaacgggaagaagggagggttagggtttcattaacgggcgcatactaataaaacgaccgcattggggaacgggttagggtttggggatttttgggttaccggcgctgatccccaaatctccaatgtgccatgattatttgaagctagacttgcctactaggatcattaattcaatttgacaatttcattggcatttgtgttttatatttcttgcggattgcgtgtgcttaggtatttcagttgctgtgtgaatggaaaaatcctgtaatttaatttctgacccatagctgttttgaaaaattactgatccatggttgtgtttgcaacgaagtctgatgatactgatgtagaatttattatacttctgtagtatgagtacttgttttgttgcgtgtgtctaggataacattttggtttagtgcatttgcatgtgatctatggctattacttctcatgtttgctgttctgttggcttgatctaaagagaatcatgtgtcttaagagtctgtcacgagtgttctcttgtactgttcttcgtgtgttttcctcccatgtccaagatagcatcacaagattagtactgtacatatacacaaattttagtgaaactacttgctgtcacctgtcagcatccagatgatgttcaacatgaatcctatttcttgccagtacattggacaaacatcacatgagatgtacaagtccctgacagtaccgtcatgttcagtaccgtcctggttagtacgactcactgacaaccaaatcacagattcaagtgactggatttacagagaaatctaatttgcaactctaacttgcaagagaaaattatgtaaacaattaaggcagcattgacacttgagcaattgagacatgccatatgaacttggaggcatcaaggcgaggccaaccatacacttgcatttgctacagcgacactagagttttcagtcaaaataatgcactcaactcaacacacagaagagtatccatctaatgctagagacaatgaggctaaactagattgatgaaagatcctcatacacagacttgatcccaggtctttcagagaccggccggatgcatctcaaggcaatgcccagcacatccttcatgcccttgacagaaacttggttctcagaatctgaagccatggctggatcaaagcaatctgatccccgaccttcagccacccgcagacggacccaatcagtcaggtcaacaccaccttcagaacccgagacaacatccccagcacacctgccagttaggagctccagcagcacgacaccgaaggcgtacacgtcagacttgaacgagggagatggcttcttggacgctgctagctctggggcacggtagcctagcacgcccaggtcgaggatctgctcaacaactccagcctgggtcatcaggcggtgcaggcagtagtcagcgacacgggcattgaggtcaagtccgtccaacaagatgttggtagccttgaggtttccatgaggcatcgctcggtcaaaatggaggtagttcaggccacgcgcgacatcaactgcgatcttcagccgttgcgcccaggtcagtggagggcctctccttcctggacgatctgctaggtttcagaggaacataaagcttagttagagactgaacatattggtaaccaaccagtcacatgcatttgcagatggagtatacaagatctctaagcctgatgtgttcaattgcagaaatgagaaaccagtaaatgagagcattaccgtacaaaaagctcgcaagacttcctggtgaaacataatccgacaagatcagtttttcatgtgctgttggaccccagtagtaaccacgcaagccaacaacattgggatgcctaatgtttgcaaacttcttggcctccttcgagaactctttcttgggccttgcaacaccttccctcagccatttcactgttaggaagacaccattctcaagtgttgctctgtacgaagtcccgtggctgctcctcccaagaacctcagccggtgcccttgacaattcctccggtgtcagtgtgattgtttcatccaggaagtgcaactcccctgctaacctgtcaggtgatctgacatccaaccgtgccaggccttcctgggtgtatgcctctccagaatctggtgaccaagagaagcggctacctttggatggggaaaatccccctacacctgacagcttctcttcttggcttagtgcttcagatgtagagccctttcgaggagcaccaagctcatctgctgagaccaccaaaccacctttgtcatcctttccttttgtactggccatgtctttgctagtcttgtggaggttcttgtctgaaaccttttctgagctagggaactgccgtgagatttgcttgtaatggcaaacaatggcaacaaggataaggatgacaagagcaacgatactagctgctataagtgctattttagctgctgcactgagtgacctgccaccagctgaaccagaggaactgccagacccagaagagctagcaggatagtctagtctcgagttcccaggatggaaggaagattctggaaacttcctcaagttcactggaacaacaccagatagatcattataagaggcattgaatgattgcaatgtatctggaagtgcatcaggcaatgacccagtgaactggtttattgatatgtcgagagcagtgagcgctgcaagcttggtgatagaggctggcaaaggaccagagaaattgtttgtagatatatcaagagcttggaggctagataaagatgctatttcatcagggaggctgccattaaagtgatttccagaaatatcaagaacttgaagactcagattttttgacgatgatcctggaaatgatagacctccactaagcatattgtcgtggatgtagagctcttgcagcatggacgaagtgagtaaattagcaggaataggacctctgaactgattggagctgagatcaaggacagtgagtttggggtactgaacaacagcttcagggatggtgtcagctagggaattatgggaaagattcaggtagttcaagcgaaggaattgagagctcacatcaggaattgttccagttagattgttctggctaagatcgacatactccaaatcattgctccatttggcaataactggcaaatttcctttaaacttgttatttgacagatctaacacagtgcagcttccagcaagcattggaagatccccaaagagagcattggaggaaagattaataacttgcaaggtggtcgatgtgatcatattgatgtgtcctgtggattaacgaaaaatattgttagtccaaaataacacaagtggaacttaaaagtgatacttttgttttaagagaaatgtcatgatatgacagaaaacataggagcgtgtttgagttgtcctgctcttttaataacaatttagataactatgatgaatgcattgagttctaggagtgatgactttactcaaatgcaagatataatctgtgagacataatattttgaaatgcaacagttcagtattcttactcatacacccagtcaggtatatacaactagctgcgtcctattaataattgtatttttcacaacatccaaaggtgaagatctaacaacaaaggttaagatacatgtactgtcactgcaactacacaatgcatttaacattactgtggaacagaaatccatcacaaactactttcaaatattctcaataataccattggggtatgcatgcataataaataacgtctctcttcatgaccaaaactatcacaagctagccatcactgatccagtaattgctttggagaaaattattagtcagtaggaggctaggagcaaagattccaagaaagaacctttcacgcaaaacaagaagaatgcaaatatagaattggcataagacaaaacaatcaaatgacctacactggtgcacactcaaccacagatcagtaaaagctcatgccatgctgtgtaatgtaatcaacagatcagtacatcattgaaatgagagaatcaattggtataatgaactaagaacactaatgtaagatgccgattcaaagttttatgcaagctgaacactaccgatctgttttggaggctggaccttttgtgaaggagccccacatccaatttttttaaatcagaatgggcatccacatggtatgaagagaaaaggaacaaaaggtgtaagaagaacaattttcaggtagagctcattaccagtcagattatttgcactcaggtccagctcactgagaaccagagaatcccctttcagaagtccactaggtacaaaccccgtgaatgcattgtttgccagtcgcaaaacttcaagatcatagacataattgaaccctggcaagtctccagataactgattatggctcagatcaagcaccttcaatctcccaaatgtcgagagctcaactccatcaatcaatgacccagtcaacttattgttgctcaagttgagatatagaactgtctctgaaatatctgccaggaacttgagctctttgggggtggtactggtgagcaagttcccactgaagtcaacatgagcaacagttgactcaatcaagaatttccaatcaacaccgccttccaattgattccagcttagatccaaagattggagattcacaagaaggccaagcccagatgggatgccctttgtgaaggcattgtatgagaggttcagagcaaccatgctgcggagacctttcagagatgaaggcaatggaccagacaaagagtttccactcacatccagtgactgaagcgacgcaagcccatcgatggagtcaggcagtggccctgagaagttgttcctggcaagcgacaggttctgcaggctccggagattgcctatgttatcaggaatcggccccgagaaccggttgtttgagatatccatgaacttcaggctcttcagactacccacattgctcggcaggctcccagacagattgttattggccatagagagcttcacaagcatagtcagattgacgaacacggacagatcggcgacaccggagatgccatggccatcaagcacaacccctgccacgtttgcgccattgcacacgatgccgttccaggaagccggacagccattgaaatcaatcgactcgtcgttccacgaatcggtgatgaatccagcagggtcatgagtgatgcccttcttgaaagcaaggagcgcaaggatgtcctgtgaaggtagctggccaaatgcaggggcagcaagcaggagcagcaccaaaaaactcccaagaatccccattgctgctctccagacaaagattggaagctactgagcctcaaagacacagcacctgaagcatttcttgcagcaaaaatggactggaagtgtagagtgtatctaccagaaggctctcacaacaagctgccactaatacccacaacacttgtccctttcagctgatctccacagtaccacacatcaccataaaacccccaacttttcagctccttccaacctgaaataagcacggaatggcaagttaaggaccgaatctttgagcctccctgcaagcaggtaaaaatccagctagtacaaagaaatggcaactttagtaagggatccaaagagttggttaaacccctcaccagcttttaacacccaatcatgcaggtaaaaaaaagcaccatctttcccccctcactaaaacagcccaactaccactagtgtattatcacagcttcaacccacaaaaacacagctcaaaaagcagaaacttttactcatccatccaagccaccaagaaaccaaaagaaaaacaaaccccagatgcaaccagcaaacaaaacaaaaaacctacacacaatctttatacacttgcaatcttgcatcctccttacccagcaatgaggccggttgctctgacgcattaagaacaagcaaccacaccaccttggagaatgaaggaaaagaatgaatggttgcggcggcaggggaggaggggaagtggtggaggcaatgccgtggagagaagggaggacggcggcgaagcgaggaaccctagcaatgggggattgggttcttggtggcttggctgctagggagaaggaggagaagagaggggaatggtggtggtggtggctgcaagcctgcaggggaagaggtagaaaggagaggagggagcagcggcggcagtggggagtgggactgtgtcctttctctctctgtgtgttggctagatgaatcttttttttttttggtttgttttttacctctgcttgtgctctgttttgttttctcctcgcggttttttattgtgcatttttgcgttttggtccttgtgattatgattatgtgtgaaatcgacccctcagttgttcaatgcagtggtactgtggttgtactggtgacaactaaacaatacggaaacactttgaccaatggtattactatggtagtttctcctttaataatgggatcataatgctgcgtacacattctatgagtatatacgattttggcaggcaatacagaatatttttttagtttgaataaaaaaacgtgttcttttccctacaccttttataattgtgtgatttttagggggcaattatatttagctatctttattgatatgaaaatatagttacgtcgttcaccaacattttaaaatagatataaggggttcgtcgatctaaatacattatttcttttttcgaaaacacagacctaactaattaatgagctactatctggtttacctctatattatatatatattacaattctcaatgaaaaccctgtcaaaaccttgatataaaattgtgtgagccttgaccctgctcacctactaactacagcgtaccaatacacccacccatcactgtacgagcctacagtacgaattagtcccaacatggatcagagtttgactcgacactctgttttacaattcgtacaaaacagcgaaatacactagcaggtcaggggccaaaacgtaaaatggccaaatccccccgtctccctcccagtgtcccccctcctttcccgtaatcttttctcctcccctttcccgcgaaatctcttcctttccctcgcgcgcgcgccaaaacaaaacggagttgcaacgcaacaggcgcggttgggtttggtttggttccgcctcgggtcccccgccccctcttctttccctcgcggaccccaaaaccgcggctcaaatgcggctcactccacgccggcgcgcacgcacgcaccgggtccggtaggtcgctgcaggtgggccccacatggcagccgccggaggaggataacccccgttgcctcgtgaaccgtgtgtgtgcccggaaaatccgagaaaaaacagagagaggaaaatgtgccatgcctcctctgtgtgtgtctctctctcctgaccttttgcttttgccaccgtggctggatgtgggccctaccaatggaaaagtttcattttttttcattgtactgtgttttttggtagcacgcttctgagttgttgttaaaaatcaaatgaatcttttcttcaaagttttactgcttaatatgttctctctgtttcaagttataaattgttttgattttagtcaaagtcaaactactttaaatttgactttgtttgttaaaaaaagtaataatatttttaatcaagataaatatattttgaaaatatattcaattatagatttaattgaactaatttggtattgtaaatattactatatttatctataaaacttaattaaatttaaaata

SEQ ID NO: 68066 - DNA, 5751 bp, Oryza sativa
tccatttccggacaccggcaatggattgcacatgcatgtgcagctcagatgcaatgcagcaacaactttattaggtttaggatgtttttttttaaaaaaaatttcatcctctgccagactgcaacatgctcgtttttggctactagcagtaggcacgcctcccttctgcagccaaacgtatgatgcgtgccctgctattatacgccaccggccaccccatttccatcttgtagtaaaatgctttttatcaatcaatgggccccaatccgattaacaaaaaaagtaggacacgattattgtatttccacatgaccagtaaagcaggcagcatatgacaagattagcagcggagtaattctcacttgtgtttaattaacttaatggtggattcgtgtgatgtgatggtgcagggtgccatgcgagttcccggggctcaagatcgggttccacgtggaggagtactcgaaccctgtgtacttcgcggtgctggtggagtacgaggacggcgacggcgacgtggtgcaggtggacctgatggagtcgaagacggcgcacgggccgccgacggggaggtggacgccgatgagggagtcgtggggctccatctggaggctggacaccaaccacaggctccaggcccccttctccatccgcatccgcaacgagtccggcaagacgctcgtcgccaacaacgtcatcccggccaactggaggcccaacacattctaccgctccttcgtccagtacagctgaaccgccgctcgccggcggcgaccctcggcgccggcatcgccgccgctgctgctgctagtaatactactactgctatgatgtaattgtgttaccggttgggttctttgagtttgttggggttggggattgtgtggtcggtctgtgttgcgatttgcagaaaccgggcgagcgaaagaagaaaaaaaaagctgtgtgggaaatggaggaggtaggcgtacaaggttacgctctcccgcccactctcgcttttataatttatcattttcaaatggtgatgatatgatgattaatcaaaaggattatattgctacttaaattgtatggtactaccattagcttgctgtgatctgtatctatcctccctgtttgcgtacctgtgctgtgccattccttctcaaatctcatatcgctggagtaacacgcatttgcttttggctcacagctagagcatctctatgccgattgccgagaggaaaagcaatgccggtgttcaaagtaaacttcaaatttggaagtgcagaaaagcataactgaaatcttggatccctaccgtgtgtatcccaaatggttccatttcgcgcgcttttcgcggtatccagttcccgcgcgcggtaaaattacaaacatgaaacatacggttgtacactactcgtacctttgcttttctgtgattccgttggttagttactgacatgatttggttgccggtaaagtggtaaagcacgcggccaagattatccagcctcccagcattgcgccgttctataaagctcctgacaaggagtggcattttccgttcttttttatcctatcagcatagtgctgctactgctactacttgacttttggagtagtactactagtactgtgctaaaccctttttttttcttcttgaaaccaagaaatgtttggggctcgattcagagtccggtcaaacagaacagggtcggtccatctatgcagcgttacaatagcttgcagccaaaccatcccatctttgctgatgcgtgtgcttccgagttattgcggctcatcgatccagatctcatctccgacgccggcatctttatctactcctcctcctactcctgcgtgaacatgccacagtagcactattactcatcagagttgagaacatgcaatgcaatcatgcagcgtgcgagagcagcagcagcagccgagatcagacattcacaaccgagctccgatccacgcgtggatgcatgtattgattcctacacactctgcgagtgagtgaatgaatgaatgtgcgtgtgtatgtgttcattgatgcagatttggatggagcaaatgcaacatgccatgccacagcatcgaataaattgctaaactgaacacatctactcctactttaactctacatgctctggcttgccggtgccggagctcatcacggtgcagccggagctcatggatggccgacacggtgacattcgcggcgcctttttcccccttttctttttggccaatatggaggagtggtacatgtccgcggatcgagctgtttccccgcggtccgcggcatgtgcgcctcgcctacatggatggatagatgtgtgtggcccaacggagtcaaaagcctaacctgtactagtactactcggcgtcgacctgtacggcatctctctctcttcttttcttttcttttctttttttcagtttgtgcatgcgtcggtgctgctgaataatgttgccgccctgctctgctctacctgtttaattatccaattccatggagctacaactacaatttggtgagtgcgctacactgttgataggtgttcaactccaccctccaactctcaagtgtagaaagatgagttgcaaagggagaaatcatcactttgttggccagattgtgttggagcactgagagaagaaaaatctgagagaatatacttggggcagggagcagtatggagatagagggttttgggaggtaaaaagatctgcgaaaaaacgaacggttgacaagctaagctgggcatgattggtgagctgagctccagtgagtactctctacattcatttgccggcagacatgaacagcggagacgaaagtcagacaagatgatgaattgacccccacctggtccatcagaccaaagtgcaattgcttgcctctacaaaaacacagctgtacatgaccatctgccggtttatacaggtcaagacaatataaatatactgtgcacctctaaagaaaagagggtagaaaaatatacaccatgccacggttgttgtgacgccgtactatttcatatctaaccacaagattaggaatttactccctccgtctcaaaatataagcatttttagccgttgtccagattcatagccaaaagttgttatattttgggacggaggtagtaggcaaaataatattcagtgcaaatacaacaactagcattttacatgtactacttgtagtaagtaccatgtcacgatcattgtctggagttgcttggctggtcctgctgctgctgctgctggtggtttagcttctggtacattgccatcatccggttgtacgcctccatgccgttcggttgctgcacacatttgtgccaagcaattcgtcaggttccaagttcaggttgagatgatggcaaaatgcaagaacgattctactggagtactacatttacctgtgcgttttgctgcgccgcttgggaggcgaggaaggcggagaaggcgtcggaggtggcggcgccggtgggctgcggcggtcggtcggcggcggcggcggaggaggaggatgcggcggcgtcccaggagacggggaggaaagggggcgtgtgcatatgcatgggcgcgtatccgccggcctggcccatgttcatcatgctgaggccgatctgagccatctgggccatctgggccatgacggacatctgcagctgtggcatggccatgcccatgggcatcatcatgctgcccatccggctcatcacctgcacctgcgcctgcagctgcttcaggtagtcgatcacctcgtcaagcatcgacgccttgtcagtctggataaacgcaccacggtttacacgaaccgtcaaaatttagttgatataaatggtgatgtgtgtgtgtctatatatatatatatatatacatatatatatacatatatatatatacatatatacatatatatacatatatatacatatatacacatatacatatatacacatatacacatatacatatatacatatatatatacatatatacatatatatatacatatatacatatatatatatacatatatatatacatatatatacatatatttgttggagtgatatagtacgtgctaaattaatttttacaaaactccagctaataacgatgtcaaccgtttgatttaaatagttaaaagttgaaaattttcaagaatccaatcaaggtatgacacgtcagtgtttataaagcttctaagtttctttttgtatttatatatattttctcccgtttatttttttttaccaatgtacgtggatttaggtttgtttgctgtcgtcgtctcaccttgcttgaattgggaacgagcttctgcaatgttttcatcttttggttgatcctgtcccgtcgtttctgcaatcaacagtagaccaaatgattttttagttagtcgaaattagcaaacatcgtaatagtaatattctagatttattttttttccaaaaaaaagtcttttgagagagaaatggagtttttagcccatggatgggcaaacaatttttacccacgggcggttgtgttctgttcatacttcatagcaacaagctggtcatttttagtcctgatgactagttaaaagaagcttaaatttttaatccatccggtcctgttcggaactgcaaccggcaaatgagactatcacgggcacagttcccaagctctgatttcattaaaaactttgttcatcaatatttttttctttaaaaaatactttctattttttatatgcaattcattcgtctgtgcccttaaataattttcataaattcagtttttgtaatccattagctactcctaattcaaacgggacctaatcaatttcagttaagtaaacatatgcttcaaaactcacaagagtcaggtaagcatatgcatggcgacatacacatcagcttggaactgaaagtgatattggcatcctcagaaagttgcaatattgacgaaccttccatcaaggcgaggccaaaaaagatatcaatgaattgtgatagctatctaaaacgtatcctatagcttgtgatactaattaacaaacgttgagttttcaactggctgctgtctaggatatcattggtctaaaaaaacaaaaaagagaactagttggcatgtactagctagtagtgacctttttcccacaaaagaaaatgaaattcttaaatcagttgtggatgcttggaccagattctcagttccgacaatcacaaaaaaaggaaaaaaaaaaggagctcaatgcatgacatctccaggggaaaagtacagaagtgttggttggtggctcaaaacagtagagtggatacttggagcaaatttagccaagaaaactcattatctaggtagtagaatcatgtggacatccatgcttacgtgattattctttcgcacaaaccttaacttcatatttgatgcgtggaaatgtgcagtactgtataaactatacctccttccgtctaaaaaaaatcaaacccagggtttgtgcgtccagatacaaaccttgggtttgaatttttttccggggaaagaatttttttttcagaatgaagatatagtactagtactagatcggtaagcaattttagatgtataatacacctagatcatatttttttttaagatagagaggctaacctttgcgtttctattaagagaaatgaacttcagctacaaccggatagaaagaaaaagaaagacttggtgcatcatttttgcttttcctgtgatgaaaaaagaaag

SEQ ID NO: 68067 - DNA, 21557 bp, Oryza sativa
acagcagctcatcaacatcggctctagataatttagagctagtagttggctacactattagagcaagtttaatagtatagcccactactagctctaattcatctatagccgatgtaatagccaattcatacaatagttgcttactatactattaatacctggtcccacctgtcatacacacattgcgtcttggagtccgtgctgcagctagctacagatctgtagcccgctactgctcttctctctcattgtttatctcattaaaatatgtttattgctggctaatagcctgctattgtacctgctcttaaacttgctcttatagccctttaggagggcggtaaggggttgcctgcaaaatgaccggtcaccctacatgtggccattagaatgtaccaacagacgtgtgctacatcataaaaaacgttctctggaagggcgatttaaaaaaaatcctccaagagggcgttaggggtgtagatttgtaaaactttgagcaaaaaattatttttgtaaatattttaataataaaatttaaaatttaaaaaattcaagtacaataccattgctggtgacctggattgccaagcaattttctgcagctggacctatcttgggccaagattagtccgatctggaaactgaacatggctctgcaggccgctgtgccagactaggccgaggcaagatggcctttacaaatcgagcgcataatgctggtagccagaaggggggcaaagcccagctttgcaatggcagtagcaacagtggtacaatgcaacacttctatattttagatcctcctgtcaatattagaacaagttcttaaaactttgatcaccttcatattaaaatcagtttatgaaatatgataacttcatgatattatgatattatgatagtagtatctttcaagaaaaatctatgcatatcttttttaagatcaattttgctacatggcattgtgacttcacggtttttacgtttgccacaggataacttcatgaagggcagctcgagatggagatagatagatgggaaatttgacagtgggctcatgggactttctgagctttcatatgatttctttcttctattcaattaaataaactagctgggaggcccgcgcaattgcgcggctagcatctgtacaaaattatatattttttacatatgattttacttacattttgtcaaatagttatctcgttgtcttaagactttggactgaaccttatcatcccgatgtttctacttttatagtttatataaaagtcacgtcagtcgctatcacttactcctttggcacatctccattatttgcttgctcgatctaccattgtttctatttattctccttgaaaacttaaaaattataccttatactcccttcgttttttaatagatgacgccgttgactttttctcacatgtttgactattcgtcttattcaaaaaatttatgcaaatatataagatataaatcacacttaaagtactatgagtgataaaacaactcataacaaaataaattataattacgtaaatttttttaataagacgaatggtcaaacatgtgagaaaaggtcaacggcgtcatctattaaaaaacggaggtagtggtttttagagtttgttggcttgttaggtttcatttttacaatatttagatgtctcgtcaaacactgctactgtagtcctctatgctctacggttcgtccactgcctctctttattaatattaatattgagattttaaaagtcgaacataattatctagaagtcccgtcaaacgatgccactgtactcctctacagccggtctattgcctcctctctttattaacattgagattttaaaaattgaacataattatctagaagtcccgccaaaccttcagcggctttgccaatgtactcttctatggttcgcccgttgcttcccctctttgttattattgatattttaaagattatacatgattattattggggtttgtttttttactttctagaagtcctgccaaatcatcagtggcaaagccactgtactcttctacggctcgcccgctgcctcccctcaaccattgtgaacattctacttaatgacatgtctatgttcctcctcttaatcttaattgggattctatttggagttttgtttataatttttagatgtcccatcaaccatcatctctactactctacaggcatgttgcttctcatttttattatcgtttgtcattgttgtattctagattgtccttttttttaaaaaaattccatatttttcattctagcattttttatttataaattgtattcctgcatgaactcttccataatttttagaagtcctgttaaacaccgccactgtacttctctatggggcagccactgcctcctctctttattatcattggggttttaaaaaacaaacataattatcgtgttggttcagcttttactttctagaagttctgccaaaccgtcaatggcttagccaatgtactcatctacggctcgcctggtgcctcccctccttattgtttttgatattttaaaaattgtacacgattatcattgggtttattttttttactttctataagtccaaccaactgctataaccatactatccgccgtccctccttttaatcttcattgggattctatttggtttgtttttaatttttagaattctcattaaccgtcaccactctacttctttataggcatgaccatgatcaaactatttagattttttttaatccgagaatttgtaagtctcgagagcaaacttagagacttttttttacattactttattaagataatagatagaatattttatttgtatataattatatcaatcaatatacaccattaaaatctagatcctttaaatacttcacttttttttaattaatatggtgatttccgtccgcttctcagctctgccccattctcggagtatgagctataacatatggaccctaaatatagagaaagctattgggaatcttgttacttagaatttatttttttctaaaaaacataccgtctctaaagattatgcgatagagcaaaacttaaatatggttgaaggagttcggatgcccagttgttttatctcccctacatatgattttgtacaggacgtgtcagttgtgcatatttattatttctaatttagctatgcagacatgacgtgtttgtctcctgtcagtaaattaagtttcctaatttgattttgatttcaaaggctgctgcgtagcacgcatcaaaatctaactccacgctctttcacgtgtccgattcataaaaacagaatcaaagagtcaagcttttacatatattgtgattaaatctcaacccttgtagtctagatatgttaggatctaacggtgtagattttttctttttccccgattaatgtgggaatttctagcatccacctgtcttctttcaaagctgttttaataatataatagatagatagatagatagatagatagatagatattctatggcaaaatttgctacaggatatcaaaaaacatgtaatgtaattagctgtagaacatcgaaaaacctgactcagctataggacacttcaaaaatgatataatttgctaaaagactctaaagccattattttattatttcttggatcaaatggagagaggaattttttagaagacggcaatgccctcagacctctctccttcctcgatcttgtctgcaggtaaaaaagagaaagaaaaagaaacaagccgtcgttgcacatggcccacacaacaacatactccctccgtcccaaaataagtgcagttttgcactattcacgttcaacgtttggccgttcgtcttatttaaaatttttttatgattagtatttttattgctattagatgataaaacatgaataatactttacgtgtaactaaatatttttaaatttttcataaacttttcaaataagacggacggtcaaacgttaggcacggatatccacggctgcacttattttgggacggaggtaatacaacggtgtttcggtgtcctccatggaggaccaccgtggcgagggcaatgatggcggcattcacatgatctctgatgatcgcctaaaacaccctattgataaattgagaacaacacagattttgccaccaatccagctgagaattcaggatggagggagggcacatcaggatggtgttgatcatgatgaggctgaagaggaggaagaggggcctaagctggagcacgacaagcatgagagacactgcatggctggttccgccgcaacttccaatctcgggtcagaaggccgagggggcaaaaggccgaagattttggtcgtctgctcaccccaagcgccctctccacctcatccagtggggggcggtggctcagcgggtggtggatggcaacgaatctgccggcgacgagaggagacgaggagatggacacgatgaagaggtggggtgaggcttgctcgctcctctggaggtttttcatggggtagctcgcgaggactatgccgtacctcatggcagtgcgtgggcgcatccctcctcgtcgttcaacatcgacgcatgatgccgtctccagtgctctgccacggacctgtcctctgcatagcgccatctacgttgtcgccgcaagtgctagatggggggagcgattcggctctaaagggcaaactcgtattttctatgttgtttctccatttgacctaaaaataataaaataatagcttcaatgtcctctagcaaattacaccttttttagagtgtcctagagctaaatcatggttttacgatatctcacagctaattacatatttttttggtgtcccgtagcaaattttgctttttctcggagagatttatacgtggttggctgttttacccacaaaaatcctcatttttttttcacaaaatatacgttctccagcgcaaaaaaaaatatcgtgtgaagagatttacacgtggttgactgttttactgagctcctctttgaaaaaaagtctatttgtccaccctcatctctttgggttatctttgacatggcttgactaagtctattcctcatcttttggaccgtaccttaggaaaaagtatactttaactcccccaactatcgcccgagtatgattcatgtcatttaaccacaaaaccaggtatatcgacttctccaagtattaaaaccggtgcaaacaatgccacttgatggttttggaggtggttttgtctggcgtgacgcctacgtgacggtcttgaccaagtctttgtcctatatggcattagaataaaaaataaaaaaaatgtggaacccatatgtcattcacacaaataaagtattgtgggacccacatgtcatcctccctttccttcccttcttcctgctccctccctctctctcccttatctctctctctctctctccccaagcctttctcttcaccttgggcggagcggcggtgtggacggtggtagggagcggcggcggcggctgccaaccgaagcacgagctcttccccgaagcacgaagcacgagatcctccccgaagcattgtttgcaccggttttgatagctggaggagtcgatatgcccggttttgtggttggaggacatgaatcatactcgtgcgatagttgaggaagtcaaagtataattttccctgtgccttatatgtccgtaataagtctattttggctcccttatcgttggaccgggccaggtcgggcagcccatcgtgacgaggcagaggcctaggcacagcccaaaggtcaggctgtgccatgcttgggctagaccagaaccccgtgctatgggtcaggccgtcgggcctcgagtcttttggctaactatagatgaggaacaaggtgagcaagcacttaaccatttcattaaaattgagatctttattatttgcatggaaatgagctgaagaattgtgatctttgtgtttgcatggatatgaattgaagaaggataatattatattcttggagttcccaaaaggacggtccaatggccgatgaaggcattctttgatgctcggtttactaagttaataaggtatagtctcctgcttaatctgagttaacaaggtgaaccgcaagtgctacaaagtttcatattatgaaaaatttccagtttccatgttcttcgctttgctaaatgaaatactccatccatccctaaatatttgacgccgttgactttttaaaacatgtttgaccgttcgtcttattcataaactttttgtgaaatatgtaaaactatatgtatacataaaagtatactccctccgtcccaaaaaaacaaatctaggattggatgtgacatattatagtacaacgaatctggacagagatatgtctagattcgtagtactaggatatgttacatccagtactatgttggtttttatgggacagagagtatttaacaatgtatcaaatgataggaaaagaattaatcattactttttttttaaaataagacgaacggtcaaacatgtttaaaaaaatcaacggcgtcaaatatttaggaacggagtattatatagagtaaaatgcactagtggtccttaaacttgtcatgaggtttcacttagatccacaaacttgcaaagtgcacatcgaggtccctaaacttggtttatcgtatcattctggtccaaagcgtcgtttgaccgtggtcttgcctatgtggcacaccacgtggatgatgacatggtgtttttttttccttttccccattttctttttcctcctcctcttttatcttcttcctccactggagccacgtcgagctcccccgtgccgaccgccgccgtcgtcacgtagcgttgctgctgtcgaaggaagaggctgaagaagagagaaatgaaagaggaagaagggagaaaaaagaaaaaataataataatgtgccatgtcgttgtctacatggcatgccacgtaggcaagatcacggtcaaatgagactttggaccgggatgatataataaaccaagtttagagacctcgatacatactttgtaagttcgtcgacctaaatgaaagctgcttacaagttcaagaaccaccggtgtgttttactctattatatattacaactttaatggagcagtttgttgccaacaaatgctaggtatgcacaaatattcattcgatctgttttcagtattgtgtcgcccctctgcaactacgtgacttctaatttcagcatgattttctttcaaaatgtaaatcatatgaatatttacttgtttcttagtttcttttttcaaaatatatcagggagatataagataattattaatatgttagattatgcactctctgttgctatgaaactacaccaccattggtcagacgtatcaaggatttctaatatctgtttcctaagcaaaggagaaaacaaaaatcattaatgttttcattcctatcaccgtatgattatttctacacttgattattttgatatctttcattcttgtatgctctttgcacctgatccatgtagagaaaaatctggtaggactaattgatatgcacctattcaaagaggttaatatggattgtggccaagccacatactcgcactgaccctgctgtaaaacggcaaaaaaaaaaaaatcttatccttgacgattggcttgaacaataattaagaatgttatacctgctttcaggtaagtggtctgttatttttgaaatgaacaagcggttaacgggacaagtgatgatcaagttctcgctccaaaaaaaaaaaaaagaagaagaagaagaagtgatgatcaagtgtggtgtgcaagattttgtcacgctgtggaaagaaaatgagaaagttgacattgttgattcactgagaggtgtgttattgtagtattcgtgcgtgtatttttgtccactcttaagaatgattcttgatccatgcatatacttttttttcttttttttttaaccttgatggaaggaacgttgaatgatttgttggtttttgcgtcatggaatgaattttgtgcattaactgattagctaagttacttgttgatcatacaaggaattaagggtgtgttcgctattcctggatcccaaccggatccctccgcacgaaaaatggagcgatctattagcgcgtgattaattaagtattagctaatttttttttcaaaaatagattaatttgatttttctaaaacaactttcctatagaaacttttttttaaaaaaatacactatttagcagtttgaaaagtgtacgtgcggaaaacgagaaagatgagttgggaaaaatggtatccgaacacaccctatgtgtgggtatcgacgtattgatgtttttaaaaaatcccatatcacgatatcaatgtatccatatcgtcgtagcagtatcgcgtatccgtgcatcaccaatggcggatacaaagggtggtccgggtggtcccgggaccaccaaaaaaagggcgatggaaccccctattaattataaaaaaaagaaaatagcgacaattgaaaagaaagaaaagaaagcgacataatccatattccctaatgccgacgcgctattccctaatgatggctccagagaccccacacacgcgtatggaatcgatctgatcgacgcgatcacgactctctctgacgcgatctctctgacgcgatcacgactctctgtctctctcctcatcgccgccctagcccgtaggccgtagcaactgccctaggccctagcctggctagcgacgccgacgagccgacgagaggagagacgacgcgtcgacgccgcgacggcgcgaccacgcgagcagcccccacgcggccacggccacgccgccgcgcgcgacgccgtgaccggcgacctgctgctgtcctgctgtctgctgtctgtttaatagtgttcgtcagttcgtgtgccgctggacgccgccgcgaggagccgtcgtcgagccgatcagccgcccgcgccaacacaaggtaacaattttagttttaggttttctaattgtccacctttttcaatttttagttttaaaatcttaaactcttgtgcattgtgagattaaattgtagtattatattgtagattgttgattgttgaatcatgaagaaagatggagttatcgtatcgctttttctttaaagtggatgaagaggatataatgaacactttcatggccattagaagacgtagacccgataagaagaaaaagtaatatggtaattttctttaagctttcatagccgtacaagcttctttaaatcaaaattttacttaattactaattttatatattttaagatgttttgttaatatatcatggtaagtttttgataatttgatctattttattacttatagttacattgtatatattagtatcgttaggtttactgtgtttagaaaaaaaattttaggtcggaccacccatatcctaaattctagatccgccactctgcatcacaggtgaacatccattgactgatcgacgtttgccaataccggtcggaaatttgaagatcatattaacatgccgtgttgttgttgacattgcccaagtgcatgcccacgaaacttcgaggaagcttcgtagatttgccattcacggcgtaacggaacaccggaaattgtcttaaaaattgtcaccatccacatgcgtatccatcgtcggctggaacaccatggtcggctggaacaccatggtgctggaacaccatggtcggctggaacaaattcaacttcccgtatcctagttgactggaattgaaggtacaatttccaacattcgcttccaaacaaggcctataaagtcccatcccctcgacctctcgccattgtccacctgccacgtacggcccaacccgccaccgaattcgattgctccagtgaccatggacgacgctggcaacagcagcaaggaggcggaggcgcaggcgccggcgccggcgaaccaggcccctgccaccgccgccgccgccgcccgcggcgcgattcatcgcgggccgatgctgcgcctcgccgcgatgcagctgatgctgttcgcggcgtacgagatcgtcagctcgtacgccgcgccgccagtggcgcttccccgcctcttcgcggcgttcgtcgcctggctcgtcggctgcctctcgctgtttgtcgcgccgccctgaagggctgcacgtttcatcggaggttgaaagcatagccatcaggtattcaggattaatctatcagcatcaatcatcagcggtagtgtggtgtaacggggctcgttttttgttttttttttcttctttatgtggagtgggagtatgacgttctgcaggtttatttatgttgaccactcgttgtttattcggacttgtttgtccgtttcagcagtaggctactgttaggctgcctgtatcagatttctctgcacatgagagcaggtaaaatagcatgctattagccagctataaatatattttaatgagataaaagataagagagaagagcagcgggctacagatctgtagccagttacagcacggactccaagacgcagtgtgtatatgacaggtgggaccgtatattaatagtatagtaaacaactattgtatgaattgactattagatcggctatagatgaattggagcaggtagtgggctatactattaaacttgctctgacgcggcttaatttttttacctcaaagcgtttgatctaaatgcttttttattggtcagtgtgagtgtgacagtttatccggctacgacgcagcgtcgcaggctcgcagcgctgagcagcagcagcagagcccagtgttttggccgagaccgagcgtccccggccaaaacagtacgagcaaagctgatgctaactagtactacgagcaaagtgtgacagtttatccggctataattctgtcacgagcaaaaataaaattgctactccctacgtttcacaatataaatcattctagcattttacacattcatactgatattatatgtctagattcattaacatcaatataaatataggaaatactagaatgatttacattgtaaaacggaggaagtatacgagagcataagaaacaagaccaagcaggagggcgatctagatcaccatgccattttctgcaactggacatgctttggaccaagcttgtccgatctggaaatagacaaaggctatagatgttgttgggtcagagactcaggccgaagccagataaaccgagccccgaaagcccacataaacaggggggcaaaggcagtagtagcagcggtattaaactgtagtacgctaccgttatgtgcaatcggttttgttaaatcatattcaacccgcaaagacagaaacatgcaaatcaagcaactaatgtatatcaagaacaactggttggatgagcttgcagcatcatgcaatttattatggcacattcctcacatcagactgaaaaactgattcagtgattccacaagcagaatagttctacacaaccaaaactgaacttcaaaacatatgggacagtatcaggtatatctacactgagcttcgatatctccgcatcccgtttcccagaaaccatcatcactagttcactcagtcttcaattatcctttttttaaaaaaagttcactcaatcttgattctcgatcagcttcttgactatgcttttaagagctggtgcactagcactgcacttctgatcgacgaagcatgacctcccttcctcagccgccttgcatagctgtggatccatgggcaccttgccaaggaaaggtactcccatttcgttgcacattttctccgcaccacccttgctgctatcaaacacctcgctgcatgcaaccattgtcaaaagctcaggagctttctccttgatatagttcagcgcccattctgtagcatccatctcgcctccctcaccttgcttcacgaatctgaaatctgagagaacctgccgcaagccactcatgttctccacaacacctaagatcggcacaccaaccttcttgcagaaatttatttccttccgcacatcgattagagagacctgctggggagtggtcacgattattgcaccatcaattcctgtggcttgaaggtactgaacgattgaaatatgttcatctgatgtccctggaggagcatcaaccacaagatagtcaatctccccccaatcgacatccttcaagaactgtttgatgagtccgttcttgcgaggtcctctccatataacagcatcatctgggttgggcagcatgaaaccaattgacatgacaccaaggttggactccacatagactggtgaccaaccaaggttgctttgatgaatatcctgaccttcaaggcctaacatttttgggatgctagggccacatatatctatatcaagaaggccaacctggcagtccatttcagcaagggcaaatgagagctgggctgaaaatgtactcttccctacacctcctttcccagacagaaccagtatcttgtgttttactgtagccatccgttcaacaataccaaccaagtctacaaacacaatcaggcaatacaatcaataattatttcactgtgtggacgaaagcagcagtaattaatattgtctatgaataacaatcggtcatggctaaaattaggaatgcgagaagtacgtaggaaagaaacaccaattatattcatgaaagaatttacttgttcaactacaatttttgtaacatgaacttgtcttcctaggtgctcaatcacatgagttcctttttttaagtggcaatactgctgtgaaatattttcatggataagtggatatcactagatgtgttctccgtattgggtttccaacaaagttttttctttaacattcttgatgcactccattttttgtatgttaaacatttaagtatttccgagtgccattctatttagaaaaggaggcagctgtgtttcaactttcaggtgggacaccagatcatgcacttccatttctttccctctttaatgttacactcacaagtaaaatgtacttcctgacagtacattagatttggaaaatcagtaaggaccacatatttcttcatgggtttgggattgggtttggctccagtgtagtaataaactaatgatcatcatgctttcaatgtcagccccaagccttgctacctccatcactcacgttgcttctgtttttttaaccatctgaactatctacctaagaacctacaaggtgtttggttgtactgttatatatgcaataaggtagaacaatagatttatgaaatcacataaaaaacactgaagacatatcattgtggtatatggcatcttcatgcccaatataaaacatcagaactgacagaacaaagctggttggtaaatatcaaaggtaaaaactatccataaggcatagaacacaatcaacatgatccagctttggagctggtagattagagcattgggcctcaaacccacatcgcacacacccaacaaaaccatacaatgagatgaggagcataataaatactttcatcccgctcctatgaaaaattttggatgttgactactaacaaccccaattttcttccttcagcttcaactgctcaacttattcatacgagtgctcttgtaagatgtatcaacagcgaggaataggtatctgtgtgcctattaattttaattcatccatctcttttccccaaaattcacaaaacaagacacaacaacccgaaatctgataattttaagagaggcccaaactgaaaacactgcagctatgtggcacgaactaaattaactctaaactatgatatatgcagggaaatagcaaacaggtatcgcacaccccagaaagaacgatcacatggaaaaattttgccagaacacggtacaacaacaattggtcaagttaccaggatcagggcccttgggggcggtggcgcaaatctgctggttggggcatccggcgcaggcatccgccttccccgcctcctccgactgcgtcccagggcaatctgcagaatcaaacacttatcgttagggttgcgcatagcagacacccatccctttttccattgcaaggcgatcgaaacccacaccaaaccgaacggaaacaggggggaaaggtagcaatcgagtcttacgctcgttggcgtccgccgggacgtcgctcttgccgccatcgccgccgccgccgccgccgttctccatctccctcgccgcctccaactccgcctctcgagttctcgttactttctcgcgaggtttgctgcctggtttggggacttgaagcctagagagcgacggaaatgaggagaaaaggagtatttgtgagagagaagggagaggctggtcaaagaggatatggagcgtccgattgtgatcgaacggtccagataccggttgtcaaggacaagtttgcatctcgtattctcgttgcatatccgtcgcgcgcgctctctctctctgtggattatttttttccgtgattttttttcccgtggttgactttattcctaattaaaatataatggatgatttcatattttagaaaaaaaaaacgaggtgatccaaagatattttaactactctagaagagcaaataatggacccatcgtagtagttggcaaagtatgattcgaccataaatactctcttgtttttcaaaatccaaaataaaatacagtcacaccgtgaaactataattgggtctagaaaataccaagacttttaggatctgcttggaagattagcccagagctaattttgaaaggtaatatttagtcaggaattggtaggctaaacattagcctagggtggtatgtttggatccatgggctaatttaaggctaaaaggtggagagagagtagaaagagaggagagagaaggagagagagaggtgctttttgatggtccccacataaaattagccccattagcacctcttggaggggctaatgttttgagggaggctaattcacattagctcaaaattagctcacctgtttggatccttgagggctaatttgaggctaaaaggtgaaggataaacattagcccatgaaaccaaacagagccttatgctttaggattggttgtgttcgggctaattggggcaaagaagataaacaactttcttgatctggtcaaatccatcatttccccaagcatatttttagaattaaacttttcacggacatggacccatcaacatgacttggccacaaagtactttctttattctccacaatcaaactcacaatatatatataggccctgtttagttccttaaatttttttcccaaaaacatcacatcgaatctttggacatatacatggagcattaaatatagattaaaacaaaaactatttgtacaattaggggaaaaatcgcgagatgaatttttttagcctaattagtctatgattaactatacgtgctacagtaacctacatgtgctaatgacggattaattagtctcaaacgattcgtctcgctgtttctagccgagttatgaaattagtttttttttattcgtgcccgaaaacccctttcgacatccagtcaaacattcgatgtgatatccaaaaattttattttcgcgaactaaacaggcccataaacaggttgtgaaaccgatagacatgataattgggtcccacgaaatattaccaaaccatcaattagtatactcaaatatagaacatttttaaatattatcacatctgttctaaaatatagtaacataatactaaataggacatattaatactacgaatttgaaccgataatgtgtcacatttaattatatgtctttctctggtcatataatcatcctccccagactttaattttcactataagagctagttgatgtcgttcctggtatctaaaggggataaggcggcaccatcagctgcttaactttgacttccagtctcccaccacttcagcttgaagaagtaaacatgactgataatctggcatgtgcataagcgagtctgtatagattaatgatagataccctaacggcaactgtatggttgaaaaagacataaatattagagaattatctaatatcaaataattagaaggagcgaggttttgaatttagattgtttagcccaccatctagccggcgagcatttctccgttatggttgaaaaagaaacagaagagggaaactacgattcgatatgatgagacgcagacactaatcaaaccagactacaagataaaagtacggaatactatactggtacagcactagtgtagtaacaacgacacaaatgacacgattcgttgtacatgtactaatcgtactgagctctgcaaaagcgtgagaggctcagagccacggcgcgaacagagtgatgcacccaacgagccaaatcagcagctcggcgagcagccgaggccatggcacccggtcccccgcgcccgcggacgcgccgacggcggcgatgatcatcgtggcgccggacaccatcagcaggaacgcggcgcgagtggtggctgcgcctccgccgcggccgtcggcgtgcggtggctctggctcttcgccgaaggcgatctcctcgggatccatttgccttggctcgagatcggccgtcgatgatatgttttctactgtatttgcctttgtgccagagcgtgtgcaatatatgttccagatcgagctccgttggcagtggcaacgaccatttttatatacgcatcgagggcaatataggtgggaacacagaatgggcccccggttgaaacgataagtcaatttgtagtataaagtccatgcgagctgtgtgcatttggccgcttcttgtgttgcgttaaccttttctagtcaatttcttcactgtttctagcttactggctggtttgacgctggtacgttactttgaaataagtattctgttatacctgcaccaatgcgcggtgaaatcactgacaggtcggtccgatacagcacatcgacccacttatcagtgataactccaggtcgtgtagagctcgcagttcgtacgtgtaggaacgtaattgcgtacggaggggaggaacgtgggctggattttttacattttgatccttttgaaaaacttatttcgtaaatagacccctaaaaaaacttatcccagaaatggtcctttttggggcgccagagtggctggcgccgtcatccagcctctctggcgccgtcctcctgccaccgtggtgcacgcgaaccgacgtggcaggaggagggcgccagcataccatgctggcgccgccccagggaggagggcgccagcatggctggcgccgccgcctccattcctgtttctctgtatggagttgcaacggtgtcatttttattttatttttttggatgttttttcacactcaggatcatgatacaaccaaaaaaaaaattaaactcgaactaccacttagctaagtctgaaaatatctagcataccacttagtctactttgcaccttcactaaaattagaccataaccatagctcctttagtaaaatcctttgatcagcatgttaaacataatgcactctaccaccatatgaaattacttaatctaattcaaaatataaccacatgaaatgagatatataagttaaacagtacatatagatgcaatttttttatttttattttattttttttttgatatttttttcacacttaggagaacataggaaccaaccgtataaaaaataaactcaaacggacaaaatatgtgacatgtagaattttccaaaactctaccgaaacggacaaaatatgacatctattaaaataggcgtaactttctcatacggactcggaatcaggcaaataatatatgcacggacatctacagaaaaagttacatccgattctcccccgctttgccgggttcggcgatattaaaacctccaaattccgcttgcaagattgtgttttcgaggagagaagtttttcggtggagctttggaaaattccacatgccacatatttcgtccgtttgagtttattttttacgtggttggttcctgtgagtttctaagtgtgaaaaaaatatcaaaaaaataaataaaaataaaaaagttgcacatctctctcctctgcactagttcggagagaggagaggagaggaaaaattctacatgtcacatattacgtctatttgagttcaatttttctatggttggttcttgtgtgtccctaagcgtgcaaaaaatatcaaacaaataaaacaaaaataaaaaatttcgggggggggcgccagccactctggcgcactccccctagccacctcagcatcgccccgccacgtcggcggtgggacggcgccaaagaggctggcgccgtcccgttgaacgacggcgccagccactctggcgccccaaaaagaaccatttttgggataagtttttctagggatctacttgcgaaataagttttttaaaaggaccaaaatgtgaaaaatccagggaacgtgggcgcggcaaaaggaacaggttggtggcttggcgtgacgggggtggattatgtggctgtggccctgtgggatgtcagtgccgcgttccgcaatcgctcgctcgctcgcccgcccgtccggcgccagcccgaacctgctaggaaacttcctcgggttcaaaatcctcaactttgccaacagaatcgccttacttgttgtttcacacctctcagaattactttcttcctcctggaaatgctgtcgttttaaggttgagtgaacaaattagcgacaagtaaaaatgaccatattaccctaaaccctaaaccctaaaccctaattaccctcatttaattattgcatttgtcacttcagattgtactgtagataattaactaatcacttctagcagaccatctatcgcattgcacagacatgggtagtactagtagtggcaccgtagtatactaaatagcaggttcaaatgaatcgatgggatagactaggcttagctcgctggtcaagatgctacaacgacaaattttgtgggacatttttctgaacagcgggatgactagctttctgggacggaggaagtattattagagcaagtttatttagtagtaaagccaacttttataaacttggagcatcatcgagagattgtgtatcatatcctactaaaaaattgttttgggtttcctaaactgaaaataataagtaaaaaaataatctctccaacagaaaacctaaattttatttaaaaaaactaaaaatgggcccctctattaaattacggctgaatttgcaaaactaaaaacgggcccctctattaaattactggctgaatttgcgtttttcttcacgtggaaaacattttggccgaggagtgaaggagaggacaagcttgagagacaggacattgggagtcggagaggagcacttgctttccctcaaatcaacatagcgataaatatggggaactccaaaacatgtgcaaggctagggatcattggatccgatttttcacctaaaagccctcaaaatcagatttgggaagaatataagagaaaggttggtgatgctcttattccctccataaaaaaataaccttataatacgatgtgacatatcaaatttggacagatagtatgttcagatttgttatactagaatatatcacattctattatgaggttgattttttaggtggcttatactccctccatccttgcagttgtgggtttctgtgtatagcgtttaaccgtccttcttatttgaaatttttgtaattaatatttttattgttattagacgataaaaatactttatgtgtttttcaaataagacgtattgtcaaatattggacacggaaacccacaactacacttaaaatgggacagatggagtagtcgataagttataaggttatttctatttttctcctctctatctctcgcctatgcatttaatgcatttattatggagtatgtgatagatagctcttgcatgagaaccaactatattcttttttttttcaaattttctcttatccacgtaagcttatactccctccgtccaaaaaaaaaggcaaaccctgggtttccgtgtccaactttaactgtctgtcttatatgaaatttttttataattcgtattttcattgttgttaaatgataaaacatgattaatattttatgtgtgacttgtctttttaatttttttcataatttttttaaataagacggacggttaaatgttgggaatcacggtttgccttttttttttttggacagagggagtagttggctcttacaggtatgtggtgtcatgggtttagtcagaggctcatagcagcagggccagaccaccaaaagttcttgctgaatttcggaactgaatattcagattgaggcacgaagactttttctgaatcaatgaggcttttagcgggattacttaaattatgtcgtcacatttttcacttccatttttttccatatatgattgtcctctctccgatatttaagctcttccatgtagataataaattgtttaaattataattttcttatatattgtgtattagaaaattttcgatgtaaatattaaaatatacattgtaattatagtataagttttataattttcaacgtaattacatgtaatgtaagtataggtaatttacattttttaaatgttcttactgttttttaaaaagaaaaatatgatctattgcagctactcgttcagatagaattaagcagatgcaaactgcaacgagcactgaaaaatgttggctttgcctatttggaggaatgagtctattttgcctccctcaacttttgcttcttattgaatcacctctcttaaccacaaaaccatataggaataacgtctccaccatcttcgaaaaccggtgtaaattgaccactttggtggtttgaaaggcgttttttttttgctgacgtggcgagttgatcatggttgactcactgaatcatcgagtaaacctcacccaacagggactctatcttctttcaacgcgacgagctagttggggggggtccacctgtcgccctttgcatctgttccttttcttctactctcttctttctctcctcctcgctcctctcgaacatggctaagtggcacggcggcaatgaggcaaaaagggcaacgacgattggcgatgggtgatgcgggtcttggagaagaggcttccggattggcaacgagcagtggccggaggagtagcgctcgggcgtggacaaatcgatcccacatgggggcaacgctcgagctcgtggaggcaacaatagcggaggtgcaacggcaagggggaggtcagcatgcctggggttatggctattggagagcaaagatccctagtggtgagccggcctcctgagaggtggctaggttgaggagatcgagtggtggatggcattgcgtggggaaaagggccggtggaggcccagggtatgaatgcctcctacccattgccatccccctttttttggcttattattacctgcgtacttaccaatggtccccatgcgcgaggaaacaagatcatccccctcgcacagaagc

SEQ ID NO: 68068 - DNA, 4748 bp, Oryza sativa
tgtttcaaccccaatgatatgttcctaattttttaattcactatcttgtggaaaatctgacaaaggacgatctaatctacggctatagggtacgtcagttaggtccaatccgttcaatggacgtccttttttattctcttctccaagatcacgttgccctgggacatcatgatctgttcatcattaacaaaccaacacaatcattgtgtggcaataagatgaattagttaggttaagggaagcttttcatatggccgcattgaacattctgtgcctactcaagtctaaagccgtaaacttactcttaccatgctggcctcgtgcaaactttacaacgcacaggcacagcaatcctaaagcaatcgatccatactgtttagtcttacaaaaaaatgattcatatatactcttggaaaataatggatcatttttgtttgaagccaaaatatgctctggctcgttaaatagtacattgtctatgtctagtttgctaaaaaaaatgtgcgatcaaggcagataagctgtcaaaatactggcaataccaaaacttctctacattttagcatggtagcaaactaaaacaacccaaagtaatcaactgtgacatcctttacctaccctgcataacttcattcgattactcaaaataacctatataataatcattgcaagtctcttgaagatctgatagtacatcatattgacaaacacattgactgagagagaatagactgacctcatgaacagttctcttccccaaccaggccaactaaattaattcctcatgtcccttggatattcgccagatcaatacaggaactaatcagcacacagattgcttgccaaggctttaacttactttatcaacatctgcatgatggagtatgacgtcagaaatatcaaacatgaaaagatttgattctgcatcaaagacctcctctcttctctttttttttttctgttgcccctgaaattgactgaatgcgacagcacacagctagcaccccagaaagtgcgttcactattggtagagcaagaagataaaggccatccacaatgggtgccctcgacccgtcccctcacaaacggccgtttccctcccgtccctttttcagcgtgaatcgtctccccagctaggagcgcggcgcctggcaaaggggcgcggctctttgcaaggagcgcccattttttgcagagcaacgaccctcgacgctgggaggagacccactgcaggctcctgtctcctcgctactccccccaaatccctctcctaccctcgcccctggcccctctcccatggcgccgcccgctcgtcgatccgctccacgggccgccatcgtgacgacggggaggagctcggcggccttgaagaggagggcgagccagtcgtcagcgaggcgacccgcgaggcgatgttgggcgggggtgccaggggcggcgaagtcggctgcgctgggcggcggagtcgtcggcgacggctagagggagaggggagcgggaggagggcgacctgcgaggcggcgctgggcggggatgacgggggcggcggagtcgtcggcgacaggcggagggcgaccgggcgctgacctcgccggcaagccgccgtcgtcgctgcccgaggccagatccggcaagcccaggccggatctggccaccctgccgccactccgacggcgacggcgacgaccccggcggagggagaggggatctggcaaccgaagtcgtcgggcaccccccgcgcccgtcatcgtcggccacccctcgcgcccatcgccgtcgccgacctcgcgaggcgctcgccgttcgccacggcaccccgttcgactgagagagggagagagggagagatcggaagaggaggagatggtgggcggaggagacgagaaaatgtgagaaagaggagaggaagaggtggctgggctagtgggctgattaggggaatgggtggaatttttgtactgggctaccttggaccaggacacccattgtgagatgtagtatcctcatcgggttgcttcagattttaaggagcccatctagggatacccttcattgtaagccaagtttcctacgagtgtcctcggttagtgaggacagtgtctcacattgtggatgctctaacacatctgatccctggagcttctcgttgcgtcggcaagctgaatggaacaacgactcgaccggggtacaaacgaaaggcagcagagttctatgacgattaccaaaagattggaacactttgcagcatactgttttggtcaacttgtggctcatcaagatgtagtgaaccagtcgatgtttccttggtgtagcaatcaactgatatgtaggctggaacccacttagctgataaaactgaatttgactgatcactccatgtacttttaaccagaagacaccacgtacatttgctcggcctagacatgtttgaattttttatgtagagtgcaggtcaaagacaaagagcaatgcagtgcaaagttcaaccacgatcaggcactccattgaaccactgatttgaatagcaaccaggagggttgcgcctagtgcaagaattcattttggtgacttggatcataaacagtcaagatgacactgcataatcgccttgcaaatcacatgccgctggacatgattaaagacctctttgattcatagaaattttatgggaaaaatgtaggatttaggatttggcactgtagcagcctttgattcacaggattaggacataggaaagttagaggaaattttcctttggaactcatttcacaggaaaatggaaacatccatcctaacctcttttttccatcatgtgtgcgtaggattgaggcaaatgacagatctatgtatcattattgctcttttagaagaaaatgtatattgtaatattgtggataataccaaagtgacacgtattaatacacttcctgacattctctttcccgtgaaattcctagcccctttgaatcgcagggtagaaaaaacagaggaatagaaaaaacataggattctgattagaattgaagtgtaaaacagtggattgcaaaacacaggaatggttgtttgattggagcgcaggaaaaacgcaggaatcggatgagagagatagactcaaaggaaattttctaagaggttggagctcttgctaaatttcctccaaaatccacatgcaatgtgccattccataggaatttaataggatttggaaagattcaatcctttgaatcaaaggaccaaataaaaaaatttcctatagtatttgaatcctataaaattcctatataaatcctttagttcaaaggggccagtaacacaactttcctactcatacatttttacagtcacatccttgtttttacagtttacattcctacaagaatactacgtttttatcatttctctgtttttccattcctataatataatttaaagggaccctaaatatatttgaagatttgcagtaaaaggaactgtttattacttctttagggtaaaagaactcagaaaagtcagaaagcaccgacataccccccaccaaacaatgcggcggagtgcggcagatcgaaacagccgatgcggcctggagtgattaggccggaccggcggcggcgcagatggaacgggggaaccaccggattcgggggctgggtgggggctctctgcggccggccagatctagttcctcccggcgattcccaacgcctgaaaggctgcgtctggacccttggagggacggcggtgcgagcgggtggcgttcgccgacggctcggcatctccgcggacactggcggatcgatcgccgactcgccgtccacgacaactgcgccggggccgccgttcgtccgagcactccatgctgacgttgctctccttcgtgggccaagcccagtgcagcccgtatatcgtcccaatttcttacattcaggccccttattttggatagcgtaaatattaggatcgctattcgttaattcgtgtagggctggatatcgagacagcgggtttggtctggctgtctggctcgttaggccaatgaactggtttggctagttaacctaacggtctgagtagggttaaaatggtcatgaaatttttttttgatcgaccgagctttatttccgcataagatgtaccgtttctgaccgttttagctatatataaattttgtttttttctaatttctttctatatcatattaatatcgacaacgaatagttcaaatgatgaatatggtccattgccgaccgatcgactgtcgttttcgaatagatgctaccaattccgatcgtttttactccgtctgactcatgagtcaacatgactttatcccaaaataaaccaatttccgaagtttgaattgtgtcttaaaaaatgaatcaacttctattttcttgcctaccatctgcctgtaaatcaagaaattttattcctttaatactccatcacctactcgtctgccaatataatttttcattaattatggattttttttgtgttagattaatgggctaggccaattaaatcataataaatttcattggcctacagtaagtgctatgggtaataataccatcttggaaatctaagtgaagaggtctcaatttaaatacggggctagttgagagtctctattgaccaattgagatggtgggcggacagctacacacatgcacgcgcgaggcgaggcgaggcaggctgcgctcgcctggttctgttcacctgcacaacgccgtgaattgatttcgtat

SEQ ID NO: 68069 - DNA, 17603 bp, Oryza sativa
atgcgttgctgccattgcccagcttttgtcccgccagccgatgcccaccatccactgcacttccctccgtcagtcgtcgcttcgagagaggcgagagatggggaagagagggcaagagtggagaggaggagagaggactaggaagaccgctgacatgtggggtccatgtgagtctcacgttgactcagcatcaagttagttaaaattaaacacaatattgttttgggatcttggatagtctgctattataagttaagaaatatgttatatttgagggctgtttagattgtaaccaaaataaaccttaccaatattgccaaaattttggcaggatttcttatgaatttaccaaagtttggcaataaactaaatatagacacatcttagtgacggatgcagctttaaaataaagatgggacggagaacaaagatgtttacttgataagagcaatcgaacacaacacatcgtattaatagttcattcgcatcactgtctcaatatgttgggtgttcataccttgttatacataattttaatggtccatgactgctataaggggataagcgggtcttcagggtgtgggcgacacgagccgtagcttagtcggtcgacccaccctgcctaataggtagatccacccctaatctttggcaagtttattaaaaaatggtacggttggaaatgacatcaatctgaatagccccttcctgttagggttcaatgatgggccagtgtttacttttttccaaaaaaaattgggaaaacaccttcggaatcttacagggttacgagcagtttcacctgaaaatagcatctggtatgatcaaccgatggtcaaatcggactggccttaatactacgatttttcctggtaccctggatcgaccaataaattttgattctgaggacgagcaatcaattttgattctgaggactagcagtcgatgaatgccaacatatacacatcatcatccgtggattcctttgtacagtgcttaatttttgccagatctcaacgcatgcctaatctgacagagtgacagcttggagccatccagtgtagcgaaccacatctcgcgtagaatccaatttactacgtgcagctcccgacagctacaatctcctctttgagcgtcttcctcttgccatcgtgcttgctcccggccttcgcaggcttcttcagcgtctgcagcaacattggccagtgactccacacatcagaaattcggaattcattgttgcagaacatggagttgaagactttctgttcatgctgaccttcttgagaagcaggtcggtctgacgctccatctctcggatctgatccaacgtcatgccgtaccactcgtcgatccacgcgaagcacagccggtggcacgccaagaacagcgccctctccccctgcacgcacgcacagaccacaagtaaggcatcacctctgaatttctttctgaacattgtgttatgcagaagagatcaaagcattttgttttaccgcgatgatgcagtcttccaggcgttcacccaagccccagatcggagcgtccatgatcaccagcttgtacgtggtcatgacgggacggcatgaatcctgcaccaaatgtcacgtcagacctgacgacgcaacacgagtgtatattggtgttttctgaactgaaacctgcgtaccatccaacccttcaagagagggcctcggctcgtcctctgcgacctgaaggctgtcaggtcgacgtttggggcgctgatcaccttgctccagtagtccctcgactgcaacgcgatgtcgacgacctctacctctcttgcagctaattgttcactggttaaattgtgggcctggttatgtacattgtgctctcttagtatttgccgtttggtctgaaaaagattggagcaaatatggttgctagatgattggagagtacttacgttctcagagcagccattgtcaggtctgatcacagtgtcgatggtcagtgaacacttgctaaaaagcgggcactgataacaaataatcaagaaacctgaagttaggttggaaaactgaaagagtatcagactttaagagcgaatgggttaactactctgtactctgtggtaccttgatcactgatgagggtcggagtagaaatcatggccacatgaacacagagaaggggaatccaaatggaacttgtttagcaagaatgatcaattattaaaacacgactgctgcactttaatagcgaaaggtctttgctaacctgtcctgctgtttggatatgcgcaccatgattcctcatgcacggtaagtgcacttgctggcgcaaaacctttcatccaagatggaattttgctgcataatttttacatttaattgtatataagaactagcattcggtgaaacacatcagcatgcattgcttaacttaggaaagaaggtaatgcatgctcctaattaggacaataacttgaagtctttacatctgcaatgttcgacatgttactcctttctactactgatcaacctcgttcttccttctgttcttggatgaacacttcctatgatcctatctgctttcagtagctacgagatctaacctcttgtaattaacatgacatgcttattcttatcaagattcaagactacaattgatcaggaacttctgaaaggccttgaggatcaacatattttctgaaacaatttaatattgcctgattgaattaaacttctgaaatccatcagcaggactggcacggaacaaactaacctctgcaaatgataattcttcgaggtgtattggcccttgccaagcttctcatcctcaaatgggacctgttgcagcacctcgacgccctccttgctgttcgtgttttgctgctccatcttcatgatggtgtagctgatccctatttcatactgtaacgaaaggatcggttctgatcagtccatttaccaaattgctcgaaccacaagaatgcaaagccttcaattgaaaattttccttttgccacactacttctccatacctcttccatcgacataggcacgacgatccggcttggtgaaagattgaagtcaaggcatgcccaagttcaagcagatggcacatgatcacccaaaaatgacagaaaaagaacacagcaaagaaaagaaaaaaaaaatccatggacacaagaactagtaggatacaattccttgatcttaaccatctctgaatttgcaccgataatggccaaatctgacagcttcgatgagctgctcttgagagggaaatgaagagcttatttgcttctatctccctcttctccggggaatggttcagtgatcgtctgatcgaacagggcaatggagaacgcagaagaaaaccaacttatcctccaagctgcaccctacaaacatcttccatccaccccctcccaaaaccagaaaatcagcaaactcctcaactagtactattctttcaatcttttatccatttccccacttgaaccttccaactgatagaaatctgaaggtttaggaggggaaacgtgcaaagaatcaccaaaactaagaaacgggcaggtccacatcaacccgggggggtgtgaggtgagcaatgttctaacgtcaccggcaacctttacgaaacgtacgtatcttgcaagttctggagaaagatgccagcatccgcgattccgcgcgccccggccgcccacacggtcgtggtcgccctttcggttcatgccacgccggccactcggcccagggagaaacacatggccacgaagaatttatgccttgaaaaaggcgtcgtcccatggatcatggggtgttccgttctcactttcttgctagcgatacatttatttacctacagtgatagccagcgacgctgtcaagcccaaacaattagtagtgtttttttaaccaactaaatatttgtaggtgtcgccggttattggcagtgaaaacggtaatagtatagctcgggcggccgtccaatctgtgtgagagtttcctgcagaaaaagtgagatgggattaacagtttaacgctgcaagcatgcctgaaatttcaacatgagagcacacggtgcgcatttgatttttgattgattgtgtggcgtccaaaagtgacttgtgttatgatgatagctgtttcgtgttgtatgtgagggagtttgctggtgtatcaagcatggtgcaagaggacaaccgaataagtttcgttgattaattacttgcgacatcaaataccagaataggtgaaccggtcggtaacaccgacactaatacacaaacagttttttttttaaaaaaaaataacatggtagatgcataaacacagacagaggagctcttaaataaaggacagttccttttaaatgtgatggctggcactcctagatagtcagtggtgatttaataagagtaatttatgtccaaacaaggagctcattgattttatgagtttatcgaaccagcagatggttagatatgaagttcagacagattaagtccgagcgaaatgaaaatatatgatatgtattaaatccaagtgaaatggggaaaaggtactccaagatgaagattggcacaaaggattggtagcatctgctgtctgtgaagatgctgcctgagacaatttgtggatagaagattcgagtggatataccatataccagtaggtaggatacatgtgggtgaccttgtactatttgacctccttatattgttctgtcacgcaaccatttcttgggtttactttgggagtatatattgcaggcattcatttgtttaaagaaaaattcacaagacctttcacgtaaatttataatttgtacttttattttgatctgaacttgtttcttgtccctaaagagaaaatgaataagttcatctaacgtcccttaattttacaccgaatccgattttcattcttaaaccccaaaactagatacaaccagtccccaagctgtcaagactggtgtaaaaaaggtccctcggcggttttgaaggcggttttagctgatgtggcgcctacatggctggtttgactaggtctacgtcccacgtggcaccgatgtagcaattatatattagaaaaataataaaactatgggcccacctgtcagctaaaaaaataatttaaaatgttggggcccacatgtcaggaaaaaaggtggggcccacatatcaatacatcctctccttctctctatttctctcccttccagctcttcctctcagcgtcgtcaaatatcggcggcgcgggaggcactgcagacgacggtgaccggcagcggccgggcggtgtggaggagggaggaggcggaggaggagaaggagggatgggtgccgatgcggccgagcagcggtgccgatgtggaggagctcggccgagcgacggccaggggcggagctacaatggttcctgtgtattcccaggaatacccacttttttttatcaagaaacaagtattacttcaatatatacacatgtacacaaattagttagccaagtactctttctcaataagatgcgtatagatggaaggtttagaaaagtgaaaactcttgctgatctttccattatgattgttgaaacaaagttgcacaatagacatgagattgttttcaagcttctcaaattggttccagtgcttccagtagcagtcccattcatttctccatcaagagttggattaagataaagattttcgtgccacgcttttcaaactgctaaacagtgcgtttcgtggggaaattttctatatgaaagttgctctaaaataacatattaatctattttttgaattttgtaataattaaaactcaaacaatcatacgctaataccacctcgttttacgtaaaaaacttaatgtttatcttcatcttcattttcaggagaaaagaacaccttctcaatttattcttcacataatcttttctgccatgaattatgtgaagaataaattgagaaacaggcttggggatcaatacttaaatgattgcttggtcacatttattgagcatgagatgtttttgaaagtaaaggactgtgatattacaaaccgctttcaagccatgaaggaacgcagaattaaagctactcttccaagccatgaagtaagtgaaatagaaaattagaggtaccgtgtaataatttgtagttttatttcttcgattatcggtattgacaaactgtgaaccattgattttttttactatggacttttttttttgttagacaggaatacccaactttaaaatcctggctccgccactagcgacggcggcaccgaggcagcggggcgcggctgagcggcggcttggcacgagcgtggccgtgcggtgacgccggccccggcgcgggtcgcggcctcggcggtgcggccggcattgtcttctccatttattttctattttcaattttcctttcttttcttcttcttttctcgattcttttcttcttcctatggcgccgatcaccgtggggaggcgctcgtgactgcttgggcggcacggctcctccggccatgtggcggctggccggatcggcggcgaggcaggcagctggtgccatgggcagctagcgccgtgggcctttatattggcattgatttgtacgtgtacgtacaacgtactatctacctgctcgtctgacagcaacatgcgcggctctggcggccacggcggacggcgcggcgtggccgacgagcatgaggaggcgacggattgagcgccatcctagcggctgggggccctcctccgacctctgctccggaccgccgccgtcctcctcatgacccgtcgtcggctgtcgtcctcccgtcagccgcatctgggaaggaggaggggaagaggggaggagatagagaagaccgagttgggcttgagtgctggaggatgacgatggtggtggaggcgggttggcggcggagggcgtgccccactccctctcccgccggcaccgcgtgccgctccctctccatcgcgactgagagaggagaggggagagagatatgaagaaaggggagatgtgagaggaggaagaagaggaggggtgagaatgacacgtgggccctattattttttattaatttatgtgcgaaactgacatgtgggtcccatgggctttattattattcttagatcaaattgccacttaagcgccacgccaatgccatgtcagatgaagaccgagtcaaattagccacgtaggcgtcacgtcagtcaaaaccgctatctaaacagctaagggatattatctgcaccagttttgatagttagggcacctaatgtatctggtttttcggttcagggacgaaaatcggatcgttgacaaattaagggaccttagatgaacttattccaacagaaaaaaaccagttctcttcccaagagaggctccacctgaaggcccatcttaaatagttgatcggtgtgttgtgttacaccgatgcaataagttcattttgtgtccctttaactacaatgctagtagaaatcttccacctccatcgtgcacacccggattaaataagattctctcgtaatatgagatggttgtttttggctgacgtgacattccagtcttataaaagtaaaaaataaatggagcctcatgtcattgacatcctttctttctcatctaccccaacctctcctagcgagaactagcgatcggtcctgtcctcgggagggttcaatctttcgttttcgacgttctatcggagggtgcccatataccgaaattttaaataaaattggtcaaatttgaacaaaatatagcgagaaatgcccaggggtcttccggctagctccacaagttggtgggttagacgacctgggttcaaagcctcacccctcctaattatttgatattagatccttccctaatttctagttttttttgaacaaaatatagctaaattcattaaaaaaagcttaaaaataaaaattttagccaaaataatatcattccgaaagtttttgaaatttttgttccggaattttgaaccatggtccttggtccaacgacgccgccggtccgccgatctggtggagagatctcctcgatcctctcctccatgcagtgacctcgtcaagctagaccactcagcaacgatggaggagggcctcaagatggcaacaggtgcatactatcgggttcctttgctccatacccacactcacgatgactaaatattttcacttaaatacccacatccggcgggtacaaaatcatcctcatacccacacccgtgcggataacgggtacccatacacatataattgacttgtagcatatatagttttgtactgtaattagccatattagaactgtaagttatcaatattttctctggcaacaatgctattaacattagcgttcaaaaggcaaataaaaaaactctacaacaacattacataatcaaaaaatcaaaataatttcatataatagactggaagaatgcttaagatgtgaaatgagttttatgctatgatttagtagtcgttaggacttttactcatagttttaggcttaatctacgggtttttttcacccacggattggtgggtacaggtgggtaaagagcggactatacctaggtacccaacgaataggagttttcgtccgtcaataggtctatgggtataagagttagaatataattagcttttaatagagtaaaaatccatcgggtgtggggttacatgtccccattgccatctcggaggggacgcgagtggtccgatggagttcccagactgacgtaacgtgcacgaggctcctgttggtgttcgagacttccatcgagccgcccatcgtggcggcgttgctgcaaacggcgtgggacgcgctgtggcctcgccgtccaactcctcttgcgaaccgctcgaccttcatccctcgtcgttggcctccccatcctccggccatacatgccgcagtgccgcagcctcgatcaaccggtgccaccatgattcgtcctcctcgtcggcagcgatcgtgtcctcgtctccggatgccgacgaccccctgacatgtgtcttttcaatgtgaccatctccggatgctccacggcggtgaggaggggaggcaaagctcatgctcagtacaacaaggattaggttgtgttcttcacttgaagttttcaacctcacttcctcgtttaccatacgctttccaaactattttcttacaaaaaaatctacaaaataaagttgcgaggcgcctataaatcggatgcccgattttttttcaaaaatcgaacgatgttccaccaagtagatcggaattgtttcactaagtagatcgaaaatgttttaattgtttataaagctaaaatacaaccaaatcatctcatgaaacattttgctacaacgtataaaacaacgccttttgaaactgtttcaccatatataaaaacaatttttcagcaaatagcgaaagaatgtttcaattcacagaaacatttgatctatatatagtgaaacaatacgagtatacttggtgaaacattattggtggaaaaaatgaaacgaattcccttaatagagcatttccgtaatatgtgagtgatttattacaacggcccatgtggtggggcgcgtggtggggatggtgcggaggcgctaggggcacgggcggaggcgggcgcctgaattttctgccgctgatcggacgcccgatcgctggcattttctaaaaaattgctataaaaattatattaatatattttaagtttttaaagttgatacttaattaatcatgcgttaatctgttgctctgttttacgtgtggagaggaggggttaccgacccctgcaaaaacacaggcttagtgtataggtcgagctaaacatgattagtgctctttcacggaggccattagagtcatcgctttgagcgacacatgcaccaactagaagttgttgttgctgctgctcgaaacatgcatgagctcgtccttagtacagcgaggccggccggttgcctgcaagactgcacgtctgcaaacatgaaccatgccgccggccgattcggcgggggtcggcagccacatgtcagtgacccatgcgagcgtcgttgggcacgccgaggccaccgtccgaccgtcggcgtggagagagaagatgcgagagagctagaaaggcatagaggagaaagaaagggtcacatatatttttcatttctttttctgactgtatctgagcgatgtttcgcttattcgcgcggtatatttgtaaacggaaagtaatttataaataaaacttttatatatgtattattagcgatctaaaaggaaaagctgaaaaataaatttcgatgaaaaaaatttaaaatcaactctaagtttaaggataaaaggatcttatttaatccgattttgcaagatggagactaaaaatttatgataatattgcaattaagggatgtaatttaaactcgcttggaaataagggatgtggacttattcctactccgatctggccttggtaacttggtttgtccaagtctccaagagaagagaagcccacttattgtttgggcttacacagcacgccgaattgactcgattaaaacgggtaggctaatcgtggcagcatatgggacacgtcttgcacgtgttgtggggttcgtacccgtaccctgcacgtcgtacaatttcgcacttttttctctctcgctcgtctcctaatcctttcaccaagctaaaagcttcacgatatgtcgtgccggccgccgcaatcacaactcgatgtttccaaccggagtggggaagcagccgagccggacacattttaggcaacatattggacattctgtacacggagacaaaggatttgcccgtacccatgcggcatggttctggtcaagactgatggtgtataccaccaaacagattaactaatcgattactagtagctagtagcctagtactgtagttaactagtcgattactagtttcccggaaactaccatggccaatcggtccataaaaacaaattaagacaagacagacagtagcatgcatgcatgcatgtatcggaaagcttaggctggctaatcatcagttagttactggtttttgttctgttgtgacactgtcaattagttactggctttaattttgttctgttgtgtgacagtgtcagttagttactggttcaaatggcagattggcagccggccggccgtctacgatgaccgtaggcgatcgtcatttcgtatggtctggtactctggttggcgcatgcatatatgctaggctaggctagcgagacttggaaacggtacgtgttaatgtgacagtccaagtagccaaagtaggtttctggagatagagttaggcagccttcttttgggggcttctgatcgatggtgatcgaccagttgctagcttcgtgagaattaatataattgaacaatattttgggatctgttgctcgtgcagcgagtgtttgttcaaactacgtacgctacagttgccgccgggagctagtacgtcgcaggcacatgtttaatgttcatacggattgacatgttccacagagagaaaaaaaaaaacaggctgatcgagggagaaaaacgacagctgctagccagctgagctagaaactaaaatgttattcaagtgcagtagcagatttttttttcaacaagctgtctccagagctcggacaaaaacgtactacatgttcaatggccaccagcaccatcgtacatattacttgtgaacatgcgtttcctagttcctacacgatgttttttttaaatatatatatatatatatatatatatatatatatatatatattaattacttactcccccgtcctaaaatataatcattttttacttcgacacattttttgagatgttactttaacgaaaaataaaaagagtcgtatattacgatggtttgtttaatgataaatatagtaacatcaattttagtagattgattttttttatttttttctattaatagtcaaagtaaaaatatttgatttggcactatactaaaaatgcttatattttaggacggagtgagtagagtatttttaatttttttaactttgtaatatttatttcattcaaaacaatcatactgggctatataagcgtgttttatttcgaccgaacgacgggagttggtctgctaatgaatcaaactagcaggactgacagatacgtactgcgctacggcagttcgtgagctcgcaaatgtagctttcgttcgagttccatcgatctccttcagtcgatcggagtagtgtattgtcaacccactgcatgcctaacatcagttatttttgcaaaacacgtacagcgcgaattttgtgatggccactagctagtcgccagctcacaatttaacaagtgtttcacaggcttacaagaactcctacagaactttacttgatcgaccctgctcattgcaaaatatctgatcttgttttaaatctgaagaacataacactctgaaagcaagcataaactgttccggccggctgaagtatgtataaccgttgctgttacatgtactcgaagcacgacactagctaagccgccaggtactaattatagttccttctttaaactgatctgtttctaattacagtacttaattactactagtgctctagattattaattaccctgcatgccaaatacggagtatggtagcttagcttagcttagctagccgcgctgaccatgcaaatttgtatcacgtccatagctggggctcgccccacgccgccgagtccaggtccgagtcgtagaacggctggtacacggtggcgccgaagcctgcgccgccgctacagtactccgccgggtgcggcagcggcggcgccggcgcctggtattccagctgctggtcgtcgtcccggcggcggtgcgcgagctcgacgcagacgagggcgacgaggttgtcgtgctgcgcccgcgcgttgagcaggtcggcctgcgcgcgcgcgagctgcaccttgagctcgttcgcctccttctgcagccggcacaccgcccccgcgcacccgtacaccgggtcccgcagcctcgcctccgcctcgtacaccatgctgctcaccgcgtccgcccgcgcgctctccggcaattcctgcacgttgccgcacgtcggtcgatcagcaatgtgccacgacgatcgatcgatcgaaatcctcgctcttacgtgcgggcgtactatgtatatacctggaggagcttgatgatgttgctggcgccgaacacgcggtgcgcggtagtgaacttggtcggttcggtaggagggaagtaaggagccagcacgcagccgtcggcgcaccggcggcggagcaccttgcacgcggcgcacgggctcagcacgacggtcgtcgtcggtgacgacgacgacgacgtgttgcccaccagcaaggaggcggtgccgacaggaggtggtggcggcgagcacgacgacaccctcgacggcggcgacacggaccgcccgtaatgcggctgctgcgccaccgtcacgttcgcgaccgtgttgccagcgtgatccattatatgacacagcctagcgcaacacagggctatagcaagcaggagaagtagctagagagactctggtattgacctgctaattaaagatccaaacaggaaggaggtatatatagagagacggggacgacgtgtggagatttttctgcgcgtgcgactttgctgccagaatcgatcgatgctccgtggaatttagaacacgtcggaggacacgatcattcgatcagatcaacatcaaattagttgccagttttttcctaacacagatattatacgtgctttgcttgaccaagtttggcaagttttgaaggcttaattaggtaggtgcttaattatacctgtagtacatgcattattccttccatgcatgcttgcaatcttgcatagctaatagacattaggcatatgctgcattaattgctactattagtttactctatactccagcttgtagcacaattatatatgggagtaccgctatatgtacgatccgttgtacaactcatatacatgtaactatatatcaattaaagtaaaacatatttatatacactgtagccgtttaccaccgttaattaaattttgtcgtacgtgagtcggacaattaagttatatgcatagcaattttctatatatggcatgtcgttgatttaaatatatatgcttgcagttatcatatatcaactagttggttatattttttaaaaaaaacaatagtaagttaaattaatatgtaatactatatcactcaataaacatacgagctcaaatttaacctctagaaattgtaaaaaaaattaaaccctaagtttgtatatccacaatgaaatttattatttttctctaatccgtagaagttgactttgaacttataaatttgtgaagtgatatattacatattaatttatatcactattttataaaaaatatataaatatttagttaatatacactgatcgagtgaacatctgctctagtaactataaacgagtttccctttcttttttctgctcatatttttgcgttgcccaaacggcaggtcgacagcgtacaggacctccttgcgatggaggcgaccctgacgccgactctcaaaccaactgttcatgggggcccaaaaccaagaccaggttgagcggcaggttggaacggaggcgataaaaaccaaagtctgtacacgtttagtcgccgtcgatcgccttgaacgggcatacacttatgacatatgtggccgcccattgatctgtctggatatcgtccataactccatatataggttggaccgttagtatgcaagtcaggctgaattaatatgtgtatgcccttggaaatcaaaggggacatgcataacttgtacgatagggtacagtaatactactccgaagtcgtgctaggattgtgttctttcttggctacagttatatatttgatctttttttttagctgatagctgagtacttttcagcgaaggacacaaccaggacagtcggatgcatgtacgtatttagctagctagtctgtgtttagatctaaagtttggattcaaacttctaactttttccatcacattaatctatcatacacacataacttttcagtcacatcgtaccaatttcaacctaaacttctaactttagaaggaactaaacacagccctactccactagtgattagaggctactaaaattacttgatcactaactgtgcatttaactctatatgctgagtctgaatacacaaagccgcatcgacgagatcagtgactatcatcaccaatgctcttcttatcatcactcggtgtagggctggaaatgagccgagccaagccaggctcggcttgcaatggctcgcaacaagctaggcttgccttggctcggctcgggttgggaaacgagctaaaacatgagctcggctcggctcgtttcctggctcgagccagctcgagctggcttgcgaccttccgttgaagctatataatttgtaatcattaagaaaaacaatgacaaatcattaatatgtaaaattaaaataactttatatattcaattcatcagaatatagataataaattacatattgacaaataataactccactagaaaataaaattatccatataaatacatgatggcctagactcacgagccaaatcaagcggctcgcgagctagctcgggttcggctcatttcaggaacgagctgaaaagtaggcttaggctttcgctcgtttggcattcaagccgatccgagctaagcaagctcgagccaagcccgagttaagctcacgagtccaagctttttttccacccctaactcggtgcgtgcatgtgaggctccgattttgttggagacgtgcatgtgagcctccgattttgctgggagacgatggctcgatcgatcgatcaaacagttcgcaagcagcatgcactccggtgtcaaaggtttctgtctgcttcaggaagcatgacttttccactagagtctgaagatgcagctgaccgacatggacttcgccgcatgctacgcagcctagatttccacatttacacatcttcccgttttgtcatacgcgaggcgcccagtcagagggtaagagcaagttttaagagcaggtacaatagcagtctattagccagttataaatatattttaatgagataaaaaatgagagagaaaagaagcgggctacagatctgtagccagctgcagcacgaactccaggacgcagtgtgtgtatgatatgtaggaccatatattaatagtatagtaagcaactgtggtataaattggctattatattggctatagataaattggagctagtagtgggctatactattaaatttgctctaatagtatatcccgatactaactccaaatcatctatagccaatgtaatagccaattcatacaatagttgcttactatactattatacctggtctcatatgtcatatacacattacgttttggagtccgtggtgcagctggctatagatatgtagcccactgatcttctctctttctttatctttttaaaatatatttatagctgacttatagtctgctattgtacctgctctaagccatatattgtcatgctcgtcgggcacgcgcgagacaggtacgaagcgacgcttcgtgatcgcttttccggtctctgccaagcgccggtatcaaatcactctgaatttccggtgcacggtttagaaaattgctcccataatcccattgctgttgcctgtaagcccaaagctagctacccgtagtatactagtactatcttccaagagttaacgttcagttgcacctatatttattatttttgttacaatttatagaagttaaatttaactttgcatatttatatgatatattttatattaatatatgttagtcaatttttatggttatttaggtgatatcaaaagagagagagagagacagagtatccgtgaagagagagccatatataacctgcagcactgccggcccagtcaacagttcttgttctcatctttgagttttccaaaaatggccatgctcaggggcggagccagtataattagggggtatccagtaacttggttcaaaaattttttttatctatagtttatctattttcatcatgtatataccccgtcagtttaaatataggcacccgtaccaagctaaatttgattcaaaccagagtaaagcaagtgagtggaacaccccttcattttgttctagctccgcccctggcaatgctgtcttgcaattaggcttgttctcggttaatctctctctgaggattaaaggaaaactagagaaaattaatttcataactatcgagatgttggaattaatccttctcaatcttcttcaatctctttcttaagggaattaaccgaagtgggcaatatttgtagaccgcaggcataaaacaacacttcattgcagctcttcttgctgtcctggagaacacaaggacaaggtggggcaagcagattacacattattcagtacttagggcatgctgttaacatgatgccagggtttatgtactggaaattcggctttgattgacttgattggagcccac

SEQ ID NO: 68070 - DNA, 2502 bp, Oryza sativa
ctgcaccccgaattcgcgaataaatccctccaaaaatttgccaaatggatggttaattaacaaatcctttctgtatgaatggctgctagcctggtacggtagcaatcctaccactgttcatagggcagcttttcttctctctaccggcaggccggcttaatttgccggcatgtaacgatcatggagaaattgcgggtagttgcgggcatgcatgtgggatgatatgcaaattaaggacaaatggagtcaaaagcggcaatgcgtgtgctctttgtgcatgcattatcctgcttgtttttcttcatgcacatctgtcacaatcgtttagttttgggttaactcagtgtcagctagcgaataatgccaggcgctaaagatgaacgtaacggcaatgtacagctaggtagtagctcttccgtcaataatgagatgaaaaggagatcagtggggattagtttgcatgtagtactggtagtaaagcaagctgccggtatctgattgaatgtaatgtcaagtctgaaactggttcaggttagtttggaaccagatgcactctggtctactgcaagggaacctcccctaaactgtcatttatactcacgaaagggatcgcgatttttcaagtagtcgagtgtacagtagtataatattgttgaggttctaatcttcattctgtgtaaaattgccaaaccatatagataaatcaaagattggaattgctttgtagcttcaaacaagctcaatatgttttgcagcaaatataagaaaacaaatttttgcaggatgaaggtgtgaaagcacaaacatcatgggtgtacgggtcctctgtttacaaacagtactccactacctgagaaaaaggtcgaaagcaaaaaaggctgaagcacgaacaaagatccaaaaaacccatatctgaactatgggcgcaccaacagcatgaaacgggcacgagaagaggatgatgagacatcaatcagttgtttatcccggggagaagaagagaacgcatgcagtaacaattacttggatccacaatataatttcgtgtcatggcacattggcatggagcatgaacctttttttctcacggcacgcacatgccgacatttcaaaacacaagaagcagcaccttctgttctcgttctcttctgagcctgatcggatgtggtttagctgagctaagcctccatgtcagtcaggcagtgaggcagaggcagctagctgagctgaggccagcctatctatctaccggccccaactatcatctgccaacttttaatacgcgctgccgtagcaagaagaagaagaagatgaggaagaggaggacggacgctgcatgtcaccgtgccaggccatgtgccgcggcccaacatggcacgttctcccctccagttcacttctctctctgctcacacacactagcctagccagtgtactagtgttgtagtgtacccacctcgcttataaatacccggttccgcactacggccacacaaaccaacacccccactcatctcacttcactctctttctcttctcttcacttcaccaccgccacctctctcatcggatccctgcagaggaggagagggcagtggcggcgaaaggcgacatgggctcgctgtcctctctcgccgccgcggcggtgtttctctccctcctcgccgtcggccactgcgccgccgccgacttcaacgccaccgacgccgacgccgacttcgccggcaacggcgtggacttcaactccagcgacgccgccgtctactggggcccctggaccaaggccagggccacctggtacggccagcccaacggcgccggccccgacgacaacggtacggcttgtgatatctttgctcgtttttcttcttcttctccgacgatctgctgcttctttccggcaatgtggctcacaaaatcttgatccaggcggcgcgtgcgggttcaagcacaccaaccagtacccgttcatgtcgatgacctcctgcggcaaccagccattgttcaaggacggcaagggatgcggctcttgctacaaggtgagtagagtactccaaactaatcaaaagattaaagaaagaaaaagaagcccatttacatggggggcctaactgtcaaagcagtgcatgccgttgcagtcttgaccatcggtccgcagggtgggacccaccgccgagagcatgtgcgcgtggccccctccaccccggttttcggtggcagtgattggcgcgccaaatgcattcaatgctaatgttttttcttctttttttttctttttaacattacagatcagatgcaccaaggaccagtcgtgctccggcaggtcggagacggtgatcatcaccgacatgaactactaccggtggctccgttccacttcgacctcagcggcacggcgttcggcaggctcgccaagcctggcctcaacgacaagctgcgccactccggcatcatcgacatcgagttcaccaggtcagtgaaagaaaccacattgtactgtac

SEQ ID NO: 68071 - DNA, 53622 bp, Oryza sativa
  unsure (1)..(53622): unsure at all n locations
atgataactgttgtgagaatgttgagtgggactttggggttttatctccgaaggaaatcacagccccttcaaaggatgtagaacttataagcaaactgaaaccatctttgcctgagaacaagaaacatgcttgtgagagaagggcaaaggctattaaacatgatacttcagagaacagggcaaaaatcattgagatcaaatcactagattcttgtgaaacgtctggttctgctgtgaatgggcatttcgaagaggaagaatgtgatgaggaaataatgaacattgatgcctccagtgattcatccctggagccatatgatctgtcagacgatgactcagatttgcagaagaaattcacccaattaaaagatcttgctgctgcactacgaaaacctgatgatccagacggtgtaagtttctatctagtgctacctgtactttccagagcaaattattgtaaaatcctgatcatcctcccttcttttttacccaaggttgaaaacgctctgagttctgccgaaaagcttgtgagagcatcacctgatgaactacgccacaactcaggtgatcttgttagagcacttgtgcatgttcgatgttctgacgtggcaatggaaggagaggaagattctgctgaagaaaagagacagaaggcattagttgccttgctggtaacctgcacatttgaatcattagatgttctcaccaagttgctgtactcatcaagcgtggatgtaagtcagcgcattttgattattgatgttatgactgaggctgcacaggagcttgcggaaactaaaattgtaaggagagagctgcggcatggaaacttgatatccgacacctctccctcttggctagttcctagtgatcagggacctgctggtgcaggtccttggagggaagtctcagaatcaggaacacttctgaattggtcacaccggtatgaaagagaagttccatctagatctggtcaagttaaatcaggaaaatctcgtaaatggggtcttggaaaagctaaagatttgcagacagagtggtcaaaaaacagatttcctttatatgctgctgcttttatgctccctgttatgcaaggatatgataaaagatcacatggtgttgacttgctcaatcgggactttgttgtcctaggtaaattgatatacatgcttggtgtctgtatgaagtgcatggcaatgcatccagaagcatcagctgttgccccagctcttcttgatatgatcagatctaggtctgccaagcctaaaacaagcatttccgtgttaaagactttcttagttataaccaagtggtacgattttgacattggattttgtttctgcagggctgtttcgcaacatcccgaagcatacgtcaggaggtctgtgttgtttgcagcttcttgcatactgatagcgctgcatccgtcgtatgttgcatcatctcttatagaaggaaatcaggatgtttctactggtttggaatggatacgcacatgggctcttcatgttgcagaaacagatcctgatacagaatgctcatcagtaagtactctggtctatatctgttatcgatcacttgttcgtgttttgttcgtcgacgtagagagcaattatggtataataggatgacatttgtttcttaaaaccacacacaataataataggtcattttttgacgaacaaaggagtacagttatgctggttttgtatcaaagtttgtctgcatcgcctaatcatttcagtaacctacccttatatgctttagttttctgtaacctactcatttctctcattccttcagtatacaaattcagtgacccagctcttttcagcaatttgtaacgaaaaacaggacatatttttacttataagctggaaaccagtttttacttaaaagagaaaccaattcagtataagctggaaactcagtaacttttcacactgtcatctaactcctcccattggcatgtttgtcttcaagatggctatgacctgcctgcggcttcattctgagatggcccttcagacatcacgagcactggaatcggcggatcacagcaaggccagcagcagcagcagcaggtcgctaccttctaagcttgataacatcatcataccatttgccaacatgatgtgatcgatgtactagattaagttgtaaataagcatatattatcttgccatgtaatattagaaattccaggtcagctaattctgattaggcttgatattgtcatattacagggttttttaatctgggatttgaaaatgctagaatttttgtcgattcgtgtggagattgtatggaagttgtcctgatccagattaaagagaattgatgaaaattgtacccagattgatgaactgactaatagttgatgatgatgagtaaaagagaattggacgagtcatgcaggggcgagggatccgtggggaccaccagccacaggatggggccactcctcgagcgttggatcagccgcgagggacgatccgacggaggagatgcgtctggtccaggtatttaagcgcaacttttttttgcccttcgcagcacaactgcacaaccacttttccgcatctctctctctctcgcgtctcaagagcagcggcgaaaggtgggaggtgagatctctctctcacttcatcctcctctcctcttctgtggtttcgtccgccgcctccatccctaaaccctacttcttctccgaaagcgccgtgagattcttctccctactcttcttcgatcttgctccattggtggtggtgtttgtttgcttggagtgtttggtgtcgcggtttctctcgttcttgtcttcgctgaatcgagcagcaccctgcgtcttggttggttcctgtttaccgcggtctggtcctcttttttcgtgttcttcgcttcccgtacccgtgatgttgttgcttgatgcatttgaggcgtggttttctcggagttggatgaggaggtcgacgagcaccgaagcttcatggttggtctccgttcgcctctctcccatcggagcacgttgatcttgacggttcctggcgcgaccaatgcgtgcgcgagaagttagacgccatgaattcgtttctcttctctgctttgttttttttttggctcctgttttgcagttggtgtgttgcggaggtgtcagtttctgaatttgtataaaccaaatgccctcttcttattctttttgctgttcctgatgcaatctgcccgtcttccttacgtcttgatcaagtagaacggcgcctctttctcttctcgaattttaaggcgtttcggaatccgaaatttgctaagattttacctggccgtgatcatttttttcctcctgttcttggcttcccttacccgtgttgttgttgcttgatgcttttgaagttgggtgtgtgagtttcttggaggaggttgaagagcacggaagcttcatggtgatctcgttcgcctctcctcggaacatgttagtcttgatcttgccttccgtttctctatttggtcttgatcttgccttccgtttctctatttctaccagtgcaagctcgagaaattaaaccacatcaattcgtttctcttttcagtttgttctgttttggtatgctgcggaagtgccagtttctgaatttgtattagctagatgccttcttctgttcttttcgctgctcctgatgcaatatgcaggatgcttcttctctacacgtctctctgttttctgcctcgaaagaactctctgtcctattgtggctttgtttactcgatgctattttttcgttcaatgatttctgcatgtgtcgctccattgaattacttgtaaatcttctgattctttacctatcaaagaaacttccatctcttgaatcttgatttggcttccttctcccttaccgagatattgtgcattttttgtctgtaacctgtttttcacttctctgtgatggtgttcggtgccgtactgtactgttaggttgttcttgctttttttcttctgttcttcattctttgtttgcaattgtttaagttttgattcgccgaagcagtgccatatctaaaggaaatcgatcattcttgtacagtacactttatgcgctcgtttcctcttcttatctcactttgaaatttggtgttatgatatgtgtcagtaaagcttatatcgcgtttgtagaaaaccttgtgtgtattttgttcgcagtaataaaataagatttaggtgtaaaataatgcagcactgcaactgaagattgatacttccatgttatatatctcaaaaatgcatttaagcatttaagggccctgaatgaaagcaccaattacaccctgtgctttgagctagataagtagtgccatatcaagtttgatgattctacttcactttatttcatatgtaacctagctttctggcatttaattgatctgtattattgtttaagtgtctttccccgtttttgttaataatgttattttatatttgtattcatgttaaattttcagcaaagcaagttccgctatgggtaacagccttcctgtagaatcgaagttcacttttgaagaagagaatgacagaattaagtatgttgtgtcgtctatgcaaggatggggtgagaaaatggaagatgctgtgagtaaacttgcagccttttgtatgacaaaaaaagggacagttctgcaaaattttcttactgatctttaagtaattgtgtaaaatactgtgattgacatatgccctctatattctctagcatgcagctattctaaatcttgatgataccacgtccacgtctttctttggtgtttatgatggccatggaggtttgcttcattctcatttttttttttaatttcaaaccctccaaattgttggcgtaactgtttgtcatgctatgtttgtctgtgtgtatcactttgtttatctctgcgcatgttttgaaaactttgttgtatatgttgaaacatttacctgtcaattttcaaataaatatgatgctacagttatggataatgaacaagttagctaatcagtaatcacattcgtgtggcatgcttgcaaggataacatgaactacataaaaagaaattttaattcatgagagataaaacactgcatgaatgagttactagtaatataaatggtgatgataatttagaggataattacagattaacaggttagttttttttttaatgatgcctattcaagtgttgttctgctactaatgttcacaacagtgttttgatttataagcttctatgcaatagaagtaatcttgatccatcgtattgagcgagacgccatactgaattgtttttttctatctcaggagctgaagtagcattgtattgcgcaaaacaatttcacattgagctatgcaatcatgaagactatcacaacgatctgattaatgcactggacaatgtgtttttaaggttattttggcctactttacataattttgtttatagctgcacttggaaatgtgggatatcattgttcgtgtgattgctgcagcatggatgagaacctgcaacagtccgatgcttggagagagttagttattcctcatgataatggatgtatgtattttctcaaggctggtgtctgtgctaagcctttcccacaggtagtaatcttttaacccctagcatcctcaaatattcatgtcgtgaagaagttactcaaaattgtatttgttggacagtgtgcatattgtatctatgaaaaaggaaatggaagaatgtgtttgatatcgagactgttgttctttcttgtgttgtactttggagttggaggagatatgtttaaccctaatctcgactaattgctcctattaaaaatggttcaattagttacatatcaattggctggtttactgagttggaggccaacaggttcttaagttctcattgcaccttggttcttatcatactatgctatccaaattgaggtattgtttgcgatatcccttcgatggttatttctttcatacattggtttggttttcagaaatgtttttctatacctgttggctttcttgagctattttttggtagtcttttccttctaacaatgttgtgattctgtgttatatacttcagtttggttgttgttttcccaggcgacatatactgggccagcgtatgaagggagcacagcatgtgtggttgtcatcagaggtaaccaaatgattgttggacatgttggtgattctcgttgcgtactctcaagacagggtggcctggtatagtgattgtttccctattgaatttctggttaatacctaatttgcaagctcgttcattgtggcgcctaacatttgtgcttgtttccattttgtcaataggctattgatttatccttcgatcacaaaccatgcacaagaactgagtctgaaagagagagagttcaaaatgcaggagggagatctcttggacttaggtgtgaacaagtaatggggaattatgtagtcaaggaacaatgggtcctcggtgattttgggggaggtgtaacaatctcaagatcaattggtatagtcttgtctggatctgtttttcattgattgcatgtaatagcacaaaaagaagcacattacactgtgattggcgttttacctacttacatttcaggtgactttgctttcaagaagaacaaagatttagatcgtgaaaaacaaatgctggtatgtgatccggacatcctcgctgtaagtgtaactaagtgtaaataggtccgtttggtagaatatgaagttcagttttgccgggttgggatctgatggaaaattgccctttcaatgtcaggatgacataactgatgacatggagtttcttgttattgcaagtcaaggtctctggtaagtggtaactcttcagcaaaaaatacctgtcaataactattggatcatttttatgtcaccagtactcattggcattctcttttttttttttcctcctatttggttcatatatagtttcactcatagttccatactaattgcattgactactgtatattttccccctgcaggtcttgcgtggacagtgcggacgtggtttcttacatacatgaccgtttatcggtggtgagtcttttctttccctcagtttgtcttcttggcaggacaagatatcttagtggtgttaatcatgctatctgttctaggaaatgacttcaatcaagcaatgtaaatatcctgattttctcttttcttttaaaaaaaaactgtgtaagccctaaacctcacaaaaccatttgttagtttagcactgaatatgcatgcctggctgacaaactgccatctgctttgacttcgattctttcgctgttaaaactgctgttaccaataatgctgtgaccaattaatattgctatgcaggagggtgcagagctgcgtgtcatctgtgaggaggttgttgagttcggcttggcatcgggcgagaacactaccgtcatcctggttcagttcaagcccggcgccttccagtaccagctggtggatcccgctggatttggcactgccgtctctaacattgccagcaccagtgctgcgccggctggtgccagcgacacaagcgacgagggcgtcgatgacgctgccactgccaggcccaccgttatgggctacgacgcggactccagcaccggcagcgccgatgccacggtcgacagcgacgaggtcgatcccaacgccacggctgacagctacaatcccagggggcacgctgagatcgttgccagccacaccgacgacgaggtctacaccagcggcagtgccagggttgagagcggcgagctcgccgtccccactcccagcgccaacaacaccgtcgcggatgaggtcaaggtcgacgccgctgtcgtcgccggcggcagtaccaccgccatggctgctgacgaagccaccgtggtgtcgttgttgtcgaccatcgtggataactactactccattaacaccagcgaggagccagcgaggaggttgatcccactgccactgtcgcagccgacgacaaggtcaccaacggcagcaccagcgccacggccggcagcaagctgcacaccagcgattcttcactcaattttgtcctggtcgaagatgatgtgtgatgatgcgtgcaccgctgcatgcgcaggatgatactgatcctaggtagcactagtatcgtagtagtagaactttgctttggtaggatcggaatagttggtttctgctacccttgtttttggtttatgcctcctggttggtggantgggtaggnnngcccccccccccccccccccccccgattttgcttgccagactcggttaattaatgaggcacttgaatggtttttgagttttcaaagtacttaatctagtgatgcttttgttgacctccattttgaatctctatacatgctgggtatgaactacttctctgttcccgattcgggatcaacaaacaaaactgtcctgatagtcctagatagcagcaatagcttcaaaggttcagagcgaacgaaaataattttcaatagtgctggcacatgttttttcagaaacatcgagtggtctcaagtctcaactcttcaaatcgaacaactgctttcttggatccacatcaacaaaataggatgtctacggtctacctaccaagatcagcgctagtatctacttcctccgtttcacaatgtaagttattttaacatttctcacatttatactgatatgaatgaatctagatatatatatctatctagattcattaacatcaatataaatgcggaaaatgctagaatgacttatattgtgaaacggagggagtacttccttgtcaaatcttcgtgccggtgtggaggccgacaccagcagagggaggtgacaagtggtggcgcgggcgtagagcacgggagtataggggatgtgccaccgtcgatccgtcgtgccggaaggtggatggaaaaaggaaggaggcgcggccgtcgcgccggctcgaagtacgcgaaaaaggaggaggaggagggagcgtcgtgccatgcgggctgtaggcattttgtgcctgaaatcggcccatggtctgaagtaggccgtagcgggctgcttcttgggtcacggttactctttcagctcggcaacagcaatagactcactcactcacactcacggtcacaccgatttctccctaggcgaccataccggaaaacccgcgactccccaactccgacgagaacgacatggacgccggcggcgaggaggcgaagcaggagcgccacctggtgctggctcacgagctcttcctcctctcccgccccgacctcgacgacctcgccaatgtcgccctccgctccgatgccctcgacgccgtcaagtccgatggcatggcgccgctgttcgagtcgctggccaccgcgggcgtgctgctcaagccggacgacgcagctgctcgccgagatgcgcgcgcggatcgacgaggaggtccgcaagctcgacgagaagtgagtggattcttcctctcttcgattttatttctagccccacaaaaaagaggtcgcccgttgctgtgttgcgtatgcctgcagtagtactatgtggggataggttttgtgataaataactctggtgttgatatgatccgtttgcctaaactaacctagcttgctctcggtgcggaacatggatgctaaagctggtagacagtggcgaagctagagcaaaatggaggggggttcgagattttgccacaagtatatcaatatatataacttcaagctacattttcgatagaaccgttgattaataattttttacatcaacagtagagacacacatgcatcaataaaataaaaaaagtgacaaacattgtttttcaaaattaagaaatccactaataacattgataattgagaattggttactaacccatgagcaaaagatgatctgcatatgcaaacataagcaaacaccattctatttcattatctcaacatcctcgacgatgatttgataacctaaaacaagttaacatcaaaatcagttctcatttttcaaataaaaagtagaatccagcgcacttagatacaatcattaccttcaatcatcatcaaatatgcgtccttgcattttcatgaagcgacgaacaacggcctcattggtgactttcttcatttcttctttctccacataacaaataaggctatcacttaagtactcatcaccaattttattgcacaaatatgttttcacattcttcatagctgaaaagcacctctcaactgtggcagtagcgacgggcaatacaagtacaagttttaaaagttgataaaccaatggataacaaagatgttttcttgtctccaccattatttgagaaagctcggcaatagtttgtatgttggagaatctaccatcatccctcacatcagcgatgtagagaccaagttggtggctaaggtccctcaaatttccagaattaaaatcactaggatacaattttgctaaactcatcaaattctctagattgaaatcatgaaatgagtctcttggactaaaagccgatgagcaaataagcaattgagagcttgtctcactgaagcgattgtcaagctcttgaagtatccaatcaataacatcattaaaacaatccacttgatagtaatgcttgtttgtaattctagatttgtgcctacgcttcttgggatcaatatatgtatcttccatttccaatttgacaatatcatacttgtcacaaaagtcagagacttcatctagaactttctcccacttttctcttctaagctcatccaaattgagcctagttgactttacacatttcatagcattcactatgtcttgatccttccgttgcaatgctagtgacaagctgtttgtgattgttaatatagtcaacatgaggtgcaaatagaagacaaaatcaaaagattggaagtactccaaaagattcgatgcttgatctctaattttccaatcatttttgtctttttccacaatttctagcactttgactattgtagcaaacatgccaaccaaacttttgagagttttatagtgggaactccatcgagtatccccaggtctctgaagacattgctcttgattcaacccggttctagtttgaagttgcccacaacccaatgccttactcatttctttaacattaatatctctaatcaaatcccttctcttagatgatccacccaccacattcagtaagatggaaatcttagtaaaaaaatcactaacgcctttatgttttctcacaatagccacaagaacctattggagttggtgagcaaaacagtgaacataataagctgaactattttccctcatgatcaatgattgcaaaccattgaactcacctcacatattgctagcaccgtcatatccttgccctctaacttgctttagacttagcttcagttctgcaaatagagcatcaatagaagacttgagataggcagaagttgtttcagtcacatggacaagaccaacaaatctctctctcacaattccatatttatcaacatatctcaagaccactgccatttgttctttgcaagaaacatctcttgattcatcaactagcaagcaaaaaacatcatgcccaatttcttctagaatagcatgtagcacttcctttgcaaaacatttcacaatatccctctgtatttcaggagcaaccaaaagactgttatctgatttttttgtacctattgcctttcttaaggatgggttttgctccgctgtgtaatcacgaaattccctgaagttgcctctgttgtagggctcctttgactcatcgtgacctcggaaaggcaatcctagctttactagcatcctagcaacatcaatggacccattcaatcgagtaagatagtccctcttaccagtttctctcacactatgaaaagcaacatcaatgtgctggctttttttgtaataaatcatcacacttcttcattgcttgatagtgtgaaccaccgacatcacctacatgcaatttcaacctttcttttctatgaaaaccattccaaccatttttaacaaatgcttcatatccaccatccttcttttctctaaacaagaaatagaaaaaacaatatgctcgatttttggactcactgtattcaagccaacttccaaactcatcaaaccattccgggacaaaccttcttgaacctgtcataggaaaagcaaatgtgcgaggttgacaagggccattctccaagtatttccttctcaccctctctctgagattaggatggtactcatcaatttgttttcttaatcctggatcatatttaatctcatcttcccagtttatatcatccaaacatgaattacatgcattgttagcactattcggctctggcactttccttttgtaaaatcgttccatcaattaacctatcattagatgatttaggaggatgtaaatatatactgattttatcattcattcaagtacagaagtagaatgaaaattgatatgacttacatccaaatagcaccttcaactcaaattctcaaatttccccccaatctgcaattttattccaattctgaaggattccaaattgaaccctactggcctcctaattctacaatgtaaaaaaaaacaaccaataaaaattttaggcctttgtatctaataaatcaaattgattaaaaaagaaatagatgaagcatgctttcttaccttgtctctactaacgcacaatgtggctgtgtgctgatcagttgatggagatggatgatgtcattgttggcttcatggcttgtgaaagtgtggtctgacgcttgctcctggttagctggttgcctggcgaccggcttcctgccttcctggctcctgcggctggagcgagcaacgtaggcactaagcaagcaggggcgacggcgacagcgacagtgagctgccgagggcgacggccgacggcggcgcgtcacgatgccgagatgggcaagtgttgtctgggagactgggattggctgattgcagagcagtggcgtggaagccaaacagatgcgaggcggagtcgtcaagattggcagcgacgggacgcggcatacgagaagtcgagaagagaaaagattgatctggattcgactctcctcatgggcttacaacgttaactggactgttgtttggactgtgggtgcactatattgggccaaggggggtgcatatagggccgagatatgggggtaataactaaaaattttgtttgaggggggttcatctgcacccacgggcctctattgggcttcgcccccgctggtagatccgtagatagcttgcatttgatttggtagttgtaaatttacgaattatgcttagggtcaattcacctctatataaatctgtactacataatactaataaactttctccacagttttgttttagattcatgtacatattgatgattttgtacattatctctgcaatgtgtaatttagcatgtagaaaagtaattgagattgctaaggatcacaatgcacaacatcccaactgatacgaataatttgtgtgtcccttttatccagaaaaaataccagtgtaaactaatgtgaaggaagaatggcatgttgaacttcgttagtaatatggtatcgatttccttggtcgctactttgttgtcctaggtaaattgttatacatgctcggtgtctgtatgaagtgcatggcaatgcatccggaagcatcagctgtcgccccatgtcttcttgatatgatcagatctaggtatgccaagcctaaacaaacatttccctgttaaggaattttattggtaagttaccattttgacatcaaattttgttctatacagctgtttcacaacatcctgaagcatcagaaggtctgtgttgtttgcagctttttgcatattgatagtgctgcacccattgtatgtctcatcagctcttatagaaggaaatcgggacatttcaactggtttggaattgatacacatatgggctcttcatgttgcagaagctgatcctgatacagaatgaatatcagtatgtactttggtcactatggggggatatatctgttatgaatcaccgatttgcattttgttcgtcaaagtagagcaattatagtacaataggctcagcacataatactaatagggtcatttttgaaccaacaaagaagtacagttgttcagggtaaacgttatatcaaattcatttgcatcgtctttgattttaacctgaaagaagagtattttcactgtgagataattcactatctgaaaataaagagctaataactcccaccttatgctttagtttcctgtaacgtacttctttctatcattccatttggtcttctattatactcaaccagtgatccagctcttttcagtaatgtgtagagtaaaaccagactagttttttgttcaactcataattagaaaaccatttcagtacactggaaactcagtaacttctcacattgtcatctaactcttccattgtcatgtttgtctccttgcaggcatcatgacctgtttgcaactctgttccgagatcttcagacatcatgagcactgaatcagtggatcgcagcatggccaggaactgcaggtctctgccttttaagcttgataccatcaaaatgatcaatgtactggactagatatataaatcgattgatgtatttggtttcggagtgctagatttttcgtcattcatacatagaacatgaattgatttacgtgaaacaatttatgtaagtcttctgttccagattactactatgtttgaaaactttgaactgattagttgagcaaaagaaaatttacctgtggatgggtcatgcagggcgagaggaggaggaggagggcgtgtgctccatggggaccaccagccacagaacggggcactcctggagcgttggatcagctgcgagggacaatccgacggccgagatgcgtccagtgcaggtatttaagcgcaatgctgcttctccttgcgcggtttgctgcacaaccactttctgcttctccctccctcacaggctcacgcattctcatctcaagagcactagtggcgaaagataaagggcaaatgttatatccaattccgtctgcatcgcctttgattttagcctgaaagaactaataatttcactgtgatatgattcacaatctgaaaatgaaagagctaatatcactcatcatatgctttaattttcagtaacctactccctcctctcattcctttaatctaatgttatactcattcagtgatccagctctttcagcaatctgtaaagaaaagagatcttcaaacgagtagattaacaaaagcgtaaagtgtctagagtttttggaggcgtcaccctaaggtggccgtttttcttttcttttggggggcgttagctgcggctagcaccctgctcgactgtctaaggtcgattctgtaaccttcgtgacaccctctttcttcttaatacaatttgggcgacctctttcggctgtcccggcaaatctgtaaagaaaaacaggacctctttttaccttataaagagaaaccaatccactaagctggaaacgcaataacttttaacactgccatctaactccattggcatgtttgtcttgtagatggctatgagctgcatgcggctccattctgagatggcccttcagacatcacgagcactggaatcggcggatcacagcaagaccagcagcagcagcagcagcagcaggtctctctaccttctaagcttgataacatcatcataccatttgccaacatgatgtgatcgatgtactggattaatttgtaaaaaaaacttatattatcttgccatgtaatattacaaattccagttcagctaatcctgctacagtctacatgatttttttttgtctgggatttgaaatgttagaattttggtcatccatgcaatgatgcaaaagaacatgacttgattagtgtggaaattgtatggaagctgtcatgttccagattaggagtatgtgtggaaactgtactcagattgatgaactgactagttgatgatgagtataaaagagaactacacggggatgagtcatgcaggctgagggatccgtggggaccaccagccacaggatggggccactcctcgagcgttggatcagccgcgagggacgatccgacggaggagatgcgtctggtccaggtatttaagcgcaactttttttttgcccttcgcagcacaactgcacaaccacttttccgcatctctctctctctctctctctctcgtctctctctcgcgcgcgcgtctcaagagcagcggcgaaaggtgagaggtgagatctctctcccacttcgtcgtcctctcctctgtggtttcgtccgccgcctccatccctaaaccctacttcttctccgaaagcgccgtgagattcttctccctactcttcttcgatcttgctccattggtgcggtggtggtgtttgtttgcttggtgtttcgtgtcgcggtcctctcgttcttgtcttcgctgagtggcattgatcgagcggcgccgcgcgtcgaactcttgcttgaatctggaggcgtctcggtttccgaaacttgaacctctttaccgcgctatgatcctctttgtttttttttttcgtgttcttggcttcctgtacccgtgatgttgctgcttgatggttgatgcatttgaggcgtggttttcttagagttggatgagaaggttgacgagcaacggaacttcatggtggtctccgactccgttcgcctctctcccatcggagcatgttgatgttgacagttcctggcgcgaccagtgcgtgcgcgagaagttagacgccatgaattcgtctcttctctgatttttttttaattttttcagttctgttttggtgtgttcttattatttttgctgttcctgatgcaatccgctcgtcttccttacgtcttggtcaagtagcaccgcgcctcgttctcttctcgaattttaaggcgtttcggagtccgaaatttgctaagattttacctggcagtgatcttttttcccctcgtgttcttggcttccgtacccgtgttgtactgttgcttgatgtttttgaagttggggtgtgcgtgggtttcttggatgagtttgatgagcaccgaagcttcatggtgatctcgttcgcctctcctcagaacacgttggtcttgatcttgccttccgtttctctatttgtaccagtgcaagcgcgagaaattagaccacatcaattcgtttatcttctctgcttgtcttttcagtttgctctgttttggtatgttgccgaagtgccagtttctgaatttgtattagctagatgccttcttctgttcatttcgctgttcctgatgcaatatgcaggatgcttcttctctacacgtctcttctgttttctgcctcgaaagaactctctgtcctattgtggctttgtttactcgatgctattttttcgttcaatgatttctgcatgtgtcgctccattgaattgcttgtaaatcttctgattctttacctatcaaagaaacttccatctcttgaatcttgatttggcttccttcccccttaccgagcaattgtacttttttttcttgtcttttacctattttttacttctctgtgatagtgttcggtgctgtactgtaggttacatgtctctggttttcttcttcttccgtccatcatactctgtttggaatttctttaagttttgactcgctgaagagatgaccatatctagaggaaattgatcatccttgtacagtacactttatctgttgtttcctcttcttttctcactttggaatttggttttatgatttgtgtctgtaaagcttatatggcgttcatagaaaaccttgtgtgtattttgttcacagtaatatttcaattccttgcttaattcttgtacaagataagatgtaggtgtaaaatactgcaacgctgcaactgaaatcactattaacaccctgtgctttgcgctagataactagtgtcgtatcaagtctgatgattctacctgactttatttcatatgtaaccaagctttctggcatttaatcgatctgtattgttgtttaagtgtattcactttattctttccccgtttttgtcaataatgttattgtatatttgtattcatgttaaattttcagcaaagcaagctccactatgggtaacagccttcctgtagaatcgaaggtcactgttgaagaagaaaatgatagaattaagtatatcgtgtcatctatgcagggattgggtcataaaatggaagatgctgtgagtaaacttgcagccttttgtattacaaaaattaggatagttctgccaaaaaattcttattgatctgtaagtaatttgtgtaaaatgccgagactgatatacgctctccttattctctagcatgcagctattctaagtcttgatgataccacgtccacgtcattttttggtgtttatgatggccatggaggtttgcttcattgtcatcttttttgtttcaaaccctccaaattgttggcgtaactgcttacgtcatgctatgtttgtctgtgtgtatcacatttttatctttgtgcatgttttgaaaacttagctgtatatgttgaaacttttacctgtcaattttcaaataaatatgatgctatagttaaggataacgaaccaagttcagtaatcacattcgtgcggcatgcttgcaagggtaacctgaactacataaaaggaaattttaattcatgagggataaaacaccgcatgaatgtgagttaatacaaatagtcatgataattaagaggataatcacagattaacaggttggctaactctattttcttatgaaacctgttaaagtgatgttctgctactagtgttcataacattgttttaatttataagcttctatgcacatagaagtaatcatgatccatcctatcgagccaccatactgagttgtttattttctatcacaggagctgaagtagcatcgtactgcgcaaaacgatttcacattgagctttgcaatcatgaagactatcacaatgatctcaccaacgcactggacaatgtgttttttaggttattttagcctactttatcattttgtttatagctgcacttggaaatgtgggatatcattgttcttgtgtaaatgctgcagcatggatgagaacctgcaacaatccgatgcttggagagagttagttattcctcgtgataatggatggatgtattttctcaaggctggtgtctgtgctaacttttggcctttcccgcaggtagtaatcttttatcccctagtgtcctcgaatatccatatcttgaagaagttactcaaaattgtatttgttggacagtgtgcatattgtatctatgaaaaaggaaatggaagaatgtgtttgatatcgagactgttgttctttcttgagatgtactttggagttggaggagatatgtttaaccctaacctcgactaattgctcctattaaaaaaggttcaattagttacatatcaattgctggtttacagagttggaggccaacaggttattaagttctcattgcaccttggttcttatcatactatgctacccaaattgaggtattttttgcaacatcccttcgatggctatttctttcgtacactggtttggttttcagaaatgtttttctttacctgttggctttcttgagctattttttggtagccttttccttctatgttgtggttctgtgttttacacttcagttttgttcttgtttttccaggcgtatactgggccagcatatgaagggagcacagcatgtgtggttgtcatcagaggtgaccaaatgattgttggacatgctggtgattctcgttgcgtactctcaagacaaggtggtctggtatagtgattgtttccctattgaatttctggtcgttacctaatttgcatgctcgtttcttgtggtgcctaacatttgtgcttgtttctgttctgtcaaaaggctattgatttatcctccgatcataaaccaagaacaagcgagtctgaaagagagagagttcaaaatgcaggaggaatatctcttggagttgattgtgaaaaagtaatggagaattatgtaatcaaggaacaatggatcctcggttactttggggaaagtgtaacaatctcaagatcaattggtatagttttgcctgagcctatttttcattgattgcatgtaataaaaaaaaccacataacactgtgattggcgttttacctacttacatttcaggtgactttgctttcaagcagaacaaagatttaaatcgtgaagaacaaatgttgatatgtgatcctgacatccacactgtaagtgtaaatatgttcgtttggtagaatataaagtttgttttgccggggtgggatctgatggaaaatggccctttctacgtcagcatgacataactggtgacatggaatttcttgttatagcaagtcaaggcctctggtaagtggtaactcttcagcaaaaaagaactgtcagtaactatttgatcattttgatgtcaccagtactcattggcatgattctttttctcctttttgatgcatatatagtttcattcataatttcatactaaccgcattacgtactgtatattttttccctgcaggtcttgcatggaaagtgcggatgtggttgcttacatacatgtccgtttattggtgagtctttttttttttcctcagtttgtcttcttggcaggacaatatatcttattggtattaattatgctatctgttctaggaagtgacttcaaccaagaaatataaataacctggtttctcttttttatagaataacagtgcttatcccctaaacccccgaaaaccagtactttgtttcgcgctgaatatacatgcctgactgacaaactgccatctgctttgagtttggattctttccctgttaaaactgctgttaccaatattgctgtgaccaattaatattgctatgcaggagggtgtagagctgcgtgtcatctgtgaggagcttgttcagtccggcttggcatcgggcgagaacacgaccgtcatcctggttcagttcaagcccggcgccttccagttccagtatgagctagtcgatcccgctgcctttgacactgccgcctctaacgttgccagcaccagtgccggcccggctggtggcagcgacagcgacacgagcgccacgagcgacgagggcgtcgacgacactgccactgccgggaccaccaccacgggctatgaggccggctccagcaccggccccggcagcggcggcggcagcgccaatgccgcgttcgacagcggcggcgacctcgccgctaacttggacatcgccactaacttcggcagcgacgacctcgccgctaacttggacatcgccacggacatcgacaccgaggacgtcttcaccttcatcaacagcgacgacacgttcggcatcaacagcgacgaggtggagctcgatcccaacttcaggcccaagcctcaggtccgcagggcccacgacggcccctctcccactcccagcgaaatcgaggccgacctcaatgccagccccacgaggtacaatatgagggatatcttcgaggccttcgacaaagtcgaggccgagttgggcggcttcccgttacagggccacgatgtctccagcaccagcaccaaccccaacaccgcgactgacactggcagtggcagccgcaccggcgacgatgacgtcgacggcgccattgccagagccatggccgtggctagcagcgtcatgacgggcgcgggctacgaggtcgactccaccaccaccaatcccagcgctgcggctgacactggcagctacaccggcgacgagatcaaggtcgacgacagcaccagcggcagtgccaggggtgacagcggcgagctcgtcaacaacgacaccaccgttgctgacaacaatgccagtggcgttgctgacagcaccaccgtcggcgacgaggtcgatcccactgccactgtcgcggccgacgacagcaacaccggcgacaaggtcgatccccctgccatcaccaaagccacggccgacagcaacaccagcggcgaggtcgacgtcgacgccactgccactgccactgccagcgccagcgccgccgtggctgatgacgagggcacggctcctgatgacagcgagggcagcccgtagatgcatgattcagaagaaagaggtcaccggttcattacagcttccactcaattttgtccaagacggagatgatgtgtgatgatgcatgcaccactgcattcgagggatgttactgatcataggtagtagtagtagaactaatgcattgataggatcggagtagttggtttctgctaccttgtttttggtttatgactcctggttggctgggtacgtttggggtaggagattttgcttgctagacttggttactgagaacacttgtctggtttttgagtttttatcaaagtacttaatctagtgatgcttttgttgatcttcattttgaatctattacacatgctgagagctgagtatgtactacttgctctgttcccgaattaatgttctcttggatacgtaatcagtaatgcgcttggtttggctgattacctctcttctcttgtctgaactgaagagaattgcgtgctgaaaccggctctgaaaatctgaagccggcctatggcatactccagcaccgcaacagcaacggactcgtcactatcaatataaggaaatcgggacatttctactagttctgcacatgggttcttcatgctgcagaagctgatcctgatacaaaatgtacgtcagtaagtgttctggtcattatggatcactagtttgcatttcgttcgtcaacatagagagcaagtatggtattggctgagcgcataatattaatagcgtcattgttcaacgccaaacaaagaaatacagttgtgcagggtaaatgttataccaaaattcatttgcgtcgattttgattttagcccgaaagaagagtaacttcattatgagctaacaactgcaatttgggtcaattagtactaaaatcaacccaaatactataatctactctctccgatccccaaaactctcttgcttcgtgctgcccaaactcgcaggaccaaatatttatgtccgaggtgatctcccttgtggcagacgaactgtatgacttgggaacaaatgctatttcgctgtcacgtataacaaggtcgacatggatggtctcgggccagtcgtacagcctcgggaggaacaccttgttgtgcatcaacctaagcttagtcttcctcaacatcgtcgtgtatgtcccggtgaacaacgcatgtccttccaatgaccgcatcttctcccactccatcgtctcttcattgagcttgacgacatggacaggcgcaccactgtagccaacgaggacagccatgagcgcgccagcttggtcggactcaaacaggtggctatcgacttggtgttcgattccaaagctcccaggcttatcaagaaccttaaaactatcgccatggttgcacggatcgtacaccgcgagctccccgtcttcgccaagaacgtacagcaagccaccgtggagcaccgggttgctggtcggtgccgccagaatttgcggtccgaagcccgtcaattcccagggcccccattggccatcgtcttgttggatcgcacgggcgagccgtagcgcggacgtcgtgttgacgcaatacatccttcgcgcgcggtcgtcgtagacgatgaaatcgggcgacgagtcgaaaggcggtgtcggcttcggcagctcatggatggtgctgccggcgagtagtacgagatcggcttggaggatcgatttaggtgagcacagcgtgaggcgtcgtccggtggagcagcagatcctagcgttaggcaccttgacgagcgtgtcggcgatctggaaacacttgtggtagtaggggctgtagtacctggcgctcgtgacgccgacgtcggcggcgctcaggaggagaggcgtgatccacgccgggtagaagggcgacacggcggagcgccagtgccggcacgtcgacgcgaagctggggtgggtcgaccacccgagccgatattccaggacgagcacgagcatgtccaacgggagagacgaccagtcccgtcgtccttgcgccgccgtcgcggcggccgcctccatctgtcgatctctgcttgcgcttctttttgcggtgctcctcacgcgagtcgcgagagttcgtgcctgcatggcgagctgcgttttgtgctgctacggagctctactttcatggcgtgtttcctccggactcgtattataggtcggcttcagctcggagattgtataccgccccagcgccccggttggtttttgttggtttgctacccactctccatatatgcaaagtatttagattttgcttttgaattgggttgatagtttgaattttgatatcgtgtaggaactcatgtttccttttcctgatctacgggcggtgcagatgataattggtaggagtactaattgtaggtagtggacgtgcatacctctttcctatgccaatagttatttataaggactagcaaatatacccgttcgttgcaccgggtgaatatcaaacaaatatggatggttaagattgcttgtgtacttataatacatgtgcacaaaaatattgaatttgtacataccttgcaaatatctccaagttttatacaggaaaatatcaaaacatatctcatactgtatacatattcagattcaggtcgtatctcaaactatattccaaattttctacacattcagacaatattccaactttcacaaattttcataaacgggggcagttacagctctgaattcaccatgctctacaaaagaaaaatggtaaaggcatctgcaatgggaaagaaacacacactttgtagtatcgaaataaaattcactcaaaaatctttagtggaatatgtttgaattctagaaataatttaatatttaaggaaataatggggcgttttggtttgataccaaaatattgccatatcaattttttggtagtttaaatagtaaatatgatgatttggtttgaagccaaatgtttggtaatgcctatactcaatttggcacaattctagaatattcttcatcacaatttaaaatttggctctcaattggcataaatccaaagacactcatttataattctaccctaccaaaatattggtagtgtcaaaacttgcctagagtttggcactaccaacataggataataaaccaaacaagcccaataattattttgacatgaaaccatattaacttggtcaaatacaatatcatatgattaatactttctagataaattttttgttggtttcatttatctaaaaataatctatgagtgattaaataattaatcgtaatttcccaacaattttaaatggcttaaaatagtaccaaacaaatttctgtaaatataaaaataattaaatcagttgcttagaaaaataaactgattttggcctagcattgtggtttagggatgaagatttggggacaacttgagggaccaaatctgaacttatccgtgcgaagcatacacgtggcccaattgtgtggcggcctgggaacggcaacccgacgcgggagaagccacactcgtctgatctgatcaacggtcccgattgatccgaacatatataaaaagtcggcagcccaaaccctaaccctaaaatcacttcccctcccttctctctctctcaaacctacggcgtcagcggcgcctctccccttccgccgcttcccctctccctccccaccggcggcgccgctccccttccccctccctccatcagcaacgccgctccccttcccctcccccatcggcagcaccgttccatctccccctctccctcccgtctcgctagcatggcacagtgttgggggacgacggcgacgacgaccatccttccatttcccctctccccgtaggcctcgatggtggggctacaagcctatgacacggagacggcggcgacgacagtccttctctctttctctcctctgtctccgagcaagaagagagcgccggaaggtaggtcgccggggtagagggagggggtgtgtaagttcaagtgccttaatttggtttcggtgattaatgacaaatctaattatatgagactaacgtttttatgagtctttctttgactagtctcatttggatatgaaagtaaaaatgatgagaggtatgtattaaacttcacatattctaacttggtctctcttgtggatccaaaatatagtgtgagcttcctatttgatctttattgattatgtgcatatgcgttccttcatatgcatatgtatgcacatcttgagggggagcttattctattttttttattataagatttctatcttgatttgaaattattttttatctcatctctctatattgtttatatcgggttattatccatcaccaaagagagaaaagattgaaagatcttggattaaacaatttgtgtaattgttactttggtgatagatgataaaccgatgtttatgggattaacttctcttttgtataagttgtctactaggttatttcccgataatgagatgtggaagacatgcatttttttgtgatggaccttaatcatgacaagaatgaaatgcatggagataaaacgatatataccacttcttatctcctacgttttgatatgttcatatatatgatttccatgttattgatatataagtgtgagactaatgtttactcgaatgttatcttatttagtctcatttacattgagaacatggagatcatgaaggtatatgttttatgttagtctacatcattactacatatgtcttctctatatgtataggataaacccccattggtcattctctaattatgcatacacttgcatctcttgtatatttatttgtatgcatatatttagggggagcaaatcctatacatttattgtgcatgttctagatccatgttgttcacctattatttatatcggatctttgcacttgagcttgcatacgagtatatgacacttgtgatgttaatgaatactcaacaaacatatccatatatttcatatgcacccggttggtcatcaagtgaaggatgacaaccgatttgttgagactaatgttctcctttgaggtgtgaaaaggaataggtcccactacgatgaggctaatgaatgacaccatgggttagtggtcaccaagccaaggacatcatcatgttggcaagaatgaagtcaagcttgtgatgagaataaagtcctgacaaaagatggacaagacctcggcataaacatggttcaaccggatggttacaagtgttgatctcggctcaagcttgaccccaagatggatggcgcaaggcaaaggtataatgtagctaagaatgttttcttagtcttttcccggtcttggtgtttggtgtagaccggatttgctagataggcgccgtactatcaagaggggtctatgaagcgagcttgtggatgatcttgtgccatattagttcctatgcatgtaggtgcattttgtgggcttgtctaaccaagtgtgatgagttttctcaagtcctaaaccaagagagaagtgggcatgtcaaataggagtgagtgacatcttgtgggtatgtccggtggatatcctttggagtgtgagccctttatccttgacttaagttgtgtttcttggatggatttttcatgggttggatggccctttgaataagctttccatatattccaagaacgccaaattccgagacccgagtcaagagatatcgccgttttactaacggtcggttgagctgaaaagtgacctgcggtctgaccgtgggccttaggccggtctgaccgggtctgttagccagtctgactggcgtggtaaggccggtctgaccggccccattggtctgttgcactagtctggtttttggtggcgatacagagccgccagagccgcaaccggtcagaccgagccgacagcagtctgaccgagccgtggacggtctaaccggccactacactgcggtcagaccggccaggttgagtgggctcaatgattgccctgtaacggctagttttctagccgttacaaagtagtccggtctgaccggcatcacaacggcggtctgaccggcagaacacaaagttggggattttggttccaacggctagttttgatggttgggggtatatatacccactccccagcagcaagggtaaggttttggcactccattgcattatcttgaacccttgcaagagctctcacacccttgtgcacttagtttatctagtgaggtgttagagagtgagttaagtcaatccaagtgcattgcttcattgttagagctagtgtggcacctgatcatcctcggcaagcatcctagacttgttactcttggaggttgccgcctcctagacggcttgtggaggtgttgcccggtgacctctccgaggagattgtggaggaggcccggcgccggttgtgagtggtttggagttcaccaccttcggagcgaaggaagaactacccctagtgatcgaggcttgggtagtcctctccgtgggccggctctcaccttgcccaccccttgacgaagggggcgtgcggtggcttcgtggttgagcggtggagttgggctcgcctcaacggggattaggaaaccggcgagtttccgaacctcggtgaaaaattccttgtctcttgtctcatttattttctgcatttacatttgtgcaatttgcattcatagagacatatttgagcccatatcacctaggtttgcaaaatttaacttagttgcttagttaaccttgcacctcaccttgcctagcaacttaggttagttttgtttaagtgccattaagttttaagaccgcctattcaccccccctctagtcggcctccttgatcctacagggtgccgtgcgcggttggggatgtggtgagtgtggccgtgcccggcgggcgaggccatgacaggagcgcggtcaatggcaatggtgactgtcacaccctgaagttctttcccaagcctaaattgaagttataaatggtctcaagaaaataccagtgtaaagcaagagtaaaccttaataaattaatgcaaataataatcagatttggcatgtgggatttttcttgagttctaaatgtcgaaatacgctaacaagatttttagtggaattttcagagctctagaaataattttaaccaattaaaattgagcacaagcaatatttaatcccaggaaaatccatttccttccttttctttttcttttcccctttttttctttcgaatgggccgccggcccgttctctctccctcctcttcttgttgggccggtcgaaggccgaggcccagccgagctgagccagccgcccgcctccctctcccggggttgccgacaggtggggcccacctgtcgggcccgtccccttcctccggccggagccgccgcgccccgctcccacgtctcccgggccacgtcgcccacgtcgccctcgcgcccgcgttccccgcgcccacttcccctctctcccgcctgcgcccgcgctcgagacagccgggattcgattttcgaatcccgcctctctctcctctcccacttcccccacgtcggccggcgattccctcttctaccggccacgtccgagctccctctcccctatttaagcatccccactctctcctctctctttttcccatttcgccaagctctcccgtgccctctatcgccctagcgtcgtcaccctcctctccgccgctgccgctgctccggtcgccgctagccacctctagccgccgtgccgagccgtgtcgtcgacgccgtcgcgttcgccgtcgtgccggccaccccgtccacccctctcccgtcggattccgccgccggaacccgctccacgccgtgcgccggtgagcatcgccatggccgccgcccttggccgccgtcctcgccctcttccatctccctctccctctctaactcctttcatcgtgttcgctaggtggttccggagatcgtcccgccgtcgccatcgccctccgtcgctcgccgtcgtcgcttgtcgtcgatgaggcacctcctcctctttctctctctctctctctctctctctcccgcaccatctagtcgccgcgccgccgcctagccgcttagccgctgccagcgtcgccgcgccgtcgcgccgccgccgcttgccgtctgccgcgccgccgccccgcggtagcgccgccgtgcgccatggccgccgggccggctcgagccgcccgtgcgcgccggccgcgtgctccccaccgccgtccgatctaccctcgggtagttcggggccgtcggttcagccgcccgcgtggcgtgccatgtggccgccgcgtgtgcgccacgtcagcgccacgtggtgcgccgctccttccccggtccgtggacttggtccaccatgaaccgccctccccgagtcactgccatgtggggcccgcatgtcggcgccgcccctctctctctcccgtgatttatttattgcgcaataattcaattaaggatttttctgtttatagtaaaaacacagtgaatcttctaaaatttatatctaattcatccaagctccgtttaagcccattgaagtctcagtaaatcaataaaaatgtgtagaatccattaaaaatggttttgttctctgtttcagtagtcttatagcctgtttgtattgtttgctttgtatgtcgcttagattccggctctccccacgctccggtgtactttgaaatagtcgccgaggttcctccagcagtagagcaaggcaagtcatgcttgtcacttgaacatgttgatcctatattgcaaatgctccattgttttccttcaaatactgcattgttttataatattaccatgggaagtttacctactgttatagccatgctattttgtaccatgttcctttgttagcttgggatataacatgactagagattggactagggatttcttagccttgcttagttcaactagcacacaatgggggacaacattaatgcatagatatcagattctaggaatgatgttggttaatgctcaccgctccagtgttggttaattaaaatatattaaatggtgggctgtgggtgcatggttttgatggtcgcgcccatggcaattaaggaccggttcgcgggaaatcctggaagaattcctcgtacttaccacaagccagcgtgggcaacggctgagcttgtagtgtagcttttctctagccgacacatccaggcaagggtgggcgtgatggagtttggatgggccttacgacggcctatgcggcttccggattcacctaggcacgagaggggactgcccgctgccttgcgagaagtgggagtgaaacctgaggtgtggtgtgcttggttagaggtggttatgcgaagggtcctgtcatggcctctttccggtatgtcgtggtggcatgtcggcgcacggaaacgtgtcgtggggctgtgtcttgtgggtacagttgtacacctctgatcagagtaaaactattcaaatagccgtgcccgcggttatgggcggtcaaccagattcaccgtgattagtctcaccctagggtagtctgatggaactgattagttcaggtggatggttgggcctgttgcaacgtggtgtagcgttggacagtggatggttaatattgattaattactataatggttttacttcttccaactactgtttataaatgctcgctttatgcaaatgaaccactctagctatcctttgattaccctgcatcatacccctatcccggtatgacttgctgagtacagtgggtagtacttagtcttgctctatttttcccaaaccccagagtttgagtatgcgtcagatggtggcttttccgaggagtaggtttcgtccgtgccatcgaggatgcctgtggagtggtgttcccgctgcagtccaagtcaaggctaagctccagatatcttttaagttttccgctgcatttatgtaagacttttataatatttgtaagacgtggatctgtatgtcaactttgtcgtttgtgtaccccggccggtcctggacggggattttaatgcacattctgcttggaattctattcgggaatttctaggcgtgacagtgacgagctcagaacaaccggatccgatggcaaactcgctcatttgtgtgatttttttcctctctttttttccttttttctagggttctcaatctgtgtaactatccgattggatgattcttttagattctccgtgtagttctgtttgataggatgacttttttcaggttctctcagtccgtgtagatctttgatttgattttgtgctttatccatcgtacatgattggtatatagagtgattaataagaacaaaaaaaattctaccttttttatcacggacggtgggtcttcttttctccgtgtcattgatgaatcggacttttcttttttttttctttttatatgatgagggcatcatcaccatggataaaccataatgatgttttacctaatcgaacataaggtgcaagcttcttatgaatcggagaggtgtatcgatcgctaagggcgcaacgcaatgccttgtacggttgtagtcggatcatcaacgtttcttccaaatcgtagttatctcaactcaccgaaagatcggtccaaacaacagctttgagcatcttgagtggagctcagggtttatcattatatatttgttcgcctttttttttatcacgatgacgaaaacaccttcaattttttaagtatttttttaagtagtagagatagagataatagaaagattaaacaagattcgatagacgcatgtgatgatatctctaatctaaaaaatataccaacttagtcttggagattctcatagagatatgttgtgcgtgtgtgctttcatatggatcaatgtgcacgtgtttatatgaatgcatgtatctatactgtgtttcgaaaaaaaatacaacctgttctcaacgctatattgacgtgaaagtaaagtgaaagtcttttttactttcacgtagaataattgattttgtatttttcttatttacttaaagttgtctttataaattttagcaaatgagatattttcaatagactttcatgtctaaccggaggaccgtagcgtttaaaaaggaaagaaaataaataaagaaaatgggaaccgttttctcgctccccttcccaggcgctatctcctcccaccactcgaaccttatcccctccaggcgcctcactcgaaccttaatttcgtgttctagttagaaatttggaatttagaaacacagctggattggggttctcctatggatcatgcttcagattttatttaggtggattagagtcttattcctttcgattttggaacgacctgggctacggactacacacgttaggatttttatcgatctctttttctttctttggccgctgtaaaatagcgaagatagagggccactcagtcggaatcgacggacgaatcggtcggaattgacgcacgaaaattttgtgacgaaaggaaaattttgccaaaggaaaattacgattctttatattagttaagatttatgaatttgatcggccagtcgtccgtcgaaatcatggaggaggcagtcgacgcatctgccgctctggatcccaagcttgctcctctgctgctgttcggcggccacggcgacgccacgttcctgtacagcgtgccgaagagagcgctgctggcgccaatgccaacgccaacgagggtgggcgacggcggcgtcgacgacatgatgagaggccaccgctggtggaccacggcgcagggctggttgctcatggcgcgccgcggctcgccgtgcactttcctatgggaccctttcaccggccgccgtgtcaggctgccccccgaccacgacggcaccgtcctcaccgccgaaggcagccatcgccggaggtgcctcctgtcatgctgtggtcccatggacccgaccagctgcaccgatctcgtcatcgacctcgccgacccggagctctggtattgccgtcccggcgacaaccactgggtgaagctccatcagcaaccgtaccagtaccgcaaccctgcccaccgtgacgccatcatcagttttttacgcaagtttacggcgatcgacggcaagttctacaccgaactacacaccggcaatgtcggcgtcctcgagttctcgccggaggttgccgaggggaactaattcccctcggcccaccggcacccgttgtcaagcgttatcaaatccatgcaggctcttaagtcgtgtagttatacaaagtcacaaacctgtattatcgacgaaaatctcgttccttgtagattgagatgcatggcctctctgtttactttaaacatcattcaagcggacaacaggtggatgttaatttgcctaaaaccgacatttttcatcttcactaatagctgatccattttgctgtgctacttatttactgttctctgcaatgactgtttggagatgctgctccacaaaattcagtggtgaatagatgtgtcttgtgtatttatcatacatctgttcactttaagccaatattcgagccttttgccctgttacatcaaattgcattattcacttaaataaataggtatgaataaggttactcaaaaaaatgctttcgcagcaacaaatctgacaaaactgcaaaagttcacccttaagaagagggatatatatatatagcattggttctgcacttctgcatgctaaagtactccacatgatacagcaggctggctttccatccataaggttacaaatgggcaggattgccgtttctgtttgagataaaccaaaggagttgcaagttagaataaagcatttatagtcacatcatgcatacagtttcagtactacctccgtcccaaaataagtgcagtcgtggaaattcgtgtctaacgtttgaccgtccgtcttatttgaaaactttatgatttttttaaaaaaaattagtcagacataaagtactatttatgttctatcatttaatagcaataaaaatagtaatcataaaaaaatttcaaataaaacgaatggtcaaacgttggagatgaatagtgcaaaactgcacttattttgggacggagggagtacaagatacaacacacagcgaactggcaatagattgcttttttgtaaatcttagcactccaatgcagcttgagcttgattagttccaggtgttgacagacggtcctgtgactggttgctcatctagggcacggcgcaactcctcaaagaagttcatctgtactaccaatgaccacagaaaaggaatcagagtacagaaactaagacgtaggagaacagtatgacaaaatcgcaggttcaatatacctgatgaggaagtttcatgtgaccatgaccccatgatgatccactagatccagagtacatcaccggcttatctggcaaaacatcaacagcatttaataggttactttggtttagtgcttcccgttggtacaactgacatgaaaattcacttgagtgcacagggtacttgatggtgttcatagtaacatattaacatcacgaattgctatacaatactataattgctagcaccataattgtgcggcgtcactactgttgccaacactttatattcacctccatatttctatcataacttatgaaacggtaatctaaattaaacataggtctaggatagtatgccaggtcttgtagaaattgatcctaaaatatctaaagattcctctaccatgattcatgacatagtaaatctcccatcatgcggcctgaatttgcttaaggactcaccaggggaatcatatgactgatcattgtacaagttcattgctgcagcccaacctacaggggaaaagcagcaaaggtttattatcacataagaagaatggttgtaaataaagttggttcaaaattagtacagcaactgtaggaatacatctttgttatatatgcctagaccatccttgattaaaagttgcctaacttccggtaaattaccggtggcatatgcacaattgcacataaagagaacagttgatggtatgattaatgaacaaaaaagataggataagcagtaggtacacagtttgaatattcttccatgttactaacatgcagagaaccccaaaataaatcacaacaggtgctccacgtatttttctttacaacttacagtatctgaatattggattatcagcctgtgtaaacttattaaagcaatgggcggttctgtaatatactgcatgtgcttttactacttactccctccgtcccaaaatataagcatttttagaccacgacatagtattcgagatgctactttgaccaacaatatctataaaaataaaatggtttaaataaaaagagttgcatataataatagtttgattaatgataaatttagtaacatcaatttcacattattgattttttttatttttttgctattaatagttaaagttaaaaatggttgacttagcactatgctaaaaatgcttatattttgggacaaaatgagtaatatcttattactgtagacataatgtatcactaccacaataacatgcaacaattcccagaaagtcaaaaagataagaacttatatcatagaacttctacaagcatttaaaagggcagcttggtctctgagaaacatacggtcattgagaagctgggcagcctcactggcacaacatccctccaagggtattaatcttgtttgactgtaatcattctgaggattgctgaaaaaagtctcatgagggataattggtggaaggttctttaatgaaggagcatggctcttctctccatcattattgtacaaataactagccttctcagccctatctgtttggtataacaaaagtgttacagtgtcagccaaaaaaaatcacctcataaattaaattgttatgcttaaacatacagataaatcattaaaaaaacacatggataaggaaaagatagcccataaaaaaattattggaaatatgaataatcaaataaagacatgtcaaggttagaagattctggacagctattggacataataagtaaactctgagtaaaaaacacatttgacttgtaaatgactgattgtggggattatgattgcaggtagcttgcattagatgcatgaagttgcatgttgtacagagtattggcatcattaatacaatggagtagaggggctcatacaaggatgtttgcttgcaaggatttccttatagatatagagtagttatcaacatggtcggtgtaaggcacatatttttcagcccatttgtggaaaagaaacatggcagtttcactgcatagaaatctactagaggaataatgaattaagtttgataccataacaaccaacaactggataagaccttatcaactaatttggagaccttatatagcagtcaagccaaaataataataaaggaaaatataataaatccccaaaacatcatgaaatccaactgattcaataataattgcgtcgattgttagcacggttcctgaagcatattcagtaaagatagccatcagaaagcatatctatgcatgatatgtagcaagattattaaaactaaataataactaacattagactgcagacaacagaatatttcaagaaataactgatggtttcaaacaaaataaatatttagctcataaatacaaagatggaacaaagaagccatatcaagttatcaactaatcaaatcaacaaggtgatagactgattgaacaatatgtcttaagcaaatctacttcttcattgtgaactccacttataattgtgaaattgtgattacgcgatcacctatcaaagggcaattttcaatatctggcagtacagtaactaaagtatgatagtctttatgcagtcattatatgccctgtgttgaagtcatgcgttaaacttatacaagctgaccgactggcagagttttgctaggcaaggttagcttaatccgctaacccaaattcgaaacatgggcaatccttcacttgctaaaacaggtagttaggtcagcattaaacatgccctgaaataagccattagccatgtagcttgaacaaagatttttctaaaataaataaaagttagttgctaaggttgttcattctcaaaaagctaaaaagagagaccagcgagccaataagccttataggtcggcttccgcttggagattgtataccgccccggcgccccggttggtttttgttggtttgctatccaatctccatatatgcaaagtatttagattttgctttagaattgggtagtggtttgaattttgatatcgtgtaggaattcatgtttccttttcctgatcaacgggtggtgcagatgattggtaggagtactaattgtaggtcgtagatgtgcatacctctttcctatgccaatagttatttataaggatttatgaatttgatcggccagtcgtccgtcgaaatcatggaggaggcaggcgatgcatctgcagcactggatcccaagtttgctcctctgctgctgttcggcggccacggcgacgccacgttcctgtacagcgtgccgacgagggcgctgctgccaatgccaacgccaacgagggtgggcgacggcggcgtcgacgacatgatgagatgccaccgctggtggaccacggcgcagggctggttgctcatggcgcgccgcggctcgccgtgcacttttttatgggaccctttcaccggccgccgtgtcgggctgcctcccgaccacgacggcaccgtcctcgccgccgaaggcagccatcgccggaggtgcctcctgtcatgctgcggtcccatggacccgaccagctgcaccgtgctcgtcatcgacctcgcctacccggagctctggtattgccgccccggcgacaaccactgggtgaagctccatcagcaaccgtaccagtaccgcaaccctgcccaccgtgacgccatcatcaggtttttacgcaagtttacggcgatcgacggcaagttctacactgaactacacaccggcaatgtcggcgtcctcgagttcttgccggaggtggcgttcaccaagatcgctgtacacgacgacgataggagaccggcggtgtacaagaaacgtactacttgcttcgtggaatcaaacggggagctgcactccgttgtcttctctcacccgatcggatgtgaccggattgtcgcgcgtgtaggcgtttacaggttgagcattaatgcggcggcaacgcaggagcaaagatcagcagcatgggtgaaggtggattcgctaggtggcagagcgttcttcgttaagataggcagttttggagcgtcacttgatgcggagggaacaggcttgagagggaactgcgtctactactcggtgttcaatgggaaagtgttgtgtgtatacgacatggaacgaggaactacggctgtaatcgatcccggcacacatcttccgtatcaccagtcaccccaagtattgatgccaacatttcctagatatcatggcggagcaactcgaagtgttgaaagcatctatcaggttgggccaacaattcaggaaaatgcttatgaggtaaaagacactaaggtaagtaaggtgaagagggatgttcgatttttcgagggtggttgtacttgtttgccgattcctattcaaaataagttaataaatcagaagaagagtaagaggtctatggctgaaagatttccttgtcaaggggaaggtgcaagcagtcccgaaacgaagaactcataccgcggttgtggctttcctttggagccgctcaaatgtcttctgcgtatgaagaaataggagtgcactacatagaggatccaacttaccttttatgccaactcgatgagtgtttttttagttaactcattcattcaaaatatgcactaatgttagctcggctatgtcacgtctattaatttcattaagttttggtctctactatgtgattgggagctctttttctctgaaattttatgaaaccatcttcttttttcttttaggtgtttaacagctccccaatctgctttcttcctgagaaagcctcgttgtgtagtgcccgttccgtcgtagcgcctagctaacatcgtcagatcccaatcccccaatccatcgtcaagttcgaattccaacttcaagtcccctccaaatcaaatctctcgacagaagtctatttcgcctccctaaagttttgtgggccgagctccctccctcggcacatcttctccctcagcccatcccctcctctcgcacatgccgtgcgagtgcgctgagccgagccgagagagagccctctctctcattttcttgctctctctttgttctctctctccccgatttcccgccaacgacacccaagttgccgcgccgcctgttgccgcgcgtgcactgtggtggccgaccggccggtcgccgccgccgtcagccctgcctgttagagtatatggtagttagagtcatattaggatagaattggtttgtttggattccttccatatctgtaatccttccttatcttctccccatgtactcctgtatatattggctccctgagactcaatacaatatgtccaatattcacagtatcctctctccctatattatctaacatggtatcagagcagacgatctagtcgcctctctctcacgcttccgctcgtcgccctcgggagggtttcaatctcctggggcggccaccgtttttttttccttcgcgtcgtcaagtcgatgtcccgagagagatcgatctctcggacgcttgcgtcgtcatcaagcggcagtagcagagtctccggtcatcatcagtctgcacttcgtcctccacctccggtccgccgcctccaccgcccctacctccgatggccaccgtcggcttatcgacctccgccgggctccgcggccgacggacgaccttgtctccgcctcgaccgctgtcttcatcaagctccgccggggggatggaccgacgtcttcaccgcctctccgcctgccttctgcctcgtcgccggcaagacgctgctggtccggcgtctctggcacgggcgcgcggcccgacacctcgccgccaggatctgcaccattgtcgccgcttgcggcctcgacgcctccggactcagctccctcgtcgttgccgccggtcagcccctacgcgtccgcgtctatcttgcctctcgctccctgtattgtttggttgtccgtcactttgctgtgatcttacacgtgattagcaagggagaggagagagagagaagatggttgcagagagcttgttggctggctggctggctgtggagggaaccgattgtgcatgtgtcgctgctgctggtacagttgaggcagagaggttgctggacgtggacttggtctacggaccatttgagcacgtagggctggttgttactgtgctgcttgctgctgcatgtatctttttttttcccgatcagagatcgggtttgcgtcgtccaccgcctcgtcgatatctacgcgtctctgacatcggcatcgacttcgtcgtcctgccccgcgcatcttcggcttgatcacccgttcaagcgtccgactacaacgacttctgtaaccgatcgtcatcgagcatgcgtctacgccatcaagctctgggttgccgctgtgtcgcctccttgggccgcagtgccgctgcctatggtccacacctccattggctattgcaacgctgagaggcgcccttctcagcgtggcctcaccgccggtggacttctcgccgctgcatcgacatggagctgcagctgtgctgtcctctcggaccatagctttgccactttcgtcgtcttcatcgccgttcgcgcatcgacaacctcgtcgtccgcactggtcatagtcagccgctcggggtctccttcctctacttcaagcatcgccgccgcatctccaagctgccactgtcgccactctaggccggtggtgcagctacctctacatggctaccgatgtcgccgtccaggccgttggtcccgctatttcgccttctactttgtccagcatgactcatcgccagcgtcgccgtatcttcctcgactacacttcgctcttctccggcaactgcgtgctgctccggcaattctccctctacgccgttctcgcgctgcgactgtcccagaggccttctctgctagtctcctccgacattggcgtatgattcatggtggtctcctgtctcgcccgcgcggtattggcaacaccggcgcgcgcgtttgtcccgagttgtcccggggtctggcaagccctgtgtaacgtctcgtcctttacggttcgactacattggctcttcggcgtcatcttcctcaacgaccgccgcgattgtatcaccgtcttcgtctccagcgcgtcctcacgcaccattggtccacgatgccctcccgtccatccacgaccactctacgacgccccctgcgccttacggctcgactacctcgacatcatcgacttcccgacttcggctacatcgaccacggctactctacgcacggcttcatcaaccacggctctctcggctccttcgctttggttacatcgactatggcacaaagggctatcatctgtgttgagtactctttccggtttcttctccagtccaagtgtccgcgctgctcacgcttggactgcgggggatgttagagtatatggtagttagagtcatattaggataggattggtttgtttggattccttccatatatgtaattcttccttatcttctccccatgtactcctatatatatcggcccccctgaggctcaatacaatgtgtccaatattcgcagtatcctctctccctatactatctaacactgccgcgcctgtgccgtctgtgcccgcgctgccaccctgtagccgctccgctccacaccgcccctagccgtcatcgccggcgtcatccactccggccccgccctccgtgcgcgtgcgtccaagggatggaggtagagccctgcctcatcgctccttctccctccttcctttcccgttttggcaaggagtgccccccctttctttcttctttttcttctttttcctcccctcgccggcgtcatcctctgtcgccgatttggccgcgtgcgccgagcgccagccgagccatttgactgcccaaggtcggttctcccctcccaaaccgacatcgccatcccaatctctcttgttttcactctccaccgctgtcgcacaccattgtcgtctcgctgtcgccgtccgtcgctgagcgtgccggaggagctggcgcgttcgtggacgcgtgacgtgaactccgcgctcccgcttcatccccttcctcggccaaaacgatcacgtttcgcgccgtgtcctctcttcacggcgccctgtcccgtcgcggtatcccctccgttccccctcctcgctctccctcctccccgtagcacacccgatagctagtaggcgccaccccaagccccgccgccgctcggcatggtctcgccgccattgccgcccgtcgcttgccctcctcggctctgcttcgtccaatccgacgctaggaacgagtcccggtggtcgtgtgtctgctctagcttcaagaaatcgaaccctcgtcgtcacgtcgtgctttccctcttttgccgccgccgacgaacaccgccgcaatccgccgccgtcggaagggcgacacggcggagcgccagtgccggcacgtcgacgcgaagctcgggtggctcgaccacccgagcctatctaggacgagcacgagcatgtccaacgggagagacgaccagtccatctgcttccgcttctttttcgccggcctggctggtgttccacacgcgagagttcgtgcgtgcgtgcgtgcgtgtccgcgatggcctgcacggcgtaatataggtcggcttccgcttgtagtttttgttagtttgctatccaatctccaaatagatgcatactggagtactagtacaattaattttgatgtcgtgtaggaattcatgtttccttttcctgatctacaggccggtgcagattataattggtaggagttactgattgtaggtcttaggtgtgcatacttcttcgcttctttatctcttgtagacttgtactactattaaatcgcttctttatctcggatgatttggaacagaaatcacgagacaacacttgtaggatttctaaaacactgcacaaattcgtataccgaaagatcgatcggccagtcgtccgtcgaaatcatggaggaggcagtcaacgcatctgccgctctggatcccaagcttgctcctctgctgctgttcggccacggcgacgccacgttcctgtacagcgtgccgaagagagcgctgctgccaatgccaacgccaacgagggtgggcgacggcggcgtcgacgacatgatgagaggccaccgctggtggaccacggcgcagggctggttgctcatggcgcgccgcggctcgccgtgcacattcttatgggaccctttcaccggccgccgtgccgggctgccccccgaccacgacggcaccgtcctcgccgccgaaggcagccatcgccggaggtgcctcctgtcatgctgcggtcccatggacccgaccagctgcaccgtgctcgtcatcgacctcgcctacccggagctctggtattgccgccccggcgacaaccagtgggtgaagctccatcaacatccgtaccagtaccgcaaccctgcccaccgtgacgccatcatctggggattacgccagcttacggcgatcgacggcaagttctacaccgaagaactctctggcattgtcggcgtcctcgagttctcgccggaggtggcgttcaccaagatcgccgtacacgacgtcgataggagaccggcggtgtacaagaaacgtactactagcttcgtggaatcaaacggggagctgcactccgttgtcttctctcacccgatcggatgtgaccggattgtcgcgcgtgtaggcgtttacaggttgagcattaatccgacgacaacgcaggagcaaagatcagcagcgtgggtgaaggtggattcgctaggtggtagagcgttcttcgttgagattggcagttttggagcgtcatttgatgcagagggaacatgcttgagagggaattgtgtctactactcggggttcaatggaaaagtattgtgtgtatacgacatggaacgaggaactacggctgtaatcaatcccggcgcacatcttccgtatcaccagttgtagcgcccgttccgtcgtggcgcctagcgggaaaattatctcttaaaaaccctaattgcgaaatttgtttccttgctcgttgtgtagtgtccgtgccatctcagatctcaaatccccgatctatcatcgagttcaattccgaatccaaatccttccaaatcaaattcctccgcaaaagtctagtttgcctcccccggggtcgatgggcccaatccctctcggcccatctaccccggggggggcgcgctcgacccctgcggaggtcgctgtctcggccggctctggctccggtccagtgcggacccacgcgccgcccgccaccgcgcgaccctggccgagcgctccccctccgctctgcccgcatgcgcgtgagccgcccgcgccgagcgcccctccccctccgctctgcccgcgcgcgtgcgcgtgagccgcccgcgccgagccgagccctcctcttcgctccctcgctgccgctccccgcgctcgttcgcgcgcgcgcccgcgtggttgccgcccgtgccgcgccgtctacgccgtccgcgtcacccggtcccgctgccctgccgcctgcagccgcgccgccgctcggccccgcagccagcgcgcgtgcccgagccgcgccgctccatccgccgcgcctcccgttgcaagccgcgcgcgcgtgccgagtggccgaccgcctggtcgccgccgtcgtcagcgcctgcccacgcctgtcgcccgtgtcgccgctccactccaaaccgccccgccgtcatcgccgtcgtcatcgcctcggccccgccactccgcgcgcaagccgccaaggaacggaggcagagccctcctccctctgccgcgacgcccccgctcccctcctccttttcccaaagaagaaaggggcgagccccccctttctctccctcctttttccccttttcctcccgccggcgtcatcctccctccgccctgtcgccgattggacgcgagtgccgagcgccagctcgcgccttgaccgcccaagtcggtttccaaaccgacattgccgccctttaaggccccgggcgccctccctctcttctcctcccatcgcctccactccattgttgctgcccctctgtttcgctgtcgccgttcgtcgttgcgcgcgtcggaggaaccggcacaagcgaggacgcggaaggggactccgggcgctcgtcttcctcctcttccccggcccgaggccggagagattactctcgcgccgtcggcctctcgtcacagcgcccctcctcatctcggtagtgcctccctccgttcttcctcctcgctccatctcccccccttagttttcggtagtagctcgagtagcctccccgtagctagccggcgccgccccgaccgttgccgtcgctcgctgtgtgctggccgccgtcgccgcccgagctccgtagcacccgctcgtcgccggcctcgctcggcgtagctccgcccaatccgacgctagcaacggattcccgtggccgcgtagatgctctcaccgccgggatttggcccctcgtgacctcgtcgccgtttcccccttttctttccgccgggtgccgccgccgcaatccgccgccgacggactccctccggcgaatccgagccgttagctcgctccctctcactctccctcgtcatcccggtgtacgccccgtcgcccctcatcatcgcaaggcgtccccgagaaaccgccaccgcccgccgtccattcgcggccgacgccttcgtcttcctcccgccagcccacgtggcagccacgtaggcgccacgtcggcgccagctcgaccgaggtcgggtcgggccgaccccggtcagcccctcccgtgcgcacgttctaccgcgagccgtgaggctgcgcgtgggcccgccgcatccgttcctccgcgaaccgcgcgcgtgcaccgcgtcccagccccgcccgcgcgcgcgcgccgcgtgctcgctccgcacggtgaacggagtcaccgacaagtgggtcccacccgggaccacgcgcggtgagcccggtccaccggctctctctctctcctccctcccgcgcgagcgcgcgccttgggccggccggcccatttagctcggccagaccgccccaattctctcgggccgcgccctagccgcccgagaaaagtctatattccctccctcttttcttttcttttattttcttttcaaaaaggatttaattaaatccttttcctttagaccaaaaatccaataatcttagaaattcaatatcttcccaaccataaatccgtttgactccgttcaacttccaaaattcctcaaatctcgagatctatctaatggcacgcttagaggtcattaatagggctttattttcgccgtttgttgagttgtcccgtttcgcgtgtagtttcggagcccgaagacccgcagtgcgaggatttcgaggatcaagctccagatctcgagcaaggcaagccacctttgaacatcttgagcctatatttgaaatttaattatgttgcttgaaaaatattatgcattgataggaccgcacttaatctgtttgtcccgtctgcaaggcagattggcggacctacctagtttgttgcatttgatccttcctttgttaattgttatatcatgtccccttgtatccatctagttgtgtctcgatattcgtgcaccctgtgcgagtatcgacggacgccttcaaacttaaaatttgaataacaacttgggtaaaacttgggttttacaaaagacttggaaaacccggcacctgggtcggtgcttgcgaactaaatgaatttccaaaaccgcggaccggggaacgtaccgggagtacggtttcccgctcttgcacttaaggaccgtttccttggaatttcatccaaacataagacaagtacgaccatatgggtggaatgggacacccctagctgagtaactagcttatcaggggagccttgatgccgagagacatgtggattcgccgaggtggtgtcggggaggactctgggcttcctggcacagtatggtctgggacctaacctgttgttggtctgggacccctctcgtcggcatatggtaaacctgtgtcggctttggaaatgccttgttatgaaagcttggaggtctcccgatgtggctgattcccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattacggttgtggaaaggggttcgatgtttgaaaaatctgcagctgatgggatcagctaggcccgggtggccgtttgaaagttgttggcccgggtggccgtttgaaaaactgttggccgggtgccaaccttgattcaattctaaagactgatacattgcacatactccgagcggacgagacgcactgtctcatccgtgtcgtttgagaagcactcacttagttgtttttagaaaagagttcaaataaaatcaattgcaaaaacaacagcctttcctcgaagcctgcattaaacacttatttcccatggcttgttgagtactcccgtactcacccttgctctatataaataatcctccccccccagttgctgaagaagatgaagcggaagctgctgatgagtagttcttccaggagcaagccggctacgatgagttttagggtttcggcctagttcccaagtcgcgcctgtgttgtttggtccaagtcctggcttccgtttcccttttgtaatgcagttgtgagctcgggatctgtccgcagcccaacatgactgtacctctactctataataaagagacctctgttgctgtgatattctgtctccctgtgataccagcactgtttcctgggactggtatcgaataacaggttaatttggagcgtcacgggctagttccggtcgggactagttcggggcgtgacaccagtcgcctcaagtattgatgccaacatttcctgcaggatgttacggcagaccaactcgaagtgttgaaagcatctatcaggtagggacaataattctgaaaaatgctaatgaggtaaaagacactaaggtaaataaggtaaagagggatgttcaatttttcgagggtggttgtacctatttgccgatttttattcagaatacgagagtgacaaagcagaaagataagttaataaatcagaagaagagtaagaggtccatggctggaatacctccttgtcgaggcgaaggggcaagcagccccaaaacgaaaaactcataccgtggttgtggctttcccttggaggcgctcaaacgtctcctgggtacgaagaagtaggagtgcactacatggaggatccaacttacctttttatgccaactcgatgagtgtgtttttagttaactcattcatttagaatatgcagtaatgttagctcggctatatgacgtctattaatttcattaagttttggccactactaagtgattgggagctctttttctctgtaactttatgaaaccaaaccttctcgttgcattaagagaatgatttggtaaattttctttgataaaataagttagaaaatattaaaattaattatgaccttttgtttttccaaatatttgttaatttggcaataatttattcaaattcagtaaaagaatgtgttaaaatttcaaaaattttcgtttggagtggtgcctaccgaaattttctagctttttagaaagaaaaaatcctgcttatacccggttttagaattgagggccgcaattgaaactcgacctcctccataagagacggaagtggacttttccaactgaaaagcatttcctgcctgaaaccggagagtgagagtcagagactcgttgttctaaaaaaaagttctgaaaaaaaagtgagagaccctcaatccctccccaaccggaacacccactccgacgagaacgacatggacgccggcggcgaggaggagaagcaggagcgccaccgggttgatggtgcttcgccttccatggtcgccctccgctccgacgtcctccacgccgtacggcaccgcaccgccgtctctctccctctctctctctccatccatcggccggctccccgcctgcacgccggtagctgacgtgttttggtttttcttttcttttctttttttatgcggggttggctgccggacgacgcgctgctggccgagacgcgcgccgcggatcgacgggtcgtgttactcttattgctcagaaaattaggtttgcccgttgctgttcttatggctgtaggcaactcaagtctatgtggggataaattttgtgacaactcaagtctttgctacgattcgtttgcctaaacgaacaggtgtaattgggcttgtagaaaagcaatatgccaatatagattcctaaggatcacaattcacaacttcccaaccaatataaaaatttctgcaccctcgtcaccaaggataaaacccaatgtgaactaatgtgaaggaaagtcgagatatagaacttcattagagcgtaaatagtatcctttggttccagacatcaacacatgcccttttagctggtcgcatatatcttccgtgctgctctccgcatttgttctgtatctaatgtttcagttactagcaagtttgataagaatcattgcttcctctgaaagtaattatttttcatgtatcaagaattgctgacgctgaagagaatttgggtgaggttgaagtgcgtgaggcccatatagccaaatccttgtacttcataagggttggggagaaggtataaatctgtatatctctatactttaccctgtgacctggttgacaaagtacatgctcgaaatttagctacttcagtgacaggggacctcctgttgcaggtccttggagggaagtctcataatcaggacacttctgaattggtcacactggtatgaaagagtttcatctatcatgtcaagttaaatcagggaaatcttgtaaatcgcgtcttggaaaaactaaagatttgcagtcggagtggtccaaaaacaaatttcctttgtatgcttatgctgctgcttttatgttcctagtcatgcaagaatatgataaaagatcacatggtattgacttcctcaatcgggactttgttgtccgaggtaaattgatatacatgctcggtgtctgtatgaagtgcatggcaatgcatccggaagcatcagctgttgccccaggtcttcttgatatgatcagatctaggtatgccaagcctaaacaaacatttccctgttaaggaattttattggtaagttaccattttgacatcaaattttgttctacagagctgtttgacaacatcctgaagcatatgtcagaaggtctgtgttgtttgcagcttcttgcatattgatagcgctgcacctgttgtatgtctcatcagctcttatagaaggaaatcaggacattctacatacacatatgggttcttcatgttgcagaagctgatcctgatacagaatgcacatatcagtatgtattttggtcactattggggggggggggggggaattatagtacaataggctcagcacataatactaacagggttatttttcaaccaacaaagtacaggttttcagggtaaactttatatcaaattcatttgcgtcgcctttaattttatcctgaaggaagagtgctttcaccctgagatgattcaccatctgaaaaataaaaagctaataactcccaccttatgctttagtttcctgtgacatacttctttctatcattcctttaagtcttctacttcaaccagtgatccagctcttttcagtaatgtgtagagaaaattcggactcttttttttcaaaaaaaaaaacgtataatgagaaaccatttcagtacgctggaactcagtaacttctcacaatgtcatctaactcctccattggcatgtctgtctccttgcaggccattatgacctgtttgcaacttcgttctgagatcttcagacatcacaagcactgaatcggtggatcacagcatggccagcagctgcaggtctctgccttttaagcttgataccatcaatgtactggattagaaatataaatcgatcaatgtatttgggattcagagtgctacatttttcgtcatttatacatagaacatgaattcccaacatgaattgatttatgtgaaacgtctgttccagattactactatgtttgaaaactttgaactgattagttgagcaaaagaaaattactacatgtgaacgggtcttgcagggcgagaggaggaggaggaaggtgcatgctccatggtgaccaccagccacaggacagggcactcccggagcgttggattagccgcgagggacgatccaacggccgagatgcgtctggtgcaggtatttaagcgcaatgctgcttttccttgcgcttggctggctgcacaaccacttttctgcttctccctctctcacacattctcatctcaagagcagtagcggcgaaagatgaaggacaaatgttatatcgaattccgtctgcattgcctttgattttagtttgaaagaatggataatttcactgtgatatgattcacaatctgaaaaataaagagctaatgtcactcatcatatgctttagttttcagtaacctactccttcctctcattcctttagtctaatattatactcattcagtgatccagatcttttcagcaatttgtaaagaaaaacaggacttctttttatcgtataaagagaaaccaatcaagctggaaactcaataacattttacagtgtcatctgactcttccattggcatgtttgtcttgtagatgggtatgtgctgcctgcggctccattctgagatggcccttcagacatcacgagcactggaatcggcggatcacagcaaagccagcggaagcaggtctctctaccttctaagcttgataatatcatcataccattttgcgaacatgatgtgaatcgatgtactagattaagttgtaaataaacatatacttatcttgccatgtaaattcctgctcagctagttctgcttaggcttgatcatatcgtattacaggcaggggcggatccaggaacaaaagattgggggagttcaattacacagtttcttcaaccttgagccatttagggactttttagtttatcatttatggtgaaaaaatcgaacggggtactccggagggtatccatgggttttgtgggtgtag

SEQ ID NO: 68072 - DNA, 692 bp, Oryza sativa
ttaaagaagacacatagatatacatctcacatatttaagatatataataaaaagtttgagaaacatatgcctgcttatgtggacgggcttttcttctcttcctagtttatcaaactagggcgatgtcaaatattattcagatgcctggcttctttacacagctgttggatatagatatatagataagtaattttacagtctttataaaaatatcacgaggtatcattttttctattataattttgttataattttggtagatagacagctcgcactgggccacttatcttatggcttcgttcggtggacggagcgagctatttatttgctcctggttcatcgcctcatcggagcctggactgcgggcgcactacgcgacggaggcggtactgcagccacctgcggccggccgtcccaacctgcatatgccaatcgccaaagaaaacgccgttagatcttggggtttgcatcgccttggcagtgtcgtctaaagcggcacatgcatatatagcagggagtatactactcccttttaaatatttgacaccgttaactttttagtatgtgtttgatcatttagcttattcaaaaaatttaagtaattatttattcttttcatatcatttgattcattgttaaatatactttcatgtacacatatagttttacatatttcacaaacttttttaaat

SEQ ID NO: 68073 - DNA, 4495 bp, Oryza sativa
ctaggccgaagccgttttgtcaatcgatcgatcaaccgtttttttctacgtataaacagtgaggacgatcgagcagctctgaaccatacatgtccctttcagtaaagcagcaattagccagctgcagggagatgtgcagtgagcaactggacatacacacgcagacacacacaacacaagttgtgtccactttaaacctgcacctgcggctacgcactgactgcaccgggatgctctgtacagagcccaagctttgctagtaaatataggcttgtgtttagatccaaaactctgcgctgaactaaacacaacttttcagtcacatcattttcaatttcaaccaaaatccaaactctgcgctgaactaaacacaaccatagattgctcgtgttcgtgctcctttccggttaacctgctcgtaatctttttaatcagtttagcacgcgagctagatagcgtagagaccaccggctttcgaggaggggaggtggtggttgccgctgcaagccacattgattgaacggacgcacgctggctgtatgtaaccgaacatcttaatgccgcgatacgctacaaaagttggcgtagcacgagccattttttcctttgtttcttgcagtactcatcgtttctcgagagcaacacgacgacattgacattgccgtgatgctacgagtacgagctcccaggaggagagaaattaagcccatgaccatgaggccgtgactccatcacctagctgcgtgaatgccagaacaagggtccaatataatgaagatgacaatgcaagtttcatcagtttcctattgtccttttctctccaggaaatcaggagcagggcggatgataaatggatagtggcaagaagcactgtcactgagagacagagatgctttgccatggacgccacggagtttgaactttgaagcgagctactagtagtagcttagctgactgaatgagtgagtgcagaaggatgcatggtttctgaagaatgcactcttatcccttacttgagctttacccaaacacccccagttatgcggcataacgaaagggaaacacaatagtatcagcgattattagttaatccaatccaaaggcggccaagttccaaagtgatgcttgccgtaaattggggctcattgcaagaattcctcccttgggccccgaacacttgcagcagttggccgtaaatcaaggtgcttctgcctgcagcaacgagcatggccgaacgttttcctttctttaacgggtaatccctagggtgtaggtccagggcccataaggcccacatggcagcgagagaacatgtatatgccggcctgatgaagagatcggacggcctggattggcacaactggccgcatcggacggctgcgaggcaatgaacggagagatgggagatggagagcggcccaccaggaacgggccttttttccggcctagggaagggagcctccgtttttgggggcctttattctgttcccactctaacgagaaaaactgtctcaacgcacgctaccccgtggcccacaacttttcacgcttttaccgggcccaccaataaactacccctacagtaacaagtactccctctatttctatttcaggtataagataaactgctttaaatttaatcaaatttatagaaaataataataatatttttgatacaagataaatttattataaaaatatatttaattattaatttaataaaactaatttggtaatgtaaatattattatatttgattataaatttagttaaacttgaagcagtttgactttaaccaaagtcgaaacatcctgtaacctgagacagagggagtagttaaaaaaaatccaaaaattactgcagctgcagcggtggggccgcgtgagcgtgtgagtatgagacgatttgtggatgaggagaggagatgcacgccgatgccatgctgcattaatggccggtggtcgcggctcccgacgaataaattttgccgtcggtggccggtgcagcacagccggcggtgattcggatagtgaccctctccggtgtgtactacgtgtcatcgtacaccacccccccgtctgaaacgtaggacgccttgtcctcttatacacttggcacatgtgcacatcgtactggtggccattgacctctccaactctgttttccagcggtaaactgattagtacaaaatctcaatctcactacaatctttctgtgtgaacgagattatactattgtctgcgtggtaaacgtacggaatctttcgcctgcacctggggcggacgcgaaggcgacgcgcggcggcggccgctcgtcggagcggagatggtgaggagtcgctcgcggggtcacatgcgatggcgcggcggcggcggtgggcatgtgggcgcgcgtgtgtttgagggggtggtggttctcgcggcgacgttaacacgaacgtggtggttgctccacagatgtcagctaagcatgtgaaatcatagtgcccgcgggacccctgctactactaccaccaccattacctctcttgacctctactactactaatttatgcctgcctctctagtctctctatacccacaaatcccgggtactaatactactccaatacgactatctcagttcagctctacctacgaagagcaaatactcggtccattttgggattttcttctttgctactctactcttgtttccatctccgccaataattcagggttcacccgccaagatccaactaggacatgtccctgtccgctctaacaaacggatgcattatgcgctacttgcatgctatggctacatggcttggtgtaatttcggactgttcgattgctacttctggctgatcttctagtagttgagaataatgcaagtggtttatggctttaggtgctattctgcggacacgcgctaagcaacaaaccaacgggtgtgtaaggtttgctcttgggctgggttggtagaaattgttcctgctgaatcctttgggctttcgcttcgcactattccagcccaaatatgtatggaagttttggtcttggcccatcattccggacaaatctggaagcccaggaacatattgcgcgaattgtatgtttccttgcctctatgctctttttcatagtggcagacaaattaacaaatcggcaggtttgtttcagcacacttaagggcctgttcagattgtagccaaaataaacctaaaattttggcaagatagcaatattgacaaaattttgataggatttcttatgtatttaccaaatttggtaacaaactaaacgtgatattttttagcaactttgctaaaagatggtatggttgaaaatgacatcaaagtgaacaggcccttacagtactgagttaccaactagcaaatgcatttttacactgtagagatcgtaaatctgtaactaagataagatatgttttacaatgctctttgctaattgtaggaccaaatttttagataatggaaatggattacatctccgacttctgtcaaaagacacacagccataagtttaatagtaataaaaatgcaagataaaagtaaatcaaaatgagaaataaggtgatgggacaaatccccaactcccctttattattgactagcgttaaaccacataaaattttttagctaacaattcttatgtaactacgccacccatagtggaataagagacccttggctaccgatttcaaaagtgtagcaccattgcgcatagtatcatgctctgtaggaccaaatatatattgtttatctttttcaatccaatacgtacatcaattattggtaatataatttttttcctctatgactagtagaagagtagaactcataaattactgtagctcttaagatcacttccactgacaatagtagtggcagtagaatactataagtagaaagccctataaaggtactcaccggttaaagatttgtaaacccttttatctggttcatgatatgttgcaagagtatggtgcatgtcttttatttttccctcaatgagtttgtaacagtaaaaaactcatcagtcccattaattttataagttgaacagaccaaaaactaaagtcaagtttttttttttaatgcaagaaggggaaaaaagaactggggggaaagacaatcgcatctctgtctctctaaaaaaaactcaatccagttgtgatccgtgtgtcctaaaacttagggacggcttctgcatgcattcactttgcagcgcatgcatgttgcaaccactacgctgcgtatcctagttttaaatgagcaacagcacggcatgataattgcatctatcaatgtggaatcgtacgtaccattgtccattgattcaccagaaaaacacacataaacggactatatatgcccccctgcaatctgcagagcaacttcctctgctggtacctatagagctcagataattgcagtgggtatatatcactgtataagaatatacgactagtaggatttgggctgcaggaa

SEQ ID NO: 68074 - DNA, 665 bp, Oryza sativa
cgcgcaggtgccaagtagacgcgcatgtgaggagtaccattcacttgcaatactctggcggataaaagaaaactcgcgcacgccagttaacgtgtcagggaaacccacggtggagactatggtggcaatgtcacgtgcgcccactatttgcaccatatatgtgtcagtccgcatcatcaattcatcatccaggaagtgaaatggacggagagcagggacccttgtaaacgcatggcttagaagtcgtcggatcgtggccgtccatttgcaatctcatggccttactcgtctccagtccactgcactttgtactgggagtaaatttcctgtgtacccctgaaaactcactcaattcctttcatacccctgaaatttacccaatcccttctatacccctgaaaattcaatttgatcccttccatgcccctaccgttacattttccatcatttcactgttacgtttggttgcaaatatcctttttgccctagatgctttaggtttaaatataagcttaaaaaataattaaaaaattttgtttgggtgcacagtatgtgcattttataagactaatgaaactaaataattagtgcagaaaattttgacataaattttgaaaataaaataaatgtaataaattaaaatttttatttcaaattttaataga

SEQ ID NO: 68075 - DNA, 16315 bp, Oryza sativa
agaataacattagagcaagtataatagtgagctataagcctagtataaacttatatggaggagagatgtgacaaaaagttaagggtgttggctctcatgcaagagctagcttaacataagctcctagacaaatacaattaatgtataagtgagagatagagagaggagaagaaaattgtagccaaccttataactaatctattatatgtgttggctttaagattggctaatagcatgaagtcggctctattattatccttgctcttatggatgcgggccatgcagcatgcagctaaaatgtcgtaaactcgagcgtcctcaactgtcgatgtcacgttgccgttacgataacgcaggcccctgcggactagaatgtcgcgaaatcgattactcgattgttcaactgtcatgagttagttttcgatcgagctgcattttgaagaaacggcgaagggcactaactggttagcatgatagcacctaattaagtagtactatgtggcacggataggaaaaggaaaaaacataaacggaggggccaaagctaagttaaatacgctcaattcagaatttctgtagcgttaggaatgctgaaatttaagggtttgttcttttctgattaagattcagattttttttacctaattacctaaacctcatcttgaaaagggtaccactaactgaacaatcttcaagaacaccgaagtggttgatgagactaccctgtcacgagccaaatgaacctaacacaatccagagcgccgcattggttgatgaaactgccctatcacgtaccaaaacgaacctaacacgatccgctgaaaatcactggcgatgtattatgcgccagccagccacacatccctgcaggatgcagcagcaagagccccgtgcacgtactgagaccgccttcccttttccctcccagcaaaccgaacaaagaaaaccatacgcagattcgccctgcggctcatgcaacggcccgcaacttgcagagatcgacgcacgcacgctcgctgctgctgctgctgaactcgtgattcaagttgacagtagtacgaacacgcgagcccaatctgcagggacggcttatgcagcatcagccagcgaccgaccacgcattgtgctatcgcctcggggtcctggagaaaggacagccgcgacggcctcccctcttccgttagttgaggggtgccaatcatttctgccgacacatttggacatctgctacgctaaacaccgccacggcggcgccacaccaacttaatgctattggctgagtacacatgatagtagcagcagcagcagtcagttctaaacttgtactagtactagtatcagtaaaaacatggccccaaaaggaaaaaatgagcggctgcaagaaaccaaagcagagaactgctgctgcttcagcggtccaggctgcctgctttgcctttcgtccctaagatctggcaggcgcggcagggaggataaaagaaggaaaaaaaaaaggaccatggaatggcggatgcggggggagcgcgacctcctcgcgtcacatggcttggattctcctcgccggttaaactagcgcggcgcagcgaccaccaggtggtgcatgagctgtagctgccaaggcaacctgacaaagttgcttgcaagtagcctcgcttgtgtgctttgggcgctaacgttgtttactggctagcgtttagtgtgtgcgcgctacttgcttgcatcaggagagatggttaaagaagagaactttgcattgtttaactcggcgaaagattgcgagagagagaattgtttttttactttgggggtggtttggatggttacctgatctgccggagctggtcgaagaagcggaggtcgaacgtgtcaccgaggccggcgaagaggacgacgccggcgaggcggtggtgctcgatgtgtccgagcgcgacgttgcgctggtggtggcgctccttgcccgcggcggcgtcggcgacggtgaagttgtccttgtacgtcaggtggcggtacatgagccccgtggtgcggagcagccgcgcggtggccgccacgtccgggttggcctccaccaccacccacagcaacggcggcggcaccagccgcagcgtgtgcgccatcctcgtcagcgccgccgcgcgctgcccggccgccgagggcgtcgactccgtcgtcgtgaccaccaccagcagcggctgcggcccggcgtccaccgcgccggcggcggcctgcgccagaaggctccggttgacggccgcccggcccgtggcgtgcagcgacctcaccacgtggctgctccccaccccgcccgccgacacggctgcggacgtccagtccgacacggacgacggcgcgaaccccgtgaagaagcccatgacgaagcacaggctggaatgcagcagcgccttcttccacagctgcgaccccgaccccttcttgcccctcccgccggcgccgccgtgctccgtggaccaacccatcgcccaagagacgacccccccccccccccaccgcctcccttcctccggcgccgccgccctgcttgcagtagtactcctccctgaaacaacgcgtggcgcggcgtctcgcgtcgcaccgtgccgtagcgaggtaagctagctccgctgctcacctgagcgcgcgtggccgtgttaggcgggggagcggcggcggtggtgttggcgttggtggtggtggggaggcgaaattgcgagtggtggtgggtttaaaaagggcgggaggtggcgagcgagcgagcggcgcgcggcgcgaccgcgcgcgagagagcggaaggcgatctggctcgttggttgtcacgtacgcttttgcccctcttttcccgggacgcagcaatcattaggtggcgctcgagctagtgacgcactaatgactcgcgcacgcacacacgatcggctgcgtgcttgtactttgtacccgtaacccgtatagtaaacagcaatagtggtggtaggaggagtagaatatcgtatctactatattggtatcagtacgtgtgtgtcgtcgcggtggactcgccgcgtggtgttcccagttggctcgggttgaatgaatggctagtggggtgccattcatgtcccctcgctccccggagtgctccaccgagcacaaaaaaaacgtcgggactcgggatcgatcgatcggtcgaccactgtgcggtgcacacatttaggagtagtccgttttctcgacctgtgtgtgtttaccctgcacactagcgttgcgtgggtccagcgtttggtactttggtgcgtttattactacagactgcagtggcggccacaccagtgtgtttggttgggtggatgaatctggatgggagatggccgcttgatttttctgtgttgtttggttggagggcaggatgaatggggcggcccagaatagggaatattctctctatatgctggatgagtgcatccggccgatttggctggatgaagccatccagttttggtctgggtgatgtgtcctgttctgattggctgtggttggtttgattttctgttaagtaagctccaaatgactttttctcctaaaccgtttatctaatttatgattgattacaccattatatttgttacaattaaatctttaaaacaagatctcagatgattatattttgataaaaaaatatatatgacaaatgggtcgcactaacttttggctttttccatccatgctatatccctccaatcaaataaaaaattggattgtcatatctatacaaaccaaacaaaaaactggatcgtcatatccaacaaaatataaaatatagatggtcatatcccgtttatgcatgaccgtgaaccaaacacaccctaagctgccgcgctgacgggcgccgggcggttcgcttgggccatcgcgggtagtggaatcgagaagcctctctctctggcgctcggtggttgcgcgttgagttgcatgcggcgctcggtctttttccggcgcgggccggggtgatgggttccagttggtggtggctggcgcgcgtacgtacgcgcgcgtcaccgagctactcctattcaattccggtgagagcaacacgacaccgggcagagatcgcggtgggcagctgttctcgctcatctgacctcacaaaacagccgccgccgaagccccgaagctgcacctgcatgcctgccacggcgtcagaaagtcagagcgttcgaactcgatctgttctgtcgtggcgttcgttcgaagaaggtgattggcagccaccgactcctcctgggtgctggtgaattggagatgttctgagcaagtgggcccggactggcagtcggtcttggtttaagcggcacgtgcggttatatttaggtgaaagctattaatctcgtgcttaatttagcgcgacaggatgggtctctagcttgttttgtttatttattgttcgtagtatgcctcactattgagttgtaagaatcttttgtgattacatgtcggacgctcacacattcacgcatatgtccctaccacacgtttaaagagataaaaaccactgcgaatcaaatttctggactcactattgaaaactcacccgtgtgaatcttctccgttagaaacttgtgcatatatcgggaccggattgactttggtattgtaggatttattcactttgttgctattttcaaacttatcaattttgggtaaactataaaaaaatacacatgcattgcaacgggtaaatgctattgtaattttattattgttatacagtttagttagggtaaaattcactataggaattcgcttggatttttttttcagaaatcatgagctgcaataagaagtctgtattttatctcaagttagcatgcgagttttttcaaaagatttcttatacgactccttttatacttccaaaaggaaacaagcttaaaatccaactcaaacacatatatgtattttcaaaagcgaatgcttaaaaaccgactcaaatacggatgacgtacaaaaatactggaaaaacatcttcaatttttatttttggtaaatttagaagttcccactctaaaactcaactaacatttgatttgaattaaacccaaccaacctcccttttacctttttttttaaccttcaaagactagattgatatactatgagcatctctgaaaactgtttctgcatagcttgagttctataagttcacactcaaaactcaactaaaatttggtttgaaattgaacaccacctaaacttgctttaacttgcccatttttgacctctaacgattagaatgatacattttaaaattaacggagtcaccaccgttagattatatggtagttagatatatattgagatatgattaatttgtgtggactcaatccttatctactctacatgtattcctatatattctctccatcctaatatgagtacaccctaatacaaatgtgacatggcggatggagtatatacttttttttaacgaatcggcaccagactgtgcccatttcattgaatatagtgggaaaaaactgtacaaagctaaaactttggaaatttacataggaaaaggagaaaaaaattaagggtttatctcggatagcctttttgtgatggctagggtccaggtcttggtctcctcctttatctttgcgcagagcgatagtgttgagagttcactgggttggaaaattctttgatttctctcttttcaaatctcccatgtcactagcaacaaaagggtgcaaattccttttctcggtgtccctgggtgtgttgctattacagtccaccagtcttggggcgacataggctgagcccaattgcccgatttgacgtgctcttgcgacgtccaggatgccagattctcctaaatcctcctagagtatctgaggtttactaggaggtggaacaccgtttcccgagtatgtctacaaagcgcgcagaaagtgttgttcggacatccacatgtagtcagtcagtctgccgtccattgaaagaataatgagctataaatatgagcagccatgtaagtctagaacttaaatccggatggatatgttccaccacaataaaccttatcagtactacgatcacttgtttgttagtttgacgtacccattttagcaataccaaagtttcaacaaagtgaaaatgccataaatacaacaaatttattttttgcgggtatgcgtgccattttaatcaggctcaaacgagcaccggttctttccctcaataactcaatccataggtcaatactcaatatagtcatatcacacacccgatgctccattgctgtgtcttggaaacgaagcaagtaattggttaggatggaacccatcacctaaacagccacttttcacccaaaaagagccacaagaaaagaaccgagccaacaaacaaataaccaaagaacaaacgcaacaacatataatttccacggatcgaattcattcacccatacggccctacgcttagccgtgttttaggattcaggcactgtaggccggccccactgggtagtgacctgtgtgaggtcaattccgataaagcacatggatgcaccaaccagttcgtcctttttccatctgcccaaaattaaagaagaaaatagaaagtgaaacagtccggctggccatgcaacacgttaagagaaacgttcctttcgcagcttctctcgctgcagaatttttccccccttctctcttcagtttctgtcggtcgcgaccaccagcagcaggcagagagagagagagagagagagagagagagagagagagagagagagagagagagagatagatcgatagacgatgccatcgtagtagtattatactgctacacaagttatataatttgacttgtgtggtttgtttttttctcaaagacctcaacgacttcgaaaaccttttctcttggatcgcaacgcgtgtgtgtatgcatatatatgtacgcacatgtgcccgagagcttagctgttgtttatgaggtttcgtgctggtttggcctcgcgggcggactcaccgacgccgccgcaagttaattagctggtttaagcacacgcaaatgatgcccggtttttgggattaaattaccggtttcgtctaagcttaatctgctcctgcagccagccagacagccggtgagccggccatgccagtacgccgtacgcgcacacatgagcggattactgcataattctcgcagatcacacggcgggtacagcgttttcctgtacgcgtatgagtacgtgtcacgtgtgacaacttgtcccccttgcgagaattctctctcgagattattggcattttgcgaaggaaaattggatgctcataattatatatttgtttggtgatcagcgagatattagtggtggtcgttcacacgaagcggtcgatctattctaagcatcttgacttctgcattggcgagacgatgtgatgtgaacagcggcgaggggtttggagcaaattaagctaagctctccgtcgttgggccatcaattttgtgatttgtttgtccgcactatgccgtggcaagggtcgtaaattagcgtaagcgtcgttaggtgctgcaccttcacgcacgctacgttttacctactggtttctccgtaggttattactgaactgttgtgttgtgggcgatggtattgataaaaatttgttgcagattaggtccaaagtttttatgccttgtttattcatgtgtgtatgatgctctaacgaatacagggacacttgaagaggtctttaggaaaagaaaagactactacttttgcagaacttttcttttttagaaaaaaaaagatcggtcgttgaacaaattgatgcggcactgtctcatgtaacaattgaatgatgtaatactgtaccattagtaaagttatatctccgtttgtcaattgccaaagagagttctactaagggactacaataatcacttgacacctctatttgttatataaacgttttatctatttataagttggctaggagaaaatattattgttaggatcaaacagaggaaagtcgtgatgctgcaggtgaaagagtgatcactgaaattaaatctgtagatcgaaacaaaaatgtcctcggcatcatatgccaacatcacaaccagtattgattccacatcaaaaccagcaggcattcggcatattactctcaacaaattgacagtgacaacttccttaatatttgataaaataaaatgaagcaatcaaataatgactaaatagtacttaatacgataatacaactaaaaaaatactcctggttactccagagcgaaatattagagaagatacacagcgcaaactaggacaaatatatgtgaagttacaaggcatgaaaatacgttagtagtacatcctaaggtaaaagaaaaattcccatcatgtagcaaatcaatgcaacctagctaatgacgcaggattaaaaattgctttttactggcaatttggtgcacttatgcattgtgccgtagcttttacatctattcgccatacttacatcaaacatgacagcaaagcaccctgaaaaactcatttgggtaaaaatgaggggaaaaaacacgtcagttcttcacctattctcctgtttaaatattttgcgattgcagattacatactgaacaaattacaagacttcagatgttagtttactctaaaatgtgctacacatttgccttaagatttttgaacagtttgaaaccccgataacaagcaaagatatcctaaaagatcacatttctacacacgtcaaggtatgtgcatacatcttttgtcccttcagaccctgtatattaaggccccaaggtgtaatgaaatgtcaaacagagcctctatcatatggaccagaaaagggcaacatatgtgcactttgaaacgctgttactggcaccgaacaatgtggttcaagtttcttcaggcaaaactctggctttgcagtaatgccattgaactcgagtactgttagtattgatgtagcacgaagtagaaactaattttcctcatgaagcaacacatcctgagaggaactccaatataatttcatccaagagatcaccatgtaacatcttggctatctgctttcccaccgtattgatgtcctcaccaacttccagccattctggatcaagaactttgtcatcaggatgtcctactgcaagctcttcctgccgcctgaccattgtttgccaaaccacctcaacaggcccttcagggccccaaacaggacaacaccgtctactggatttccatggtgcaaggatctcagaaagaacagtatttgcaagatcaaacagaagcctcctttctggtcttggccatgcagatatcttattgtacttcctctcaagcctgtcgaagacctgaggtccaacagggcaaccaggcgagtgccatgacttgcacaagagctgtgagtcagcgactatcataccagagtttataagcatgtcaaggagatacgagaagcccctttcctcctcaacctgaaaagcttccagagaccggtaagaagaaccactgtcatcatcacttgacaaggatacttgttcatatcggagctcacagtcatcaattagtttctcgacatctgaggtcaacacagaagattcagttattttaagcagactcaatctgaatatttccaaatattaaatggttaatccagcattgaacattccaagtgaaactctcaacttaaaattttgaaacacaaacaagaactttaaaagttttgattcaaacttttaactaaactttactatcagtttagtgctctgaaagttcattgattagagggcaataaacatttcatagcatgttgagccttcagctggatgattgaaaagttagactaaaaggatgaattttcaaatttgtagcttttagcttagtgacttgcaaaagaaaccggccattagttagttaactagtcatgattgctagacagcaaatgcctttttagtgtatgctaattacgcatgatgctccagtcaggtgctatagtgatggtttagcttgagttcataaatatttgcatatttgggacaattgcttatttaaccctattttaaagtctaactaccaatttgaccctactttttctagtttgcttattttgaccttgcttttcaaaaatgaatatcccgtctgaccctgtttccactgcaccgttaaggtttcattttaaataagaaaataaatatatttacttttcataatgaccaaaataccctcaaagaaaccctatccattcagatccggtctcctctcatatcccgtctctcttctggtgagtggcggcggcgacggtggggcccagaggaagggatccgcgccagcgccggctcgtggagggagggcgcggcaacagcgccggggcacggagcgatttgcggcggcgccatggatgccggcctctcttgactcgcaaccatcgtcgtcgagacgcggcgcacgcggttcgagatggttcggctagtcgccgtcccggcggccttgcgtgtcctcgccacggagtagcacgccgtgggcggcgctcacgcccaggagctccgcgagctggaggctgcggtgggctccactggggtgctgcggtgtgcgaggaggcggaggcggcaatattttagcaactctataggagattactgggtatgcaggatctagtatgcaaatcaacaatgattcaaatacatcagtgaactctaggcttcgtgatgaatctccagttacccttgagcagcatttggaaaatgtcaaaaccttttgccaacattgtaaaagatatgggatcttcaacacgtaatacatcaagctctaaagtacttggtaggagcaggggctgtaggtcttttactggatctagtttgtttgaagatttggagaaggacgattgcaccccaccagccaccaaacagaagtttcatagatttcgctgtgagacctcaaaattgtcaaaggggatctgcactgaactagtatgatgcagagagtgagaccctatcaagggcagggttctgttgcaggcgacacagaatttactgtcataggtgaatttgttgctgaactgaaagaaatgtcacaggttcagtatcggaaggtcatgtgagtcattggaaatgttatcttattcctgttgaggccgcccattctacttgtttgaaaacagcacacggttatggtgcttcacatttttaatagctcaggagggcttattataaactaaatatactcattgcactactttaagatatcattgacatttaattatgattttgttctttgttttgattgccagagtggaaatggagacttagtgtcaattaaataagcaagatataagggtcaaataagcaagggcaaaagggactatttgccccttacttaacaccgttaactccctttaatggaatagggtcagataatagattcatttttgaaaagcagggtcaaataagcaaactacaaaaagtagggtcatattggtagttattcttcgaaatagggtcagataagcaattgtccctaaatatttgtatcaacttctacattgttagggtagctggtaatgcagttcagacctctttgaaacaagtaaattcctctatgaataacagaatactccagtgttccaaatggggccagtttgtctcacttactaggcatgtcttgtaagttacacttgaagtatccggaacaacaactgtcttcatcagttggaggctcaagaatggacactgggcttggttgcccaacctctttcaagcttttatgagactttgccacataactatgatcagaaacagttattgattcataatcacggcaattgaaaggtgatgctgaaacctaaaaaagggaacacttgagtgagtggtacaccagaaactaatgcatgaaaattgattctctcccagtgcgtcattatattgataaatgaaggcaaagtaaagcatcctagtactacataaaccaggtactctaacatactggaacagtacacttctggactcaagaaaaggctaaagaaagagaacctactattttcaaagaaaaaaaaatcaggaaaagagcaattagaggctggatttatttccatataattatcaaaaaaagaaggaaaagagcaatttcgatttctgggttctcattagaataccttcttaaatgcttaacactttgagatatataagaaataaatgctcaaacattaaacaaaaaaccataaaataagaatacgattcaggaacagtaattgaaacatttaagtttcttaactttgtagtagagaactgcatcatttagaaattcatgttcacagtatgcaacatttgagcaaatttcctcaattaactctgtttctgttttgaattacagaagttgttaatataagggcctactgaccttttcttccccacatgattcaaatgaagaatgtacagtttcagcaggttttttcaccaagtcctcatctgttgtgaacaatattttctcatttatgcagtcaaacgttgaaaagttgtcagttgaacaccgcgaatggtttcgattatcatgagaaggggaagcagatctatgttgccgcaaggtctgatgtttcgcacaagcattcctcaagttatcttggctgggacttccaatttgctgcagtcttgatatatcgcagaaagagttgaagtgagactgaccactgtggtaagtatttgatgtatttgggataaaattactgtgaggggaattcttgtccaatgaactgtgaggatgcaatcgaggtgcatgctttggcaaaactatgaagcatccttccttgccattgctgttgccccggttaagtttattgtgtcgaatctgcgcatgtgagtcggaatctctctttagcctctctgaatcagataaggcaaacatctctgcaagagttttcgaaccaacactgccttcctcatacttctgacggtttttcctgggtgagctatttgatgatggcctgttgctttgtctggagttaacttcaccactaacacagttctgagatgatccagaactactcgtatccggtacgttatgatgatcaaatgatgactcctttccttctaacagtgaatctacggcattcctactcaagtatctttctcgttttattctagacacatcaacatcttcagtgtctaaaagatttggtgaaaccctccctctattctgcaaagaaaaatcagcctgctgcatctctctcctgaaattcttattgatgtgagaggggtctggcgtacaaaaggctttccccgactcttggactttccctaagcctggctccaaaacaacaatgctattgaaatcttcaagctttcctcttgatgaatttctaatatctttaagtgaagtattacctaagccagcagggtacttcctgaaagtacttgaagtctctttctcatattgatgctttgcggaataattcatgtcatgggggcgcttctcaaacaaaggattgtttatctctagcgagtttaggcgatcaaagccatctcggcacactacattgttatcgaatggtccatcgccatagggagacatcgatggcataagcttctttaactttaatgcacttcgtttcaagcttggcaatcctttagggaaatgatgggacctctctttcacgatagcctcctgtggttcctctgacacttcaaagacgtccttgaaatcttggtgccgattgtgggttacataagcaggtggcaatacatcaattcccatcagttttgcaatcacactaggtgacgatctcctgtgctccaattccttcaatagatccttcccaacaagaattttggttgggctgttatttcttcgtggcctgcactccttgtaccgatgcccaagctatagaagttgtccaaaacaaaaaaggaagcatatttctcaatcttaacttttgacttttggtcataaggtaactgatttgaagaacaatacaatgaacagaaggaattaactcactgaaatctgttccatcttgaagattactgtatagagaatcagttgagatgagaggttgctacatcatctcaggtgaagtgctttatgcctacatatatccacagaacatttgtaaagttatgttagttctatgtagagcagatagaaaatcagcacaacgccactcaaagtagatggtttagtacaatgtcactcagttctccaatatattagttgacttaggctgcactggtattgtaggggtggtgctcggcctatcaactatgtggaacaagttgagagaaaaaaaaaagacccaacagctgctggtcaggatgaagtgatgaacatgagagcaggctgattaacacaacactaaaaatgcagcaagcctgcatatggtgtattttccattatgaactatatgtgatggctcaaacaaggacagcttgcgattcccgctactaatagactcaaggagccgagcagtctgtcctgtagaatctcaatagtaagtggaggcgcatcaagaaaagcccaataaatttaacaaaaaaaaatgatccttcctgtggcatttcctcaaatttatacttgtttacaaacctatcatttttctcccttaacaagtactccagtatgctaaatgaaaggatgtctccaccccaaggtttgatcttggtgtccacaaatacagttgtgtgcaagtgcgcaagcctggttggtgcagaagaaaatgaaaggggtgactcgcagagtaagccaggggcggatccaacttgggacatggggggttcagttgaacccccaaacttttgggggaacaaacaaaactgttacaatctgtattaagggttaagagcttcttccagatctagaagagaagctagggttaacgcaagcaaattcccagacaaaactactcccggtgggagagagatgaatcagaaagagaatgtgaatgctcaccaagatcccctcccctccccagctctcctccccggatggagatcggcgcctctcgtcttggcgcaaggagcggacacgacgacgggaacgggacgggagattttctttttcttttatacgcatgtacctttagctaatctagttctaaacaaataaaatcaccatgtagaacaagaataaactacgcaaacctatacacacgaacaaaccaactaacctcctgtcaccttcaccgtcctgaactcctgatctgaactctgaaactcctttgaaccaacagcagggagagagggagagcgagagctgcagcatcagggattcgctcgcagctgaaaaggaaaaccacccagaaaaccaaaccgtcgccgccgccagaaacgcccagcgcgtggaggccaggagcagcacaggtacaacggaaaaatgcaatgcggtgcgaagcgcgcgcggtggagttgctcctctcctcctcccacgaaatcgcagtctttttctccctacttttctatgccctttcctctcttctcactgcccactgttcggttttttggaggaagaagacgagctcagagcacaacaatggtttgggacctccacgcgactccgctacacggccaccgctcgcgcctccccacccgcacgcggcacgtcaccgacatgtgggtcccgtaaaaggtgtgacccacatgtcggtctgtgagacaagtggcaacgcggggtacacgccctcgcaggttgcgagtacttcgccggatgaggaattaaatggcggcgtttagatgaaactgattaaataccgggggtggcgcccgcgtgcgtccctatgcccacccggaaacgtatacagatctgtggaacactgacactgggcaagcgggcccgagagatccgagccatttcgcggtacggcctcgccttgggccatgaggcgcaatggtggaggtggtgataccgtgctaggagtgctaatcgtacccactcccgtgctcccctgcgtgctacgcgatgtgtcgtactgctgtgcatgagagggaatcttgctgtgggcagtgggcacaccagagtgcaccccgtcagtccccgtgccgggtgtatttacatgtatgggtggatggagtagggaaagtaagtaggattggagtgctagatggatcggtataccgatctgaatcattctccagaacggctttaatttgcggtgaggttgatgaggttggggggccgatttccaggtcagttttatttgtctaattatgtttatggtgttttgtcaggtctccagtggaccagttaagtgcagtacagtgctgttggctgctgctgcctgctggtggtccccattcagcaagtggaggaatggatggagtcttgttgccgcaa

SEQ ID NO: 68076 - DNA, 9980 bp, Oryza sativa
ttatgcgaagcatgtaatgtatacctcgctgactcgactactctttggacttgtgcaagatttctcatttggcagatgagcccttaggtggtgaggcacaaaaattttgaactcttctaggaactcgggatagttacctatgattctctcaacctgcaagtaaatcattgtgaaatcagggcctttgcaattattttgtcaagccattattgaagaatgaacaccttttcgagaacttcttcgctggtcttgatttcgttcttataatatttagcaagaacgttcagcaaagcatggaaatcttcgcggctgatatcaggacatgcctgcaggtataaggtcaagttaacaacaattggtaccaaacgagcacccacaccacacaaggagggagcaagcaaagcgggtttctttgggcaccttcactctctcaacgaaattgtgtgccttgctacgcatctttgctctgcaagggctatatccttggatgaagtgctcgaagacctgtatggcttcaggttggccgtccaatatctcgagaataatttctttgcatttttcaatcgacatgttcctgaattcaggatcaggattctttatcatcagtcatcaaaactcacagccgagtagatgagaggatatagtgattgatacctctgcctccttatcttgatcatagatcggacgaaatggctgtatacgtcgtcaggaagctctgacttgacaagtaccaaaaattccatcgtctcgactctgtagggatccctctccgtcctcgcccttttggacggaacgccatcgccaggatcaccggcggaagaatccattctatttctcctaattatttaggcgaacacctgcacaagagcagacagatgcaacaaatcagcaaagacctgcacgagaacagacgaatctacagtgacggcctcgtctaggcaaccaaaatctaccgccgctccggttatcccctcgcaaaaaaaccgaaaaaggaattcgattcaaccaagtcatcaatccgccgtaagggctgacgaaaccgaggcgattaggaggagtactctcgtgatctcggcgccttgattcgcgcacgcgagtggagggactgacctcaagtatgccggcggcggcggacgcctggaggaaggaggcgagcgacgagggcaccgagactccacaccttccggaaccttctagaacccccgcggcgcggccgcgcggccgagggaaagaagagagagagcgcgagggaagagatgaagagaaggaagacgcagagtatttaagtgggctggattggattggaaaccgagacgtttccttccggtttgaaataagttcattttgggtccctctatttgttgctcagtccgaatttcgtcctttgaccggggtatgacccatcccctaatttacgaaaaccgggcaaacgtggtccctcggcggttttggctgacgtggcacatacgcggtttgtttgactatatctccgtcccacatgacaatgacatggcgcttacgtggcaattatatcttataaaaataataaaaagcgtggccccacatgtcagctgcaaaaaaaattgaaatggtggggcccatgtgggccccacatgccagcctcactcctctcttcttccctctcccttctctctcttcttccctttcccctctctctctccttccgggcagaggacggcgcgggtgggcgtcggagcaagcgagctccggcggcggcggcgggcgtggtcggcgccgccccccgaccggagcgccgtctgtccgcgtgaaggcgagtagcgcggcgacgccctggaagacgccatcgacgccgccatccgtgtcgccgccaccgaccacccggacgccctccacgcgcgccgggacggcatcgccgagagcctctcaccgccgctccacaagccgcctacgccgcgctctcccctcccgacgccgtgctccgcctcctttcctccctcccctgcgcccccaattccttcatgctcaacaccacgctccgcgccctcgcctcctcccccggctcggcctccgccctcggctaggccaccctcggcttcttctccctcctccgccacgacagcggcaacagcagcggcggcggtggctcgtactcgcctcactccctcccgggcacgcgcgtatgggaaaggagaagaggaacgaaggagctagagccatgccgagctccctcctctcctgccggcgagctagaagggcggtggatggctaggcgagctcaaccggcgagcgcgcgtgcgtcgctccctcctctcccgccggcgccgctccctgtgcgtcagccatccgtgtgcggtccgtgcgaggcaccgctccgggcgtgtaggcttccgtgtgcctccttcctcgctcgccgtcgccctcacttcaactggtaagtgattcgctctgctccccgtgcgcgcgtggcttcgagttcgaggtggcgaatttgagttaactccggagctcttgaacttttgaaattggttcggattctgcgtgccttgttcttaatcgagtgtggtttcgatgtgcgcgtgtgtttctggacggaagttcggtgtattggaggaagggaattggtttgaactttgaactaacttggagttcctcggttggatttgagcatctgtgatgaagcagtggagaatcgcctcatgaattgcttgtctgtgtttgcattgcggtgatttgaaccttgctgctgtgatttcagtttggttattaggcgatcgcaacataacccagtgaagcagttctggtgctgctgtttcaatcctgccgccgccgcaccgcccgccgtgctggacgccgcccggcgagaggagggagcagagagatggggattggggagagccggagagaggaggaagaagaggattggattcggtcatttgagaatgacatatggggcccacgtgggccccaccatatttttttaagctgacatgtgggacccaccatttttaaattatttttcctgtggctgacatgtgggcccacgatttttattatttttccgacatataattgccacgtcagcgccacatcaatgccacgtgggatggataagccacgtaggcgccacgtcagccaaaaccgccgagggacctcgtttgcccggttttcaaaagttgggggtcgggtcgtaccgttttgcagttaaggtacgaaaatcggactaggcgacaaatagagggacccaaagtcttattccttccggtttctatcctcttgttgggccttgcgctcaatgccaggcggcccagttaaactacacgcatgacagcccatcacagtttggacatccagatgggccaaattggaatatagcgatccattcggcccatcatattgtaaggcccatcttatgtatactgaacagaagggaaagcccacgacgcaccggtactgagcaccgcagccacggcgccgccggctgctcgccggcgaagggagcagccacggcgccgcccaccaccgcctcgaaggccacctactgcactcgtcgaggtcttgtgtctcctcggccgacgagtggctagcgttctcaaggcggcctctctctcacagacacccattctcgctgcttcgtcgggctgtggtcaggtaatctccttccctcccgggtccgggtagtcggcctcttctagtttcaagagatgcttgttttgattggggatctatggcgctcttgacttgatccctgcgtacttgtgctgtgcggcagtggcaatgtcggatttggccatttggggattttcagggttcggctatcgtgccggcaatggggagggggattaacttgatgttttatcaattgatcttctgaatagtgattgatttgctaatactattacttcactggatagcggagataacactagttaaattctatagaaacgtgtcaggttctgtgcaatcttatgaatgaatccttcatgcctcgtcaatttatctcttgttaattaattgtaatatggtagcttctgagtaatactatcatattcaaatcactgttgacatcatagtagaatcgaaacctaaaaggattaatgatgttgcagaaattaagagttagctgtaactgcagctgttcttatatgtttttaacatggctgtattaattatgtatcatcgaaatgttttcgtaccctttcatgtcatgtccctgctatttatttagcattcgttagcaagtatatgtggccaatcatgctgatgaaatccgctaatgcgctgagaaacctacaaccatcaactagcgcaaaaaagggcatcatgccattgtgcattcttactgctccaccatcatttagtcaaaaaaactgctccaccatcatgtcactcaactagcacaatcacctttttctactatgtactttcattggactcttcttcacaggacaaacctgcatgtttaaattcacatgggatgcatgtgtagaaaggaccaaatgttgtattgtagcggggcttattttctgtatagtacaagttttgttttcaatcttcttatacatattacaagttactcaatttgcattggcattcaagtttagagttacatagttgaagcattgtcatcaggattttggttactgcagaagttcagaggactttatatgtcaatatgttttggttgctgcagaagttcagaggactttacatgcccaatgtacaagttgccgatgtgtctaatttgacagcaggaattacggtctacaagaaagataagatgaactgtatgctggatgcttatgtgtttaacaagtccttcaaggtacagagtacatcaattgaacctttggtttaaccttctaagtatgataaggagtgctaacaattatggatcagaacatttttgaatgataccagcgatttctagaagtaataactgctttgtggagccatttattgtacctgtctgttctgtgttttattaatactacatcagttttcgctgtgttgttgtttatccaacatttcaaagatgcatgcgatctgtagaaacactttggtttcacctttccttttggaaaaatagtagtcctgtcgcttgacttaatccccactaaggtgttataaggttgattgtggacctgtagtcaaacttcaaaggttacctgagaaaaacagaagttgtcttttactgaaaaaaagtacataatataaatgtcacttgacttctcctaatcttaagaaatttaaggtcagcgagtccttttagaaggtgattggtgacaccttctccacatatataacaatcagctgtttcctgtcttcctgagctacgataaacatttctcattgcagtgataggaactataaattgaatatgtaataaataacatatcgttgcgcatattacatctaaaaaaaatgctctctggttgtcatttatggtcaaaactgtaacaattttcgcaatgtttttataggcctcatttacacgaggaagtgcttgatcacgattagtttctataatcctatcttccctgatcaattgggttatgatgaattttacaccattgactgctcatatttatttatcttctgatttccattcttgttttcagccttggtctctccgggttcattcctctttgccttcagaaactcagcaagaacctgaagcgcgacatcgacatcatcattcctcattaggacctctgcaacctccgcaggcgttgtcagcacctcctcaatcagctgctcgatttctgggtacatggcatggttttcgacattgtggtagttgctagccagaactcggaaagcctctcgagtgcaataccccatgtggatgtgcatgtccatcctgccagggcgcagcagtgctgggtcaagccgctctctgtagtttgttgtgaagacgatgatcctctcctcgccgctggttgaccacagaccgtcgacaaagttgagcagtccagatagtgtcacctgttagaacaaaaatacccaaagtggcagcatcattggtaaggattaagttagttatcaaatcaagaagtggctgggattggcattgtctatcatactatatattcatgagacaatgattggttataaccaagtaactaaccttgtcttcgttttcttctcctgaataggtgggcttggcacgcttgatctctccttcgtcccgttgctgcaggtcgatggtgcagtcaatgtcttcaacgacgaggatggaccggttgctcatcccgacgagcagcctccggaggtcagagttggacttgacctcggtgagctcaagatcgtagatgtcaaacttgaggtagttggccatggcggcgatgaggctggacttgccggtgccaggtgggccgtagagcaggtaacccctcttccacgccctgccaatcctcctgtagtagtctttcctcttgacgaacctctcaagatcgtacatgacggagtgcttgaggctgtgatccatggcgagcgtgtcgaaggtggaggggtggcgcaggtcgacagcggtccaggcgtcgtactcgatcatgtgcatcttgaggttcctgtgcttgtcgttcatggccttggccgtgtcgatgacgaaggggaggtacgacctgagcgccttctccttgtgcttcttgtggaagctcacctcgaaggacttgacctcgaagcggctgcggcccctcctgttggcggcgccgccgccgccgatgccgtagggggcggcgtgggcggtggcggcggcggcggtgtcgcgggagacgaggcgccaggtgtactcgacgccgtcgtggacgtcgagcatctcctcgccctggtccatggtgatcatgatgccctgggcgtcgtcgacgcggctggcgcggaggcgctgcatgtcggtgttgatccgcgcggcgaggtaggtgcgggcggcgtcgtagatctggttggtggagagcccctccgtctcgtcgatgaccacggtgtgggtcgacgagacgcgcgcccggatgccccgcgccgccgaccggagcatctcgcgcagctcgtcggggaccagctcgctcaccacgccgcgcaccaccatggccgtcccggccacggccgccgccgtcgccatgtacttctcgtagtcgccggaccacgacatggctgactgccgtggatggacagaccgaccacctagtagctagtgggggaggagctcttcttcttcgtggtcgtgggcgctaggcgacgcagctaggcgggaccgcggctgatcggaggggcgtgaagtttacttgaatctagggcaccgttttgggtttgtgtaccgatctgtcacgtatttcttctacacggagtatttgtttttcttcctggacacgaaaaaaatagtgtatttgggtgcagaaggaagatctggatcccaagggtcaagtttgtagacgtgccgtattgtggtcacgtgtagaaacagaacctgtattcgaacttggagataccaacgacttgtgttgatagaccacggcccattgggcagaagaggcccggcgtgaaaccttttcaggccgaagcccattgctgttgatacttcatttatggcccaacaccgtccaaatgcactgcactgcatagccactgtcctcttcttcccccaatcccacaacctgatgcgggtggaggcgatggtggcgggtaatcccgtaataggaatactggtgagtttcttctctaacaacttttgcttcagtaatgacaacggttagttaatctatacattcggggagcccaatggtgaacgccagttcgaggatctgcgaaagtgattattctgtgtaaattctcatgctagtctatttcatctatttgttccaaatctaacacttaagagttaagagttcttctgtttgttccaaatctagcacttgagagatcagagttgtccacatctagtaacatttttcttttcccgttttcaccagatctgaattccatatgttttaaatgaaggtttcgtgtgtgccttggtggtttttgtctgggtgtgggttaatgtgaaatctaagaaatcaatggggaattgttccttttgaatagtcagatgtatttcaccctgttttctgaattagcttgcctggacaatgtttcgtacacaaacaaaatctgatgttgcatatgtatgacttgtcgagacaatactttaaatttcttaggaagcacacttcattaaataccagtgcacctcctatctccaaatacacattgtaattagtagtcaaaaaacgatcacatgttttgaaatggatcttccgttggacctatctagcatatacacattcttgttgtcattgttgtactccacaatcctaagtgcattcatcagttgaggagtcatttttgttctccatcgctttgctatctttattctcctccgtctgcttatttgcatccttgctttcagccttggtctcgctggcatcttttatctttgactttaggagctccagtagaccaaggagtgcaacatcaatatcatcatttctcatgagagcctcagcgacctccgcaggcgtcaccatcacctccttgatcagctcctcgatctctggatatgtgacatgatagtcgatcgagtggtagttgctggcaagaatccggaaagcctctggggtgcagtaccccatgtggatgtgcatgtccatcctgccaggccgcataagtgcttgatcaagacgctccttgtaattggtcgtgaaaacgatgatcctttcctctccacttgttgaccacagcccatcaacaaaattgagcagcccggataatgttacctgtgtggacggcaatcaaattcttatcagcataggtgagaataatcgtgaaatcaaggagatgaaaggtttgcaaatatgaatgttattatgcattctgattttaaaggtactcactttgtcttctcccttgtcttcttctgtagagttggacttggtacgttcctcccctgcctcccgttgtttcagttcgatgctacagtcaatgtcctcaacaacaagaatggaccggctggtcattccgactagaagccttctgagctccgagttggaatggaccccagtcagctcaagatcatatatgtcaaacttgagatgattcgccatggctgcaatcaagctggacttgccagtccctggtggaccatacagcaggtaacccctcttccatgccttgccaatcctcttgtagtaatcttttctcttgatgaacctatcaaggtcgtcaataattgactgtttcagcttctggtccatggcaagcgtgtcgaatgtggatgggtggtggagatcaattggagaccatgagtctgagtattcattcatgtatatctggagaattctttcctggtcttttatggccttggctgtagcaatgatgaatgggaggtatgatttcagggctttctccttgtgcttcctgtggaagctcagctcataggagcggacctcacgttggccgctgccattgccattgttggggtcagctgaaatgctacgtgagattaagcaccatttgaattctgttccctcatgcatatcaaccagctcttcaccttcctccatggtgacaaccatcttctcggaagattcatccatgctgctgactcgcaggcgctgcatgttgttgttgatgcgtgttgcaaggtaagcccgcaccgcgttgtagacgtggttgtgggaccagccctcagtctcctcgatgatgattgtgtgctgagatgaaatttgtgaacgcaggtagccgaggccggaaaacagcacatcacgcacctcgtatggaaccagctcgttcacgacgctgcggaccagcatcacagacgctgcaacggatgcagcggttgtgatggccttcttgtatgactcgatggccttgtcgtatgacgccatggtgagcaagctctggctcctctcttgttcttcttttgatgaacttctcttcctctttgttgctggtaatggtatgaaaca

SEQ ID NO: 68077 - DNA, 5678 bp, Oryza sativa
  unsure (1)..(5678): unsure at all n locations
ggtgttgatttgaggtagagtttgtggggagggggttttataggtgcagagttgggggcgaatggtggcttcgtctgaaagaaagaaatctgaatactactcctacttccagcttccacagttaggaaaatgacatcaccattacaacgtaatactcctacacatattcacctgggaaagaatgcaaccggtacaaattgtcgatttctgaggcatttgttcttaatctattgcacctttattcctcccagcgtatcttctttactgaagagaactttgaataatgatgttttaactgtcacgaattaagatctcaataaaccaaatactccttgggcagctagaaaaggcaaactttacttccttggcatccaagttttcctctgaaccattctttctgcagggagcagaagagttgtgcaccgcaagtttctgctcgaaatactggagcagaagaatgcccgcatcagtattccagaaaagaatgcccgcatccatctaccacctcgttggctgaatccattccatgtgcgcaaatcgcataccgttccgtgcagacgacggttggtcgacgtccgagtcagagactgtcgatcagcaactttataaaattctgaaaagttccagctgcatgcatataatggtccatttggggaaagtggggggcgttgctttggctttgccttgtctcggtctacgtcgccgacgtgttgagatcgacggaaccgagccccccatggttacaactgctgctgctgctacagctggtgatggattttggaccaaaggggtcaaattgttgatcgcgtagcggcggtggcaccaatcgacgtgttgctctgtggtttgtccggcgactccatggaccattttccttggtgatatcatcagtgagttgagtgggtgcttttattcgtttctgttggtgacagctactcgtattctatccttgtgtaaccgcctctctctgttctcttgtgctcttctgttgtgatggggaaattatctagtacatttaagttcatacagattcctcatgaaactattaaaaacttttgtgagctgtaaatgtattctgggcacacaagtttttcgtgcactcagctcttggggttatggccataagcagctcttgattcgttgatactccaagagggcctattgccaaggcatcgattggatcgtccagcaacgtgcacgttgcacatcacaaacaaattgattgctttcagatcgttgcgctaactgtattttactgatcatcatgcggcgcgcttgaatacaagggtcgacactgtgctgccatgatcaaaacactgtgttgtgttgttttcgggggcacaacgtgtgactgaacctgctaaagcaatcgtggtcgccacgtttaatttgcttttgcaggagagatcgaaacgtgaatgggactgcgtgttgcaatttaaagcagccataaaggaaaactcaattaattatctaaagtgtcaagacaaaataaacaacattttcccttttccctttgggtggtagcggcgccatcgacagaaagagcagaatctagcatgcacgttttttttattttccttttatttttttcctaaaaaacattttttgagcatgtgtggctggcacgttggtttctgatttcttcatcatcaagactgagtcactgacacgtgtgcacctatgcggtccacgtgtggtaatcgcttggatgatccggtacttgtttcaatcgcgtaaaatgaccattcctatttctccctaacaaattgcagtgccatatttaaggatgaaaatattttatgattaaccttacttgcagagtgcatctttggcttgacgcagtgtgattatctaaaagagatttcgcgagggaaaatgacaaaaaaaaagatgtttcgactttgtgaatcttaagatatgttaatacggtcttccaaagacacaggagtagagcgtgagtatgtgttcataaaagtaaatgtgcgtgcgtgattgtattgtattctattttttttaaaaaaaataaaatgatgtcagcaatggcgaagaaaacaagtagaccattttccaaaactgtaaaaaaaagagaaaaggaaaacaagtaggcttgcagatcctgcggtccagcccaagagaacgttagtgtgcgcggcctacctgcgcgtgtcggcctacttcggtctggctgagaaatagtaactgggccaacatgcgtgttgactagctcggcctggttggcgaagacgacggcccaaacgcggagagagatatcgaatattccgtggcccaccaaagccgacaacgaccgcagctcgcttgtcagacatcggggaaagcaatcaagcaagcagcggccgcatcgatcggagcggagaaattccccaactctgctcaccctcaccgttgccgacgacttcgtgcggcggcgaagaggagaggcgatgggagggggagacgccagcggcggcgacgggccggagcaggagctgaagcgggctgctgcggcggcgtacaactacgagggcgacgcgcgctgggcggagtactggtccaacatcctcgtcccccctcacctcgcctcccgccccgacgtcgtcgaccactacaagcgcaagttctaccagcgatacatcgtgagttccaccaccaccactgctttgcttcgcttctcccccctatcaacaactacttagggtaggggatctgacacgctttctgtacggacggttttagttcggggcttcgtccccttcgatttgtgtggtgatggcggtagccgtagctaatacccaagcttgcacttgctaatacatgatggtgtgttgatgacttttaagatggtaccaacgcagatgtgatgcttgctgctaaaccgcttgcttcatgtagctgagctgtgagcacaatctacactttgatgcattgcttgtttcaaccagggttttgttttcagttgatgatgaactcgatgctacaactactgttcagtactagttcatacctctctttaccaaacttcctaaggctaagggaggtttcaaatactttttaatcttgcttcatttcatgacgacgtagcttggcaagcttgcccttggtttcttttgttgaagcaatctatctccatgttaaaacgaaagctacatttgttaagcatcaaaccacagctttcttggcatttatcacagttagaaactcaaaaacaaaaacatgctatttgcattcggtcattttagaatctatgctgttacccatgtacaagtaaagagcaaatcaagatgatggtaaagctgtttgatttccttttgctttcctaataggatcgtgatttggtggttgagccgatgtcatccactggttccacccagccaagcggaccagaagtaaggtcttcgtccttctcatccagtgagaatgtcagggcccgtagttcaggtaagttgctttcagtttaagtatagtacatctctcgttttattctgtcgcgtgtcacatctatttatcatgtgactcattttcatatttaggatcaagttccagatcagctgcaccaccgcccccaccgccacaaacagacagtgctacaaatcccttacggtttgatgcacggaccatacacttctccattaatgcctgggtaagaaacaattcaccttcttcattcgagagaatctattctataccactgagtttgtttgggttcaacaatttgccatcgacattgtctctttctataatataccgacgactttatcaattgttctacgatacgccattgggctagatcttctttccaaaaatacccaaagtacccttagagccatacaaggttaacaattgatttatctcattagaagtttcaaagaaaaatgaaaacttttatgtggcctctttacacaacatggaagtttacgcggcctccttacacaacatggaagtttccagtttttttttttggtatatgagagagagtttactaatacaagagataatagcacaaaaatatcttatgtagtgtatgaaagatgatatataataaaaacaacaataaaaagtatttacaaagcatataacaaataattatattttctttttaaaaaatagacatgtaaaaaacttaaaacttgtatacaaatttccatgttgtgtaaggaggccacataaaagttttcatattttcttgaaacttctaatgagataaatcaattgttaaccttgtatgttcataagggtattttgggtatttttgaaaagaaggcccagcccaatggcgtgttgtagaacaattgataaagtcatcggtatattatagaaagcgacaatgtcgatggtaaatcgttgaactcgaacaaacttagtggtatagaatagattctctcttttcattagcatttgcatgtgtaattatttgtcctgaaaatagttggcacctttagtagtgagcttttaaaaatcaaacattatggtttctgatagatatctcatatattggtcctggtaaccttgatcttatgatcattattagctacagcctacatggccatgacaccctcatatattttcaggtacttgttgttgctggtctggggatgcttccaattttgccaaaacatcttgcagatagagcctgcaaactttcattgctgggaacaatactctcctctgcatactctctatacagcacttatggggtaatttccttgctacttgaagcacgaataactagcactatttttaatcttatttcttttttttttcgttgctgatctgttctttttttctgtgctaagaaaccaagagcatggaacatgcctgcagtccagggttggttgcaagctgtacttggaaccaaggattttatccatttgatgttctctcttatgctcttcacgtctcagttgcacttaaaaagtaatacgtggtttccctttcaagtttgtggttctgacctgtcttttgctcgtttcacatcttcttacatgttatgttatcctttttgtaacagttgctgcactacctgtgttctgctgggcacttgatcatgttgctagattcctaaggcgtaattttgctcgctcatccttctataggtaattgtgcgttccattatcattgaatttcgcctttgcaatctggggcacaaccagtgtgcattgctctgtgattaattccatctttccggtctctcattcaggagttacttggaggaaccctgtctttgggtagagacaaataacactacactcagtctcctcagttcaaatgctgagattgccttgggttttcttctgatcatatcacttttctcgtatgttccttcccctcctccgacaattttggattttcttttgtctggaaagtcatattgtatactcatatgagttacctttgtaccttgcaggtggcaacgtagcataattcannnnnnnnnnnnnnnnnnnnnnnnttatcatttgatcatcattattttgccccattgctttatagctacaacatgatgtaagggcgatttatgctggtttgttacatattatcaaaagattcaagaatgcccattgtcaattttgtttagtcacactttctagttggacatgaccacatgagtactggccagtcgtcagggcatgcatactgtttcagttctagaatcccaatatttttctgccgactccaca

SEQ ID NO: 68078 - DNA, 1491 bp, Oryza sativa
attagatcaaggtggagtcgaaggcggagattgatccgagaacagagcaagaatcggctgaagtctagatcggctacgattaggatcggctgggtctgagtcggactaggtgagctgatgcagccgattctgacagtataatttggtgtatgacattgggttgaattgaggtgcttcaacatgattgtcgtacatggatagagtcctgagaaggcaattgtatctattaattaggatgttttatgtaacttccttagagatatgtgtgggcaaaagtttgccgcaaagacttatggtatcttagagtttgttagagatagtggtcgtgtccggtatggacatatcttgtaattctcgggtataaatagacctcgagccctatgtaatttttaacacacacgttcaatacaatttcggcgcatcgccacctttttgctttagttttgtttcgacgagttcttgctttctggttgagctgcatcagtttcgatcttcaacaagaggtaaaacttgttatgacgacttgtgttctcgagattagtgcttccatctttatgacactctaatcttgtctatataattcgtcaagttatcatatatcttacataatctttggcaatatcgtcatctaacctacaattgactaacatctgttaatagaaggcagccgattaggttaaatagcgacgttgttctcgattatataagatatctaccattttatgaaacactcagcggcttgattgtctagatattgttctttttttatacttaatgctgcatcagttgagtttgatctattaagtcgtgcttagaatatcaatctctagcctgtcctctggttgccaattagggtagtattggagtttcaaccgatcttatctgatttaaccatattcgatctatatgcttcaatgacatgttaaatccgccctttatgtcaggatcttattgcatttaagtatattaagcttttgtttggtatattatatttgttttgatatctttatataaagtagtatcggagtattagccgatacatgctagatctatctgatcggctatgctataaacatatataatcctgttattaatatatatttcgatctaagtgatttatactgtctcggcttggtgaccgatctatcctaatcacttgatttaagtatatattaatataagaactatatatcgttaatatctacagccgatcgaatagatttagttccttactatctatttataaccgccgatcgattcatatatgacatcggctcaaagataaatgatatgtcatcggcacctagccgatcggctatcatttatagatttaaccacgaattctttgtctctatttcttgttgattacaggatcaaatcatctggcacgctcatacattcgaaggcgagctttggacctgcactggagttaagcagatctcccaggcctcgtcttttctgtcaacacgggcgtggggcggtgcgtgggcg

SEQ ID NO: 68079 - DNA, 2914 bp, Oryza sativa
ggtcataatgcagttatgctaggctgcttcttgcttatgctagtactccctccgtctctaaatgtttgacgccattgacttttttaaacatgtttgatcgttcgtcttatttaaaaaatttaagtaattattaattcttttcctatcatttgatttattgttgaatatacttttatgtatacatatagttttacatatttcgcaaaagtttttgaataagacgaatgatcaaatatatttaaaaaagtcaatagtgtcaaacatttaagtacggagggagtataatctataatttgtgcatatatgctggaagaaaagtagtgcaagcaaagcgaagatagctagctgcatgctgcagggagcagaagaccagggagttaaggaaacgcgtttcgtgtggagccaatcgccggccgcttgcttaattacaacttgacccactattgatgaacagcactggctaggatattcacacaatgatgcatgataggatcagtacaagcaagcaacagcatgatatggtacagcaatttccaacgaatttcgatccactcgatctctcaacgcgtatatatatcggccgaccggcgtcacatcgatctatcgtccaaatccaaccgtgtcgcacttaatttcctatatccgcctacgttaatccgcaatataaaataatgattaaacatgttttaggctcatttggaagaaaagaactgtttagtttttcctgaagcatttgaatcctggaaataaaattcatatgaagttatctggaataaagagcatgtccttaaaagttttctatgaacatcctaaggaataaagcattccattacaattttagactaaaacaaacatgagaaagtccaactcatggttttctcttcctgtacatgtctacaatttctttttttttttgcgtgtgtaatccaaacgactgttttgaaatactcttgtgcagttgtgcttctaatttatgtaggaatttataaggcatgtgacccgtgttctttatatttttgtgctttcaaattcgtgtgtttcaaaggactcttagtctcttgggtgcgtttgagacgaggggaaatgaattgtttacagcaacttttttagagattatttttaccaaaagcgtacttcctccgggttgataatacttgtcgtttcgataagggcacggtttccaaaaaaaactactttaaccattattttttattataatatgtacaaaagtgttaataaatatatgattttattaaagtaccttttaagactaatctatacatatagtaaccatattgaaagacaaatattttaaaaataatttataatcaaatattctaaagtttgacttcactcttatctaaaacgataagtattatcagcccagagggaatatcatttaacagcttgaaacgaacatagccacgtcgacgtgtttcaaattcctatgcttgaaagcactttcctgtaaaaccttttttttaataaaaaatacgttgtttagaaatttgaaaagcgtacgcgcgaaaaataagaggtacaagttataaaaagggataaaagaacacacatttaggctctgttcgtaattcccaactccttccgcctcgtttttcatgcgcacgcttcccaaactgctgaacagtgtgttttcttaaaaacaattatatatggaagttgcttaaaaaatcatattgatctatttttaaaaaaaaatagctaatacctaattagttatgtgctaatggaccactccatttttcgtatgcaggagatttaagttttaattagtgttcccaacccattccagctaacacagcctaatgtctctaagagtccatgtcgacattctaaatgttgaataggccgaaagaaaggggtcgagggaggaaacaattaagaacagaagaattataataatttttaggacatgatatgatggagcttgtagttaaatttaactcatttctagaacagctctcctttctgttaagacaactaatgttatcttgaccaaaactatcctggatgccacaatgtctgaacttttgcagaaaaaaaatgataggtaatcacacggaatcagccattggaacgttcttgccacgcgtttttttattttttttaaattttttttgccaacaacgacgcactatatatataaacccaagcaaccagcccaagctccaaatcaatcaaatcgcattccaccaattctccactctccatcctcctctaaaatccatttcaaattcgcgaatctgattctcttcttaatcgaatcgcgaatttcgttagctgaatcaaatcacagcattcgctagctgcacaattcttcttatcggaatccaaaaatgcaaccggcgatctcccaattccccgccgccgccgttcgcctggctggaccggcgctcccataccggcgaccaccacagaagacgacgacgtcagtgacattgaggaagccggcggcggtgaggtcgcggcggcgcgacgacgcggatcagttcttctcgggcggcggcggcggcggggtggtggacgaggggatgatcgagctgcggcggaggatccacgagatgagggcggcggagagcgggtgggagccgccggcggagtgggcggcgtgggagaaggagtggtacgggagctacgacgccgacgtgtgcgcgctggtgggcgccgtgcaggccttcctcatgagctcccgccccggcgtcggcgtcgggatcgtggcagcggtggcggtgagcgttccgaccaccgccttcgtcctcgtctccggcctcctccatgcctcccagtctctcctctccaacctccaacactagaagcttagcttccaagctaaccatggatgatcacacttgtgttctttctagtttatactaatttaattttatctaaaaaaact

SEQ ID NO: 68080 - DNA, 667 bp, Oryza sativa
ctaacgtaaatcgatgtccattaatttagcaaaattccatatatatattgcattgaatgtttgtgaaatataaactgccaaaaatgtttgtgaaatagcaatgtattaaacattgacttgttgataagatcaggccgccttaatttgaaacacaagagttttactggatatattttcattatataatcactatagttctaaattaacccttatgaaattctaaaatgaaattcctttgtttcgaaggagatgtacgaatgcatgtcctcgggacaatgattgggagagtacgagacgatgaggttgtgttaattaattggtgaggttacctcgtagcatgagccgcatcccctgccggcctttgagaatgggacggtgccgcaggagatcatgccgttgtaaggaggcaggttgacgttcttggtcccgcacgcgccacctggaaaaaaacaaaactcacccattaatcgatcgatcgcatagatcatggatgagctttacagctacttcatcggcatggatttagacactgttcaaattccgtattctatcgtactatcttgagacaaagatagtacacttcatgatgagccaggtaacttatattttgaagaggagatagtaacattacacgataagatgttactttaccggtgtcggccgaact

SEQ ID NO: 68081 - DNA, 6396 bp, Oryza sativa
ttttttgttagaataagttcaccgtaggtccctcaacttaacagcgagatttttttaaggtccctaaaccataaaaccagaaatgttcacccctaaactcactcaaaccattcacctgaggtccctcggcagtatttttgtccggttttactgatgtggcatcctagtcaacaaaaaataaaaaaataaatatgtggagcccacatgtaagtgacacaaaaaatgtggggccaacaatcctagtcagcaatctcttctcaatcaccttttcctttgccgcagatggggagcggcagcggcgcacggctggaggcaggcgcagcggcaggcgagcgcggctacggagcatcggtgttggcgggcgagcggcggagagcggagcaggcaggcggcgacgtgcgaacgtggagggagacaaggtcaccgccgccgctcggagggaggggcgctgcggacgtcgtcgctatgggtgtgggaccacgccgtggagctgcccgagatgatggcacgggcggagaggcggcggaggaagccgcatcaacatcagcaacaatagcagcaggggagcgcgcggagggacgccattgccaccgacaaactcgcgagtgaagctcggccggctcggccccctctctctcctctcccgctgctgctccgcccgctgccgccgcctgcctgctccgccctccgccgctcgcccgccgacgccgccactccgcctgcctctagccgcgcgctgctgccgctccccactgcgtcgccgcgcaccccgcctgctgcagccgcgcgctgtcacccgctgccgctcgccctctgcggccgtgcgcgtccaccgctttccactgcctgcagccgccgacgtcgcccctccacttgctccggccgcacgccgccgctcgccctttgtggccgccgactgccgccaccaacgccgcccctctgcctgctctggccgcgcgccgccgcctgctgccgctcactctctgtggccgagctcacccgtagtcggaatggctccggccgcctgctgccgctcgctctctttggccgagctcacccgcagtcggaatggctccggtcgcacgcccgctgccgcccgccgactgcagccgtcgagccattcctcctcctcccccgtgccattcctcctcctcctccgcttccttcctctctgctcgcccgctcgcctgccggccgcgctcgcctgccgcctttcgcctgctgtgtcgcgcgacctgccgcccgcccatcgccgctctgccggcctcactcacattgaagacgggagagaagagagaaaagagaagagaaggagaagaaaagaaaagaaaagaaaagaaaaaaagatgtgcaactgacatgtgggccccaagtatttttattaaaaaaatttgctgactaggatgccacgtcagcgaaaccacccacgtatactgccaagggacctcgggtgagcggtttgagtgagtttaggggtgaacatttctggttttgtggttgagggaccttaaaaaatctcgctgttaagttgagggacttccggtgaacttattccctttttgtttggacaattgtttaggtcatggatatagatggccataaggcccgcccggcacggcacggcccagacacggcccaccagccatcgggccggcacggcccctcccttatttttggctgttacatatgtatagcttaaacaagtctatttttcgtccctcttctttgggctgacatatatatagctaaattaagtctattttatgtccctattctttcgactatggcatatgatgtctattttactccctattctttgtgtgttggacctggttgccgggccggcccaacgtgctagtggggagtgggggccaggcacggcctagcggtcgggcggggcaggcatggccccgacccccgtcggccggaccggcatgggcccgacccctgtcaggctgtgccgtgcttgggtcgggccaaaacgtcgtgccgtgggccaggccgtcgggtctcggcccttatggccatctatagtcatggaccacgtagacgcaggagactaggttcgtgcttggggactcgtgaaaagcaatgacagtatgctgggactgcttgggtattactacggtttttctttggaataagttcaatttaggtcccttaatttgtcgcttagtctgaaatttgtccccaaaccacaatactccctccgttttaggttacaagactttctagcattattctcacacacacacacacacacacacacacacacatatatatatatatatatatatatatatatatatatatatatatatatatatatatatatattaatgaatctaaacacacatatatatctaaatttattaacatatatatcaatgtgggcaatgctagaaagtcttataatatgaaacggaggaagtaccgaatataatacatcccctaacttacagtaccgtattaattttggtcatttggcagtatagtggccggttttggttgacgtggcgagtgggacccatgtggaccctacatgccagctgccaactcttcttcctcccaacatattctctctccctccctcacttttctccacacacatcacctgctcgagagaatgtctgtgaagaaaaatctccctaaccgctgaaaaatatcttcttcatgtcttacccgtgttcggccgtcacccgcatccttgccagtcgttgcaccgcccgctccatcgccatcatgcacctttccacacagcatcgtgccgcatgaactccgtgtctatcgtcaacttcctctcgttcgcttctccccactgccgcacgagggacgatgatgacgacacccacagcgacgaccgtagcgattgttaacaaccaaatttggtaatatcggcatcgggaaagaagattagatcgaagcaaagtcggaggcggagatcgagttcggaaacagggcaggaatcggctggagtccagatcggctacgattaggatcggctgggtctgagtcgggctaggtaagccgatgcagccgattccgacaatgcaacttggtgtatgacgtcgggttgagttgaggtgtttcaaggtgattgccgcacatggatagagtcctgagaaggcaattgtatctattaattaggatgttttagataatttccttagagatatgcttgggcaaaagtctgccgcaaagacttatggtatcttagagtttgttagagatagtagtcgtgtccgttatggacatatcttgtaattttcgggtataaataggcccgagccctatgtaacttttaaacacacatgttcaatacaatctcggcgcatcgccacccttttttgctttagttttatttcgacgagttcttgctttcgggttgagctgaatcagtttcgatcttcaacaagaggtaaaacttgttatggcggcttgcgttctcgggattagtgcttccatctttatgacactctaatcttgttgatgtaatttgttgagttatcatatatcctacataatccttggcaatatcgatatccagcctacaatcgggtaacatccgtcaatagaaggcagccgattaggttaaataccgatgttgacttagattatataggatatctaccactctatgacacatccaacggcttgattgtctagatattgtccttcttttcatacttatagctgcatcagttaagtttgatcttatgagtcgtgattagaatctcaatctctagcccgcttcttggttgctgattagggtagtatcggagtttcagccgatcttacctgatttaactactttttatcctatatgcttgattgacatgttaaatctgccctttacgttaagatcttgctgcatttaagtatattatgcttttgtttagtatattatacttactttaatatcttaacatagagtggtatcagagtattagccgatacatgctagatctatctgatcggctatgttatgaacgtatatagtctcattattaatatatatttcgatctaagtgatttatactgtctccgcatggtgaccgatctatcccaatcacttgatttaagtatatattgatataaagattatatattggtaatatctacagccgatcaagtagattcagtccttccttatttattaatgactgctgatcgatgcatatatgacgtcggctcaaaaataaatgatatgtcatcggcacctagccgatcggctatcatttatagatttaactgcggtttctttgcttctatttcttgttgattacaggatcaaatcaactggcacgctcatacatttgaaggcgagctttggacctgcactggagttaagcagatctcccaggcctcgtgttttctgtcaacagcgatgtgtcgcgtcggccagccgcgccacgcccgcgccttcaccccgctgttgtggtgtcgttccctcaccaccgccgcactatgcttcggccgccgtcgtcaatccttcgccatcagtccccagtccactagcagcggaagcctggatgtcgagggcatggcgctggctgactacttcttcggccccgagttggacgacttgatgcagtggctgggcgacggcgacgtcggccggaagggcacgctgccaactaagaaggaggccagggagacgatgccgacggtggaggtgaccgccggccactccgcatccgccttcgcaactgcctcaaccgtctgtcgtgaggactacgccgttggcgagcacgccacggggacgccctacaggcacaggttccacgcaagtgcattgtgccatggctgaagatgcacagctcgtgccacgtcttccgcttccaactcccaaccgacgacgacgaccctaaggccgcacgcggcaacaacgacgcccacaccggtgagaagtcgtcacggttctccagttcgccgccatacaccatcggccgtcgcttccaaccagggtcaatcccctccggtcaaaatccgacgtggcgccacccaattagacgttgtttcaatgatacgtaaggcccacaagggttattattattatttttcctttgcgccatgtcaccaccacttcagccaaaaccaccattcaaaaccgccctgggaccttatttggattggttttagaagttaagggacgcgtcatatctagtattatggttcagggacgaatttcagactcggtgacaaattgagagacctcaagtaaacttattcctttttctttttcggccgtaaatgaaaccgctttgtaactttggttaccaaagataccggtgaaagagaaatgccgtaaccgagctgtttcctgtttgctataagaaacatttgagaggagaaaaagaacatgttgctgccgaaaatgaaaggtttctttctcgtcaaagagtgaccataaacatttcatagtacatatatatgtcagatttttcttttaggaaaagggagatatattactcatggggaacatccacatctaaaagatgtgaaatgaaattacaattgttatctggccagaaagcggttaaagactcgcttatacctttattagctaaaaaatgactaacaatgttctgatcacaacgaacttttgtgagtttaatatcccttcgtccagtcacgaggctctgcacctcctcgactagaaatcccatctccgagagcactctctgcttggatcgtattagattcatcgcctcatggcaatcggtttcaaccaacaccggtagcagcgtccactgtaacgccatacaaatcccttccctgcaagccaatatctctgcttccagcggttctccacatctatctagcttcccacaagctacaaagataaccttcccagcaccgtccataagaacagcaccaataccacctttgccatctctttcctcaaaagatccatccacgtttagcttcatccaacccgcaggtggcttctcccatcgttgtttcttcgcagcctgttgggactgaggtttccttcttctattatgtctagctaactatacatttagctacgcaaaatctatttcgagaggcatctcgatttagacttaactagcgacgcggacaattacgtgagaagtactagtagcgttacagacatgcatacaagtagtttttctattaggttgtgtatttttttttcttacgaaattttctcttaaattacttatccgatctataatccgattacaccgttgtgttcgtaacaattaaatctttacaacaagatctcacatgattatattttgatgaaaaattacaaattactcttataatatgtctaaattacttttagattccactaagttacttcttagacataccaaagtaaattcagtaaagcctaaaagtaatttacatataatatattataga

SEQ ID NO: 68082 - DNA, 748 bp, Oryza sativa
ttcctgcagccctcatgtaaaaccatgcactgtttttgttctacccgtgtacgtacgacctgtgaattggcattgcgcggcatatacgtgtgcatgtattatttgttattggatatttttgttaataaaaaaataattaatctagataaaataaattgataccatcatcgagggttgtaagaatgtgttagtctagctaggaagagtcaaaatgtttaaggactttcacgcacagctattattatagtacaacttacaatttgatcggtaattgatcacttataatcgaagtacatattatacccctattttgaatgatgatcaaaattgatcagaaactgtgacgcatgtcatcgtctctcgcaggcgcacaaataagatccagcgactgcaccggcaccatcgagcataaattagactggatcaagtctcaaccatgaaattatttaaaaccctttctaactttcataaaatttttaattcgtccattcgttgctagtatatagtgacagtatattgtacttatgggttctctaattatttgatgctagcacgctctgtagatattttatctgtacagaatactgatcacgggatgttacattaaactacctgagattaatgatgaaaattacaccttataatccaacaaaactagtactgtacgtaccaacagtattttccatttctaagacacgacacttcgtcgaaaaaaaaaaactgtgttccatacttgggtaccacacgt

SEQ ID NO: 68083 - DNA, 665 bp, Oryza sativa
agatgagatatcaaatctttgacgggttgcaaatttaacacccctcacaggtgaggtcaaactagtaatgggctggagagcaaccccgtcactacctcacctgcgacggcttaaaattctggcccatcacatgtaaggtgatacatgtgacgggccacggccggatgcctcaccgatgacggcaaacctaacgacccgtcaaagatgacggtcatctgtgaccaatccttaggcccgtcattggtgtgccgtcacagatgtagggttctggcgtagtgacttaaatagctaggtagacctatattgtacccatcgaattgatagggattagctgcattgtaatctctactcgccgaaataatacaagaagcagcacctggacgtacgtaaactcgactacgaggttccgaaccagtataaactccgtgtcagctgtgattgctcttcgcaccaagcacggttcacaacgatccaaatattacgtgtctactgtgattactcttcgcaccaagcagagtgcacaacgattcaaatatctgccggtctaaaacagcgacagaaccatgtcaggtaggggatctaacagcgacagtaaaacagcgacagaagcgcgtcaggtggatccaggcgacgacgtcatcgtcacagtcggtggtgggacccaa

SEQ ID NO: 68084 - DNA, 550 bp, Oryza sativa
tggtggggctgagcccgctgagcgagacgctgtggcggcacagcaagacgatgcccggggcggcggcggcgctcatcggcgacgtgtcggcgaggctgacgtggaaggacctatcggtcaccgtggcgctcggccccggcaagacgcagaccgtgctcgacgagctcaccggctacgccgagccgggctcgctcaccgccctcatggggccctccggctccggcaagtccaccctcctcgacgccctgccggccgcctcgccgccaacgccttcctctccggcaacgtcctcctcaacggccgcaaggccaagctctccttcggcgccgcggtacgcatacaaaaatcatatactcatgtagtactccatacctagcttcttgcttcacttgttttatccaacaaaatcccatttctaggaatcaaaattgtctcgtaccacagcccttgctatactttactgtctccttagctagataagttcagtcatcatccataataagtatccatcccgtttcagcattaatagtcaagctaactaacgaactag

SEQ ID NO: 68085 - DNA, 544 bp, Oryza sativa
aaaagaatgaaaagatgacagagctagctaatgccaatattattattattattatatattgtgccagaagaaatatatctttcaaaatccttttatctccttgcaaaaagaaaattcctcttagctagaagaattttacaactttctttttttggaaaaagatcatttttacaacgattttcgatcaatcaatcacgaaatgatgagaagctttcgttttctttcgcttaatttgttttgtttcagacgagggattaagctgtcgtccaaccaattaattaatttgctgttcccccgtttccctgctacttacatgatacactacgactaagccagtactaacatttggtgagaaattaagtgcatacaagaattaattaattgacgaaatgcgcgttgcatacgcttttacgcgtcttgcacatgcgtgcgaacgacatttacgtacgtagtaaacgatcaccgtcgtttaattatgagcaagcaaaaattcttattatgaataggtaactcagctccgacgaacggcgacaccggctgatta

SEQ ID NO: 68086 - DNA, 8581 bp, Oryza sativa
  unsure (1)..(8581): unsure at all n locations
tctctcattcaggagttacttggaggaaccctgtctttgggtagagacaaataacactacactcagtctcctcagttcaaatgctgagattgccttgggttttcttctgatcatatcacttttctcgtatgttccttcccctcctccgacaattttggattttcttttgtctggaaagtcatattgtatactcatatgagttacctttgtaccttgcaggtggcaacgtagcataattcannnnnnnnnnnnnnnnnnnnnnnnttatcatttgatcatcattattttgccccattgctttatagctacaacatgatgtaagggcgatttatgctggtttgttacatattatcaaaagattcaagaatgcccattgtcaattttgtttagtcacgactttctagttggacatgaccacatgagtactggccagtcgtcagggcatgcatactgtttcagttctagaatcccaatatttttctgccgactccacatacgagtatacagctagttaacatttcaattaataaccgcatttgtcttaatattacttttgatcattttgaaaataaaaaacagttgtgtcaaatatactggcgccctttccatttctcaagtaacttatattgatgtcagtacgtattggtgttctttgcatgcttgcctgttgtgcaggtgttgaagcagatgtaccatgctcctgtaaccgctagctaccaccagagcgcgtgggcgaaaattggccggattgtcaacccgtacatccatcgctatgcaccattcctcaatacacccatttctgcagcccaaagatggtggttcaggtagcaaggctgaggacagaatcacgatatttgcagatctgatcatgcggagaacttatctacaatgtgttttgaagagctattacaaacttagcacgccgttgctctcgtcatgatggagctgtgcatcataaaaactcctgcaagtagttcccttttgtattggcttatactttgaggttaacattgatgcaagaacggtgttataaaccctggagggctttttcaccaccgtaatgctcgatcagtgatcacgacgatgttctatataattcctgccaaactcaggctgacctgtatacaatggattgctcttagattgcatcatctattcatgagtggctatgaaatactccatccgtttcacaacgtaagttattttagcatttcccacattcgtattgatgttaatgaatctagacatatatatctatctagattcattaacatcaatataaatgtgggaaatgcttgaatgacttacattgtgaaacggaggaagtaatgagttgtgtttatctgttgtggcatatctttatgctctgttctacttctagccagggaccgagtgacggtcagaatgcacaacacaggcagggcaaccgtttcgcccttctcccctcagcctccaggggcaatgatctctctggagggaacacctgcatttcctacatgaaagagaggtcaaataatatcgaagaaatcacatgggtgcagaactgcattttgccacaaccagacaggcaggtagacaaaaccattacacggtcagagataaattttgggattttgtttgatgccagcaccgtttccattagaagacgatgaaagacaaaacaattacatgttcagagataaaatctggcattctgtttgttgctagcactgtttttgttacatgttcagagacagtttaagggggttgcagcacgttagaagttccgagacaattttgcagcaaaaaggaaaattttgctttaaagaaagttattagcacataagattgtctgcaaaaaggaaaattttgtttttaagaaagttattagcacataagatgtttagacaattttgcagcaaaaaaacaaaacatatgttgctgcccaggatcgaactggagaccttcagtgtgtaagactgacgtgataaccactacaccacagcaaccaagctgtctccataatgaagtttgtagttcaaatagatttagatccaaacatctgcaaatcggaatatctaacttccgaaactccatcgcaaacaggattgctcgtgcggaattcctctgtgacagacagtttttactcactattcttgaggaaaaggaaaggaaaatatctcgcgagaaaagatcccaactcgttttctttcaccctaagatctttctgcctgtccatgtccaaccaaagaagagtctgagactctgagttggatggatagggtccccaacccttcttcaccaatcaccacccccatctgctgccattgctgttgcaggccagctaacggaaggcccgggcgacatgggtttgcagatgatgcgtggtaggccctgcgccccgtgctgttcgtcctcctcctcctcctcctcctcttcctcctcgtcctggatgccctccaagcatcctcacgcgccatgtgagttaccttctgcatcttccttttctttccccccactgctatagtattccccaggcggaaaaaataacttattttttatgtaaaaatgcattggtactttgagcaatttgccagcggaatctaaagttccaaacttctaatgcagtgagtcgaaggaaaatctcatctgagtcacttagagcattggccttgcacctcttgcccaaacgtcggaaataccaaaatggggatatctcaaggatttcagcatcttcgtccggtgtgcttgaaatcaccgagaacaagtccaataacaaggtcctcacttaaatccgtaatccatgtacgactcatttttgtctgttgataatgattgcaacatgaatttcaggctgatgcagaaagaaagatccttgatgatgctcttgacagaaagccgcagattgactgggttgaagaagatatctcttcttggatggataagagttacacaagcagcaatttggagtataacttattaatgcaaaacattcaggtcttagaaagtagtttggctggtaaagacttggtaaggctggaaagagatatccttgtacatatcgaacggctgggagcattgaaatcattcaacgcgtctatctccagggccactctaacacaaacatatgaattagagttttcacttcctggggatattattaagcttgatccagagattcctctcgaggagcaaaatgatgtggtaattgttcgaagtgggaaaagtcaagagaggaaactgaaaagaatgaaagcatcagaaaagggctctcgggtctccgtgaaaacaccctcacgaaaatcaaagaagtccagtagtagtcaatttatagctgagtggaaaaactatccaggccgaagaaggagcattgtacgagaacaatcagcattgctggttactatcaaggtactcttcatcatcagcatatttattccttttagcagtcaatctattatattattaaaggaatagaaaaaggagcctccacgttcgctctcatggcctagaaattctcacattaatcggagaaaaagaaaagacagagttcatatagaaatacaatttagaaatagctaaaattaaaggaatagaaaaaggagcctccacgttcgctctcatggtctagaaattctcacattaatcggagaaaaagaaaaagcagagttcatatagaaatacaatttataaatagctgaaatttggaattaaaaaataaggaatattagaagaggagacatagaaatacaatttagaaatagttgaaattcggaattaaaaaacaaggaatattagaagaggagactagagtccatatagaaatacaattaggaaataactgaaattcggaattaaaaataaggaatattagaactagagtccatatagaaatacaattaggaaataactgaaattcggaattaaaaataaggaattttagaagtagagtatagagtccatgtagaaatacaattaggaaataataaaaatttggaattaaaaacaaggaatattagaagtagagtatagagtccatatagaaatacaattaagaaaaaaatagaaattcggaattaaaaaataaggaatattagaagtagagtatagagtcgatataggaatttaaaactaactaaaatttggaataaacataataaaattaaaagtagagatataaagatacaatttacaaataactaaaattgcaaattaagaaaaacatgggaagaagagtttaaagtcaatataggaatacaatttagaagtaactgaaattcgaaattaaaaattaaagaatattgaaagatgagtttagagttcacatagaaatacaattagaaataataaaaatttaaaaataaaaataaataatattagaagaagagtatagagtctatctagaaatacaatttacagaaaattcggaattaaaaaaaggaaatattaaaagacaagtctagagtccatataagaatatatataatttataaataactaaaatttgatagtaaaaataattaataactaacacttaatattatataagatataatatgaatattacccattagtagttttgtaaagttattgcaaaatttaaaattatgttgtcattttaatatatttgaataatataatgaggaaacatatatgctattatatgagagaaaatataatgatgctagccgcgcaatctgcgcgggccactgtgctagttattgttaaccataacatatccttcatggttttattcttactgttctctaggagtgtgcaaaccttgagaaaataagagaaaacttgttgaaggatgggagtgaagtcagccatgcaagctgggccaaggcagctggaattgatgaagcattgttgaggagtaggctgcaagaaggttactgctgccgagagagattactggtaaccaccgagtggctagtcaagtacattgcaaagacatacgctggaatgggaacagcttttgaggatctactgcaggttgagagataacatatttattgagaaaaaggtagactacattgacaacttccattttacaatttgatttgttggaatgacactgcaggctgggaaaatgggtgtccttaatggagctgagaaattcgacagccaaaaaggatgcaagttctcaacttatgtgaagtactggataaggaaagcaatgttagcacttcttgctgaaaactctggagtaatccagctgcccgtatgcctctgaaactatcttgatatgcttcactttgtttcatgagaaaaatcattgcttaatgatgtgaactggcaatgcaagtgtaggcaaggatggagggtataattcgtaaggtcagggaagcgagaagggcgattcgctacaacacagggaggaacccaccagatgcagaaatcgcagccctcatcggtgtatcagttgccaatgttaggttggcacggaaatgctctcgtcgagttgtgtcgctttacacagagatcggagttggacagaatgcaaaatttgtggtgagcctctcagccctgtgattgaccgatgataaaaaatgacaaatagttcttccatcacccgttgatggtttattttgacgtatacaatctgaatggtgtttaattgcaggaagtgactccggacacatctttagaagctccagatgaggctatgttccggatgcagttgagagagagactgcttcatgtcctggacaggctccccccaagagaagggcacgtactgaagctgcggcacgggctggaagatgggaaatgcaggtccctggagcagattgggagcatttaccatgtctccaaggagtggataaggaaaatagagaagtcggccatgtccaagctgaggaacgacgacgtgcataatgaactcaaggacttctgtggattctagtgctcctgatcgagctttcttgtgcatatagagctctctactttgcatcaagtacacatgattttcacaagggttcctttgcttcaggaggaggaacaaggatgcgttcaacgagaagttgagaactgtactgatgatgttgtgatagcattcgatagaaagttgtatatatcgcataacattacaagcatttgtttacctttttattttgaaaatttacaagcatttgtttcagacgaactgttcagtatagagcagatgtaatacagaatgtggatcatacattgatggatgtatagtgcaaaagaaatattgccatactgttgactgttgctaaaaatgctgacaattatatcaatgttttgaacactgatcttccatgatcttatttttgtttggtatttcacttgcgccagactttttatctcatctctttcgattttttgttcgtaggatcttacatcaagattcatgttgttgtagaccaaattgtaattacacacaattacttatacttagttatagagcatttacactcagtttcaatgcactaaaattagattttacaactgtttttatctttagatttatgggtttttgacatgtttatattttttatttattcagaacggtttatattcattgattgggttaatggcttaatgcttaatgctctaaatattaatagttaggattaaatgtaaatgtcaacagacaaaattggtgtcgtggtgtangttgngtttaaattcccaaaccccggtttttccaaaagcctaacacactgaaggtctccggttcgaacccgggcgacgccatttttttaatttctactttctttttttatgcttcgattacagagcaggccggtccatgacacgaagcacccgcgggccggcccacaggcccatatctacggccccagtgtttcagcgatgatgatgacatggctgtgatgtgagccggcaagtccacgtctgcagtttgacatctttgtccatccctttagccaactgtggaggtaattagacagctaaataattgcatccacaaagctttgagaaatgctgtagctcaggtggcgatgcacagtaggatcctagtgtgttctgtgcgtgttttttccagcatgtggctgaggaaagcttcgcctttttgccacctcaccaaatgtattagaggagctatccttccttgcaagttgcaaccacaccaaaagccatcatcagccatgtaataataatatgattaagcaaaggagacagggtagctcacacatcactgtcactcaaaaggctctttctgctatgtgtccaaacctttagatcttgttgtacatgtgtgtgtagccaagccaagcagctagcagctgcatcatgagcatcgttttttggccaagaaatatactgattctagatatgccttatccggatcataagcttgctcgacgatttgtcatcacatctgaacatctctgaattaatctgatgcatgccgccgtggctcctctatctccactatctcctgtttcagagttgaaaccatttaggcagctgtcctagctggtgtcttttgctcatggattgtgacatgtcataggtcattgttcaagttatcaagtatgggtgatacatctagtccttgtcctgttagcatttaacctttctctgatggcaatatgtcctggttattggcatgttgcttttgcaaacagtgcacaacttgtcccccaaacacaaccagagactaaattcctaccaaagtgctgatctgaagatacctgaatatgtagtacccgggaacaccaggataccagatagactaattggtaaacacacatcagaatatcagatattcagcataggttgaggacagagcattttgagaccttctttgcactgtcaattgcacaaaattaaagcaagcatgtaggtattgtgaaagaaaaggagagggcaccatggaagcaaaaggcttccaagttggtactatgaaggagagtgaattgggacgagatggacatgcacctaacatcgatctcataccagattaaggattgtagggcctgagcgccatacagtgcttcaggcactacagattgcttgccaatcgccattgacactgcaaccacattcttgtcgctagtgctgtttgctcgatcagtggaaggatatgagtcataccgcaaacaaaatgattcagatattaaggacactatatacatcgctgcaacaaaaaattctattgatgcagcagagaatactaagcatggtagcattgcagatatgcacagtgcttgtgaccatacaatgggtggctacatgagacaatgttacaagattccaaacttttgtctacaacactgtccccatggctgtcaattagattcagcagcaagatggttggaacttgaccctgaggataaaatttgttaagcatcttgggaatccagtcgatggatgaccacggcaactgatggtgctaggttccgatggatggcgtggtggacagggacatgcccagctccaggtccagcggagagcaatggtgactagtgccgtatccatgaccttgttgtgcttctgaaactgatggtgtttctgacgaaggccacgcactgtcacctgatttgtggtgcgaaacttggagagacagagaagcagagatgtagatgttgcagcgagtggcaggatc

SEQ ID NO: 68087 - DNA, 10580 bp, Oryza sativa
gtcttcggtgcgcagatgggcttgagtgatcaggacattgttgccctctctggcggtcacaccctggttagtttggctattaaccattgtatgcctctgcagtatgtaggagtacatgttctaatgtcggatttctgtgctttgttctgcagggaaggtgccacaaggaaagatctggttttgagggaccttggacaagaaaccctctgcagtttgacaactcttacttcacgtaagcgatgttacgagtggttgaattttgttcttatgctgaacaaagttggtaacaaaaatgttgaactcatctctccgcgacgattttaatagggagcttctgagtggtgacaaggagggccttcttcagcttcctagtgacaaagccctgctgagtgaccctgccttccgcccactcgtcgagaaatatgctgcagtatgtctcctatcaatcatcatcttgtgttccacgttttgcatcttgtgttcctcgttttgcagagatatgccagaacatgatactgattgtgttttttttccccaattctgctaggatgagaaggctttctttgaagactacaaggaggcccacctcaagctctccgaactggggtgagtaatggtttgtcaatccatttatcgtgttatctttcatgacaacaaggtcatggtagctaattgtactcttgtgatttcaggttcgctgatgcttaagaggtttctagtctactactgctagtacattgcccgtggtactcttgttttgcatctaggctagggccagtgtgaaccagcagactaccactgtgagtcgcctctgtaataaaatttgttcggcctatggccatcctcagtacgttgtcaatgtctcggtgggctgttatgctcaactgcaatgctgcatccactgaaacctctttctagatgtgttggtatgaaatgcggtattgcgttcccgatttcccctgctactgtcttgaacctgccgtggtacaatccttgtttgctgcacttcatttttagttcgttctaattccgcctggaatgacttttgagtgcttcacgggctgactgcctgaccgtgttgctgtacatgcctaccccatcagttcaaaaaaaaacaatcctacctacgaaattcgttttttattgggacaggacatcggctgagtttaatttcaaaatttttcaacaaactttcaacttttccatcacatcaaaactttccctatacacgtaaactttcaacttttctgtcatatcgtttcaatttcaaccaaacttttaattttgatgtgaactaaacccacccatcattggatggacttggcaaaacatggcttgaccattgagatcgttttggggattttgttcagtcagctcttccatggtgtctatcagaagagttggggccgtacaacgcaaattatttcccagatggtgttgatatcatcaatgatcatggcaatttggcaaaccatttcttatttcccagatggggttggtataataattaatcatggcaaccccatttgtttggtgctaacttgatgaaacatgaatgccctcaacctcaacagatgggctccagtccggccggcgccggccagcactcggtcaacacaatatgggcacgagtggggctcaaggaagtgtggggcgcagcacaaggagccaagagacaaggagtcatgttggtcctttcagtttcaggcaaaaaaggaaccgaaaggagccaaggatcggaccctttcgaagcttttttgaccatttcgtccgacttgcaaggcaggcccagaaacaaaaataacccaactgtctagtggtaatatcatttgggatctgttaggattttcagttcgaagaaactgtcctgattcagagttcagacaaaatacgccttcagtagttggtcctgccgcccctcgtagtttcactatcgaaagggatcgctgctgtcgtaatacgtttggttttggcaatacagaaatcaatctgctcgcaaagtataatatcataatccaaagttccaaacccttttattcgaacatagtaccatatatcatacaaagcagccacaacttgcagagaatgtgggtttcgaacatcaacaaacaaacaaatgcaatgttcagtctacccggctctcaatcttgatcatatgtacaaagcaggtatagacgggatctcatttccatggtgattcaatctagtaccggatgtttgggttcatctcgatcgcttcgttgaagatcagctgcttcatttggtcctcgtttagagccttctgctcgaagtcgaaggagaagggctccaggcagatgggctcatcggcgatgtcgtgcaatctctctaggtaaggatgatcgagcgcctcctcaactgcatgtcaagaacgatgtcagtgagatatagttcttaagcacaaatcttctgtcatccttctaaaccactctgctattgtctagtgtttcaaaactaaggtctactgaactctaaccgacagaggctgcaaacgtgctacctattctacttctgcactactacacagtaaagtaacacagtcttttatcgtcacttgagcaacatgcaaaatcgttggtagccccaaagacagctaaaagacgggttccctttaaagtgacgagatcaagagaccgactgttcacggcaagtaaacataaaaatagttggggatgggtcaaacaccggcggctatatacgccagtcaaagaagcagtgcgatagaaaatactagtgctatactagcacacatgcagtagcatactgaacagggtactgtacacagtacacactcagctagtaaattagtacttgtaattttgggtactaattttagtagtttagaagcagagcagcaagcacgagttgggttagccctctgcacgcacctgtgattctctgcagcgggttgaaggtgagcatcctctcgatgaggtcgagcgcggcgggctgcacccgcgggaacatgctcgcgaacgtccggcgcgggtactgcggcaggtgcctcatgtacttcctcgcgtcctcgttccgtatgaaccccagctcgtcgtccgtcggcgtcccgatcacctgatcatggacccaacacgatgagacccaagaacaggtagcataattcagcgtgtgagtgtctacgctgattaattcactcacctcggtgatgaggcgcatctggtgcatgtggtccctgccggggaagagcggctggcggttgatgagctccatgaagatgcagccgacggaccagacgtcgatggcggcggagtagtcggtggagttgagcagcagctccggcgcgcggtaccaccgggtgaccacgtactccgtcatcatgtcgctctccgacgacggccgcgccagcccgaagtcgcagatcttgaggtcgcagttggcgttcagcagcaggttgctcggcttcaggtcgcggtggatcacgttcgccgagtggatgtacttgagcccccgcaggatctggtacaggaaatactgcaacaacacggccgcaatcatacatacgtgacatgaggaagatcgaattgatgtttctgcagctatcgattgattgtgtgattgatcgatatatgaaaaaaaaaatcattcgctcacagttcactcacctggcagtgctcttctgacagttcttggttggagcggatgatgtgatggaggtcggtgtccatgagctccgtggcgatgtagacgtcgttgaacgcctgagggatcggcggcgggatcacatccctgatgcctatgatctgcgtgttgttgtagcagttagtgacagattaccaaattcaggtacacgccgctgcgtaattaaccacgtagtcttcagttccactactagttatagcctaataggagcttacgttctcgtggtcgaggtgcctgaggagcttgatctcccggagcgtgcgcttggcgtccatgtcgttgttgaacgcgttggcgatcttctttatcgccaccatctccctcgtctcaaagttcatcacggagctgtaggcaccagcacacggaattcagaagagaaattagaaaaacaaagcaccaaaaagtactccgaatagacatgccaaccagtcaaccactacgctgataataactaactaaaaacctgctcagctcagctgcagaatcaaattaatcatccctgctctaaaaacaggggattagtaattggtcccaattactccatcctctcaaccactcatcgacgcgtatcaatcaatcaaaaggaactgacgaaggatcgattaacatggcaagaaatctagggcaggcagggaaaagaggaatcggcgtgtgcgtaccagacgatcccgtaggcgccgcggccaatgggcatgatgggcggctggtacttgttcgtcacctcgaacttgttcccgaagatgtcgtagagcaggtaccggccgccgtgcgtcatcgtcggcctgaactccgccaccggcgccccgtccatccctaatccctcctcctcttctctcgccgcaagcagccgaattgacaaacctaattaacgaccttatctgactctctctcgattcgcagagacagcaaggcgatgagggagaggggacgagaggcgaaggcagctattaaaaagggaagggggcggcggtttgtgaattggcacaatttgtgatcgctgctgctgctagtggctctctccccgatcgagcacggagtcctcggtccggatgaggaaggaaggtggcaagaaagccagcgaagcccccgtagactctgcaccaccctgtacccgttttcgcgcgtgcgtttcgtcggcgggtacagcggacggcgaggatggggggagcccgtggcgatcggacggcgggggagggcgttttcaacggtcaaacggcacatgcggcagccacgccacgcaccaaccgtgaaactgattggcgacgcgggggggtcacgggctcacgcgtgtcaacgggggggaagagatgctagtggtgtactgggtgtggtgcgtggatttccggggtgggcgatggggacggaccgacggaggcggacgaagccggacgcggtgcggtccgtcgggttgggttgggggccggccgatcccccggtgttcagctggtgggttatgggtaaaaatgttcgtggaaatttccgatcaaccgaacatcttttctgtataagaggtgtcacatttgattgtatcgtttttagctatttataattttttgtttcttttatttttttacatcaatactaaatagtttaaatgataagtataattaattactagtcgatcgagaggatcaattttttaaaggagatgctaccattccgaccgttttcactccccggtgatacgccgtccgtttgccgcgcgactgctttggtgcggacgcgcgcgttggtgtcgtttgattgaccggtcgcgtatgcgcccgtgtgtccacagcgggttgagaacctggcgtgatgctgcgtgtcgcgtgagcgtgactcgtgccgtggaataacctttccgtcgggttgtgcagggtgtcgtgagcgattcgttgccctgctagtacttcaacgtgtagttttcgccgtttttattggagttgagaataccctgaaaaaggttggtaagtcgtgagtcgtgaccaaagtagtaacaacagcatcaagtataacgccttttaggttaaaaagggaacggcaaaagtggatggagaactgacgtgttaagtaaaaacagactgacgctttactgaaagttacccactgattgttattgactcgtggctcctatttaaccatagaaacgaaacggtcataacgtaagatttcaggtggaagcgaagcacaacatcctcctttcttccacagtgaaaacgatcgatttgatatccacagtgagcgcttggtccgtaagaccgtaaactctggacttccacgaggaaatgagtcgtccccgtccagtcctccacggaccacggcgacgcaacgcacgccacgcacccttttccactgaagctgctgcgtaagttcagaagaacaaattcagaagaaacactaggcagtgtggtaagcagatgatgtcatcaggatcaagtgccaataataaaaaccagagaaagcacagttttaattcacagtcgatacgaagcaccgaggatgatacttatcactggtaactctgtgaggagtttgcgagagaaagcgacagggcggctcgatgcagatttgtttttcaaggagttgatggtgcagtgcccccaatttggcacttcattatcccaagtaattaagaagaataagagggctcggtcgatgagcaatcgtgtactactaaccaattgatgtgtactagactactaatggcccagatgattggaacaaggagggcttagaaaccgaggtcacatgattgcgagccgagccttttgctatgctttgttacgaacaatcatacatgcctggcattcttatttggtagattatgatattcttattgagtagtaatagacttataagagatgtgacacccgtctgagttaagaatccgtgaaacgcgacaacatcgaggcccacggagaatgatttgcttgatcgatagtaaattatcaattcgcatcataatgctcagtatttttcaggggagtgtttaatgttcttaaggggataatgttttgtattagcagcgtgtaggatgaaccttttcttttctgaaacgccctaaaatatgctgctccgcagacgggattattccccaataggatactgggccaatgaagttgacgggatactccggctcccggcgatattgtgtagggatagattccaggcttgtttctcaccaatagaaaaccacactctcatttcgtgtaaaagaacagaaacacgagaaaaaaacgtgtctgttaacatggatgcacgcatgcgttgccacgagggaacatgatatgcaaacttcaaggcagcttctgagcgctacaccagcaacatttagcaacaaagatgaaagagaactgtctccaggaacatttagcaacaaagatgaaagagaactgtcgtcaacgttgttcagcgaccaaagcaacaaaagttgcaatctcagggtgataccagaccgcaaaaacaatgcaggctaatagaaagttcatcgatccattacacaccaatagcaatatagcatagccccaagggcaccaaatcctttcaggtgttaagactccttgatctcgtcttaaaccggaaatataactattacaaccatagcatgaccatccacaagatgaacgccagagactgggattaaatttcaagcttcaggggactcgcttgctctgggcgagcgtgagccgccacggctaccaccatcaccatttccatccctagggctcgggctgccgttgtcccttgggcttcggctattgttgtccattggactagggcttccattgttccttgggcttgggctgcgcccattggcagccacagggctacggtagccgtcagatgggctcctgctgttctccctgccccaggggctgtcaccattgcgctcatcattatccttgggtggtgggcttacccgatcctgtggactccttggactccgcctaccattcgggctggggttgcgctcctttccatttgctgctggggagatggatcgcctgggacttctgctgtagctaagactccttgatctcctatcatcacgatctctgcgtcccctgggagatccagatagggatctggacctagatcggctgatagtaacaaaaagattgtaaaacaatcaggccaagggaaaacaagtaccaggtcaacaatagcatatctgcgatttgaacagacagcatggagagtaataatttgagcaggtggcttttgaagcatacctgtaactcctgctccggctccggctatagctacgactacgaccatgaccacgtccacggcgtggcgatggggagcgcgaataacttctctctcgcctggaaaaccaagtacgtattggagaagtcttgagtaattcaaacatagtaccttagaacagagtgctacagtgtatctgaccaacggtatcaatcaatacctgagatttcttggactgttttggcagtttctttctatgtgacctctttctccacaacggtaacatttgttcttccagtcaccagccttgcagtctcttgcccagtgaccatcaatcccacagttaaaacagcgacctgttcctggaggaggtcctctccccatatattcacgtgaaccaccagcagcaccacgtggaacctgcatgcacaattttttgaaaagaacatcagagccaacaaaagtacagataatcaattcagcagcagcatgacatgaaggaagaaaataaattagtatcaggatgtgcttaggaatgcaaccaaagaactgcttactcctttagcaaactcaacaagaatgcggcttccatcaacatccctgccatctaggttataccgcgcttcatcagcatcacggggatcactgaattcctgtttggtaaaatagatgtcgcaaaatataggactcatatgtgaacaaaatacacctcataagaacttaaaaagagagaagttacgcaataaaaaaatgagggaagtattcacatacaataaacgcgtagtcgcgcttcaactccacttcacgtattctgcaccaatggttgccaaacagtaagccatcatgactcaagtactcaaatgcatcaccgacttgcaacttccactaaaacagtcaataacattacaccaagggcacccttcaccaaagtcctcgacaaactttggaagaatggtcaccaattccggagaaaaaagaatggccaccaattccaccaagggcaccccttccaccagaccaccacagacctcccgggttgtgtaaaaaaccgaaaaaccttcaacaagatcattcaagtcaaacacacaagacctggggggtcaaacttctacagcatacttaaagaaataacagaaaatgtcacactgaatggcttgaaggaactctgtccacaaagtagctgaaaagagacggtatggtaccactgaacccaagacctgccatgagctggccaatgggaaagggtaggaaggatatggtgctttactggcctatgctgagcacaaccgaagatttgcacccacattttggaaaggtcacaattttaataggaaacagcttgatttgtttggtgaaatttgaacgtaccaacaagttgtaatgtcaactgttaagcaagcgttagcgcagcactagtgttttacacttacaccaaatgaaagtgacttatcataattttaccagaaaaatccattatacttcagaaaataagctctcttaatgcccattgttctgttcttaccttccatatctgccgaaaagatattctaggtcacgagaacgagtgcgcgaagacagtctaccaacatacaagcgtgtgcttccataatgatcatcatagcgaggcatctcctgaaaacaaaagcaaagaaacatcagtacttttcaaaatctaatgaatatgaatgactgaaaagagcatgaatacttgcgcagaaatgcattgtacagttagggaatatttttttcatgcaggaaaaacttacaaaacaaaagttcttggtaagtacaacgcacacatacagtatagacccaaatttaggggtaatcagattagaggatgaggtaagacatgattggataggccttgtcactcatagcagcatagacaatatcaacaagcatatatgcaaccactaaagttcacaaagaaccagttcagccaagtctagccagtaatcttagaactgactcgtcgtatctacatacaattctatataacttcaaagaatcaaaataatgcaattatagaatcctataggttgcatgagcatcaacatatagcagatattaaaaaccggagcccaagcaccatgtgactatacaatcacgcaggggcggatctaaagtgcgacatgggggagttcagttgaaaccccaaatcctcttcaggaacaaacaaactgttattagtactagtgataacaaggttaaggcaaagagaaacgcctccagatctagcagagaagctagggttaacgcgaattcgagaaaaagaaaaaggtgttggcagggagggatggcgaagaggatggacgctcaccagagatagaggatgcggcggaagcagcggtacgccggcgccggcgccgctgctcgctggatggagatcgccgcaggcggcgggcgggtgaactcgcgaggagacgggagagtcggtcgaggccgaggcaagagtcggaggccagttaatacgctgggattttttttgttagaataagttcaccgtaggtccctcaacttaacagcgagatttttttaaggtccctaaaccataaaaccagaaatgttcacccctaaactcactcaaaccattcacctgaggtccctcggcagtatttttgtccggttttactgatgtggcatcctagtcaacaaaaaataaaaaaataaatatgtggagcccacatgtaagtgacacaaaaaatgtgggg

SEQ ID NO: 68088 - DNA, 728 bp, Oryza sativa
agttttttaaaaaaaaatgtttcagaggatatcttcaaatcagtatcagtgaacatactggaagctcagaagacacttattaattggatttaggaagtgtggcaacataattttcattttacctctcaatacagatagttatatcaagtgatacaacacgagactacatatttgtatttattacatggaaatgcagtgagagcaaaagaactctagaatttagattgatatgaaattaaacatgaagggtaagaaatttacaggagaatcaactaataattatccttaatgttttcctacactaaggcaaaagaaaatgtgtaaattaaattgactgtcactgtgaagatgatattatgtcagtcgaaaacgctaaaaaaaaatgcaatagcaatgccaaagtaaacacctttcatcgcttgagttgtctcaagttgaaagccattcaagatccagaaagtttgaatcaccagaatgaatgcaactttctttcaacggctggaacatgatgtatctgaggtaccatgggtgtatacctgtagcaaattttgagagaggaattaaggtttcaaaaacaaaaatggtagtagtccactatttaagacaccatgctttttcatgatttcctagtaaaatacttgtatgagaaggatgaaggtcaaccctgaacgaatagaaaccaaccttaattttgatacctcactttcacagctcaatgaaatttcatt

SEQ ID NO: 68089 - DNA, 662 bp, Oryza sativa
cctctcgcagccctcgtcgatggacagcaacaacgaggacgtcaacggcgacggcgacgacgacgacgactgcaaggaggaaggagaagaaacctgcagccgcaggcaatccatgctgtaactcttgtgcaagtaggacgccggcgagctggccgccgcagcatggagctgcaccccgaacagccgtagcccggcgccgccgccgccgccgccctcctcgccggctcgttggcctgcagtcgagtagtcaccagagcatcgcctcgccatgatggcgtgcatgcgtcaatgcgtttgtgtgtgtgttgtgtgtgtcgcggctgcagattagcaggctagttaagggagggagaatgacctgcgcatttgcattgcattgcacaatcgaatgggatacaaatatggtaatatatggagaaaagagtgatgctaatctcgctgctgctagtaccgattgatcgagagggacgtcgacttgctactagtgaggacacgacaattattgcacccgtcgtttttgtgtttagccctatatttgtaatcaatttgggttttaatttatcgttaaccgtactgtcataccataccactgttgatattatgggcatataatgatttaatttattccataaataaatcatgacattacagatgaaaactag

SEQ ID NO: 68090 - DNA, 35329 bp, Oryza sativa
tccattataaatacaattcttatttttaaatctatgtatacaaaataatcgtatctatggaaacaggagctaagatttgagtatcaaatccaattcgacttttagagtctaactccgtggaaaattcgctagtcataattcataaataagctgacattgtttgttgagggaactgatttgatttgtctgtaatgcaggattaccagggatggattgagcgtgggctgtcaatttcacagcgagttgggaagtcatcaataatttctagactgatgctaatttgaagagcaataaagcatatccatgtattatcggcaaggaagctgcatgtgacttggttagaagatggaaaagaacaaaatagtgggttttacgttttactaagagctttatagtgatatacttaccaccatccatgccctatagtccttatgttgtaacttatgttcttctaagcaatcatgttcaacagaggtagagctcaaagggttgaatgtttggtaggtgccggtggttataggtagtggtgtagaacaatttcgctcgttcccaggggatgcgctgtcaaacccttcagtcggcttgccacccaactgttgtattttcttgtcctgtatgtgctcatggactcttagtcgtgagctcgtagcagatagttcaatcatgtttccctcgtgccaacatggcacagtacctcaaaattatttgctgtgtctttgaaattcttatggcggtattggaaggacaaatgtgggggttcggtttgtactggtttggccaaacctaagccaaactttctgcctaaggcagaaaatttgcagtcctttgttacattttacttcggattggcaggtcaacgagttgcatttttgtagtaagctacttggttaattgctgagttgtttaactgtatactagtcgtattttccaggacgaatatgcttgttaatcaatatactctctctctctctctctctctctctctctctctggacaagtggtgagtaggtgatattctctctctggctgcgctggaagaaacattccagctgccagggcatgtgcttccggactaacacgattctgcactgggatctttgttatttcatccaagttgccaaaaaatatctcaggaattaccaattccctatggttgcatgttttcagaggcgatctttgcagctccggagctacactgccatcagatgcgactgataactgtcacaagcaacttgccattttagtactgctgggtcttaacccttccggccctgttaggaatggagtagttctcctgaaatttcatattcccactctcaaaatatgttcatttttaatccatctcatatactaccaatacaaaataaaaagaactaaaatacatttactttattaaattccaatataactattctccactttatctattctcaacgcaagtttttttttactctcaccaactccgatggaatgataacaaaaaaataaacttattttgggacaaggcagatgagccaaaattgaacttagtatgggacggtaggaaattaataattttgtactgaattatcgtagacttcatatgttcgaaataagtactcccttttataaacacaagtcaacatgacaagatttggtaaatacttcctccgtactataaaaaccaacttcacgttacgtccaggttcgtaactagaagttgatttttatgggacaaagggagtagtgttgtaacgggatgaaatctgatgaagatggtttattttatctctcttctccattatttatctctggacggatcgggcgaacatggttgaaaaatttctcttctcccatatatacctcttctctcggttggttttttctaaccgttttttagcggtttttagtggaatagggtgaaaagcaaaggagaatgattatgtattactacatccgtctccaaatataacaacttttagctatgaatctgaacacagttgttgagatttatagctacaaatgcttatattttaagacagggggagtaacatggtagagatattttcttttgctatttgtttccagtgaactctcgttccctgcttgttctctgtaaactctctctctctctctcgccgattttgaagaaagaaaaaagaaacaaaaacatggtcaatggttcgttggctcatctcgacgccactaatcacacactcacacgtgacttgagttcggatcgcgtgaaacggtctccctcgccgtcgaccgatgcagcccattcgcgtgcagtttctgcgatcgtcttcatttctgagaaccgtacaccgcactgcaaaagcctgcacctttttctaccttcctttgcgctactgcgtttttagtcaagccgattccatgattccatttgcacactacaaaaatcgtctaattatatcatcagccgcgccatgggagtatgggggacgaggtcacgaggaagagaagcgcgattccctccctgcgggagcatccggaatatgccaatctctctcacctgcttttcgcctgcgaggctcgccgcttttctgctggcaaaaagcgaaccgatctcatctctcgtctcgagaccggttttctcctcgctttccaccccccctgatcatctacagttcagctgtacatttcgtggtttggtacggagagtctgtcgctggtgacgaccgcgccaacgcagaaatttacaggtgactgctactactagccaccactactagtaccacgaagcacaaatatccgggacacgtcacgtcgctgtttgataacgttaacacgagggcttcgtctgtgctggaagcggctcgctcacgcgctctaccaaacgcaaacggggcacgcggcgaccgcttcgccgccacaaccaggtagtagtgtgctcgccatcgctatcggggtggcaatttgctttgctccatcggtggagcaagcgaccgagtccgcaccgcaggggccacgaattaggcaggcaatcactcgatcggtttttgccgcgggcgcacgtccaccatggcgaagtttaggtaggagtaattggggacttggggggttttggtgttttttgtcatgctctgctgccgaacataataaggtcatcgccaactggggtttgctgccaaacttctgacctgttgatccagtaccggcggtaggattggtagtgatcactgagaggctaagctataccgttggtggtgcagtacgaccaagcacactagtactatcgtgaggcatatatacctttgctacgattacaatggggttttgctacgattacaatggggttgcaaggagaaagtggatttcgaccagatcgtatgtgttttgaggggggaaaagagctaggttttggtcctcgaaactttagcttaaaagaaaaactaaatgaagatataagtatataacattacttaaagataggtatacagcttagctataaagaataatccttttagtttagataactaataaagacgaatatcactatagatgcattttagatctcaggtatatataaacttaccctatgacaacttactattacctttgttttttaataacaccattgacttttcatataacattggtccattcgttttattaaaataaataaatttggtatacacatgtaaaagtataagttaagactatagtttctttgatgataaaataagtcacaacaaaataaatgatatttacatatttcttttttaataagatgaatgatcaaacatcacatcaaaagtgaacggtgccacacattataaaaccataggtaatttgttgcaggttatttttgactcgattagagcgaaaaattctttaaaaagacaaaaatactcctacggtcaaaagcttttgagctaagcctaaagtgaacatggaatacgatgtatgcataatttataaattttcactctaacaccatgtctgaagcatgtggtgggcattttcgtctttctcgaattcatttctctaattgagtcaaaagtgtcatttgtcgttttgtcgtgacatattttttcgatgtctatcagtaaattatataaattttaaatgttatgtagcaaaattcgcaggatacgaaggaccaaacaatgtacatttaggctgggaaggtatatacgcatgactacgtctaatctaaacagcagcattgaaaaattactccgtctagtacattatctactccagtgcctactactactactggtcaataataaataaacctaagccaaaaccagccttaaaaagccttatataattaaaaaaacaggtaaaaaggaagcgagaaagaaatctcgctctcgcctcctcgccaccgttctccgtccatccaccgagtcaccgacaggaggcgcgtctcctccctcctcacctccatctccataaacacagcaggctcacgcacacgcctccgccccggaggaaggaaggaaggaaggcaaggaagccaagcccgcgaccccgacctacccccaccaattcaaccctccctcctcagatccaccaccaccgagcgcccgcgatgacggccaagggcggcgccgcgccgtcgccgggcggcgcgggcggcctcccgaacggccgcttcttcaccgtggggctcgtcaccgcctggtactcctccaacatcggcgtcctcctcctcaacaagtacctcctcagcaactacggcttcaagtacccaatcttcctcaccatgtgccacatgtccgcctgcgccctcctctcctacgccgccatcgcctggctccgcgtcgtccccatgcagctcgtccgctcccgcgtccagctcgccaagatcgccgccctcagcctcgtcttctgcggctccgtcgtctccggcaacgtctcgctccgctacctccccgtctccttcaaccaggccgtcggcgccaccacccccttcttcaccgccgtcttcgcctacatcatgaccgtcaagagggagtcctgggtcacctacctcaccctcgtccccgtcgtcaccggcgtcatgatcgccagcggagtgagttgttgctctgcctacctctccctatctatccccttttttggtagatctggtgccgctgctgttggatctgagggggaatccggccatggctggatgatgatggggggctcagttctcgtgagatctagcagctgagaaggctaacaaacaggaggatctgtttattgtgccttatgggaatccctttattacgttagtggcttgcttcagatgatctgaagtgctgatggttccttttctactactccttatgttggaaatttgggttatgattttttttgggaccaattcattagtatttactaaattcctgacacaaatgcacccaccaatttgagaaaattgctcttttgacacatggttagattttttttcctcaccagtttgtaggggtagctgatacagctcttttcagtatccttcttgttttattggccggagcccagagcaacatccaaataattgtttgcttggtgataacccacaggccagagtcattgagggagataggttcctctgtaggtagacttgttctactgtaaaacttcaccggtgaagttgtggacgtccaagccattttttttgctctgtagtaccaaccttattggttgagttacaatgcgttgggatttgggagatatattgtgatattccagtgtaggtgatggaaatagccatcggtttcgattgccatgaaattgatacgtggaatctcgttagattgacacatgaagaattgtgttcttcaaagtgttcttgaaccttgtgacgttaattgtggtgctcttacattgagttccatgcaataggtattatgctgccagctgattagaaacaattgttgtgcttctaggcactctaataatcttaaaatcaggtaatctaagaaaataggagaatcctatatcattaattgaatgagaacaaaaaatatcacttattgtgatgggcctacatcatgaagtcatcatagattaattagagttgtcatagatgtataacaaatggcgcaagtatacaacacaatttttataacacatattatgagttgtatagcgaatacaagtttagctgcgcagttgtatggtgcctactgcttttaaattaaatacagcatccaaggctagcaaatttgtgggttggctagcagcattgcaccccatagaattgtgggaagctctgtgtaccttcttgtttaattatctgcttaagggtatacattgcttctgtcatcaactaattaatatggatcatgcaaactgaacttacagggagagcctagctttcatctgtttggattcatcatgtgcattggggccactgctgcaagggcattgaagacggtgttgcaaggaatcctcctttcatccgaggggtaaacctcttttcttttcattttatgtacagatcataactgatatgcatggtctggattcaaactattgctttcatgaaagtgatattcctgttgagtaatgtgcagattttgagggtttatctttttcagggtaaaatttgacgatgcatattctgccattttgcagggagaagcttaattctatgaatttgcttttatacatggctccaattgctgttattctcttgctccctgctaccatcttcatggaggacaacgttgttggcattacaatagaactggccaaaaaggacaccacgattgtttggttgctgctgttcaattcctgtttggcatattttgtcaatttgaccaatttcttggtgactaagcatactagtgcattgactctacaggtatggcatggagtctcactctttaattcatctcttgttactggagtagaatttagcagtgttcaagaaattgttttagatttcaaatttgttgctgacatgttagtacagtgtacccactcacttccatacatgattttagaatggcgtttgattgattggtaatacataattacacagcaatattcgcattccacagttaacaaatttagcttctataagtttaactgtagaattttgaggtggcccagggaatgacatcaaatcaaagttttaaacttatcggccagccagctactgagcttggaaatatgtttactatgtccattgatttgaactaaaagtgcttagcttagttccctcttaaaatttccgtaattccattgggttaccttaagattgttagcatattttggttctatttgtcccactgctcagttgagtaaataagttctattttaataatattgggatgtggacaagtaattcgcaaatagtagcattagtcttcagtaactagcatacagcttgacacattgttcaagttatctatcaaacctgatgagaagattgtctgttgcactgctatcattgacaatcttgtggaggactgaagcccatttgataatacaaaaggagaatgcaacttaattgacccgccaacaactattgccctattaagatagtgatatagatagtgtttactatctagtattgttattacggcactgtctaggtctctaggctacgcgttggcatctaggcaatccaggtaggatgctgcagaggcttacctctcaatggtgctttactcctctgcctgccactggccaagcccccctctatcgtgctccctctgagactccaatctatctaagtgcctgtcaggattcctcatcttgtgcctggccaagctctaggtctgagtaggcatgtgcattcttacccagtttgcttggctctgctgtagagctcccccaatctgctttgctctgcctccctcccaatccctgatttttgttgctcaccatctctgctctgctttacacttctctgcgactctgcctccttggtgccttgatggtcgacttgtacacaatgacgatcattgtatcatctgtgctattattcatattttttatgcacaaaacatgatctgttatgatttgtaaccacttgctgaaacaccactaatttgttcaagtagttgctattagatcattggttcatttatgatcatttaaccgtagcagactgaattgtaattttgtgtttataagtttttaacatccactgttgtttccaggtcctaggtaacgcgaaaggtgctgtggcagttgttgtctcaattctaatattcaggaatcccgtatctgtaaccggaatgctcggttacactcttacagttataggcgtaattctttacagtgaatccaaaaaacgcaacaagccctgaatattttagaatgccgtaaatatggctgtcctttctcattccggtggatgcccagggctaatatatgacggggaactacatcggggacaattgcaacaaatcctgcactgtatggagcctgattggatagcaaggatagaagtccaataatacatgtagtttgcccatgggatctgggaggcattttgttttgctaatggaaatgatcaatagaatattttttttttgtgtttagagaactgtggctcacgttgccaacattggttaatacggttagttcgtggaaattgtttgagtcattcatcggttattgtaagttcatgttcccccattttgttttttctctgaagattgcctgtaccaaactttgctccaggaccccctaatatattatgacagtgaatttaatcccacagtgagctgttgttacactgatgctgttctgcttcattgtagtttaccttaccttatgaaatagagtctacataaaagtaaatttactggaaacttaagattacaccatgaataggagtagctattttttttaagataataacactatggcttttactcaacgagctacaactaattattacaaagttcacacatggacaaactcagcacacactgacataatgtaaagaaaacacaaactaaaaagacaccaacactgcaacacaagataaaagaacctatatccgaaattgacaaaaaatatatatataatcgttgactcaagtttatgacatgcattttgtggttgggtccaaccccgaaactaatatgttgtcctgaatagtacatttgacattctgattttcaaggttcctccttgccttcatcttttctgccctttgcagtgtgaagctagtctatcacttgcccttctcttgatctgtctggttggggctattaacgcctctggaacaacatgtagctttagagctaaactgtcctgggactggactgactccaccacagttgtgtcctgtgctaatccatcatactctcataagatgttgtaagccctttgattcaggcaacaacattacctgggtagatggagtagaagaagcccctttctctgaaaatagaaccactgttctggccaccattgtccattatagaaccatccttaagattggatatgtcttcacccttacccttgccatgcacgttacttccatcttcctcttttccatcttccttatcacctccactgtccatgtggaggggtagctattgatggtcaaggttatatatagcgtgaacacataacgtcatcctctcaaacatgtgattttcatcgcagagtaggccaggtttacaaaatgctgataaggtaaggtaagctaatgaaaactccgtgtctactgtattggtagctatgtacgatagtggctaaatgcgcgtcaaattgcagaagagaatgagcagtagcgctatcgtattatgttcttgtggattgaggtaaacaacgtgtggaagtaggcgaagtgtcgataattcgagattttgccaattaaacgggagtaattagacgtgtggtttccagcgtctattcatttgaagtccagcaaacttgcgcatttagactctcgcggaatccatcaaaagctctgttttctctgacgataggcactaagtaccgagctgaacaatggacagtttagcaatgtagaactgataattcagtccgtgaaaataaccgcaacgtgggaaccaataattgagctcacatatgtgcaccaaacttagttgtttttttcatctaaaagaaaaacctgagttactactgcagtaaaacaaggggcataatagtttgcagagctggttgaagtgggaaccaaacaagagtcatagcgagtgatactgtagtaggagtatcatatttcatcagattcatcatatggttccagacagaattttcagagaatatatgacgagagattatgacgatttattcaggttcactgtcccctgcagcgactggactacagacacttggaaaaagaaggggtttaccattgaaaaatacgctggtaaacgagagacgaattgaatctttcttgttacagatttttgatgggcgtgcgcccccatggacgcacgagttagagcgaattaaacgaatcgaataggcagcctagtccgacaaccggacgaacccttcatgtgcagcttgttaatcgccagagcacctttggcctcctcttaattcctcgcactgtcgccgtgccccttcaactgcatcccgtcacctgctccactgcagtacatgtacatcacaaacatgcaggcaccagagttagatcggtgtactcggtagatcctgcgaactggttacatcatgtgtagctagctggagatctgcaaagctttgggcagcaaaagacagtgcacatgcgaaagctgtactaactgatggtagttaaggtgattagtagtatcttcgtagctgtctctctttgattgaagttcaagttcagattcagaaaagtttgtcgacataggtaacgggtttaactccttcctttgcaatgcaactaccgactaaaaaatgcagctacattgatcctctagtgcaattgttcatcgcaatgttcctaaacaggagtctgtccatggaattaagaacttgtagtgctcgtgaatcagtagcatgttttacctttgggaggggccatgacggtgggcttggagatgatggcgggcacggtggtgacggctgcggccgagaccggcgggaagaagtgggcggcggggacgcccaggccctgcgcgccatggtagtggtactggtagtacgggtacacgggcatcatcccgttcgccgcgagcatgcctccctgcgccgccgccgggtacgagaagtgcccctgcaggtaggccccgttcgtgccatgcgccgctgccgcctggcctagcttctgctcccgcgtcacaaagcaaaattattctcagttcatatgaaaccgtacatggctgcaaggcaacatttaggacgttttggtgcatcagggagaggagaattgggtagatcaagaaggcttaccgcgttgtagctcaggtcagcgacgtagttcggggagtacctgatcgagccaaaccaatcaatcagtgcaacgaattatcgctggtgtaacacttggttataataatagggcacctaaaagtcagatcgcgtaatcaattgacaactatgggcgctgctttaactgcgtgcgcagccgttaattttttctttttttgccctcccctgttcttctgcgttctttccctgcatcccgtgcaggccggcacgtgggcacgtgagagcacgacgaggcagctggtccggtccatgtccagcctgtgcctgcgcgctccttgtcgcgtcgcgtgcccccctagccagccactgcctcgcatgtgccccaccccatgcaccggtccccccctccgccccgtccgggcgcgcaccggacacggatcctcgtacgcgcgcgagcgcggagatactagctagcgagaagagagaattcacgcgcgccgcccctccgaaacgtcgcgccatggcggcgcaaaattctcgtccgtttttttttcttctttttttggagccgtttgggttcgaaacgttgtgcgcgcgaagagatcgagtagaattgtagtacggtagaaggggaggagagcacgtacccgtaggtggtggcggcggggtagaaggggagaacgccgtggtattgctggtggtggccgccatgggcggcgtagtgcgcggccggcggcggcggcggaggcggcgtcgtggaggggtggtagtaccacggcaccggcgacacgcccctggaccccaccgcgatggctgctcgccaaaggcatgtgatctcactcgtcagtacgaccgtggacgacgcacgttaattaacaaacagctgtaactagcgttggttaaaaactgcaccgggtgcgtacctggcgcgggctggtggtggtgaggggagggaagcgcgggggcgtgcggccccggggttgccggcggcgaggggcggaggaggtgcggcggctgggcgcgcggcttggcgccgagggacgcgaggttgcagttggcgcggcggccgttgatgaccggtgtggcgtcctcgcacgccttcttggccgcgtccgcctccttgaacgtcacctgcagccacaccaccgtaagaaaaccgaacctcgcgcacgtcgcgacacgaaagcgagaatgagagcgtggagtggtggaactgacgaatccgtagcccttggagcggccggtgagcttgtcggagatgatgacggcctcgaggatgtcgccgaagcgctcgaagtgctcgcggagcgtgtccttgtgcgtctcccacgccagtcctcccacgaacaccttggtcagtgtcgtgtcaccgaacgccgccgccggctgctgcacctgcaccacctgcggcggcggcggtgtctgctgcggctgcccgcccatcatcgtcatctctcttcgtggccggggccgcgcgcgcctagctacctagctaccgaccacctcaacgacaccacgccgagctgagacgacccgctagctgcgacgtgcgttcgtgcgcggtgatatgcgaagggggaggcgagcgagagcgagctatgtggtgcgctactgcggctgcttatatagaccggagtttataaattcttggggggaaggagggagagtggtggttgggtgggctggataacggaaacaggagagctgctactactagcctgtcgcactgctcctctagcctggcaactctgtcctgtgcctcacttggcctctctctctctctcctctccgactagtgtaactaacagaaaattcctgcaggctgcaacacacattcactctccggctaagatctctacacaccactctgattattctgcgtagtcaggtttcggacacaaatgaaataaccaattttataactcgactaaaaacttgcgagacgaatcttttaagcctaattaaaccgtcattagcatggtagcatttatggttaattatgaactaattaagctcaaaagattcgtctcgcgattttcatgtaaactgtgcaattagtttttattttatctatttttaatattttatacatgtgtcaaaagatttgatgtgatgtttttggaaaataaaattaggaactaaaccccgccttagtaaccaaaattaatcttcctgaagaagagttgtctttggggtggtttaattaatttgacagttcatattggtagtaactcgcgtgtgtccgtacaatgtattaggctgtgagatgattcgattacaagtttatttacctggctggagaaaacgagagatggacgagtggccatatggggagctgtacgagaagatggaaccagctggctttgcagtttcgcctttaccacacaacgtgctcgcgcctttgatttgcttagctagctcgctcgctcgctctcagctgcgtgatcatgttgccctatatattactgtagtctttagctgtttttaattaagaaccatgttaatcttgacgattgatcagggcgattgtgattctcagaaaagaagcttttcctgtttcctttcctcgtattgtatagtagtgctgtttagggttgcaaatcaggcactggggaatgcatacagttgctgcatgtgagtgtatttttaagttgacagaaaatacagtcatacggtacacctgaaaacacatctaaagctagctagctagcacgtgagggtatccggtagggatcgtcattttgctggcaggaaaacataagactcagaccccaaaagtatatatacactagatgcagagtatactattcctatattactagtactcctaactgctactcatcgtaacaaaaacaacgtccctgccgccccttatccagttgttgtctcacgtaaaatctgcttctaacctaagatgaagcagatcgatcgactgagggtattgcacattaaacctacaagctagggctacaaattccctcacatacacatcattgtgttccataaagagcagcacgacggcatgggcaaactgagactgtgaccccaacccaaatataatggacgcggcatttgcacggaggggatcgggcagatctcgcgttaattcgccggcatcgcaaaaccaaagcatacactcgcagtgtagcagtatttccggtgacgtacgccaccgcgggaccggcggactatgcgccgcggtcccgcccggctccctccctcccctcacgtgaggaggggccgcgcgcccctgcgcccgcacggcgcgacgagctagcgactgcacgcatgcgcccgatcgatcgcgcgatcccggtgggttggtgtctcggcgatgatgagtgggcgacccatgcatcgccagtttaatttgccacttgctccccggccacccagcccgcgagccccgcgaccgatcgatcgggagatgggatgggagaacgtacgtctctcctctttttgctcgtgaaacaccatgatttcgccgcggaatcgcgtagaggcgcagtcagccgcgcgcgcacacctccggctgcatgcgcgccttgctggatcggtcgatcggcagatctagtgtccggtcagtcgcctgcggcattgccttgggtagaactggaactttgttcggagatactaggaggcatgcacatggatatggtgtactggggggacgatccgacgatgacgagatgcgtacgtgtgtgtccctgagatcccacggagaaggtagaaaaagagtgacttgaaacctggcgagtactcctcatgtgagacacagctagaaatggaaggacatgtacgagtaagtgactgtttcacgtactatactgatcccgcaatcgagcaatattcttgtccatcttcatcagggtgctttactagtgtttgagaagtgcttcgaacatcacgtctaccgatactcaaaagcgaaaggcagaaatagatagacgtacggatgcaaatatctatactcgtggacagagagaatctatatgacgcccggcctgtacatgctcgtccgctggctgatctcgctgttccaaacaaaaggtctagcaaagcattttccatcatctgcgtcagctataccacattattctaaccattccccatatagagtagccgcgaccaacccaaacccacagtccagaagcgtcagtctagccagcgtccttaaaatagcgagtccctcgttagtcgtcagagcgctaatcatgcagtttgcatgcaccgtatacaggggcggatccacagtacatttactggggtcatctgaccccgatgacatccagctatctaaggtaatgtcttatattttgccacatgtgaccccattagctaaagactaatgaccccagccaatcacttcagctctcacgctctcacagggcagtaaaacagtttacttgtttcactgcctcctaccaagcccattaaagtcaactttgtttggttgatatactttggtctaataagcatttactatagttctgatctttgcatgaggaaacgaaaacctctcttatcatagtctaattagcattacaaataaacaaatacctttatacaaaaaaaaacgattgtagattatataatgtatacatgtttaactaatgtgcctaagtagaaaagaagttaacttttttaaaatacaaccatttctcaaccatatatatccatattggagttgtatataacaaataaatatgtgatgttataatctatgctcacagatagggatgtaaatggagcagacaagcgggtttttcttacttgcttatcacacttctagtttattttttctacaaaattttgtactgaaataaactagcaaatgaatatttatgcggatagtgagactacccactttgcatccctacaaatagaccccggcatgtacgtctctccgtcggcgctgaataaaacgaacggttaaatatgtttgaaaaatttaatggcgtcaaatatttaaggacggagggattagtacattggtgactccggtggttcagctccgcccccgaccgtataccatatcgatgagtacagtcacacacatcgatcgtcacatgcccgtcgagcccacccgtaccatcgagcatcgaccagcgcagcgattaccggtgcgcgacactgtttccgctgtcctcgattcagcggtggcagctacgaccagatcgtcgtacgagaccctgacgccgcacgtacacgtttccgatggtggcagcaattaacggcgccgcgccgcgacacgacgaagaggcagcctcgcgcccgcagtgcagcaggacgtacgcgctcatgctgtcatgcatactgtcatacgcgcgcgcgcgcacacgcgagtctccgatgaggcgagacgacggtcggatctcgcggtggatacgagctgatgcatggggccgggccggagcacaccgcatgcaagacggcagaggaggggcgcaggcacatgcgcccacgtcagaacagcgagaatctccctcctcctctcctcacccactgcaccagctgctgcctcgctgcgtgcccgtaacgtggacaactgttactcctgtctacatgcccggatgccacacacgcattacacaggctcacgccgcattgcactgccacggtatgagagagagaatttagtcttggtttgactggaccgagaggaggggagaagactagtagcaagtagcaagggacaagagtgggctgggagttagctgtaagaccagaagagtgagctggcttgcatgcctctcaaaggggcaaaggggggagaaaaaggatggagaaaacaaccgcggtgtaatcatcatcagatgcaatatggggttagaaaggctggccgggttttgcagagagccagcagcaggtgggcatattggcagtgctggtttggggttggctttgtttttctagatcggattagattagacggacagttgatggcccatgcatgttgtcatctgggcagccttttctcatctttatttttttattgctttgcccttttcatcaaatcgctctcagttactaactgctaagcaaccttatggatgaatgtcagctactccagacagacaaaagattggcatttctgaattccaaacatgtatagcagttgatactagctccaaactgaacattatgtttagtcaaatttgatcctctagactgcagccggttctcactcatcagtatacttttcctagtcaaattatgttcagtgcacctagctagcttgaggagcaagggtggacggatgtgtgtcacgcacccgagaatgtgttaaatatgatgatccccatggccatgggcaccgcacacgacgcaatgttctgtccacctttttaatccccatgacaccaggtggtgcacatgtgtgggcgagctggccggccggcagcacgcaggcataatgcgggtagggagagagatcgagtcgactggcgatttcagcgtcgacgatctgtcaccgcttagcttcgattcccctcctctttcatctccgcatgtcgcgcatgtctgcgagaccgtgactatctgcgtgtgtgtgttgaatgaaaatcatggactcatgcaggcagccatgttggatttgagcgtcgatttgaggccacccacctaggttagtacccgctgccacgttcgatcctgtacttcctgcacgctcctaaccgggagagagaaaaaaaactagagaagaataaataagcagtagtatagtacgacatgtctgcgtgcacgttcatggcagagagcttagaacgacagcttgagagagaagagaagagaagtagaaaacagctagtgcctggcagcctcttgtgtgtttgcgttattttctcgccacttgctcgcgtcaatttgttcaccgctttaatttcgtgggtgaaatgatgaacatcggcgtcgtagatcgatccagcgtgagagatttatcctggtctgttacaataatatcaggatttttatctgtaatgctgcagtggtaccgattatatatggtccaaaaactctgagctgatcgatgcgtcccaattgcactcggagcatgtacctgtacgtaccaacagtgtgttgtcagttcgactggaagccagcaaggccggtgggagaacagtggaacacgaccaaaagggaccaacttgatcgacgacgtaagcaaggccccggcctgtctgcctgatagatggctcgctccctagtccctactgtgcgttctaataattgggcttagatcgatcgatcgatgagagagaccccggccggccgctcgcgtcagcatgtatgcatgatatgcaccaatatgcaccgcacggctgtaaacagaggcttcttgcgtgcgtgagcgacgcgatggtacaggccagctagaggaattagcggcagcaccgtacatgccaccgtcgcctctcgcctaatcgccttcgagatcacggcgtggctagcggctagaaaattggctggaaactagtccgctagctagcttatcagaccacagatgcgcgatccgggtgctcggctaggacaggctgttcgatcgattcgtcgcgtggatggatggagccatgcattgaggaggaataaccgaggtggtgctctgaattgttagtcgcgtgctcgacgcggcgccgagattgcggctcagagctgagaattgctcggggagataagcaggcagggtgggctgccgcctgccggtgaacggagctccgccggtgtgcgatttagatccgaagctttccgatgtcgatcgaataacaagattgtagtgtgtcggtcgttatgattgaattatttctccccattaaggtcctaatttgattccggttcgtacaatacaaagcacgcagttgggctgaattagtaactaactgggtggcccgcacaattgtgcggctagcacccaaataaaatcatatattttttagtatgattttacttaaaatttattaaatagctatctcatgtcttaagagtttgaaagattaaaccttatcatccccgtgtttctaattatatatattttttaaaagtcacaccagttgctaccccttatgacatctgcttctttatttgcttgctcgatctaccactatttctattcattctccttgaaacctttaaaaattggatcttatagtttttagagtttattgtcacgttgggtttcgtttttataatttctagatgcctcgtcaaacgttgtcattatactcctctatggcccgtccactgtctcttttcttaattgtcactgagattttaaaaatcgaacataattatcgtttcggttcatttttactttctagaaatcccgccaaaccgtcagcggctttgacattgtacttctctacggctcgcccactgcgtcccttctttattgtcattgagattttaaaatcgaacatgattatcattgtttttttactttttcaaagttcggaacctttaaaaattaaaccttgtagtttttagagtttattgtctcgttgggtttcattttttataattttttagaagcctcgtcaaacgatgccactatgctcctctatagcccgtccgccgcctactctttctttattatcattgtgattctaaaaattgagcataactatcgctagaattcattttttattttctagaaatcacgtcaaacatcagcggctctgaaactatactactatacaccccgcccactacttctcctttttattgtcattgagattttaaaaattgaatatgattgtcaatggggtttatttttttttactttctagtagtcccggtaattgcattgctcgtttgcttcacggcctgcctgtcgtccctccttttaatcgtcattgggattctatttggtgttttattaacagtttttatatgtcgtatcaaccgccaccactctactcctttaaaggcctgttacttaatttatctcgtcatgtgttttagatggtcttttctttcaatagtctttatttttatcacaagttttagttatttataaattgtattcctaattgaaatcttatttttctttttctaatttcagaatttattttttttttcaaattttaattaatatcgtattgtgttcttttaatatttttattttttatttttaatttcagttgtttcaaaattgtattcctacttgaattctcttttaatttttctaattttgaatattattttattttttattcttaattttaattaatctcgtattggattcttatatggattcttatttgaatattgcttatttttaattccaaatttcagctaattttaaattgtattcctacttgaactcttttttttttgctaatttcagattttattttttttattccaaattttaattaatctcgtaattgggttcttatatggactctttttttaatattccttattttaattctgattttcagctattttaaaattgtattcctacttggactatccttttcttttctaatttttattttattttatttttattttgaatttttattaatctcgtattgggttcttatatggaaacttctttcaatattgcttatttttatttccgaatttcagctattttaaaattgtatttctacttgggtctcttttttttctttctaattttggattttattttatttttatttcgaattttgattaatcttgtattggattattatatggaaacttctttcaatattacttatttttaattccgaatttcagctatttttagattgtatttctacttggactctccttttcttttttttctttttctccgattaatgtggaaatttctagcccccacagtgaacgtggtgccttctttcaaagctgtattttattataaattaaattttagttgttaaaaataatatcattggatattcatttaaatttaattttatataattatgattttgttgctacaatgaaaaatttaaagttaaagtttagtttttaagactgtactaaatttggacacgccttagcgagttggacggagagatgtatctctaccaatgcataagttttctggtctatttactctttttttttcatccataggtaaaaaaaatatcacattttaattctaattataccggctccaaaatatatatgcacgcactgtgtttgaatcctaatcacctgatctgttgattgatccttagtatccatataggataaggaaagaatcaaagcaggagtacgtccacctatttggacttgtattctattacttaatcagtgttgtccgtttgatctagcagttgttttctattcagacttctattatcaaagttaatctacaccatcaaagtttagtcccagtataatctaatagtatagatttttcttttttctccgattaacgtgggaatttctagcccccacagcgaacatggtgcctcatttcaaagctgttttaataatataatagatagatagatagatagatagatagatggatggatggatggttctcacagaacacgggccggtggtgtacactcgtttaggcccaaaacaggcttccaagcaggcctggtagggtcggacgtgagtcgtggcacaaccttctaaaactaacgcgcacctgacttctacgaatgtagggcctgttcacttttataccattttcaatcttactaaattttaataaaattgttaaaaaaatggctatatttaatttgctgccaaattttaataactatataagaaatcctataaaaattttggcaagccaaaatttgataatgttttttttcatcaaagtgaacaggccctttaactcctatgagtatttgttacatttctgtttataaatggatcatttttcatttgtcacttttacgtttatttatattgcctaaaagagatttgtaactacatttcgcgaacgtgaaaaaagagacaaatttttctataggacatcgcgacttcgtggtattagctgtgggacaccgcacaaagttatttttggaggaagacactcttaaaatgtggtaattttctagtggacaccgcactcattaaaataataatttccgatagaaggggagaaaaaaatcatgtgaaatgtcataaatacccctaggcccacttgttatattcttccccgaactccctctcacaatcctgcatatcctccggtcaccgacgtcatggacggcgcctcttctccatcaagcagctcaactcgttcggcgccacggccgtgctcgtcttttccagcatccagctccgcgctgccgtcggggagaagacgtcgtcgccgacaccgctccatctccacccccaccgaactgttgctccgctcggcgcttgccggagccgagccgcgccgctgccttccccaccgccagccgtctcccctcgacggtcgccgcggcggccatggcggcgacggacagcgtcatgccggcaccgatgcgctgcatctcggtcagccccctcttgttgctggtgagccgccgcaccgcgggcactaccgcggcatcgtagagcggcacgaggatgagcatggcggcggcgtagacagagtggagcgacgccgccgggatggcaaacgcgccagctccgaacccgaggcggcggcgcatggcgcggccctgcaccgtgaagagcggctgctggacgagcaccatgcagtagacgatcccggtggccctggtccacaccggcagcatccgcacgatcaccttcagctcatccacctgcgtcactgtgcacagcctccacggctgcgccgctgccgccgcagcctcgcccccccccccaccaacgatgacaccgccaccgccgccgcagcctcgccgcgttgtccaagaacctgaactggtcggtgtgcgccagcttctgcccgcactttggcggaccgtcgtagaggacgaagctgtcgtgaggcagcgcgacgttcctcttactgatggcggcgacgacgacctggcaagctcgcaccacagttctgccatgaggctggtgcctggtggtacctgtacatggcggagccgaggaggaagctggccatggcgaggacggtgcagagagccgggacgccgaagccgacgagccagccgaagttgtcctgcagccacaccatggcggagccggagacgagggcgccgacgaggaagcgaaggcggcgaggaggaggaagcaggccacggccagcgccgccgcgaaggacttgccgcgccacctgccatggttgggtgagagataagagatgggagagctgacaactgggtccaggggtatttttgacatttcacgtgatttctctcttccctcctaccggaaattattattttaatgggtgcggtgtccgctagcaaattaccacattttgagagtgtcttcctccaaaagtgactttgtgcggtgtcctatgcctaaaaccgcaaagtcactgtgtcctgtagcaaaatttgccaaaaaaaatatatatgtcaatacattagaagagcatagttaaaacaattatgttttcttaactactccctccgttccaaaatataacaacttttggatagataagatatatcatcatactatgaatcgagacatgcaagcgagctcactagtcaatcttacgtatatgggtaagtatacattatacctatgagagacgaaattcctccatcttcaaataaatcaattacaggctatgaatctgaataacttgtaattgttttattttgagatggatgatatacacagtattgtggcagtacaactcgcagggcacgacaccatccctacctcctgtttgggggagtttttggcagtggcatcttatagaatcttcagttgtcagaagctttgtcaaatagttcatattttcacttaaattctataaaattgtagttgtgtaatttagaaaacaaactagaagacaaaaactggattttccagcttttccatatatattctcaccagctgtttctcgaaaccttaatctctcaaaaaaaaaaaaaagatcttagtcacgacatagatggtcgtgactcagcaagggtgagattaatacgcatatatcttggccgatatatggttttaggccccgttcgatctctctttgggagatagtttttttttcacgcaaaacaagaaatatcattagcatatgattaattaaatattaactattataaatttaaaaaatggatttatttgctttcttaaaacaactttctatatcgaattttttttaaaaacacaccatttaacatattaaaaaaacgtgcaaatgaaaaaacgagaaagttagaatttggagttgaagaatataactgagcctaagtaccattcaactcaagtacggatgcaggctgcttgtagatacacatatagatatagtgcgtgtctctgcttccttgttaaaatcgtggtgtatggtatcgtcacatatgctaccacgttttaaaatataatatttttaacgctcaaaattaattttaagtatggggttgatcggaagtgctggctgtcagtcagccccaatccaaaccaaagagtatttgctgcagctgtgaatgggcagccaacacaaccgatcaagcactatagctatatctccatctagtctttccaaatttatttaagataataataacaattacatctcggtcactgttaaacagcacacattcaacgagccaaagaaaaaaaaacaaaaatatttgagattatatgacaaatccctgtccccctcccaatgacatccaactaaaataccgaatagaggacatgtaacatttataacaatgctggagattattactccctccgtccccataatacaagggattttgagcttttgcttgaactgtttaacgactcgtcttattaaaaaattttggaattattatttattttttatgacttaatttattatctaaagtactttttattttcctatatttgcataaattttttaaataagacgagtggtcaaacagttcaaataaaaactcaaaacagttcaaataaaaactcaaaatcgcttgtattatgggacggagggagtacctttactcccaaccgcagatgcgtttcaggcaacccaatcctcagtagatgaaaaaggaaaaagaaaaacaaaacaggcaataactaaagtgaaaaaaaaaaacaaagcaaaagtatgtgactcgatgagacgaggggtccaaatcccaggaacatcttcgagaaagcacaagctcgacgccggctaaacccgcggaaatccccttccgctttgtctcgtttcctcctcctgccccctcggcactgcaccgccgcagcttccaccatggccgtcgccagcgaggccgcttgtcgtcgggcggctagctgcttctttgaggtcggcaggcaagagatcggctcctccaccccgcgcgcctcctcgcgccgaatcagcggctccgaggtgcccctttctcggtttttaatcccatatgatcctggtgtctgatttcttggaaccttctaggtgttgatcttgtagagttcgcaagtcactaaggaagtaataaggccgcgtatttttgcccgtaagggaggatggatcatgatggccgtattcgtgaatcgtgaagtactatttgatactacttgttcttgttcgtaacagttcagtttgcataggcattatggagttaatgctgtaaaattcatatcttacgactttatgagtccgccgatacgaattgagtactgtcagggtccatggattaggcacacttaaattgataatattgtttggataaattttgattatactaccgtttcatttgtttgtaacttgtagaacattttctggatgtttcattgaagtctgatcatactagtttattgtgattgttattgttgttcaagaatgtgtatatgtatgattggagtacttcctgagataaattactaaagtcatgtgacaacctttctgatttttttttttttgtaattgcttctttctataacaccgaatatctcattgtcatgttggactagttacaattcttctttcctccaattgtttagggcctagtgatgcggatgcatcagtatggaaagttgcgaggccatgatggttgtgttaatactgtcagcttcaatcctgctggtaacctccttgtgtctggttcggacgacatggacatcatattatgggattggcttgctaaaacacaaaggctcatttacccttctggccatcaagaaaatgttttccatgctcgtgtaatgccatttacagatgatagcgccattgtaactgttgctgctgatggtcaggtttgtatctatcaacatctgagttgtgttctaatagtaatactaatttaataccaccatgttattcgcaattattcccataagcatgttgtgcggttacttttgtgttctccacaagtcgtagcaatcagcttcatgttgcatggaacattataataattgtattcgtttactggtacatgcactatttggaaagagacttagatctctgaattgcatgcaattactaagagaaagactaggtttttttttgcgtataacatagtaagtttgcaacaaaaaaaaccatagatatatctaacccttttacttgtagtttattttcttattttgtttgcaatggatgtagttttgaagtaaacctatatctctgtttttacacttgttggttatattggaaatgacttctctaccaatcaactgaaaatattagtagataaagtgataaacacattagcatattttacttttctgttatttgcaatccgatataatttttgataacatgccatatacccaggttagagtgggacaactgaacgagggtggtgaagtcacaaccaaacaaattggggtgcacgatgatcgtgcacataagttggccattgaaccaggaagtccttacatattttacagttgcggggaagatggtttggtacaacatgtatgtcactcaaaacaattttctgcaattgtggcaactgttttgtgatagcatgtacattgaacatttatttctttacagtttgacttgcggaatgattcaccaatgaagctcttcagctgctattcattctcaaatagcaggcgtcgtgtaaggcttaataccattgccattgacccttggaaccctaattatctttcaattggtggttctgatgagtatgtgcgggtatatgatttgaggagaatccagttgggtgcttcaaatgacatgaaccaacctgtagataccttctgccctaagcaccttatgggtgggaaggtccacataactggtattgcatactcctacgcaagggagatacttgtctcttacaatgatgaacatatctatttattccaaaacaatatgggtcttggtccaaatcctgaatcagcgcaagcagagttcttggacaggcttgagcagccacaggcatacacaggccacagaaatttccgaactgttaagggagtcagtttttttggaccgaacgatgaatatgtcttgagtggatcggattgtgggaatgtatttgtatggagaaagaagggaggtgaactattgaggatgatgcatggtgacaaaagtgtagttaattgcattgaaccccatccacattttccgttcctagctactagtgggattgacaaaactgtcaagatttggacaccttcagcaaataaagtgatgtcgctgcctaaaaacgcaaagcaagtaagttgtattgacataagtaatgttggacttgtatttatccatttccttttttttatgttttacgttatttttattttgtcccttaatagataatagcttccaacaagcgggcgagagaaattgatgcatctcgaccggagctgacgctttcatccgacctcatcatgcatgttttgaggttgcagaggagacagtctgaattgtacagggagcatgaaccagctactgcagatttggcaagtgatgatgatgagtctttcttcgctgggtttgatgatgccaataggaatgtaagatctaactctgatccaagggaatgcattgtgacatgaaaggaactgaagatttacagcctgccccttatacttttagcctgcagcctgatgccctgatataccatgctatgctgcatatgcagggcttagcaaacgatgcaacaagaggaacacagatactcatgatacgtgccggcaagattaaacggttaggacttaagagtgtgacgacctaccttgatagtgttgtaaaccaggagtgttactgggtgttttcatctcatgtacttagtctagtattagtaaaaaataatcactttgctggcaaggaaatgcgcatgtaattatggagtactccgtatatttgagaatttctatggcgatgctaagcgtgcaacattcacagaggtttcccttgtcgcggaaaccagctgcctcagactcttatcgtatgcatgtatactgaatgcttatcgtgttggctcctgtttcgacgtttgattttgatcactcgtccatcttcgtgttccacgtgagcatttgcaaactggaatcaaatttcccctgtatccttgtggtatacgcctctcagaagtgaacgtctgggacagacctgtgcccgtgttgttcttatttcgacgttgacaatagaatcgagaaacctgtcgtgcgaatactgtggttaaacctgatatataataggcaaattttactatagtacactgaaattgtgttgttttaggtctaagacaccgcaaaaactaacttttgggagaaaacactttataatcgtggtattttgccattggacaccgagccgactaaaacaataatttccatgtgcccacatggcagtgactttagcatgaggaggagcagaggcagcggcggtcgacgagcttgtcgctggcaccggcggtgaacgaaggggtttcgcgaggtgcggccaaaagaggatttgtagagtggagaattgcaaagctaatggtggtggtctcgtgcacagtagtgaccaaaatcagtgtcagcggcggtgcgagcggcggtgagctttggcatgctagtgcatgtcgagatctagcttgttttagtgcaaacccgtgcatgcatatgtgcctacatggtgcttggatactcacctgatgtcgtgcgcgggctggcgaagattggacaacagcggcgacgggagtaatggctccggcaccggcagaaatgacagaacgacgtcgatagcgataagcggcccaaggtctaccaaggaagcgtgcgcacaagattagtagagctagtaggaaggctcacgcccaaggaattggacggaatcagaaaggggaatcggaatcggaaaggggaagcggcggccaaaggtgaggaagacgatgtcaatctcccacctcggtgcatgattcttggggatttttgggggtcttcgagagaaagctgtggtggtcacgatggcatggtggcccggtctggggtggttcacaacggccggaaacagcggcaacatcatggtggtagcgctcggtgcgtgctctagagccgacaatggcatggcggcattctcatcgctgcagtagatgaaataagacggtatcaaaagaagaattgtttggcatgatgaggagaatagggaatgcataagagatggggatggcgacggcttggcgatgaatgaggacgtcatcttcttcgctgcagattttagctgctccttccaccaacggagctgccgagcgcacgaagtagccacggcagcacccccgccgtcacctgcagcgtgccctcaactcgaacctcagcagccgcggcgaggctgcaacgtgacgccggccaggttccccatatcgtttggcccggggttaccaccaccccgtggcagcgcggctaccacggttttcacgcgataaccacgaaaaaccgcacaaaaatcgtattaaaaaaataacagttttgcggttttaccgtggttaccgcgcagtatacaacgataaccgcactttatcgccgacaatgaagaatacaaattggaaaaaaaatcaaaaaatacggttaaatatgtgtagaaattagagataattggaagaatatataggatacttagaaatctaacttttaagtgttaaattaaaaaattaggcatgacccattatcattaaaaataaatttacatcactagacataaatatatataacacccaataaataacatcactagacatggagagaggactcgagagatattttctccactaaagggccttaatggccgcatgaacaatccgagatcaggcccattccatttcttctttttttttctattttctaattgacattcggtttagccctcaaatttgaatttatcgaactctttttcaaaaaacttcttcaccatatgacactacaattcaagagctacattcatgttttttttctaatttgttttgattttttttagaaaatttaaatttgctcaaaattcatcaaaccctaatagccgataaccgatctcatagtgtggttactgcacgataacgtgaaccctgacgccagcgtgcgccgcaacgcggcagagcagagtagggaggggatgaggtcccataggtatttcggtcacaccgcgtaaaaaatgggacccctagcgcctcgtcaacacaaaattatattttagtcggcgcggtgcccactatcaaaataccactattatgaagtgttttcctctaaaggttggtttatgaagtgttttcctctaaaagttagttttttcggtgtcttacgattaataccacacaatttcagtatcttttagcaagatttgccaatgtaataacaggtcggttttgtccggagccggattcaaagtctcaaagatcgtgaatccaaaatggataatgccaaatgtcacctgcaagatcatctccaaggatttgctgatgcggttttgggtaatgggtttggcttcccagaaaaaacccatgatcatctcccaagaagtggctatataccagctaaaattaatactcgtcggttgctggcgacgtgccagttgccacaacgccgcggcctccccgatggcatccaacaaggtttggcaaaggcgtacacggcgttctgggtgggcaccgccgtgggtgaaatacgttgccgccttgccgcgtggatcacatgaacgaccgaacaaatcgaaccatgggcaaatgcagcatcgcagtaacaaatgcacaatcaggactgcactagggagaatggatcttctctctctcagtgacctctaggagagggtgaagggcttggagccgcagggctaatggcgtccagccacgtatagcgtgcgtcaggttggtgctaagttcgtctttggtatgtaagcccgtggtgcgtgtttttgtctcttttttctagctataatcttgacgtgttttcctttcttttttctagctataatcttttaggattgtaatttgtgatttcttattagtacgtataaaacttcacatcgtttggtaccgtttggtgtgtgtgtgtattgtttcttttaaaaaaaatgataacaatgctagtaccttagataagagttctcaaaaaagtatcttagataagagaaacaagcaacatgacacccaattacagtctctaaaatagcataaagactctcatcacaagacgtcaagaccctaatctcatcgcataaatcacattttcacacatacaaatgtactcttaacaccacagcacagcatcagttgctattgcaccgttgcacgatcgctcgatcacccgacgctggctctgctcgaactctttcgatcaggccaccagcacatacaccgcgtagatgatccccgggatgtatcccagtatggtcagcaagagatcgatccagaactcaatctgcaaacagtaccccaaatcagaaacaggatccaaatcaaacggcatcaaacacacacacaagcacatactgcaacaagaactatatcagttaagaattaagtgtgcctcgcatgcaacttacacccaagccgtagcgcaggaagacgccgaccggcggcaggaagatggctaggagcacctccaggaacgtcgccgacgccattctccctcttctcagaatttcttgtcaggcagaaggctctctctcctcttctcagacctctctctctccctcactgacgaaatggctggaactgaggccgatccacgagaccacacgtccgtttatatcctgtatttttcagtaaccatgcggttctggagatcgggcgtacgtgtcaggcgatggcatgaggccgtcgcggttgcacgccacgcatggcggttcgttgcgtactgaagtggattactctatctagtacttaaattctggggcttctggctttccagcgtcgttttctcccggtggctggtgagttgtttggagaaaagaactaaagaaggcaatggctatctgccttttggcttgccctgcttgtttgcacctgtactgtgtatcttcgaggctcttttgtgatgcgtgttgatgatggtagatacgaccatgctgcatggacactgggcaccagttgtcagtttgttttctttatcataacaacgtgtggtagaagttgaactaatgactcggataaattggcttttgttacgcgggtgttcggacttcggagtttgcgtgtacaagtgtactccccaggtaaaaaaaaaaaaaaaaaagacaaaccctagtttctatgtttgaccgtccgtcttatttgaaaaaattataaaaaaaattaaaaagaaaagtcacgcataaagtattaatcatgttttatcatctaacaacaatgaaaatactaattataaaaaaatctattatattattaaaggaatagaaaaaggagcctccgcgttcgctctcatggcctagaaattctcacattaatcggagagaaaaagaaaagacagagtccatatagaaatacaatttagaaatagttgaaattcgaaattaaaaaaaataaggaatattagaagaggagactagagtccatatagaaatacaatttagaaatagttgaaattcggaattaaaaaataaggaatattagaagaggaggctaggaaaaaaataaaatagaaattcggaattaaaaaataagaaatattagaagtagagtatagagtccatataggaatttaaaactaactaaaatttggaataaacataataaaattaaaagtagagtttagagtccatataaaaatataatttataaataaaaaaaatcaaaattaagaaaaacatgggaagaagagtttaaggtcaatataggaatacaatttagaagtaactgaaattcgaaattaaaagttaaagaatattgaaagatgagtttagagtccacgtagaaatacaattagaaataataaaaaaatcataaataaaaataaataatattagaagaagagcatagagtctatatagaaatacaatttacagaaaattcggaattaaaaaaatatattaaaagacgagtctagagtccatatagaaatatatataatttacaaataactaaaatttgatattaaaaataattaataactaacacgtatataaaatataatataaaaattcagaaataaaaatatataatattggaagaagagcatagagtatgtatagaaatacaacttacagaaaattcggaattaaaaaaatattataagacgagtctagagtccatataggaatatatataatttacaaataactaaaatctgatattaaaaataattaataattaacacgtatataaaatataatatgaatattacacattagtagttttgtaaagttattacaaaatttaaaattatattgtcattttaatatatttgaataatataatgagaaaacatatatacaattatatgagagaaaatataatgatgctagccgcgcaatctgcgcgagccaccatactagtttcatataagacgatagtcaaacgttggcacggaaatctaaagtttgtcttttttggggacggagggagtaaccctcagctagcacgttaatcaggactacagcaagttcatgaaagaaaggttttcagttcatgacagttctacaaaaggttttccgttcatgacagagagaaatatctgagtaaaacgtactggtttccttgttttgctccttgatctgaagtctgaaagatcgggcgaaatataattgtagtactacggaaaaccttaccgagtctctaatgacagtagtcagtaggaggttttttttccccgtttgggatttgagatgattcacagtacaagcttgatgcgaacgaccgtgggtcatcggtggcgcaggtaggccgtgggtgctcagactgcacaagattggcatccggtagtttgtaacgggccggccaaattttaaacaaaggttgtgtatttggcggtggaataagttcacctttgaatctttgatcactcagcttgacgttgagtttttattacaacattgaactgcaattacagatataatacgtccctcaaatctcaaaatcattgcaaacaagattcctatacagtttttactgatgtggctgattcgagttagtcgtcgtcctacgtggtgttgacatggcactagaagcaagattttaaaaatataaaaagttagtcaaacaaaaaaaaaataaaaatagtggaacccacgtcgatgagtcccactctcctctctacctctcacacgaagacgggaagccgcagtgcgagggtgcggtgtcggccagtgcaccgcccaccttcgtcttgaagcagcgttggtgacgagctgtcgtgggaggaggcgtccgagatgaactatcattgtcatgccacgacatccgagatgagctatcattgttgtgctcctccccctagtcactaggttctgcttaggtgggcgatagccaccttcgccctgtgcacagaggaggagaagtggatgaggtgtcgatggtggagagaggcaagaagagatgtagggacgagatgatggggagaagtc

SEQ ID NO: 68091 - DNA, 44821 bp, Oryza sativa
  unsure (1)..(44821): unsure at all n locations
ggttatggctattggagagcaaagatcgctagtggtgttctggctctgcgagaggtggctaggttgaggagatcgagtggtggatggcattggtgtggggaaaaaggcaggtggaggtcgagggtagaaatgcctcctacccattgccatcaccctttttttgccttattatcactgtgtcactcagcaatgttcgagaggagtgaggaagaagatgagtgacgaggagagaaagaagagagtataagaaaaggagcatatgcaaaggccgacaggtgcaccccacgcttgcccccaccttcttggtttacccacacaagaaagaaaatagtccatggtaggtgggctccacttgctgactcaacgtgtcaactgtggtcaacctaccatattagcagaaatcacatcctaaaatatcgaaggagttgatttgtgctggttttgaaagatgggggaggcgttattgtcggttttgcggttgagggatgcggttcattcaataggaagaaatgaaggagagaaaatagacttattccctacttgcagcatctcattggaggtccagtacgtaaggcccactacccaccacgtccacacactgcaggccttaaggcccagtaaaatatggaccactcacgtgggagttctgtttgggcccaacaggtacttggggacgccgttccgacccaaattggcgtggagtgcaaaacggcccgctcttctgctgcttgccagaacttccgcatgatctctctccagctctccagccgtccgagcttctgaagcgctctgctacttgttccttgagagtttgagacgctttccaccatccagccagcatcttgcgctaatccgctgccgccgtgaagccgatccaccgatccacggaccacggccgtctttttggcttcatgcctccgacccgccttctgctcggacgcctcctctgcgcgaccatcggtgcttgatcttttctttttctttagacaatgataatgatcggtgcttgatctgaccatgtattatcttgtcggcgtcagattaagcaaactgcactttcatcttctctgcattttaagcaaacggagtattaattaattaatttcggaaacaaaatggtaccaatgggcacggcggtagccatcagctgccggagatcgaaaagaggtgggagaccgaagatacagctccgatacaggtcacgggtatcgtcgggcttctcgagaaagcggacggccgccgcccgccggacgcgtgcctcgcgagatgatcgagctggccgttgtcatcagactgacgaggaggtagtagtgtgccacgtatgtatagcttcgcggcaccccattccaatcaaatgatccttgcgacgtgaaccatccaaagaggatcggtggaatttcgacttgcacagccagcccattcctgcaaaggcttttatcaacttctctccgttcgaaaaagggtttatcacgagtgcacattcaacgtgtacacgtatactacatggttcgacactcgaacagttctttttcttttaaagatgttcgaacgtcagttcgggcaaacaacgttatctgttttttggagtgcacattttacaatcccgaggttgcgatatgtggcccaataatgtgcactctgctgcattcccctttggagaaggttggatcagatgtagtatagggtgtgtttatttcacgctaaaattgaaagtttggttgaaattgaaacgatgtgatagaaaagttgaaagtttatgtgtgtaggaaagttttgatatgatgaaaaaattaaaagtttaaaaaaaaatttgtaactaaacaagaccataatgtattaatcacttgcgttgacaacaattggcacactcaaactccacaagccatctcatacactcctattatattattattagtagtattttttgctgggaacattaggtacagtctactattttaaggaggccaaaacgaaaagcacatcctcttttctttttctttttaacgcattgacatgacagtgtagcaccaacaacttcaacaccagcacgatcaagcatattctaccatagaaacttcaacagttcaaccaacatcagcatcaactcctgttccgttcaaaagaacgtccaaactctacctaattgacaaatgatttcaccacgtccctttccattttcccttgttttttttcctcctcgaagaggtcgctttctgtaccgtctggaagacgtcatgtgttcttactatagaatgtccacagaaaatcctgcattccacggcggccgaaatccaatcttgccgatggtttggtttcctcttcctcactttttctttctttcttcctctccaagaagacaagtcacccttccccacgcccctctctctcctgacgagtggggcccaagtcgtgcggtcatagactttttactactacaaccaacgttcgcgacccaccgaaagttccagaaatccaccgctctccgggccccacctgtcgccctgggcccgcatgtcatacgcgtgcccgccaccgcgctgcgggcgccgcctctcccggtgggtttagaaactgtgaggccgatccgcataccgcggcggccgtggtgggcccaccgtctagcgaaaaccacccccgccgccgcgcgtgccacgtttactcccgtgggccccgcaacgaggcacaaaccctaggccgcttatataaacccgacccgccccgctccggtgatcggatccccacagctttgcgtttgcactcctctcgatctccattcgtttttgagttcctcgtttgctccgcctctctttcactcatgggtaaatccgccaatctttgattttattttattttgagtttgattttgggtttgattttgtatgtgtttttggctgattggtttgtgatttttttttttttggtttctctggaatgagcaggcaagattaagatcggaatcaatggtgagtgttcgagcatacgattggatctggttattttatggtatggggtttattcggtgcggatttgtgatggatttttttggtttggatgatgcagggttcggccgcatcggcaggctggtggccagggtggcgctgcagagcgaggatgtcgagctcgttgccgtcaacgatcccttcatcaccaccgagtacatggtaccgtctctttccctcgcctcccccgcgaattagttgatctggtgcttttgagaatgtatgatatgatgattgtgctcgcttcggttaaattgaattgcacgaattcggtgcccatcaattgggattgaggcatcctggtagatttgttaggactatttgttataaaccttgtttggatttgtgatctgcagtactgtagatgtcactgtcgttctgctctgatggaccacaacgcactctgtttataccatggattcataaatgcaattcttgtctgctttgactgaatatttctgtagatccatatagtagatggtttgtgttcatctcttcttttatctgatggtgctatggatgggatgattggtatgagtctattacactacagtatttataaagtcatgcagacatgcatactgatgtgggtctcttttgcatgcttcaatgcatttagaaactatgtgtagttgagtacttgaatggcgttcctacctacaagacctgatttccttgatagtacagaatgctaattttggtttgatctgttgtatatgctaaattggactgtcgttgcgtgcagacatacatgttcaagtatgacaccgtccacggccagtggaagcatcatgaggtcaaggtcaaggactccaagaccctcatctttggcacgaaagaggttgcggtgttcggctgcaggtttgttgccatccatttcagtatcatttttgttcatctgctcacaagagttacagccagtctgataagccaatattctgatgtaggaaccctgaggagatcccatgggctgcggctggtgctgaatacgttgttgagtctactggtgttttcaccgacaaggacaaggcagcagctcacttgaaggtacattcctgtgtcaatttttctgttcagggtcaagctgtagatctgttctcaatcatttttcatatgcagggtggtgccaagaaggtcgtcatttctgctcccagcaaagacgcccccatgttcgttgttggtgtcaacgagaaggagtacaagtctgacgttannnnnnnnnnnnnnnnnnnnnnnnnnnnnnnnnnnnnnnnnnntctcgccaaggtgtttattctgatataatttggcgcctgctcctgtgcgcatgtagctactactggagttttaagctaacattttgtcttgttacaggtcatcaatgacagatttggcatcgttgagggtttgatgaccactgtccatgccatcactggtaggcatcactttgcttaatattaatattggactgagtaaaacgtttggtaccatctatctgatctgatttcaattcaagtgattaacatttgaattcctacagctacccagaagactgttgatgggccctcgatgaaggactggagaggtggaagggctgctagcttcaacatcattcctagcagcactggagctgccaaggtataaacttgtatttctgtatgtattacattgttgataatgtttcgttatcagacatttgcacctaatattgatatgtttcaaggatctcgtggtatcgttttgtatttactttataatgcaagtataacattaaaaaattgactttccactccttgctagtttgccccccttttcctttgcaaaattaaggtttgtttcgttgcctgccaaataacagtagcggtgtttaatcagatggaatgatggatctcacaaaatgtggcaaccaccttatttttgttgtgttttgttaaaactacactgaaccttctgtatcgggcaccattaaacctgtttatcgtgtactcaattagttttactcaatttctcataggctgtcggcaaggtgcttcctgccctcaatggaaagctgactggaatggctttccgtgttcccacagtcgatgtttccgttgttgatctgactgttaggcttgagaagcccgccagctatgaccagatcaaggctgcaatcaagtgagtaattcttaacaactatgggctctgtaaatctttatgaacttctgatttctggaccgagaagaatctgcttgtgttttcagaaaagaaaattatttgctgccttgaatgtttcactaattttgctacatcttctcagggaggaggctgagggcaagctcaagggcatccttggatacgttgaggaggaccttgtttccactgacttccagggtgacagcaggtaaatttacccattgcagtttcttgtataattatgggtcatattggttacctctaggctcttgctatccgacctattaatttaccaaaaaaatgcacttatccatcacaggtccagcatctttnnnnnnnnnnnnnnnnnnnnnnnnnnnnnnnnnnnnnnnnnnnnnnnnnnnnnnnnnnnnnnnnnntggggatacaggttagtgtgtgctgcattatgaaagtgtaattctctgttacatgctcacgacagtctgcttaaaccacattttcctctgattgcagcacccgtgtgatcgacctgatccgtcacatgcacagcaccaactagacgagccctcctcatggaggcctgcagatacaggggagttgtgttttgccccagagaagagtagatgaagcctcttccgagaataaattttaaattctgtatggttttatgtccgtcgaaacctaaaactatacttggttgtatcatggtggttggttgggcctggtcatggctcatattttgtgtctaattttcttgcgcttaatctaaatcgaagtgttgcttcgcagatgcatttgctctgttttctggttgcttcttaaatacgcgcgccctaaaccctatgtgcgcgcgccagagtttcttcctgatttacaacgtttgctgtttagtcattggccaaaccccttagagcccaccttgattgatcgaaacccatctcctccatcgataaaaattggacctaacttatcgttaatgcaagtgcattgtctcgctggggatgagaaaaccaccagcaggtcagcaagccaggagctacttctgtccgctttgtctctagaatttgtagaatgctcgttttcaacggaaatgtggactgccatcaggcctcaattgtgaagtctccattgcacacgaggatttatctctagaatttgtagaatgcccgttttcaaaggaaatgtggactgccattaggcctcaattgggaagtctccattgcacacgaggattgaatcaaaaaaaaaaatttgaaggacgaaataagcaggtgttccagaatgattgcaggaactgataaacaagaaaattgaagaattgtgaacttggaggtacagagtttctgtatctctgttctgaaaactgaagaattgtaaacttgaggtgagactatttctctgcccctgctctgttttcttctatcttggcattttagctctgtaacttgctcttgttttatcgcacagcctgacctgttaaaacgaaaaactgcacgcacaataatggatgatctctatcacaaatgagatcgaaaatcatacgttcatttctgacaagaagtcgtacgaaggagatatgaacagcaaatttattcagtcacaacgatcacatataaagcatggaaatgcagagcagacagccagagaagcagagcgcccaacggtgtgtaatgctgctttgccaacggcgggtggtggctcactgcaagggcacacgaacaatgggacacaaccaaagtggattctttcttcccacgttgatgcctatctcctccgtcatgtctagttcgttcggcgcaactccttcaagaagctcccatttaaagtggtataagagcgtagcaagcatgagctccacggtggcatgcccgaatgtcaccccggggcaactcctcctaccagcaccaaacggaatatactcaaagtttgcacctttgaagtcgatcttgccatcatcgaaccgctctggcttgaacacctcagggtcatcccaatgcttggggtctctgttaattgcccatatgttcacaaacacggtggtgcctttaggcacgtcgtagcccatgaccttgcacgcatggagacactctcttggaagaagcaatggtaccacaggatgcaaccttagagtctccttgatgataagctttagatacttgatgttaactaagtcatcttccttcactggatgttttccttgaagggtgtttcttgatggcccattgaattatatttgaagatgtatcacttcccgcaccaaatatgtcctgtataccgatgtagaatttagtaaattgatttaacaatgtcaagcaaaaaaccaatgtgccactgatgtacattcatcacagtactacttccggtagaaaatatatgacgttttgaagaaggtccagccaaaattttgaaacttctctcattaattttcataatacagtttgaaaacataaaaatgatatttgtagatttgtcctgaaaatcaatactttcatagtcctacagaacttactattagatttttttaacttatttgtaatacaaatctgtggtctaagttgttcttcaaagatcttaaaaaagttaaacattgtatatttctttactggagcattagcaaatgtgcttaattacctggataactgctttgatattgtccatggtgagaggcatgtcgagggcaccttccttctggatcctgaggagagtgtccagcaggtcctcctccatggcgccgccgccaccctgcgcagccatggcgtcccttacctgctcgtgctgccggatggcgctctcgatcagctcgttccccttccggtggctcgcctccgcgcggcgcgtcatgccgccgacggcggcggcgatcctcgacgacgggaacaggtcgtccaggctgaaccccgtgaagctcctcaccgcctccgtcatcgactccaggaactcctcccgcctctccaacctgtccccgatcaccacgcgcatcgtcgcgtccgccacggccgcggcgaccagcgcgctgacgttcacggcgtcgcggcgggccggtggcgacgacaacgaggcggcgacggccgcggcgaggttggcggcctcctcctcacgcacgcggcggaacgagcgcacgcgccgggcgctgagcatctccacgatgcacaccttgcggagctgccgccacatggcgccgtagggggcgaacaccacgccctcgcggtgggggcgcagccggcgcacggtgggcggccacggacgcgacgcgaagccggcgtcgtgcgtgcacgtcacctcgcggccggcgtgggggagggacgcgacgacgacggggaacgccgccgagctggaggcgcatgatcggcgcgtcgtcgagaccgcgcgccaggtccgccatggtgcggtggacgagcgggccgcggagcatcagctggtggaggttgccgatgaccggcagccgccacgggccgggcggtggctggcgcaggcgcgcgccgtcgccgccgcgcccgcgcttgcccccgatcctgacgaggagcaggagagccaagaaggcgcagatcgaccagcacgcgacctgatccatggcggtggaggccatggccatgcaatgcaagcgaccgcgttctggtatggagcggtgagtgcaactgtgcaagatcgccgtgcaaagctcaagcactgcaagcctatatagagaggacggaagtggatcttttgactttgtgcggtttacagctcagtaattaacatgtaaaccatattttactgtatttcacgtgtcagtgacataactataaactatacaaagtctaagggcacccacaatggttatctataggctctctataagagatccatgtcagcatattttcctacttggaagagattaaatgaagagagagagcaaagctatctactaacctggagatagtctatagagaaaaacgagacaatatattagagagctatagatacccatgtagacatactattgagatggtttactattaatttagtctattgctgagatgtacatgttttatagatagcaccttactttaccattgcgggtgctctaagaagagagttacatttacattccacgatgcgctacgtgatgaatgctggtgatagatagatactccctccgtcccaaaaaaagacaaaccgtgggtttccgtgtcaatgtttgactgtccgtattatatgaaaattttttataattagtatttttattgttgttagatgataaaacatgattaatactttatacgtgacttatctttttaatttttttataatttttttaaataaaatagatagtcaaacgttgaacatgaaaactaagtttcgttttttttcaacggagggagcagacggactgcatagccatcgcggtgtcgcccacaaaaagccaagcaggactcgaggtcaaaggaagccatatcttttgagatatagatatcataatgactactgatgcactgctatattggagatagtattcggtgacagcgtacaccatatcagtttcgtttaggtttcgttcgattaattcctcttcaaagaaattgagagaatcgatgcatttttttaggattaatcgaataagctcttatatgaaactgtttctcatgggaaaaaaatactctatacttgttaacagaaaaatgaatctattatgctgaaatttttatagagtaatgaaaaaccatttcaattggcagtagagtttcataaataattactagttctaaattcaaatcatcattacagtttgtaaagagtaccgtggtaatatagaaatatttcatatttagagctattcatttgagtagtgttgaaggttcacacactcacaaactcacaataccttcacttggatgtgatcacaaatgtaacatgtggccttgtaggaatgcgggtggtgataatttaggactttttttgaaatttggaattgagaaaacaaagaataggaaaagcataggccgatgatttgatcccatcttttgacatatagttcgagcctatttgactggaatggtttaggctgaaatctccctggtttggttcgtccggtttggtatttggaggtggggaagtagggtgggttggtttggtgagacttcatgagaaagtaaactagggcgattttcagttggatttcatcagcttattaatggactaattagcattaatcttaaaattcgttctgatgatgtgttacaccacccaaacatcaagtccgtgtctgttgcacttatactgggaaacaattataaactcctgaggggacgttccatcgttgtttgctacctgccttcactcgtcaagtaggcccgctaaagaaatatttgtatgtgcaataatgcataatccatatcacggttcacaactgagattaaaaattcgtctacaattggaaacaaagtcatagaatgaaaatgagaaccactttattaagtcgccacaaccatttatatataaaagcatgataatgcaaggtagagaacccccatggtatgtagcacaactacgacatagtagcttgttccaagggcacacggactataggatgcagataaagagcattcttcctacccacagtgatgcccatctcctctgtcatgtctagttcgttcggtgcaactcctttagggagctcccagtcgaagtggtacagaagcattgcaagcatgagctccacggtagcatgtccgaatgtcatgccagggcaaatcctcctacccgcaccaaacggtatatactcgaaatttgcacctttaaagtcgatctttccactgtgaaaccgttccggcttgaacacctcaggctcatcccagtgcctagggtctctgttaatcgcccatacgttaacgaacacggtggtgccttgaggcacatcgtaccccatgaccttgcatgtttgacgacactccctcgggagaagcaatggcaccacgggatgaagcctcagggtctccttgatgacaagctttaggtacgtcaggcttgccaagtcgtcttcacttaccatctgcttcccttgaagggtactccgaagctcgatttgtgctttgtgcatcgcttctgggttcctcattagctctgacaagacccactggaccatgtgtgaagatgtgtcactccccgcaccaaagatgtcctgtgtatatattacggcattatacaaagcgaaaatgacactattatcacccactactatagaacctggcatctgtgatgagtcatctgtgacgggtttgacgttaaagcaaatttaatgtatacataccaggagaacggctttgatgttgccggtggtgagaggcacgtcgaggttgtcttccttctggatcctgaggagcgtgtccaacaggtcctcctccatggcgcaatcatcaagatgcggctgcgcagccatggcgtccctcagctgctggtgctgtcggaaggcgctgtccattagctggtggcccttccggatgctggcctccgcgcggcgcgtcatgccgccgacggcggcggcgagcctcgacgacgggaacaggtcgtccaggctgaaccccgtgaagctcctcaccgcctccgtgatcgactccaggaactcctcccgcctctcgaacctgtccccgatcacggcgcgcatcgtcgcgtccgccacggccgcggcgatcggcgcgctgacgttcacggcgggggcggcgccgccgtcgtggccggtcggcgaggaggacgacgacgaggcgatggacgcgacgaggcgggcggcctcctcctcgcgcacgcggcggaacgaccgcacgcgccgcgcgctgagcatctccacgacgcacaccttgcggagctgccgccacatggcgccgtagggggcgaacaccacgccctcgcggtgggggcgcagccggcgcacggtgggcggccacggccgcgacgcgaagtcgaggtcgtgcgtgcgcgtcacctcgcgcgcggcgtccgcggacgacgcgacgacgacggggacgccgccgagctggaggcgcatgagcggcgcgtcgtcgaggccgcgcgctaggtccgccatggtgcggtggacgagcggtccccggagcatcagctggtggaggttgccgacgaccggcagccgccacgggcccggcgggaggcgcacgacgtcgcggcgcgcggcgcccagcctgacgaggagcacgagagccaagaaggcgcatgcgcagatgaaccagtacgcgacttgctccatggcgaccaagctgcgcgtttagatggatctgtgagtgcaagatagaattgcaaaagcctaggccttgcaagcgtatatgtagaggtgagagtgtgagatgagttgcatttctacgtgccgacgtagtggctgaccttgctgagagataatagatttaaataaaacccggcctctgtatcccttggatataatgctctatcttggagatactattcggtgaacattggtcatcttggagatatcttgataataaatgttaagaaatttctgttttagttacaattaatgttttaaagtttatggagtatatctgagtcttacttaaaaattaatgggccacatcacacctgttgtccacagggaataataagacaatactactaagacaataagttcacttgccatctcttatctttccgtcgagtttaaatcatatctctaaatcataatactccatccgtttctaaatatttgacgccgttgactttttaaacatgtttgaccattcgtcttattaaaaaagttaagtaattattatttttttcctatcatttgatttattgttaaatatatttttatgtatacatatagttttacatatttcataaaattttttgaataagacgaacggtcaaacatgtgtaaaaaggttaacgtcgtcaaatatttaggaacgaagggagcactaattaaattcgacgtaaaaattatgggacagtttgtggacttattccagtcaacaggccacattctcccacatgccttgattagatgggcctaaacccagctaatatacgtggaggcccatccatactaggccataagtcctgggagtacctatacatctttcgaaagatttttataatcgtatcacacagatttttaatctttatattaaaatccgatagatataataaaaagcaaaaagcaattaagaaacaccataatgaacattaaattaccatatcctcaagaaaaagaccaaatccaatacaaaatttaaaatttacatgtgaagattcaaaaattacagtgtaacttacaaaagttacagtgtaagtttcataaattacactgtaacttacaaggaaatgcactgtaaatttgagtgagaaaatcgagtgagagataagaaaaaatctttcgagtgagatatagcaaaatcgtaagtccttgtctattccgggctagggttttcggttcaaaacaacgggccgtatattatatgggccattatttagtcggactaccagcccatctccccctccaagcccagcacggcgcaacgcctccacttggcccgccatctcgccgtcccttctcacgagtcacgacgagcgccgcccccgccgccgccgccgctccactcgttgcctcctccatcctcttcttccccccccccccccccccccccgcgacgagcgtcggcgacggcggcggctggctggctggctgcctcactcctctcatcgaagatcgatttctctcctcctcaacccgctacctcgcctcgcttggatcgaagaaggtacccttctctcattctcctctcggcggctaccgaaccgggcagcccgccctgggtgggattggttcctttatttggcgatgaactactactacccttgctgatccagatttttttttctgtctccagtccatccagtttgctccggatttgattgctgcgtgcgtggagtactgtactgacagcggtttcttcccaagaatttttggggatttttggggattcagcttgagccttcatgctccaacttaggtgctgctcctgatgcgtcttatgagtgtcggatgccgccatggcgctgcgagggcgctgcaaccacttccactctgcagattgtctatctcatcatgtacgcaatctagccgagatgtcagcaatgttaacctcacggtggaggaagaagaggcggcgaggctgatcaagaattcgctctcaaaggcacgcaagtggagtgtacaggacttgattcagtgccttggagccgattgttcgggaatccggcttaccggaaacattgtggacaccttgctgttcaagtttggggatgactggaaatcggcattgggcttctttcagtgggcgcagtcgagggatgattacaggcacacggcttatgcctgcaatcggatggttgacctgcttgggaagatgaggcagattgaccaaatgtgggagctgttgtctgacatgcacggcagagggttggtcacggttgagacggttgcaaagagcatcaggaggctggcgggtgcgagaagatggaaggatgttgttttgctgtttgataaactggaggatatggggttggaaaggaacacagagacgatgaatgttcttcttgatgtgctctgcaaagagagaaagattgaagtggcacgtgaggtttttgcggtgcttagtccgcacattccgcctgatgcatacacgtttaacatttttgtccatgggtggtgcagtatccgtaggatcgatgaggcaatgtggacaattgaagagatgaaaagacgcggatttccaccttcagtcatcacatacaccactgttcttgaagcttattgtaagcagcgcaactttaggagggtctatgaagttcttgattcaatgggttctcagggctgtcatccaaatgttatcacttacaccatgatcatgacatcgttagcaaagtgcgaaaggtttgaagaagccttgagtgtgtctcatagaatgaagtcatctggttgtaagcctgatacactattctacaactccttgatcaaccttcttggtaaatcaggccatttgttcgaggcttcccaagtatttcgagtggaaatgccaatgaatggtgtgtcccataatctggctacctataacaccatgatttcaatcttttgctactacggtcgagatgatgatgctctcaatgtgctgaaagaaatggaagcacaatcttgtaagcctgacattcagtcatatcggccgcttcttagactttttttaagcagaagaggccaagctgataccgtccggcacttgttgagtgaacttaccagcaaacataatctaggtttagatcttgatacatacacccttctgatacatggtctttgtagagtcggtgataccgtgtgggcgtatcaactgtttgatgagatggttagtagtgaaatagcacctaggagtaaaacatgtgtgatgcttttggatgaagcacaaaggacaaacatggagacttatgttgaaagaatcgggaattacatgagttcctttggaatttctgtttaagtttttaatggatttattctcccatgtgattaatttattagtattcagcatattacatatatttttgcatgaaaaaatgatgcttgctatagtgattgggtgaagcatggacaatctgtatcttaccattaatgcataaactaaaagtcaggaagcatcttttgaccataaccataatagtaggttgttaatcagtagaattataggcaaatcaaatgcaaacgtcttcttttactttagtatttgatgcataatgcatttgtaaacatgatacaacgtcgattgaactaactatttttctggtatgttggcatgagtgcatgacagttactattgcctgagattcaaaatgcacgatcgaatatatacttctgtgtgaacaatctttttagattttaagcactaaatgtgtaaacaactaaacttgtatggattaactgcatataaacattgttgttgggtgtgtctagcaaaaaacttccacaatatatagctttgttactcttttgctagtatagtatgatgaaaactatatgtcgatgtatttattgtattggagaccatggagaaaaaaccatccacatggggatggaaagtatgtgattatattttggacgaagtctctcgcctgacaccttagaatactaccatcattttggtaacagagttgcaaggcatgttccattggcttaagaatcacagcaataataaccggttaacatgccatctctcctacataaaatgattgattcgattatctggaatagtggtctttatttactatttattgacatggagcaaatgatgcaaatggatcaagacttggatacgccttagcaagagcctggaagatttccaatcaggcgttcattattgataagtaaacaagttgctttacatcaacctctccctatttctatatgatatcagagaagagccgccaaattaatttttagctagtgtatgtgagtaccactaatggctggaaataaaattgtatttctttcgggagaaagaaactcaccaaactgacaccatgtttagatcccaattttttcttcaaactttcaactttttccatcacatcaaactttcctactcacatacacttcaaacttttctgtcacatcgtttcaatttcaaccaaacttctaattttggcgtgaactgttctatgaaactggtgctggtaatgtcctggtgtttgaattcgtgatgcctactgaatccactgttactttctccaggcaacgaatttctgcaccatctctgaatccatcttttgcatctttgtctacttgggggtactgagatacatccatccaaaagaagacataaccgtgcactcttgtactggtgtagttggagattattgtcatataggagtaggagtattagttttgtttgtccgagcttgtccaattcagaggtcatgtgcatctgaattatggcgcctttcacttgtcctgacctctgggattccgccggaccctctgtctgggtccctgtcgtcttcacgtaaactgaaccacttctactgaggacggcattactctgcctggtcggcatgtctgcccattgtcaaaaaaaaaaaagttactactagcatgtagttttgattgagtatttggtttacttttttaaaatggtttatatctccaatcctcgtcattaggcaggtcttgatactgaaataaaaggcacacgaggttaccacttgctaggtatcttcaatctgtcgttaggcacacatccggagtcctgactgatactgaaattttaaaaaaaaggtacatgaggttataacataaactttggtatcctttcgaatgataagttgataaccggttgaatcaacgctactgcatgttagcccttcatgggttttcagtttggaaattgctatgcattctacccaaatgtacaaccagcatacccctagtgtatgttaaggcacagctattgcttgtctggctcgcatggtaagaagcctgagcacggtgaatggtggatgtggcattgtcagatgtaagctgtatgatccagtcatattatagcacgattctttcagttatttgatggttttcatcaaatattattccaactagtaataagtcctttttttcaaacacagtataaatgcatgcgctcaaaatgcgcgtacactcatccatataaatgcatacaaacacaccctattcctatgagcatatccggaaaactggatcgatatattttaagattgacgaagtaaccacggacatctcgttatcgacggtacgtcacctatcactaaatgaataattagccgtaatgcagactagccttgactgcacgcacgtatgggttcgaagcatcccgtgcaaagggaggtgccgtcggtgcagccgtgcagggggagggcaaaggatcgttgcgaatgtgcaactgccgaccagtggcatgtgtgtgggggcggagtcgccggccgaaacgagcggaacttttttctggttcaacggcagttgattcattcatccctcctccagtccagtgtgttattttgggctaatagctgaatggcagaatgatccgaggtaagtaggaataaattattaaccattatatagcaaggtgagtatagcttaactgattatatttatttggtgaaatcagcccatctaatttaacacgaatgctcgcatttatggttatttatatatattttttggataggtgggatgtgcgtgtgcacccacattgtgagcgtcttagtttgcgctgtatatttttttaaaaaaataaatttcaaatagtgtttgagaaaattcatgtgtagaaagtttacaaaagttcacgcagtttgaagctcgggaaagcgcgtatatttttattccgttccggagaaaatgaacactcccggtcacatgtgtaggctctccgcgaaataaaaagtaacatgtctaggtgatgccgtgcacatgactaaggtagacgatcaacatgcacacacaacacatgggattcggatcaaatgcagtagtagtatggactgcaacttaaacagttgtagctgctacgttggatctaaatccaacggtaagtattaggtcggttactgtagcaaaagtaccaaaccataaaatattgttcagggtactgtagcacgagtactgtagcagttgatctgaactgtttatcacaaaaatgaatggctgaaaatgcatgcagtcctgagaattacgactgcacccgatctcaatcccaacacatgcgggggtccatcgttgtctgcacaagatgctaatctgcggtcaagggaaagctgataaacactgctccgtctctgacaccaaggttagattgatgatactcctacagattgttcgccatcatataatttcagatcaaaggcgttctctgtccacttcgcagcatccaaatcaaccacaaaatttccaacctgacaaagaaggaggttcattacaccactgattccttgccatttcggctaatgacaagtgaacagtgtggaatgtggttgccagcaatgccatgagatcggtgcatgaatcttcttggctttcttctgatcttcataagatcgatcaccggcgatcgattgatctggagcaaattgtttttaaattcgtcaggaacacgcttcaatttgggggcggtttcgctgccacatcaacgtcaaaagtaactgattaggagatgggcaacgcactttgctttaattctgcaacacatgccatagaatcattcatccagtagcttcgcaataactagccagatcatatcaccgactgtgcgcgccgactggttggcacatactaatcctatatcgttctaatatataagaacttatccaaatacgttgtacaattatgttcttgattcttatattttgaaacggaggtaataagtttgtgtgaaattgcaaaatacaagtagttcgaattatgtttgattcgactgcaaatctgtattaagatgacacattgcatcaatgtacaaatctgacgatgacagattattgtcgggcacagagcgtagtactagtaataagaaccatagtttaacaatactcaggcagagctcatattgaattcactaaattcaaaaacatttgatgctgcattgtacggagtactacacagtggcagccattgaatttgaaatcaagtccattattacctcctgtggctatttttaattacacgcatattactcctgtcggccaaaatagccatgattagcactaacccagtactgaaactacaaagaagaaatcgccatcaccatgatcatcatcatgcacatcaactatgtgcaggcctaccatcgctaaaaagcaagccaccaaactgcacaggacagtacaaccctttttgcatcattttgccaacccaaaccctaaaaccaatccaaatcaaaccaaccaccttcctgcgttgatgaccactgctgatcctggtgcaatggctatcactctctctctctctctctgtctgcctggcgtgcgtgtccccctcatcaatgacactgtttcgtttcacctttaattaaagattcctatcctctccaatgattctttgctctttttttttctctcattctgatcatgcaaaaatttccattgaattctctgtctccctgctttcagtgaaaactgaatactgaagaagagagataatgcatccatccatgtgtgtgtgtgctgtgttgtgttaagctttcctttacaaagaggaggaccacggtgctttgtcagtgtcactgcctcactgtttgtggtctcaccttttccctatcacgtcctcaacttacactagtctacatgccacctttatcactgtgcttgaaatccatggctattttagtggcctaatgcaagagtactcttcttgaccctggtggtgagtggtgactggtgagctgagctgagcttgcagttttggttcttggggtcttgaggagttgagctgtggtgcttaacacaggcatagctgcttgcttctttctttcacaaggtattctttgtcttcagatttgcttcattgcttggtcatgttgtatgtcttattatgtgttcctatgttcttggcttttcctgtcaatgtgtactagactactagtgctgttctgctctgcaatatctagtgttcttgctatttgtagaacagaatgtgaaaagaacagcacatttgtttaattttagagtttcagagcagtatgttcttcacctatgaaaaaaaaaactacaatctcctttcttggcagaaaagcagtggcaacaaattggttaattctattcttctgatctccattctgcatatggcctctccccttacagcttgcaaatgctttcatcctactagcagtgcaatagtgcaatccaaccacgagcaataaataattgtgtttttttcttattcttttctattaatgtagtcagctcacatggtgccatcttcttcttccactttggtgcagttgttggcattggctccatgtgatcgatgagctgagagagctcagctcagctcagctcactttcgccactgcagcatcggcgagctagagctgtagatcttgggaagatccagcaatggagaagccggcgtcgtgctgctgctacttcccgctgcggtgggagagcaccggcgaccagtggtggtacgcgtcgccgatcgactgggcggcggcggacggccactacgacatcgtccggcagctgctgcacctcgacccgaacctcctcatcaagctcacctcgctccgccggatccgcaggctcgaggcgctctgggacgacgacgcgcgcttcgccggcgcggcggggcaccgcgcgggcgtcgcccggagcctcctgctggagtgcgagtgcagcaagaacgggggcgccgccgccgccgccgagaacacgctgctccgggcggggtacggcgggtggctgctctactcggcggcgtcggcgggggacatggcgttcgtgcaggagctcatggagagggaccccttgctggtgttcggcgagggcgagtacggcgtcacggacatgttctacgccgccgcgaggggcgggaacgccgaggtgttcaggctgctgctggaccacgccatgtcgccgaggtgctcgacgaattgccccaacggcggggaaggcgcgcgcggcggtggcggtggccgctcctcggtgttccggctggagatgatgagcagggcggtccacgccgccgcgaggggcggcagcgtggagatgctgagggagctcatcgagcgccgctccgacgtgtcggagtatctcgacttccgtggatccaccgtgctgcatgctgctgcagggagagggcagctagaggtgaggcatctacttcttggccattgcttacttcactacttctgcaaaatgcaccatagtgaacttctgtttgtgccaatatgcatggatgacaaggtagatgcccatttcatcaggatgtttgggtgaaaatatttctaaactcgatatctttcaacgttatgaaaccaattttgccttttgatgcgctgcaggttcttacccggtaatcgatttcaacataaatattaaggaacaaattattttcattcgtcctatgtgatgattagtttgagcttggaaggatattgttcagctagaatgctgcgtgtaacccaaggagacattgagatatgtagatagttgtcattaaagaacattttttttatcttatataataagcataccacgcccagatgataaaggctcatttagttaatatcgtcatgctcaactctccagtgtattatgaaccaaagaataattataaagaccatactgatttggcctctttgacatggacttcaagttgtgcaattcatgaccagattttctttaggaattttagttagaagcaacaaaagctccaatcattgatctctctccaataattcgagttgaaaagtggatgtactccttgtcgatccagtttagatgggggtaaaatcacactttttagatatatacggttcctttctgtctcttgatgttgatattcagccaactttctttctgtttcttgatgctgatattcagccaatatttcttgccacaaatcattgtaatgttaggtgtgcaaagctccagttatatgcaaactagaatggaagtttccttctcccagtattatgcccttatgtatgtaaaacatacctcttgcaggttgtcaagtaccttatggccactttcgacattgtcgattcgactgataatcaagggaacacggcattacatgtagcggcctaccgagggcatctgcctgttgtagaggcattggttgctgcatctccatcaaccatttcagctgtcaacagagctggtgatactttccttcattcagcaattgcaggtttcagaaccccaggcttccgacggcttgaccgccaaatggagcttatgagacacctgatacgtggaagaacatcaaatatccaaaagattatcaacctgaagaatgatgcaggcctcacagtccttcacatggctgtggttggttgtgttcatccagacctcgtcgaactcctgatgacaaccccatcgatcgacctcaatgctgaagatgccaatggcatgactccacttgcattgctgaaacagcagctgcgctcttcaacatctgacaagctcatcaggcagatagtttccgcaggaggggtgctgaattcgactgttctgcgaactcggtcagcgatcgtttcgcagataaagatgcagggagggattgcaagcagccccggtacaactttcaagatatcagatgcagagatcttcctctactccgggatcggaaccgcggagtcccgacgccctagctcatgctctagcaatggcaagtgtgaccatgcccatcatggagatgcaaaatgcggaaatgctgaaaaccatggatcttcagagaagaggctgagctctgccagccgtgccaaggaccgtctcaagctgatgctgaaatggcctcgtcagaagatgtccagaggacacaagaaatccgacgatggcgacgccatggattccatcaagaagctgagcgagcaggccgtcgagaccccggccccgctcaggcagacattcaccaagacgacggcgctgaacaacaagaggaccctcgcggtgaagacctcgactcccagctcggccaccaagaagaagctcaacagcaagctcatccacggcatcatggaggccatgccgcacctggcgtcctcgtctccggcgtccgccttcccgaggtcctccaccccgccgccgccgcagtccggcaagatgaagggcgtctgcctggaactggacgacgagaactcgatgacgacgccggtgttcggcaagctgaaggacatcgtgctgaacaacgacgacgatgatgacgccatgggcgagccgtcgagctcggggtcgtccgtgaacgacgacgcgtcggcggagatgccggcgcggcggcacgggtgcggcaacgggaggctgatcaacatctgcttcggcgcgcagggcctcaccgtggaggactcggccagcgggcagcagaccagcaagatgttcaagcagcagtgcctcagggtgtcctgactcccgagtgactcacacgcgcacacggtataattagcctgcttttctttggttttctgactcgaattgagcttgcagttcaacggaacatatatggtttctgcatgttgaactcgtcgggcttgtgtggattttgttggctgctgcgtgtaaccgtatccttgcgtggcgtgcttggtttctggttgggcttgtgttaacgccttaacggcttacttcgatgcaaatatatttggtgaatgtatcagctagttgtggtgagttagtcgatcgttttgtttaatttaaacaaacaaacagcagttattcacgtttccggaagaatccctgcacaaaacggaatgaggaaagacaagaaatatcttgtgtattgagaatattgaacatccacaacaaacagtcgacaaacatctgacaggagacaacaaattgcgctaaaagacgcatgaattttctttttttttccctgtaaacaagaaaagcagaagctttttcctatttgcccatatgcccagcaaacaactatcgcttcctccactacatcaaaattcgaatttacagcaggaagcaattggacaaaccgaaaactagagaacgaacgaacgaaaaatctataagccgctgggcaacaccttttgccgctgggagctttagcacctggatcactaattcactatgtgcaaagaaccatttggtcctctcattgcttacccaccttgcggcctggccatggcacttcaaagatggctacatacatacacccgacaacagctcggagtaccgcaagtcgcggccattatggctgtgccgtcctccaagcacatatgatgatttgtagggcaggttaccgcgatactccaggcgcataatttacgacatccagcagcatcaaaattgagggccttgttcgagctagtttggaagcagaaggaaggagcgtctaccatatgcacagctaattcagcaactagcccacaagcactgggactagttgatctctccttcctctgcatctttagtgctggggacactgctaggatcttcttcctcttcctcctcatctgctttcatgaagagtcccagctgttccaatggattgcctgatccaggaagaaaactgggcatgccatcctgggaatgctcaggactagtctcatcaacagaactcacaatatgttctgtggttgccgttccaagcatttccaaatcctttagatggaggttgtcattgatttccaccgttctctccatctgcattaagttaaaccactcaaattttagcgggaaaaagaaagctcgacaccagtaaatgcagtttttttcactagcctcctgcagggcctggcgagctttctccctctcaaggtcccgtttacgcttggcttcagcttcagcttcagctcttcgagcttccatagctgcatttccttcagccaacagccttgctttctctgaatacatagataaggcacttctcagggaaaatgtaagaaccatcatttaagagtaaacttcaggtggatatgcctgttaccttccttctggagcttttccagctcctcctgtttgtctccaccctgagctcaccaaatgttcgttccatgtcagaagcagcgcaacaaaagtgaacaaacaaaaccactcgatgaaactaatcacaaacctggctgagaatcccctgtgccttaacaatcacatcagcataacgactcctaaggagggctgctcttaagagcttgtctggggagacttgcctgtcgggttttgaattctcccctaaagtttcatagggaaaggatcagatgatccaatcagcttaatgcactgagaccccttaatggcctcatatgtactgcttgcaaattcatgcttaccctctggggcaggctttgactcgttatcctgctcacggagctccacatcatcagcaggacctgtgattttgaaagttgtaagagcattaagccaaaagctcatccaactgccacatgaaactacaaacttgtgctgctgtgacgattaaggtgcattttgatttctaaaggtaatttttttgtagattttaacccaaaacttggtcaaactacaattacatttagtgcataaaacataccaatagatttatatttcaaagagttctcacactgatattatgcaggtgcttattgttgaatactttttcaaatcaaaataagccttaagaagacgtggggaggtagtagaacagaaagggcacaggaatcttacggatggcatcgactggacttataacatcactcttttcttgctccaccagttgttcagatctcttacttccctaaattatatagatgacaactatttcagtgcaataacacggaagaaaaggaaaagttgtttcgatgagaagaaaaaagcaaccttgacaaaatgattaagagggatagatatcacattcaaaattgagcctaaatttctcaaagtaccacagtaatagattatttaaacgaacatgtctgtttctgaccaaattagacaataagggtatattaaattaatatgagagtcagcttatacagtatgcaggggctgatgtctgattatagatgcatagcaatcaaccggccagaacaaaatattcacaatttttcatcaagcacccaatgacaaatagccaaaataccttcggctttcctgggctaccacctttttcttgttcgctttcactgtcactgcccgactcagaatctgcattattggagtaaatgtgattgaggacacctcaagacaaactcatgataaaggaaggcttatgacaagtgggactagcagaagtccaaacaggaacaattacgcaaacatttagccacacaaacaagatatgatgcatgtattgctattctgaagataagataagattgttgcaaattagcacaagggtaaattgcaggatggtatcctgcttgttcgtcagttaacgatatgaataacagtaaccccagttaaagtttctataatactgataatctagtcccccagaagatcaaagaaagagggaatattgttgaatgcatgagcatgcatactgactagtgggcatctaatggtacagatgcacctacagtgaagtataattgtgcgtacttcttgttcagtgcctcgttagctaaactcaactaaacatctactcaaaagtaattagcttcaagcttaaacgtcacagaagttaatataatgaaatacacaagtgtttgaagtaaccagatcattcttgcaaaaacatatttgtttacaaggacatatatcatactaaagagagtatgtaagcacagaggagcacagaccgctggaagaagatccagagtcactgctggaactacttgggctaccacacttgttaggattgttgtgtgcatctttttctatcaatataggggatgcattcccgcaaatatctacatcctcctcaactggatcaccacctgcagagaaaaagaagttgtaagagtactgtgatgttgcataaaactaagcattagcaaaggaccagggaaaaaaacctttgcagggatttgtagaggagtggctaaggccagatacattagcagcctcattctcagaaggctcagattttgcctgctggctctgctctctctcttgcaaatacttgtcaacatgtttcttcaactcgaatagtaggtcatcactgacagcatggatatcaatctctatctctccatcaccaagctgatctgtgttgttgtcaatgcattgctgcaacaaatcaatgatgtgtgaaggtacctccggatcctcagacaaagatgccaaacagttcccaaatgattctttctcctcgaatgtcatttttggctttacagactctgttggtctaacagactctgttggcctcacacactctgttgacacctcactgcagtccacagggggagtcttcctcctctttgagtcagccctgtcaacctcgacgtgcgcctctgtggcaatggaagccagcttcttttcaattgtcctccatcttgattcaaacatcttgtttagttgaatggcataatcatgcactacatgcccacgaggattgtaagtcatcgcatttgaaaaggtcagccgtacatcggctgcaaattcagatggactcgtgtaggaaccagagtcaagcttattcctgatagttccaagatccatcggtttcttgatgatttgaaaataatctggaatattcagcttaacagcatcaaccggggagtcgaatatgttactacatttctgagtcatcagctttttcagaatagcatcgcattgcttaaaaatcgcatcctcagtcaacaccgtggaagcctcaggtcggggctttgtaggcaagaaacgccccttggcaccacggaccacatggttaccacgctgtcccttcttacctcgaggggcagccgaggacgagagcgcgggagctctattgacagggacagggacagcaaactccggcttcttgaggagattccggaccgaatcaagctctgtgcggaacctcttccggagatgcctcctctcggaggaggacatcttggctgggacgaaaatctcccgcttgacatcgaagccgtcgctgtttaggctgatgcacttgcgcttgggggccgaagagtcctcggagtcaacacgaacggggctgcctgccgcgccctccgactcgccaacggtctccgcgtaaccccgtggcgccgctgacgccatgccccggaacgccatttcatcgtagccccgcttaatctgcctctgctgcccaaactccatgaggaccgtcggtgtcatgtgcccgggcgccagatctgttcaccattgacaaccataagagacccaagattcagtcacgcggaagggaaacttgaacttagcggaatcaaatgccaaatttgaacttcccgtacagcttgatgtaagagaacaacagaaacacaaaacgtattcaaaaagttccctccaaaaaccctaatcccacacctagacctaattcgaattcgaaccccaccccccgccacgcacgaatccgacaccgcgacccccgaatcctccaattcgcgcccagaacctaacggcacgcgaaaccgaagaaaccccaagagaaaaacatccccgaaaattcgaaacggagacggggggtcgcgagaacctgaagaagccggatctgaagagggcgaaaccctaggccggggatccgcggcggacggcggcctcctcctcccgtgcggccgccggcgagccggatctgctccggagacgggcggatctgagggtcgcgaggtggccgccggctcgagacgcctccccgccttatcctcttttttttttctcttttttcttctcttttctttttcctcctctcgagtcgagccgtctcctgcttatccttttccttcgcgaagcgactcgacttgagccgagccgaggtggagggagccgagccgagccggggagagccgaagtggagatccgcgcgggggaagcgagagacccgaaactgggaagcgaagcgatgcgagactgtgacgcgcgaggggcggacgccctcgcgggcggtatttataggcgggggtgaggccgcgggtcggatccgggccgtcggcttcgcggggatcggacggaccaggggttagatctgggcgtgggccccacccgggccgacgtgacgtggagcggggcgcgctttgactttcttcgagaaggtccgcgcgcggacgcggattcctacccgaactgaggatgacgtgtggggcctactatagctcgggaccacctgtcagtgaccttgaggggtcgtgttggggtgggtggtgcggagatcggccgtcttttatcgagcacgcgggatctgggtacggtttgggcgcgccggggagcgaggtgacttggaggagaaggcttggtgccacgtggaaggaggtgcgtggctgggttattggagggaaggatgtaacgggtacgggttaggtaccgaaagagaaaaaacggaaggttagtcgttcgctccattttccatgcgattttcctttttaataaaagggccatattcggcccaagaaaataagggcctaaattgtaggccttttgtataagaataagtccaccttgactcccttaaaagtgaccgaatctaatccgtgtccctgaaccgcaaaaccagatatcatggccccctcaactgttaaaaccggtgcaacttacctcccttagcagttttggagaatggctttactgatgtggtgtctttgactcgatccaactagctaactcagcttgtgggacctacacgttagtgtcacaattttatctctctcctttctttctttattcctctctttttcccacgctgtctaacagcaaccgaggcggatgcggattggcaacgatagcgccgtcgcggccacacctcacggcgcggggtacggtggccacctcgctgacaccgccgcgggtggcgcttctttctcccgctccgcatggtcggcctcgacctccgcgacagccacctcgcggacacggccatttgctcggcgactggacgtctcgcggcggcggtggcatcgccctcgcctctattttcccccaagcgtgcgtgcgtgtacaccacgtccacggcgcacgtctgcgtcaagaacgtcgcgccagccggggcacccacgtcaacagatgggttcgcttctccgccgcgtcgagagggttcagctgaagaaaaaaacatcctccccctgcacgttttcagtgacccagataactcctctgctcatattgagtttcttcatctgggttatgtctgcctgaacacagttgctaccactggtttgttggctttgccaacactcatcttaagttcattaatcaattgttgaattttacgtgtcgtacaccaccaccgtcgccggcctcccttgctccgcctcttcccagaccagctcatccagtgccaccgacccgacctcctccaaccgctcgaagtatgggccacggtggccgcccaagctccgttgggccgctctcgtcacagccgtcggagaacaccgcgacgtgcaccaacgacgaaccaaggcagggcttggtcgagccaacgacgaaccgcgtcacggcgacggtgcaccggacgccgccatgaccgcgaagacgagcagcaacggcggcggcgctggtgggaggggaggccgacatagcgtcgcctcgaggccgcgagcgctgacggctccctctcgcacgccgccgccactccgcctccgtcgccgaagagggagagagagagggagaaggaagaagggatagacctacatgccgcacgcaccgacggctccctcgagctctggctcctctcccacggcgccgccggcgcctacgccctcccgcccaccgctgccactccacctccgccgccaccgctggccctcgctcgccgaagaggagaggggtaagggacagagggagagggaggaggaagaaaggatagacccagtgggccccacatttttttcccgaatgacgaagaggtcccacatgtacgtttttagttctaatgctacataagcaccacgtcaacggcacaccaggtcaacactgccacatagacgccacgtcactaaaaccactctcagaaaccgctgagggagtcaagttgcactggttttaatagttgagggagtcaagatatctggttttgtggttcagggttatagattagattcgggtcactattaaggaagttaaagtggacttattccttttgtataggacgtaagtatggttgctaaggccctaaaaagcgactcttttgtggtcgtagcagcccagtatagtttaatttgagacctatgtgttctacttctaagagcaccaataagagatttgctaaattctatcccaaaattctgaatttggaatcctaaacggaatgatgtaggaagaaaattctctccaagagattaagtaaaattaattccctaaaaccaaaagtgggccccatgccaaactactaacacgagacagtttatttaccttcctcacgcgtgattgtgagttccggatcacggttgtgcgctcacggtaataagatcatgtgtctcgatgtatgtcgccgttgttcgctcgttcccaaccctcgctgcccaccatccgttccctccctaaccctagcatgtcattgtctcctccctcccaattctagttgttgctcatttctcacgactttagtgtacgtcgccatgacactacgagccacaatcgcctggtgtgggcgccaagaactgaggggatcatttttgtgtgggcatgggaacaagatgacactggtgggagttagagattgggaagtgtgcgcgtgaaaaatgatggagcaaaatctaggagagagaaaaaaacacaccctaagtgtcagggttacagataaggcatacttcatatcctacgacttatgtagtacacggatatggtatactttcacgtatacgaatcgttcctatatacgctgttggaatctgttataaattatgggaattatctccacgagacaggtgatttccaaagtcctactcggaagggatcgagtttctgttataccgtgcaagatccgatgtctccgagtcttacttgggataaaaatgacccacgatataaaagggaccccaaggaggggtgcaaggcatcatatctcatcgccaacacacccactgtagtttacgaagtcagagtacgcgaagccaagtcgccgggagatcttgtcgaatacatcgactacgatctttctacttttgttgtaatacgtggttttccatcatcaatctcatataaaaactggactagggctattaacctgacaaggggcctgaaccagtataatccttatcttttgtttgcttgatgtcgtattgcgtagatcatcgttccaatgtaccctagtacccaaatcatctggtctacaagtatcactcgtcgatactaaggtgtcttatgatgggtgagtatcttttacaaaatggtactatcattacaatcactgacacgtaggttccacttttctattgtcatccacgtcaatggctttgtttggatcctccaggctattaaatagccctccggaatcttactatttatgagtattaaacgtagattactaacaaaacccattccataacccctgaactattttgcgagacgaatctaacgaggtatattaatccatgatcaaactattttgtgagacgaatctaacgagatatattaatccatgatttattttgcgagacgaatctaacgaggtatattaaatattaatatacctcgttaaattcgtctcacaaaatagaccaggggttatgacgctataccctccgttacaaaataagactttctaacaatcaaaatttatttatctgagagtatacctatttcttcacttactcatcttaaacaattgcaatgaatgctcatttcatttctccaactaatcacattcatctcattcatctcttgtttagtttcacgtataccaaccccgtgaaaggctttacgagtacttatactttgagagaaagaggatgctaatttccaagataaaaataataacaagatgataatgtcaatgtgtcggttagcttatgcttaccgaacgatgccaggtatacacacagtaatgcccagatttttctcaccagcacacatcagatctagtgacataccaaacgaacagtaaaaaagacatcaataaactgctgcatacagcagcggtttccactcagcgtgtacttgcgcactagcgcgctcattgggcctcacaagtactacatggaaacacgcggcgtgcgtgcgtccatgagtccatccacgcgcgacgagctgtgtttgtgcttgtgcccaaacattcgagcacagagcagccaatcccttcccttcgcatgcgtgcccaaaaaagttgcacttgtcacgtggggcgatggggtgtcgcgcgcctcgccgccttggattctagccacgcagcgggggaacaaaaccacatgctgggcttagcttagctcccatatgcgcacagcagcacagctcgtgctaaccgacgacggcacacagtagcctcacatgagtcgctcgcggcccaaaagcacacccccaacacaaccacacgcactacctacctgcacccgttcgtgcacgagaaacaggggcaggaaggatggccgttagatctctacttccagcggccaagaatctcctgtgacgccgcaaagaaaacgaatgaaacaaccgaaagtaacttgttcttaacgatttaaaaactaatattaaaaaaaataaaccacgctaaaaaattattgaaataaactttaatatgaagttcaaattttgaatttcaattatggctgataagctactagaggctggagcgatgtagaatgcgaactggatgggagggtgaaaatgatgagcggggattgcgatttttttacttactttttttaacttaaaatcaataatatgtggaaccgctattcagaaaggtcatatgttagtgatcacgttaaaagaaaaagtaaataatacttcctccgtttcacaatgtaagtcattctagcatttctctcacatttatattgatgttaatgaatctggatagatatatatgtctatattcattaacatcaatataaatgtggaaaatgctaaaatgatttacattgtgaaacggaaggagtagaatcctgttgcgatgagcggtgcatcgtcgtggggagaacgtgtggctcgttgatgatcggcggtgccatgttttcagggaccgagcggcaacttttgtgctgatagcgtgcgtcctgccgggcgggcgtgcgtcgttatgtgagggcaaggccgcttatatgctgccgcaattaatcggaagaagctgaccggtgccggccctgaggacgtccacggtgcagacgtgcacacacagtacagtctccgcttgttacagtgaccgccaatcatgagctcaacactctctattcccttcctgattgctgacagctgcagctgacttccttccagctatagcagcagcagtagctgccgtcacttcgccaccacagtgttctcatctccctttcatatcccctgcttcctctccgtccatggaggaggtggcagtagcagctggcatcctcctcctctgatctcctcctcggtcacttcagtgcttacttgccggtgatgaggaggtcttctcaggggaagagctccagcggcggcggcgttggcggcgtacggaggtatgacgtgcacggtggtggtaacttgctggcctgctacgcgaaggcggcgaggccgaggccgtccaagtgggacgacgcgcagaagtggctctcccgggcgggcgacgacgactgcggcggcgaagctacccggcggaggagctcctgcgccagcgccgacgacgggctgctgctgcctcctccgccggcggcgcggaagggggccggcggctggcgatcgtggagcaacgtggaatgggagggcgcgcccgcggcgatggcgccggcgctgaaggccgcgcgcggcgacgagggggtggacaccaaggtggtggacgccgtgcaggcgtacgtgccgcagcggtgcgtggtgtcgctgagggacgtcggcacggagatgacgcccggcgggagcaaggagccgtcgagggcgaacactccccgcgtcgtcgcgccggcggcgaccgcccgtgtcgtcgcgcggggcacggcttcgcctgggcaatgcgacggcgggtcgcgtgacagcgccgtcgccggcggcgtggtggatctccgggcggctcgcaagcgcgccgatcaggggcacgacgaagtcgcgggcacgatcacggccgtgtcgcccgcgacggcgtggggcgacgcggagcgcgccaagtacatggccaggtgaccgatcgcgttccctgctgctcatcaattttctttcatcttatcgatattaacatcaatataaatataagaaatactagaataacttatattgggaaagggggaagcagttctttgcttgttatccgtctaaaaccagcaaattcgactaaaaatttagttgctcatctcctctctaaatccatggttaaaatcggtttgaactacgaaatcctgctgcaaaaatgcgctaaagctgtgctctgcatgtgcagtcaacagtgcgcagcattttctttcgttagcattttcttttgtcggacagcaccacatcagtgctgaactgtcagctagaagcactgagacaatgacatcctctgaaagcctgaaaccaaaagcaagcagctaccaccactatacttgtctactcacgtttgcatcgtgtgccattgccattttcgctttgtcaggtacaggcgcgaggagatgagaatccaggcgtgggagaaccgggagcggcggaaggcggagctgcagatgcggacggcggaggagaaggccgagcggatgaggctgcgcgcgcaggcgaggacggcggggaagctggcgacggcgcaggcggaggccaaggcgcggcgcgcgcgcgccgaggccgagctggcgctgggcccgcccgggaggcggtgccaagggttggctgctcacgcggagcgcgagctggagcagcggcagcggccgctcgccctcctctctctcgctccggttgccgctgctgtgccgctgagaaaaatccactgccacagtcaaaaggctcgtgatcgatctgagagtttccgctgcttgttgaaggcggtttctgatgtactactagtaccaggcacagaagaattttatctttgtaccatcaatgaagacccgtttagtttcccaaaagtttttcctaaaaacatcacatcaaatttttagacacatacatggagcattaaatatagattaaaagaaaaactaattgcacagttatggaggaaatcacgagacgaattttttgagtctaattaatccataattagccataagtgctacagtaacccacatatgctaatgacggattaattaggcttaaaagattcgtgtcgcggtttctagacgagttatgaaattagttttttcattcgtgtccgaaaatcccttccaacatccgattaaacatccgatatgacacctaaaaatttttatttcacgaactaaacagtcccgaaatataatcttgttacacgaataaatcagattgttttattgtactattcggcatcaatcacggcatgttatggtccgtgccatttttcaattcaagcatgtggtatgtagttggactctttgaccaacctgtcaggtcggccactaccagtccatttccactctcggcgtcggggccccacctgtcatggacccgaatccccccgcgccgcgtacgcgaaggtcggtgggaaaccggcagagcaaaccgcacgataagaacgcggccgacgtggaccacgtggtgcgcggacgctctgcgtgcccgacttggctttctcctcctctctcctcccgcaacccgcgcacgattcggttccccctctcctcgcggccgcctcttcccccctcgaatcccgataagcagaggcggaattctccaccgcggcagcaacatgcaacccccagttcgattcggctgcgaggtgaggtcgtccgattcccaattcggtcggaatcacgcccaattttttgtctctactagggtttggtttcggtctgaggatttctagtttggtggagaatcgaggtccgatcccccaaccgggtcggaatcacgcccaatttttgtctctatagggtttggtttcggtccgaggatttctagtttggtggagaattacctctgggattttgcggattcgacgtcggttgctagggtttgtgaggggagcgattcatggctgcggggagccacggggggtacaggggctacgaggtggcgagggagcgggagcacgacgtgggggtctctaggaggagcaaggagcactaccaccaccgccacccgagccgccaccgcgactcggaacgccgccgtgacggcgggcgcagcggtggccgggagctgtcgaatgggtacagccaccgccgggattcgccgcgtccaccaccgaggaggcgtccatcggaagggaggacggaggacagggagcccggcgaggtctcaggtgggagtggctcagagaggtccggtgagcgcccaatgaagaccggggagccgagggagaatggtgtcacgcgagtcagcaaggaggaggcgaagatgtccccgagtaagaagaggaagcaatctccagtaatttgggacaggaatggttcaaagcggcaggctcgagaccctgtgaggggcattagagaggtagatgctgtagttgctgagattattatgcatcagtcgcattccttgcctgtcatgagctcactgtctagcataggcgatggacactcgccaatgattttggatgtgtcagttgataaggtacaggagtatgagaagaacaggattgtggatgaggaggaagagggatacccaacaatgagaaacattctgacctcaagatgggcagatgctggcgacgaggaggaaaatgtgtttgtgcccaagaaaaagaagagcgtgtcacctgtcgactcgattgaacgagggtccacaaaaaaggttacaagccctgagtctggagaggtgctggtgtataactcagtgagaagctcctcaaggtcatctgactcgggggtattacagggtagtgcaaaccgggaccttgaagtggagaagggtgacaacatagatgttgaggaggcggctgatgatgattatcctgctggtcatttgctggattctgattttgaaggtgaggactgtaggtctgaaacccctgagtgtacacggtccccacgtaggtgcattaacatgcttcaaggttgtaggagcgttgatgagtttgaaagactcaacacaatcaatgagggtacatatggagttgtatttagggtgagggataagagaactggtgagattgttgcgctgaagaaggtcaagatggagaaggaaagggaaggtttcccactgacttctcttagggaaatgaatatcttgttatccttccaccacccttcgattgtggaagtcaaggaagtagttgttggtagtaatgacagagatattttcatggtgatggagtacatggaacatgatcttaagggtgttatggagacaatgaaacaaccgtatagtcaaagtgaggtcaaatgcttgatgcttcagctattagaaggtgtgaagtatcttcatgacaattgggtacttcataggtaatgattgttaatcactaatttttcttctcctttacacattttctggaattggttttgatgttagattctaataattatgctgttccatagggatctcaagacatctaatcttctcttgaacaaccgcggtgagttgaaaatatgtgattttggactctctcgtcaatatggcagcccgttaaagccttacacccagttggttgtgactttgtggtacaggtaagtcattagacagtctatagtttcatacaatcagtctaactcaaaatttaacttatccatggtcttattacatgctccttatgactgcagggctccagaattacttttaggtgcaaaggattattctactgctattgatatgtggtcattgggttgcattatgggagaactcttatcaaaagggccactgttcaatgggaaaagcgagatagatcaacttgataaggtatatggttttgacttttgtctattccatatctttattttgattaaggaaatcttatgatgaagtgatttccattgcagatatttagaacacttggcacgcctgatgagaatatatggcctggttattctaagttgcctggtgccaccgtcaaatttggcaaacaaacgtaagtgccaactcatttcttgtttctgctggtttatttatttggatcatgcagtttctgtatcatataaagtcttaccactcattcctccctcaggcacaatagattaagggacaagttccgagctgtatcattcactggtgggccgatgttgtcagaagctggatttgatctgctaaatagattactgacatatgaccctgagaaggtaatacacttaatagagtgatccatctgattcttgtatcttcattttgtagctgactgaacatggttttttcatacagcgtatatcagcagaagatgccttgaatcatgaatggtttcgcgaactacctctgcctagatcaaaggatttcatgccaacatttcctgctctaaatgagcaagacaggtacgagtgattttgctttttacttctaatttatcatcctaattctgaaattggcgttttatgtggtttgtaatgttgtatttgcaaaacatgcaggcgcttcaagaaacatatgaagagccctgatcctctggaagaacaacggatgaaagaacaagggaacaatggagatcgtggcctttttggctaatcttgaaccatcactataggtctgctgtggatgctaattttcagcgtggaatcaatggaagtacatgtcttccaaggtgagatatccactggaatgaagtatctgtcttcttggtgcctgcgacaactgatggcgttctttagcaggcatatgaagggggataacatgtctccttatggtccatgctagctattatatcattgcagggttactgggttagctctttctcagacttctggtcacaatctaattcacctgcattataaggtgtgcagatctaacccacctgcatgatctggcctattaacttctatctggtgcaccagttttgcttctgaaatttctgactgtaaagtaccttagtttggtactttgtaaacaatgatcaacaggacctttttttttctgtgcaatgagcacattttcttttgatcttcgcattttgtttgcaagagatggatggagcaaaagagggagggtgcattatgctttttgacgaggaaactggtacatagtaatgcaaaatgtaaggtaatatgctgaggcttattgtgtccactgatgtggtgtataaaaatgaaatgtatctttaatcttttttactgtactttgcaagatcacttcagttgctccctgaagctgcttgaaaactagctaatttatgtaactggtcattataaaaatgatcctccactttctggaaggaaacaatacctgtcagatttttcaatatcacttgcgtgctacaatgatgtattactgactctatctacttctaatcttgtgtaatagaagaaccaatcaatttaatatcatttgcttgctacaatgatttatcagacaataactgactcttgtctacttctaatcttgtacagtataatagaagaaatcaataatctaaggacgtacgattgtattaatttatctttggaccatttgtcttgcatcatttttttgtaacaagtgacagccaggaagagttctttgtttttatttatttatttatattttcttctaatgatctacctttttaatgataggccgctagacttttatcaaccaaatcattattcatgataatggtgaaagatgtgaaatgtttttaactctgaggtgctggcttttccctcatgaaaaggcaatactcactgatctttgattcattttgctatcctgttgccgtatgttcagttcaaatcatttgcttgtgctttacagatgattatagtgaaatcagtgattcttatgatgtccattcttgcacttatcataataaatctacatgtcatattgacttatcactaaagttcttgccagaccagttaatgatgttcctttatgctagtttgaacttgctggagagttgattgggttcactgtaaacaactaagtgttctgtgacacatctgcagcttaagctgtggctataccgagacaggaagcttgatggacgtatctaattgacttatttgtggaaggcttcgagtcttcatctgtgatctgttactgttgtgaattctagtggtcagtctgctatcttatttctcaatatattggtgatcagtatgcttcttgctagtagcttcttttgtagctgtacacctgtttttttttttcaatgacagatatattcttgacatgttatattttcagtcctgcccatccacatatgtgggacatgattttagtacgagttaccagcctagatgtgtggatgaatcaggattttgggcaatccataatttcttgtatctccttgtgtccatgcctgcaagtacagctgtgtgttatcctgcagaacctttcgttcttttgttattctttttcaagtagaatcatgttgaagaattgcttgcatttgataaaataatattgagtctggattctgcaactggaaactcattgtagactggtagaaacaaggaaaactgtgcttttgtaattcatttccacaaatcatttactcttactcctacctttttcctttatgttttagtaagatgcagactgaccaagaacaacgttgaggcgcaggacttgtcatggttgtccagtattttcgaaggttgattctatcaattccgcctgccttttatatatatttacaattacccacattccttgccagttgacaccatgatcctactttttatcttctgctttacaatctttcagtgctgctttgctaattttctactgtgctactatcaaattgcatgctttactggcactattttcactaattatttctcttgcgcacctgtgaaaagtttgatgcccctgtggctaataacttttttagtgtcatgggttacttgttttaaacttataagtaaatattctattgagtgaaaggcttgaaaattttgtcaccaagatgcgaacgaccattaaatactcagcacagttaaggcttggaaaataaggttacatgtttagcatgacagtgcgtgaagtagagaaaaaagcgctgtcagcaattatgctttcctgaagcaaatcgatgtttctggtattcgaacttttagggcatacaaaacagtctttatagcaggctcttgggggtaccacctaagctcagttaatatcaactctctgtagactcttagcgccagataatagggaatttcctcgcatgaggctagataaaggaaagaagaataatgataaaaatattttggtggattcatggttagagcctctgttgtctcaattgttataagaggatagtctctaagatgatgtgtattaccaaggaacccatactaggctcaactgttgtacttgccatactacctccgttgtaaataagtgcatttctggtttcctaagtcaaactatcctaattttaaccaaattcatagaaaaaacaatactccaataattactattcaaatgagcatcattagttccattgtgaaatatattcatagttttacttatttgacatggtagacattattactcttatctataaacttatgcatttgatttagtagaaaactacaaacgcacttattttaggatggaggtagtagtagtttgtctaaatgagaaacgtatccatgacagtcacactcacacactttactccatttccttaatacaaagaacaatcttaccaaccatgcttggttctaccagtatcaacactctattcttcttgtcgtgtcatggatctgcactgcatcttttctaatgtctttgcatttacttgttttaactgtccctttgtttgtgtcccctgcaaacctcgtgcaaagcgacaatgggccatactccgagttgcagaggcaacaagttctctacgtctcctatcgtatgtctgaccattttgtaggagcggagttcagggacctttgtcaaggcaggcggccggatttcttgtttccggtgctgcaatatgctcaggcgcgttccttttttcttttttttttggagaacttagccactaggtaaaggttgtaaaatgccgtagcatctgttctctgtaaatacgactgggtgaatacagtgaattggtatgtttcactttcgtcgatttgttggtttgaaccgtgtctgaagttcacaaatctgtacactatcatgctgcatcagtcgaatctctgggaaacggaatggtcatcagacgtcttttgagaatttgagatctccgagcactatgtataagatgtattagaacgtgtctttttttctgaacacgtacttgaattccaatcactatactttgtcatttcacaaacaaatatactagattgaaattgacgagaaacgcatccccagtttccctacggagaagtaccatccaaacaaccatgcgtatcgaggtctgaagatgcaaaacctgtggctttcagtttctactttcagtttccacagtccagtgctctctgcttaggtggccactggaggaggaggtattgcagcaaagcaggtagcaactggtgggccccacaccctgagtgtcctcctccagaactatagacaaccaaatgggccggaggcacgtgggccggcccgggcacggcggtactgtggcc

SEQ ID NO: 68092 - DNA, 780 bp, Oryza sativa
  unsure (1)..(780): unsure at all n locations
ccgtcaggttgatctaactcattcngcactgccgcggccgactctagtggatccccatgattgaagggctcatcatttcacttggcaattagtttatggtcaaacatgttttcttaggagacagatggtccatggccagcctgttgcatgtcaagggaaataagtgtttaatgcacgcttcaaggaaaggccgttgtttttgcaattgattttagttgaactcttttctgaaaacaactaagtgagtgcttctcaaacgacacggttgagacagtgcgtctcgttcggtcggagtatgtgcaatgtatcaggctttagacttgattcaaagttggcacccggccaacagcttttcaaacggccacccgggcctacaactttcaaacggtcacccgggcctagctgatcccatcagctgcagatttttcaaacatcgaaccccttttcacaacagcaattttacaagcagtagtcaaacaaaactacgctaggaatcacctcacatccgcccatgaccgggggcacggctgttcgaacagtttgttaacctttgcagagggggggtacactttacccacacgacattactaacccggatcacccagcccatggggatcagccacgttgggagaactccaagctttcatgacaaancattttcaaaagccgatacaggtttaccatatgccgacgagaggggtcccagaccaacaacaggtttaggtccagaccatactgtgccaggaagcccaagggttctccctgacacccaccccgcga

SEQ ID NO: 68093 - DNA, 950 bp, Oryza sativa
ccgcgcttgaattgcaactcggactccaacctatactagactcttgtatttatctagatttgtagcactaagaatacgtcatttggtcctaaattcttatattttgtgacaggggagaagcaaccagctacactagattgtacaccatctagcactatgaatgaagtaatgctaggttatctaatacttaatactttaatactaagttgttatatattaggacaaataaaatagcaattcagtcattttggttaaccaaggtatggccgaataagaccctgtttagatgggactaaaacttttaagtctttatcacatcgaatatttagacactaattattaatattaaacgtaaactattaataaaactcatctataattttggactaatttacgagacgaatctattgagcctaattaatccataattagcatatgcgatgctacaataaatattctctaattattgattaattaggcttaaaaaatttgtctcgcaaattagcttttatttatgtaattagttttgtaagtagtctatatttaatactctaaattaatgtctaaatacagagactaaagttaaatccctgatccaaacaccacctgaactcaggtagcacgaaaagcttgaccgaattagtttaaaaaatcggtctccatcacttatgtatcggtctggaaaaagcagtccggtttttcaatctcggtcatttttctcccaccggcacagtcaccagacagtggtacgatcgacaaggtcgcgtattgctgccaccaccacgtgctaaacctcaagatttgtgcagtcggcatgcaaaactcctctagtcaatggagcggctatgctagtactcctacattattccgtcgtcactcttatacaaacaaaaaaacggtgcggtgtacgcaccgtcgcggcgccgaccgaccgccagtcgtcgaagcat

SEQ ID NO: 68094 - DNA, 620 bp, Oryza sativa
aagataaaagaaattccaagcttttccatctaacatctccttcattagaccagaaacatgcttgcttgcaagctacctgacaatgcaaccgtccacggactgattgcatatcgtacaaaaatttctgtaacacaaaacagcactagtcaaacctgaagctttcatggaaccaaaccatctctagaatgagcttgcactccaatttgttataatatccaataaagcacacactctctcctggtattactgtagtaatgatcaaatttcaatgttcagaagaaacaccattaaatcatgaattggatttaaaacatgtgtccttccatgtaacatagtcctacagagacagctgccaacagcagtcgatgcaaacttctggttttcatttggtataacttaaaaaggatgaaatgtgcaaagatattgcaaatagaaatggatgttgtagaatcaaatgcgaactgtttcagagctatccacaagaatagatataatatttctttatagtactaacagattattcccaagtaacaaaacagcatgcagatcacatgagagcaatgcaatgacgaaaaaatcattagtagagataatcctatggatatatatacaatagagca

SEQ ID NO: 68095 - DNA, 871 bp, Oryza sativa
agcagcagcaagagcagcagggggaggagctccatgcctcgcgcgttgtggcgccaaccaaacacacacttcgtcaacttcaaaggggaatagattttgccgatttggagggtataaactaaatttgttaatatatcaagggtgaaatggtaattatttcatctcatgacatatttcgaagagacccctgtaacaaccaaaattactggtcttggtggaatcgcagcggcctgcagatctcctcttctccgactcaatcattcgccctgcgctgcacaaggggaggggaaggaaaggaaaaccaattggatctctcaattaatcgggtcaggagcaagcggcctccacgcaacgcgggaggtaatcaggtagtgcgatgccactgcttacctgcttttctgttcttaatttcgccgatgttttcccctctactgaaatttctttaaactgtctcgaattgtcgatgcattcgcggggaagggaaattttctgttcttgttcgtagtttcttggctcaacctctccatcggctgcagtttgggatttcaatttgggcgccaattatgggtagctttcggtgacatctgactgttaggtttgtcagcactcaaccaaatggcctggccgcgagtttgtgcaaatttctttcgtccttttgttgaattgggcgtaaatttgatgtatgctcttgcctacattacttgtagttatgtggaacacgccgagcagaacaatttcatggtcttagtgtactctgatacaagtaatgttttcttgagtttggtgggagatgtcaaactttgtttgctagcactagagatggttggttggttttgtacttgtatttcatgttgacctagagcatgttttg

SEQ ID NO: 68096 - DNA, 8782 bp, Oryza sativa
caaatcctgtataatgactaatcctgctttgatctaatggaaagctaccattatcctaaagaatgcctatacagtagcatctacaatatggctcaacatagtgcgcaataaaattaaggcactttagattctcccgttcctaggcagatcttttatctgcatgatggtagctaatcctaacagaccgatgctcaatcaaatctccgcttggaatttaacacaaacactcagcatgtgaattcaacaaatgttaggaataaaacaggaacagagaatacatgaaacagtaacaacactcagctaaccaattgaatttcgtatacatggcagaaatgaacataattaagcaaccgacaagatctacgttcagtaaaaacacacaccaaacaccagaaatggtatattcatggcacactaattataagtgccatcaaatgctagagattaactagatggagtctagaactcaagatgttagctatctcatcagttttctgcttgaaatgcacaataagcttctggtcaacatcacccgtactgatgctatcctagatttacacaataagcattcttcattcacatttagtcaaaagttctaatttagttccacacaattctctacaaaatcagttctgtgcagctgctatttgtaatcaatacatctgctatcctccccttctcttgtcaccagttggatcagagttaattgaaagtaagctaagaatccagaacaactagtagttattttgccacaagcgtaaaactccaccatcccatcccgcgtgtacagtttgcatagatcaatcagttcatctacaccagcggcagcgtctattcaatcaatagaaccctaaaccaaaaaaacaaaacgccccctaaaaaaaaatcgacagccatatctaggtcacgcagcgggggagccaaggggggatagataatccgcgattaccgtctccgggagcggcgcggggctcccgtcgtcgccggcgccccccttgtcggacccttccatccccttccgctcctcctcccgctgcttcccctccggctgcctcgcgtccgctgggcccgtcggcggcggcggcggctgctgctgcttccgctttccacggcctcggcgcgctggcatgcttcagcggcgcacgcccatcggctcgccgggggatcgaggcgatcggccgcgctggggctagggcttggcctccgcgccggcggcgacgggtggggggtgagccggcggcggtgacgacgacgagacgggaggagggggagattgcgaggtagggcgcgtggtgaaaaaaatcctggtaccacagccgtgttgtgtagtaagtggggattacgccgccgactcgagcttacgtactgtgtagaatacgccttctctcgaacacatgcggatcataccacactggcgtgtagttgtaagtatgatggcttcagaagttcagattcgtcctatcaaaaaaggaaaaaaaataaaaagaagttcagattcgtttcaagaaagatcatatactactcgtcatgtttgggttagcttgtatccatgtggggattttgtttcttacatctcttgccactaaagattatactcatattccttcgagaaagattatattcctacttgagttcttttttcgaaggaccaaaaatcttttgtgactcatcattttaatctctagtatactgcatcattggtttcatattataacccttggccctgttcctttctccaacaaaagtcggataaaattttaaatactcgtgtcacatttttcaaaccgctaaatgatatgtttcatgcgaaatctttatatacgaaatttgctttaaaatatcatattaatctatttttcaagtttgtaataattaaaactcaattaactatacattaatatcaccttattttacgaaaaaaaacttaatcttcatcttcatgagaaaataacaccaccctagtactttgattattttcctattgaagcccttttatgttctaatattttttaaaaaaacaatttaacaacatctacaataccaaattaatttcattatatgtaacattaaatgtattttgataggatgtttgttttgtattgaaaacaatttgatcaaagttataaaagtttaactaacaggaagttaaagcgatttataatataaaccgaaggagtatgtactacagtggcgaattggatcgacttcaataaccaaggtatcatctacatttgggagaaaacaaaatttagtttactcgcatgctcaattgttgtgaaatatcgcgaaaagaaaaaatctttatgaactagagtcccgctccggtgcttttctacttagagtagaaattaatccgaaccgttgatcgtatttaatcatatggttgagatcgagttctactcccaccaaattttatgggagtagaaatgtggagggatatatttgtccaaaggtaataattcgcgtagggtattatcgtaatttgtttttatctaactcttcaccctctctctctatcctatcctaatcgatgccattctcctccatccccgcctccgtcggtgtccatctccttcgccgcctccgtcgccggtccttctccctctccacctccgtcgcctccagcgccatcggcatctccttcccctccagcaccgtcgcctcccccggcctcaccgccttctccgccccctccatcgccgtccgtatcccccgccgtcgccgccttgtccgcctcctctttcaccgtccgtctcctccgcccgcgtcgccttcttcggccccctctgtcgccgtccgcctcccccgccctcgccgcctcctttgacgccattctgggcctcccgttcacctctatcgtcgcctccgtcgcccgtccatctccctcgccgcgttcatcgcctccagcgccctcgcggccctctgccccatccaccttctctacctccagcgacctgtggcggctgcggcgtacgtgctcggcgcctcggcaagggcggcggatccacgatgtgctgcttgtatggcagtccggcggaggagaggctgatgatgcaacgtcgccctcatcttgatgttgccgttgattgttcatcccatctcttcggctgctactggttcgagaacaggtaacgtcctgtcccattttctcccatcacttcctgataaatgatacagtaatgttgtaggatcactattagatcctccaaaagtagcagcctgacgcgagcaaaattcagttttaacaccaagtagtacttcataagcacaacctgctagatttctactgaggttgttgtcccaactatacaaatttgaaatgtgtctgacaaatgttatcaaatcaccacatagataattcttctgtgaccattagcgagagatgatttccgcttgtgcttcattctattttagttgatgagcagccgacaacggtttaaatggttatgattttgcttcagtaaaattctagtactaattctggagttctctatacttcgtaaattacacacagatcgatttttatttgattcgttgcttgtagaaatagttccactccctgtgctacatcacataagtcaaatttcagaagatactactagtttatagtggttacggccagcatggaacagttaaggtccataattttgtaaggctctgcagatcattttattttggaggctttccaatgtgtataattttcttttcattttttcagccatgcagtggagctccaatggtgagtttgcctttcattgtcttgttggagattgcacgttggaattactggcaaaagtcatgcttcttgcattcaagagttgtatcctgttctgcgagtatgatctagcagcatggtatggggctgatattttataaaggacaacgaccaatgtctgaattgatatatatatatatatatatatatatatatatatatatatatatatatatatatatatatatatatatatatatatatatatatatatatatatatattgtactcgccataatttaatgtctatcacagaagcagtaatatactcccttgcgatatatcccacgtggttttctttggtagacagtgttcgtgttttaaaacaaatgaataggcaaagatgatatatatttgcacttgggagttgccgtggatggttactgcaagatgctttaattttgtccatgtcgcgaggggtcaatcccagtaccacaccacttctttttttcaatcatctaacataactgcaactatcttttttatcttcacctaacagaaattaatctgcaatcaccacggttaatatatcctgaaacttggcttgatagagctttattttttgctaattacacccctgacctccacatttacatgcatatcacttaagaagtatataatcatctgaacaaagtctctgatacaacaaaataaaaggctgaagaaacgtcagtggtccatccccaaccttcaattgtgttgatgcttcttacatgctccctctcatagctccggcttgaggattacttcacaagttgcaaacatgttcaggaaagtgaacaattctgtgatacaagtgaatctgacagtcgcggctgctttaaaatctcatctcataatgaaaatattctagcagttaaagaatatatatcatgatgatttatgagaatgcttgtggacatacatggacaaattagtaattaacactataagttagtaactatatggaactgctccctaaaaaaacaactcaggaactgagtttctaattcagaaatgttccctcagataaaaactcaggaactgtgtcaacgatcctaaaattgtgagtattttcttttcaaacaatacttttagatttttagaaatataccataacagaaattaacagtcaaaatagtattttatacatactcaagttcagagattcagttgaattgtattttattcaaataatattataatagctagcacattacatcttcagaattaatatatactccaatatattgcatccagcccgaatcaaaattcagcatccatccatatcaaagtcacatccgataaatcgaattggaacttgtatacaacgctatacatgcaatctagtagcaatagcattagcatgttcctcttcttgtgcggttcgtttcaaaaaagcaggttcctcttcttatcaacaacgaagaaatcaaattcgattgagagcaaacgcacaagtaccatgataatcgaaaataaatactagctgttagcttgttcagtgggaggaggagatcaacgcggatgtgaacgcggtcgtcagggccgaagaaatcggcatggccgtggtcgatagggaggagatcggtgcagtgcagatgcgcgtggtcgccagcaacggaggttggcacggccgtggtggctagacagggatcagcgacatcgacggcgggaataccaggggtggaggatggcaggataatcgaggtcaccgacggggagataaaacggcggcggcaggatgaacgccggctgatcgaaatgggcgccaccaccggaatcgagctgtgcaggaacggacggcggatggatgcggcgagacggtcggagcaatacgagacttaaaagaaaaggaaaacacaaatacccaaattacccttaagcacataattagtaagtactaatatacccttccaaacagatggttcagatcatttctactggtagtagaatactacgagtagaaagcaccgtagtcaagctcaatgaactaacgttcaaagttataagactgtccgggtaaccaacaaaaacagtttggggaacctgactgcccatgctcctccccttcgtgcaaataccggctcactctttgaaggatctttggttttacagtacagtacagttttaccataagtaatgcaaatgctactaagatagttagctgtagctacctgtggaactccaaggtagttcaggtgagggctccaataaaaatcatcaaataagtgagaactcatgaaaatcatatttaaaagtcttataaatttatgaaaaaaaatttaaagataaatataccaaatcttaagtccaaactcaactttatttgagaaaaacaaaaaagacaaatttcagatgaatagtgttatattactattcgagtaaaatgcgttgcaggtactacaacttgcaaggtgggtacaatttagtcacccatcttgtaatttgctcaaataaatcactcaacttgtttggaggtgcaaatataataaaaaacgtgtcacgcgtattatttttgccaaggtggacgatacgatggcagacgtgacgatgagttggcgaaagtaatacagttttgtagaaaaacccttctactatattactctttgctaatttaattggtctatttagatatgttatgcccgtgtgctaagccatgatcgtaggtttttttgttggcgtgcgcacgggataggacggcgccagatctagcgagtcgcggtgatagcctgcgtggctgcgtatgaatccatcatcggcgaaattatcaacgctagccacgagcgctcctatttaatccatgaatatgatgtcaaattaccacattgaagagtgcatataaaaattggttttagcacaaggaacaaaccgctttatttcccaatataaagacaaacatatatccttgtacatcaggcaagattcagtactggcagcaaatcacgtattgaagatttggagtatcaaacaaacatatgtactcaaacgaaaaattgaaacaatataagggctaatttgcatctttgttccttgcatacaaggtgaacctgtcatgctgacgtggcgtccaccttggtacaaataatattgcacctctaaacaagttgagtgactttttttttagataatggaagttgagtgacttatttgagcaaattacaagatgggtgactaaattgcacacaccttgcaagttgtggtacctgcaacgcattttactcttactattcactcaaaagttatctcttttttccctctataatagagttgagtctaaacttaaaatttagtgagaatgtatttcatacttgcatctatctacagtattcttctcatgaatttatacactttttaggtctagtctcatgggttttcacttatctaatagtcttcattggatatgtcgccgttctgattagctcacatcaacttctcctttctgcaaagctaaaaaaaaagggacctatcaagtcttgattataactttgtacagcaacctgtggcggtgcgtacgatgatcacatcatcgcgattcactcatctttttccgtatagccatattccttggatgttgtcacgatagcacgagtgacaaaacaaactcggcaaaaaaaaaaaaagttcccattttagttcaccatcgatttcgaccgtggattttcttcgtgggtcatgacacacatcataaaaaaagaaaagaaaaagaaaaagatgaggtcgtatgcgtaatgcgttcactaatcactcgtcgaaatcaatggctagtggtaacaggctaacagatagtgccggccgctatctgaaaagattatagaagaaaagctttagcttaatgctaagcgtgtgactggccggaccggaggaatgacaggtttttgggctggttgggctcaaagtttagaagaaaagggtcgcgtcatgggccaagtcagcagcccggcccacctgcagccgaagcaaaagcaaagccagctgccgagctgcgtcgtaaaggcgaaagcgaggcaccagctaacccctctctgccttttggttttgtgtttttttcaccttttgcatgcgtttttgcctgcctttttccacatgctttggagcttggaaggcgcgcgccttcgcgctagtggcaacgtaaaaactattgcaacggagacgctcccacattggcctcgtgccaggttagccggacggtcgtagaaccaccacatccacaggtctgtcaacgagttttctctttcttaaaaaaaaaatcataatgtctgcatactcactgaaaaaatcaccaccgacgacgttcgacagatatatcacctactacttaaaaaaacaattatctataatgtttcatacataaatctggatgaattggcttgacgataagaaacctagggttaagctacgctcacttcggatgtcaacgatttttctaacgcaaaatagagggagaaaatcaccagaaaataaagtgtcgccggatttgctcgatttcctcgtgctcttgcctctccttcctgcgcccttggcgtgtcaaagcagccggtcactcaggacgatgggcgcacgcgcacggtgtgccaactgccaaagccaaagcagcagcaaaagcattatcaaaagcgcacgagcccgcgccaaataggcgccctgcatgagcaaacgtgcatatggttgatttctacgtgaattgagtgaatattagtggagaacgtttgatttgattaacaagcgaggatgggttttaattgcgatggtgttatgataaagttgtaggtgtatgactctactcagatcaaatattgttctttataaattttggccgtatagtactctgagtgtatccataaataatgagaagaagaacttatattcttttttctccttcagcccgtacgcagagtgccagggctatccatggccatgtgccacctgatcaaccgcacaactttcccctcccaaaaaaaaaaaaagaaaatagaggccccacattcttatatttcaatacaagccactaatttccaatatattatt

SEQ ID NO: 68097 - DNA, 55448 bp, Oryza sativa
ctggctaacgattgtcagtagctcataactaaggttctcatgtgatacgaacataggtgctgaaaacaaaacggacactgttctaacatgcactaccctatagatatttgtcaaagtatgataccgtactttggattatcgtgatagtatttaaaaaaaatcactttctctcagttacatataaattcttctattattttgggataaaagttaactccttcgatttatgtgacggtggtaatataagtctatgtttaattagatgaagtagtatcatcagctatatttttaataataaatatctttcattaatatatagtaaaattaaaatgttactttaagtcatctataacatacacaataaaaaaagttatataaagttgggaaactccaaaaatttaaaagaaagaatcacacataatacaaatagatatgaactaactccattattgtgacatattttttctaataaatttgaggatatacattttcaagtaatacgcccaaaccagttattaacgaacatacatttcaaatagagacaaaatttttttcaaaaatatgatccacacataaacattcgtaataaaagttcaaacaagattaaacaacatgcccgcgcgtatgcgcgggctaccttcctagtttttataacagttgtactccctccgtttcatgttataagatgttttgacattggttaaagttaaactactttaaatttgactaagtttgtaaaaaaaatagtaacattttcaaccaagacaaaaaatttattatgaaaatatattcaatttattgatttgatgaaactaatttagtattataaatattactatatttgtttataaacttagtcaaacttaaaacaatttgactttgatcaaagccaaaacgtcttacaaattgatttgatgaaactaatttagtattataaatattactatatttgtttataaacttagtcaaacttaaaacaatttgtctttgatcaaagtcaaaacgtcttacaagctgaaacggagggagtattatattatttataatccaatccataaaggttaaagaaagttacttaaacaatctgttcagtggcttatttcttttttttttaaaaaacacaatttaaatgcacaccctatgaatgaacaaatatacaccctattcctatgagcacatccgaaatactggactagtatatcttgagatgaggaagtcatcacggtgcctcatctcgtctaccactaaaagaataattagtcgtaaatacgatcactcgtgttaaatttaaaacttgaaaccgttggacacattccacaataaggaacccaaccagtggagctacgttcacttcgttgttcaattgcttattaggtactcagtccgttctttaaaaaagtccaatcctaactatgtacctgggtacaatatgtatccagatatattgttaggatttagtttttatagtacgaaggatgtaagggtgtggcttatggttttaaaaagtttgaataaaaaattatttgttcgtgcttatccaaaattaaactaataaaaagagtgaaatgggtgaaatattgttttgataaagcagtggttctaataaagagatctgtactaattaggctctttaaggaaactcccatactgaaaacagattaaagccgttaattaggttaatcatgtcatcacgattatagattgcattgggaattcttctagacggaaaaatacaattgagaacatcatggacttttattttatttccaaaattaagaattaaataaatataaagttgtacctatcttcactttcaatttagtattttatatatctatttacttctgaaattcaaaatcaataataattagcaagatataaagggcatcattgacatatcttcaccaatataaagggtgaaccctacgaaaccaggtaatagttattcttgttatcataatgtgtggataagttgtatctcacatttaagagaaatggctggattgagaagaaagaatggacgagagagagagagaggagagtattaatatttatttattgcttgtcgcctgttattagtgttactactaagatgatactactacctttttactacttagagtatctcacaaaggtaaactagataacaagcttccttactactcactttttgacatattgtgaatactctactgatagatcgttcttttaatcaaaaccacacaattcaataaataatcattgtattcactgtatgattaaatttagagtaaattttacaaaaatatgtatatactttgatcaaattatcacaaaactatatatttaataccaaatttatcacataactacatatttaagttggagtatcgtaaaactacaaatttaataataaagctatcataaaactacatgtttagagtcaatttagtcacaaaacttggatgtttataattgaaacataacattattagtgctaaggatttaaatcctaaaatatgtagttttgtgatacttcgctttgaccgtatagttaatgttgtgataaatttgttattaaattcgtagtgttttttgatacatcaccaattttgggataatttggcgaacgtatttatagttttgtgaaatttacttttaaaattataatattaataatccagaataaataaataacgggtaaacttcccatgaatgcctaggaatgaaagtgaaaggcggctagctagccgacgacggtgtgtcctgcgtcgttgaccacctaccccccaaaagggtactactccgtactagtagttaagagtaacagtcgcggagaactgtcaacagtaaaatcatctcgaatgcaggaagcttcacagaaagcatctgttgctagctgtttcacttgtactaccgttctgtttttgcctctcaattctcacgtgaataatggaaaatttcgacgtcctcgcccgagcgccattgtacttagggcatccacaatgtgttgagaaaccaggtaataggcattcaatgctcctctacaacctggtaatagccattgtggaactagtaaataagtagtaccgggtagtatgcttactaccgatagcaagggaataaataatgttgtttacacaatcgagacagagagagtacaggatgaaagcatctttacttatgaatggttgagggttggagaatattttattggtggaccccaccttaaaatctcatacacattatgctgcctgcgtacaactactacctctgacccaaaacctgacactaatgctcacttcaattttatacattggtgttgccctcatgtcatctgcttcaacaaatggagaaaaataataaagaaaaaaaaaagcttcctctcacatttcgcacgagggaaaacaaaatcggctactccaagtcagctgcttcaacaaagggagaaaataattaaaaaaaacttcctttcactttcagtgatctaccattccaagcagtgatataatatggggaacgctaataggcgatcaatcgattggagtgatcgatccccattcccctgtacgctcctctccccttcctcatccccttcttctcttcctatacaccataaatttttaaaaaaataaaaaaaacaaagttgaaaaaaatatgtatagaaatactatattaaaaatatatttgaatttaaattcaaatttgaaacatgtatgcaaacttttgatttataaactttgggtctataaattaatatttgaattcaaattcaaatttgaatcgggtatgtaaacttttgacttataaactttgggtctataaactttagatgtatagaaatactatatataaaaaatatttgaattcaaattcaaattaatatttgaattcaaattcaaatttgaatcgggtatataaacttttgacttataaaatctgggtctataaacattagtttagatgtatagaaatactatatataaaaaatatttgaattcaaattcaaatttgaatcgagtatataaacttttgacttataaattttgggtctctattctttaggtgtataaactttatatgtgtaaacttgaggtgtataaactttagatgtataaatctattaaaataggaaattaatgtggtgtcaggaaaagaagccagccacgtggggaggggtgatcgcccaacaggattttcgtataatatacggccgggaatgctagataccaataagatcccatgcatatatagcgctcccaacggcatgccttctcctattttctcgacgcgagtcacatgtcacgcacggttcttccgctcggtgggccaatggtttttgctacgtgtaaatcacgacataataagtaactcacgtcgctttcctagctgagcaacgacggcctcatcttttcactaatgctgatgtttatcagccaaatttaaaatttaaaatttaaaatttggagttgattttagggttttttcatcgaagtttatttttcagtctttgctttagatcactaagaacacgtatataaaagttttgttcacaaatgatttttcatttgcaaataagtcaaatgatggggccgctaaccatatgacataggttctttctcatctttacctatttttctcctttttttggttaaatttcttatttatgagttgaaacaatttgattttttaagagaaatatatgatacttgtgtgacaccgatatttctcatttatttttttcttgaaaaattttcttttttttccaactagcatggtggcccgcgcaaattatatatatatatatatatatatatatatatatatatatatatatatatatatattcttaatttattattaaaatatattaaagtgacaacatatttttagttctgtactaactttaccaaactactaatgtgtgtaacattcatgctgtattgtatatacgtgatagttattaattatttttattatcaaatttaagttatttctaaattgtattcctatatggactctacgctcgtcttctaatattcctttttttaattccattttttttatttctagattgtatttctatatggacactaacctaattttaattttatttttttttaattccgaattttcattagttctaaattgtatatcggtatggactctagtttattctttaatattctctattttattaattctgaatttcagctatttgtaaattatatttctatatagactatgtttttctttttctctaattaatatgagaatttctaggttgtgagagcgaacgtggaggctcctttttctattagttcaataagttaatagatttatcaagcgatacatatgtatggttctgctaccttatgtaccttatattgtacaagtatcttatttgatgcctttatagatacattatttatctttgtcttttgtatgtgctaccagtacgtagaatattattcttggcaccaattgctatataatcaggacgggatcgggcatttaaatatttgccactttaaagatgtggtaattaagcatttgccactcgcgatctatgacatataggctctcatatacctatgacatatgggaccaatgacaaatccttaattgccacttgtaaaagtggcaaatagttaatatttgtgtggtactatgtggtaccagcccttgtacccacttgtatcacatgatacctacctagtaccactgtagtaccgaccaagtatcaatgggtattaattagctggtaccgacgagcatcagttggtgcctgataagtaccagccgatacccctagtacatataggataccagagtctgatactttatagatatcatcctgtctgaacaagatccatggtatagtagcccctataatatagttgcttgtggcaaactcataacaggtccaactctaaccacaacatgtgtaacttgcttacttgcagcatatatagtcttctttttattccaagatcaccaacattacagtgttctagacaggcgaagtagtaggagttcttttaaaaaaaatattacaaagctcctgataaaccggcatctagacagagcctgcattggtacatagcggctagaattttgaaagggttggaggtatccaaacgtagccatgggtctgcacgtagcccatcctcttgctcagctcgtcggcctctgggggtccccgggttcccggcttgtacggcagggccttcaccttgccgtcgtcgatgtcgtgcagcagcggagtgaagatctcccacgcagcctgaaaaccaacacggcgtcaggtattcattcagtcacaagcgagccgattgcaagtcacacagcgtcaattacacaaagcacaaaccttcagttcgtctcggcgaacaaagtgctgctgatcccctcttatcctgtcaaaaaaatggaagatgatatcatggttcatcctttatatatatataatggattaaaaacccggcctctacatccaacacggatagttcatcttggatatggcatgtgttgggaacaaggcgcaatgcaagtgaagaagttattagtgtagcagaaagaaatgggggaagaaggatggaacaggacgtacgtatccaggatgaggcgttcatacgcttctgggatcttcacgtcttggtagcgtagcccatatgacagatccagctcgctttgttcggttgccatttctagtccgggtttcttgacctgcaacagttcatgcactttgttcagacaacacttgtttttttggagttctcttcaggcaaagatgaatagacaattctgacatatcttcagataaatgggtttacagaagttgtacatacagttaatttcatatacatggcttccgatggctgcaaccgtataacgaattcattccttccttgcttcttgcctttatcagggtgaaataaaaacagagttttagacaccattggcagaagcaaaacaatagcagacagaactgtattgattcaaataggttacggatgtttaactacattcacagttatgtgaaatttctctagtctgctcatgagacaaaaatacgttttgttatcatgtaaaggtaccacacacgcacacattttaacttactgccagattcttgcgcctatagaaaacaataattagttatctgaaggagttaaacagaacaagtttttacttcataccaggtcttttggacagtattattaccaataagaaaatgacagctcacttccaaatctattaaacacaaacaggctgacaagcagggtcaacataagtcatagaaacagtgactcaaccaattagtaaggtgacccggcaaaaaccaatagtaaggtactcaggtcaaattgaaagtagggagcttatagcaattttagatactaaaatgtagcaaagtagcaaaccgtctcatgcttattcttgtctattttctaaaggaagtgttgcttatactaaggtgtcacatcataacccattataagaagtaactttttcataccaaagcactagcacatttttacattatttctcagtattatcaagaaggaatgtttagtactctctttagtgcttgcataatgcaacatcttatatttccaatagagttgtctgccgttatccattaactcttgacagagatattcagatttttcagtttgttttggactagcattcagatattctaaatcaaataacttagtttcttaaaataggttgtgacttttgcaagatcagacttgatgacaagtttcacagcacatttggatacgagaaggtgtttagcgcatacatttaaaaatgtcaccaggagcatccttgaactgcacacgtatctctgctttcctattgttcagtgctttgccagccttgagaatgaaaggaactcctgcagcgcacgattattactatgttaactgcactgaaagataagataatggtaactggagggtcagaaatagatgtcaatgcagcttcattttttctaggacaatgtaggcatatggaaaatggaaatcttggaaccaaatgcccatgtttgatcaaagtgatgcagaacagctgaaactcttgtatcgaaaaaaggcagttcagttggaaaatgcagatatttgtttaaaagtgacttcaaaatactgtatatctgtatgttgtaaggtgtaacatataccttcccatctttcattgtttaccctcaatacaagagatgcaaaagtaggtgtgttggagtcatctggtaccgtagagtcatccttgtagccatcatattgcccaaggaccacctcatcatgctttataggtgtcactgactgaagaacctgacattgtggtataaaaacgcagaaggaagtattgtaagcaacgaaggatgacaaaaaaaaaaaaaaagatccatacaggtttcctactttcagttagagtagaattgtataaggagaagcaaaaaccttgactttttcatctcttatgtgctcaggcttaagagagacaggcttttccatagccaccaaacagaagacctgcagacaagagcgaaatcaatacagaaagggggcctcaagtcgtgaaagtggaaacagcaatattctcttttgaggaattataatgcatgacaggttgctgctctgcctcctcgtggtataacataagaatggtgatggaataaagcaccaatcattctgaatggtcaagtaaaatgttcagcagtccccacagaccacagtaagcaaatgctaatgtagattcacattgggaagtgaaagtgcacataaaactcccctagaaaaggcaagtgcatggaaaactatgctgcataccaaaaataaatatatttacctgcaacaaatggttctgaatgatatcacgaatgatgctgcagcaacaaaagcgaggtcaaatatttacatcagcgaagacgaataacgatgcacgggaggtcctctaggtgattatttgtctcataacataaacaccataatgcagttgatttattttaaatctagcaaatactgtattatcataaaaactaaagaagtttaatgcctagaagaaaataataaaatgcaatttgtatatttctaatggacaactgtacacgatcgaatgacttcatgtgaactatgggaaccataaaccatttacaatatatcaaagtgattttacacttttatagtatatccacagtcacaagcatatgtgcttacaacaaaatactttcagtaaaaggaactttcatgcaaaataaagttactcccaacatacccatattgatcaaagtaccctccacgtccttcagtcccaaagtcctctctgaatacaatctgcagcatatatttattatgttcaagcacatgttgttcgcaccatgataatgataaaactttccagaatttccaaaactaatccattcaactttataccaataacagaggatgtcatagatgtaactacagttgacaaataaaaatacaaaggactacatagaaaagcatattacctgtacattagcaatgttatcacgattccaaagaggtaggaacaaacggtttgcaaagcgaagcacaagctgaaatatattgaaatatgttatagtagcatggaatatatcgttcaactaactagacgaagccatacaacttaccagattttggaccaattcttttcctaaatagtggtcaattctgtacagctgttgttcattaaacagctctccaagctgggcactgagttcctctgcagactccaagtccttcccaaagggcttttcaacaataacccttgtccagccagaatgagaagctgaaagcacaatatgacagttacagaaggtgactagcataaaagaaatgaaactacaacatagtatagcacaacttctaaaaatcaaacttaaaaataattaatttgatttttaatttactatgaaccaacacatgactcaattaataactaagagcaaattcattgcacccaaattgcttccagaaaaccaaaactttatgtttcaaaagtcccaatgaaaaagcaatgtcaggaaaagagtcggcgactgctaggaattggtatgcttagaaagttgaaatagtagcaaagttccacaaggcaaatacttagttaaataaagaggacaaaaggaaaatagtacaaacaagagtggatacaaccaaatatatttcctatattttgaaactctgttgtggataacttcactacaccaaaggaagtgcagcagctttcaaaatccgtaaaaaaggggaagtactcacatggattcatgcagtatgatcttatcattttgcatactgaggggtagactgatggaggcaatgccaaataaaatagtctacgtgagcttcctggtttgttgttcttcgaagtttcattctctgaaatggcgttatttaatgatgcaaatccttccccgctattgtaggaaccactaacatatttaatctgcaaagaaaattcaacgtgttacgaaatctaaatgcaaagaagctattcatgatatcagtgacttactaattgcaaaaattgtgaaatatgttcatctgaagctcctttgaggtatctgcgataacaggagaatgctatttaggcactagtatatcatcagacttaaaaacagagaaactacttcctcatacagaacatcccaatttatttttacatgaaattcttaaattattttatggtaaatgttggtgctaatatgtatctttcttacccacgaatgcgttctcttaatccatcatccgaaatatttgatcttgcatacccaaatatatggacttctccagattgtagaaatccctatcaacaccaaaggttacagttcagaactttgtacgtgtgtcaacctgacaaaacattatgtacatggcatgcaatagcaatatagcattataaagtgctgcagtagaatttctgagcaattataactcatcacgaatgcatcaattttatttctttttcactacaactctttcagaagtttgacaactatggaagaagctagtataccaaactatgtaagaagctactagttacaatcaaattacctgctgaaagaggtgaaacagcgctgggaatgttttcttcttagcaaggtctccagaagcacctaggaccacaatggacaagcaaccagactctgaagacagttctaggtccttcaaacctgacaaagaactgaagctagcccgccctgatgaaggggaagaatcaccagatcctcctgacatgatgaactgtatggtctcttcctttggagacaaaacctaagaatgtaaaaaaaagtactgttagtctcaatatgaggtattcacaaataacttataatctatccaaaactttaatctatgctaatatgaacaaaaaggtctattggttgaatgatggattcttgaactgaatcacctgtcagtacctaacagccaatttgcaacagagtgtaaatcaaaatgaatgtttgcttcagaaaaaaaaaatcaaaatgaatgggattaaagttggtttcatgaaatcagtactaaactactaatatagctaccctgaacttacatcagcgaactactcccattgtttgccaacttatagtcaaagttctcataaaacacaaacaggtactgtagttatgctagtcaaatgcttctatgagattctaatacagaaaaaaaaaagtatctacaagactacaaatgtaaatcaattgaactcggtgcccctacattttgtacgggtaaactggaacacatgcaacaactgaaccactgcactcactagaagtctagaacacacaacagcccaaccacccaataatcccgaaataaactagaactgcaacttgcaaagcaaattctgttccgagagcttcaaatgattaaaacgaacctatacagcaagcgcatcagggcgccaggaaatcgaggagcacacgcagaataaacacagagatcatgaacacaaacacggcgcacagaacagaggaatttgcctgcgaaggctgcgatgagatcctaaggccgcagcgtagcacaatcccttccacggcaaatgaaatcagcaatggaaaaaccgatcgcgcagaactctgctacggaaccgatcaaccaccaaagaggaatctaagcagtgtggatgaggaggaggagggagactaaccagcagtggcgacgagatttgacttcccgaggtggaagaagaagacgacgacggcgaattgggcaatggatggtgatcttttccgggtgcgatttatagggggatcttcctcactcacacccgctttccatccacccctccactctcctcccccgccgcttttatactcgcggacgactcgtctctcgtcggcgttgttctcagctttgacccgcgcttagccgcctctctgctttgccacacgcccacacccaccaaccctgctcgcttactgttaccctaccaacatagtataaatcaccaatcttataagttattttttttaaaaaaaatagcgtcaatccgattgattgaactactaatataatccatccgtttcacaatgtggagagtgctagaatgacttacattgtgaaacggaggaagtatataaaaaatgtgaaccgtgaagcgtaacgctgtggtagaaccaagtcaggttcaagctctatatttactcccttcggattgataatacttgtcgttttagaccagggtgagatcaaatcttttattatgaatcatttttaaaatatttatctttcaaatatggctactatatgtataaattagtcttaaaaagtagtttaataaaattatatatttgttaatatttttatacacattataatgaaaaataatggtcaaaattatttttttaagactatgcctttgtccaaaacgataaatattatccggagtaacatggatgctcgtatttatcaatactgactttatcaatttgtaatgtatttttgtcaaggactacgtggcaacttcatcaatatatactgtgtttcaaataaaatatgaatgaaccggtagaaatagtttatcattaacatttaatatttgtatcacttgttttagcgatagaaatagtgcatcagtaacatttactcgctttatataagttaatagaaaataaaactacgacaaataaaaaatcctaaaatgaactctataaatttcaaattttatatttttgctgaagctgatatactgagatttacactcccgtcccgtaaaaaaaatatacttagatacatagttagaagttgaacatccataactaaatattgtttttttttctatggattgaagggagttgaagatgcaggcgataagtctgagatgagaccaaagcaatctgtggaatgccgatggattgtagttttttctatggattgtagttttcccgagtatcctcactctggtactctagtactctacgtggccgtgtttagttgtaatttttttcttcaaactttaaactttttcatcacatggtttaaatttcaaccaaatttttaatttttgtgtgaattaaacacacctagtgttggtgacaaagtttttcactttttccaacccatgaggccatgacatgacatcaaccaaatggcgccgcaaatcgagcatcgtctggaaaatcaattcacgagtcgaacggcgcggccggtggtatatctatcatccccatctctttgttctttttttttttctgtttcgatgatttaacaatggtcatcagcgacgtcacaaaatacgctaaaaagcaccacgttttaatcctcttgtggatattatgggtaccccatacccatacggcatggttatccgactagtcataggggataacttatatctatggaatatgtaatagatcatgactcgggtattacgtttccttatatattacggaacggcctaaagtcctggtttgataatattgtaaagtagatttaggaaaccgataccgtattggttaaggtttctatcttgtaatcctgccccccaccctatataaggtgggcaggaggccctctagggggcatgatgacacaaactagatcgtcagatctataatacacccggcggattcaaatccccaaacaggagtagggtattacctctcattgagagggcctgaacctgtctaaatcctttgtctccgcatccatccacttttaggtctcgtgcgctacccccttttattattgccgaattcatgtttcgacagttggcgcgccaggtaggggttgcgtcgagtttcccatcaacaagcgcgatggaatcaatttcatgggtcgccgacttcgttttcgctttgggagttttcacttcctttccgtcgaccacttcttcaacctcctcttctctgacttgatccaaatcagtcagggggaaactcaatctgatttttatcattgtttatcatattgatttttaatctcagattaatttcttgctattttttgttgttgttcgcatataactacgccgcactattgaggcgattgatgctggtcatggactcgaggcgtctcagctttccggtcgatcggccgcgagtccactccgccggcttgtcctcgccaccgccattgctgatagcaacaacgacttcaccgtcggccaccaccgttgatgggcatcgtcatctacgccgccggtctgcctccgtcgccgccgactggtgtccccgcctatacggtcggttggtcaccccaccgttgatgggcatcgtcatatacaccgccggcctgcctccgtcgccgccgactggtgtcctggcctatacggtcggttggtcacaccaccgttcatgggcgtctacgacttcaccgccggctcgcctccgttgccgccgagtggtgcctccgcctacacggctggtctattatgccgccgctgttgggcgtccacgacttcaccgccggcctgcctccgttgccgccgagtggtgcctccgcctacacggctggtctattatgccgctgctgttgggcgtccacgacttcaccgccggcctgcctccgttgccgccgagtggtgcctccgcctacacggctggtctattatgccgccgctgttgggcgtccacgacttcaccgccggcctgcctccgttgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgaccggccgcctcgtccgccgccgactggtgtctctgcctgcacggctggcctattatgccgccgctgttgggcgtctacgacttcatcgccggcctgcctccgtcgccgccgagtggtgcctccgcctacacggctggcctattatgctgccgttgttggatgcctacatcctcaccgttggctcaccttcgttgccgtcgactggtgtttccgcttacacggctgacctattatgccgccattagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggtgctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagataagataatttattttctgctcttaataattgcaaaagtacccgaatagtaaactccgatccgtgaaactttgttccattaatgacgaactcatgtcactcatatgcatgtttgggaagtgcttaggccgactcccagtgcttggtggctatgactagtcgggcagagtgtttaaacgtaatgagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccaccggctcgcctcgaccgccgccgactggtgtttccgcctgcacggctggcctttatgccgccgttgttgggcgtctacgtcttcaccgaccggcttgccttcgccgccgccgactggtgtttccgcttgcacggctggcctattatgccgccgttgttgggcgcctacgtcttcaccgaccggcttgccttcgtcgccgccgactggtgtttccgcctgcacggctggcctttatgccgccgttgttgggcgtctacgtcttcaccgaccggcttgccttcgccgccgccgactggtgtttccgcctgcacggctggcctattatgccgccgttgttgggcgtctacgtcttcaccgaccggcttgccttcgccgccgccgactggtgtttccgcctgcacggctgccctttatgtcgccgttgttgggcgtctacgtcttcaccgaccggccgcctcgtccgccgccgactggtgtttccgcctgcacggctggcctagtatgctgccgttgttgggcgtctacgtcttcaccgaccggccgcctcgtccgccgccgactggtacttccgcctgcacggctggcctattatgctgccgttgttgggcgtctacgtcttcaccgaccggccgccgcatccgccgctgactggtgtcatcgcttgcacggctggcctgttataacgccaactgatgctatcttcttcacggctggctacatcgctgtcactacttataggcatcagtatcttcaacacaagctgcctacgtttgccatggctgccgactggtttcttcacttccatggctgcatgattctgccagtgttgattggccttaccatcttcatcgcctttcgtctcgtctgctgctgactagtgccctcgcctctacgtctggtttatacagctaccactactgatggacatcatcgtcttccgttgccgactggttatgccgccgccgactagtgcttttatcttcacaactgcgcgtcttcgctaccagtttgcttctgttgccgccgactcgtgttcacttcatcacggcgatgcaactttgtcatcatggtggagcgacttcatctttattatcttcggcactggcaaactctattgctgctacttcgcaagttttactacttcaccaaccacgacgtctttgtcatcatgcctcgacatctcggcatgcgatgccatgttattttactacaataagaggctctccaacattcatgatttctacttggaaatcttcaacacatatcttcaatcaagcaataactattcgacgacaagaggctacagttttcgactctatgttcagttgtttcccaactaatcaaagagtcgggggctacacaaatacaaggctcaaaatttgacaaattttatgtcaagctgaagaaatcaattcatcaacccacgagtcaactccaggagtcattatcttcatctttgcttcggagcagacattctacttcaacaacttcaaatatttcggtttagacgagttgggcaacaacatcaactctcctccaagtgaagcatctacaacagctataacattaatttgatggattattgtcactaacatcatcaccagcacctctgcttcatcgaccctgacatctctgctgttgctaatggatgattatgttttcgccgacttattatttcaccttgacggttgacctactatgcaaatgctgatgagcgtctttgtcattatcattggttgctacactgctattggctggatcaccgacatcgtcatcttcatcatgtcggttgcgtttgtcgtcgtcaactattttcttcatcttcatgattagtggatttcgccatcactgttgatgcgcgtctacgtcttcatcgtcggtttgcttttgtcaacaccgactgtttcttcgcctccatggttatgcaacttcattacctttgattggtgtcactgttttttactaccactgacatcttccgttacttctgatgagcaatttcgtcttcatgttggtcatttcatctccatgccgactgcgtcagctattgccaatagacaattttgactatgacaaaatgacaagctatatgctcaggggctcatcaactcaagcgtgaggattatatctccaattgggacttgttccggatacattccacatggattcatagtcatgagtctatcttctatgctcaaagactggaccaattattattccccgtaaaggctatcaaccgaatacttgcgccagtcgggattcaattattatatttattttggagtatcccataagggataatcattcagatcagaagctattcatatgagctacacttggtctatattacccagaagatttgttacccgggagcatgttacatgcgtcatcctttaaagggtatcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtaaagctttatatagctgtcccgctgacttttttatatagtcaaggtgctgtttgggtttatcaagcaattgattggatacaatatcattgctttttgccacgtaagtgtgcatttttattgaccaatattatggcttaggctgattatatattatggtcatttgtcaggcggttggtaaatcctttatgagtttacttactcggatgttataccacatatgccatatatttccaggtgtggtgaaaccatgtgtcttttagggacttaagcacatctgttaaagcagtgtgcgcatggcgtatgcccaatactttggaaatttctttattcacagcattcaagcttctttatagctattttgctatatcactcatcatattttacaaagcagttggtatatcacccggatcatgttatttggaggattcacaccgcatatgctatatattgatatcaagtcacttggttgattacgattatcaaaaccactcggttggttggattatttattccttgactatatgcttggtttgttcaattaaccacattgtcgggggctacacctattaggtgcatctagtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggatattatgggtaccccatacccatacggcatggttatccgactagtcataggggataacttatatctatggaatatgtaatagatcatgactcgggtattacgtttccttatatattacggaacggcctaaagtcctggtttgataatattgtaaagtagatttaggaaaccgataccgtattggttaaggtttctatcttgtaatcctgccccccaccctatataaggtgggcaggaggccctctagggggcatgatgacacaaactagatcgtcagatctataatacacccggcggattcaaatccccaaacaggagtagggtattacctctcattgagagggcctgaacctgtctaaatcctttgtctccgcatccatccacttttaggtctcgtgcgctacccccttttattattgccgaattcatgtttcgacacctctatgacctaaatggtcttatgataaactaaacgtcttcgtcctaatctcgctgacgtctcaacgaacccataaacaagaactcaatatccagctcgctagtacggagtactacgctgtatataacagtaaattatacagaataatcaccattcatgtactaatgtattatgtactccgattagtgcatgaaccacatggctaagctgaccactgtgctcgcagatctaagcatgttcctgatgcacgtgttaggttctttctttttactgccacttgcccggagaatttttttcatttttaaatttttttcttttaatatttacagaaataatccatgggcgcaaaaaattacaaaaatagaccctgccgccctctactagggcggcaagctgacgtggcaaacggggagggacgggcggtgacggcagacggaagagggagggtttttttttgcacgaaaaccattgccgccctctgttagggcggcaagggcccccatgcaaaaaagacagcccgggcctagtactttttggctggtacgtctagtagggcggcaagggacccagatgcaaaatgtacgagccaaatgctgcgaaaattgcatttagccccttgccggctaaatgcaattttcgcagacggccgcagacggcgccgtcgagccgccgtctgccacgtcagcttgccgcccaccactagggcggcagggtctatttttgtaattttttgcgccgatagattatttctgtaaatattaaaagaaaaaaattaaaaatgaaaaaaattccttgcccggagatggtctccacggagtcgccggcccagctagctgcagcccaaggccggagcaggccggcccacaggccgtatccctcggcccagtacgggatcaagtcggacttgcgggccaggtcaactccaattcggactcttgagctcgtcgcatcgcagtgatcatgtcggagtcaacgggttcatcatcatatccgtggcgctataaatttgcagcgagcacgtcgtctccctctctttccatcttccaagaatccatcaccgagctcgcggcctagctccgcgcccagagcgcgccatggattatctctatctggatgatgccgacgccgacgtcgaggctatgctccgggagatcgcggccgccgtcgacgacaatggtcccgggggagcggctgctggcgacgagacggacgggagctactgcgccggcgagagatgcgcctgcgcggcgtggacgtacgacgccgacctgtacgccagcctccgggccatggagatggccgccggcgagcggtcgtcgccggactacatgaccgcggtgcagcgcggccgggtcgacccgtggacgcgcgcgtcgctcgtggcgtggatggaggggatcacccgggggcacgccggcctcgccgccggcacgctccaccgcgccgtcgcctacgtcgaccgctaccagtcggtgaggcccctggaggcggtgagccaccgcctgctcgcgctgctcggcgccacggccgtcttcgtcgcggccaagtacgagggcgacctccccgaggagaggctgagcgccggcgacgccgccgccggcgccggcgccggcgggctcgccatcgccaggagcgaggtgctcgacagggagctcgacctgctcgacgcgctcgggtacaggctggcccgccccaccgcgcacaccttcgccgaccacttcctcgccaggtacggctactccggcggcgacgccgtgcacgccgtggcgcaccacctcgccgacctcacgctgctcgaccgccggagcctgaggatcccgccgtccgtcgtggcggcgtcggcggtgtacctcgcgcggtacgcggccaccaccctggcagatgccgggctgccgccgccgctgccgtgggaggacgacgggctggaggcggtgacgggatacagcgtcgtgtacctggcacgctgcatggaggagatgtacgacgtgcatgagatggcgtcattgtggccgggttacgacgagatgaagagcagattcgccattgactacctgttgcttccttgcagacttgtggtgcccttagtcttaatgtgatcatcgtaaggggtttaattaattcatagtatataggggatcgacgattagctaggagagtcaagagaatcaggtagcagaaaaaagaaggggttgatctggaaggggaaaaaattgccggcatttcgatgctacaagcagaagtccgttgcaaacgtgtgaggtttcatcaacgatgttgttgattgtggtaaacctctttgtaaccattaatttgatcttagtaaatttctcttggccgacgaacgccttgttcgcccgtaaaaaaggtggtgcatgtaattgtagcttagcatctgtacgtaagttttttttaattgaaatgtgaaatgagatgtttggaaacgtcgtaagttcaatttctcgatgacgtgtatttgcttacttctaaaattttatttcggaaaaaaatgcttttcattgtctacaaataataccatttaaatttaaacataataattacatctttctagctttgtttacactccgttttagccttttaggcctccttttagaacagatagttttcatataagtaaattttagggattaaacgggctttttagctactttattggattattgtcacagattatttactctaggtctcttaaatatgttttctatagatcacttgttcgaagccatttataaagtttacttttaaaacattaattcattcataaatcaaatatataatcggcagtaacaataatccaacgagtaatctgttaaacttatctttttgcaagaattttgtaaatttgatgtgttccaacatataaactgggaggccgttccatgtgcaacgtggcgtccccgggagaagccacgcgactgctactgtgcctttatttcagctgtccgtaaccacgccacgtatgccgagagcacgaaaccatctcaaaaactatccgcataatcccggtccactcactggcacactgacaagtgggtccagaacccccacccgggcccacacatcagcgaccccacagccatctcaccaccaccagataagctcccctccacggctttatcttccctcctcttcccctccactgcttcttctcccaagtcctcgtcggcggccacaacacgtacaccacacagcggcgcgagaccggaataggaggtttcaatggaggtggtgggcggcgtgtcgtcgctgagcgcgtcttcgccggcgccggcgcgggcgcggctgcggcagctgtcgcccggcgaggcgagcggcggggggagcttcctgctgatgaggacggcgccgaggagcaggctgcaggcggcggcgaggccggcgagccgggcggcgctggtggtggaggccagggggagggggtggtcggaccggcggtcccagcagcagcgcatgccgcagctgcccaagatcgaggacgacggcaaccccgcgcttcgtcatcttcatccgcaccgccaatgtccgtgctgccctgattcttgttcttcttcttcttcttcttctccattcctgatcccaatgcttcgcgtgcgtgtgatcaagatttgtgtgggtttttttttctggtttctgcaggtgtacttctggtacccgctcaacatcgtcaccggcggcacgacggcgaagatcatgctcgcggcgaaggacaacttcctcggaaagtacatctacaaggacacgctcgccaggaaccttgccgctgtcatctacaaagtaattaacagcacaatctgtttgcttacacaaattgtcacacaatcgtgtttgaagagttgtagaaaagagaagatttaaatgtgcgtgtttcatgatttgatttctgaaggatgaggatgacataatagacacagcaaaagagcagtacagggtgctgaagaccgacaatgagtttcgatatggctacaaagttgtggtaattttctcagtcctcatcttctgtgcgtgattgtatgttgttgcactcgaaaaaattgagaattgcaatttacctgtctcatttgggtgagcaggagaatgggaacctgaggtctgcgctgacgacaagtaatgtgatcgaagtacgtttcgctagcgccttttatctcctctccctgtcgaattctctgcaagttatgtaggagtagcaatttctcatgaacattagagctgaaatctctgaaaatgtacatttcagacttgtatcttgctttatcctaggctgacattttctagagcacaaccttcaaattattttggcctagtactagatagtagctcagaaaatgttgtcctggaaaagaacttctatgcagttaagtgaggatggtaggcatttcttatagtaaatgtacaaatgaccatgttttcagtaagcatgtcttgagcaaaggtagcaagtcactaacagtaaaatgttttgattatcccagctcccaaagaaagaagagctcaaaactgtggttgacaaggtgaaggacttcttcggcgacgtaacctctggcgccaaagagtcgtttgcgcagattacaggatctgtcagcgcagaggcagaagcgccagtggaggaagagaagccctgggtgaagaggcgaaacgagaggaagcggaaacagaaggagaagcagaaccagaagcaggggatcagtaagtaaagagagacaatgctcctacactaaactacattactgcttcctgtgattttgcttgtgtgaatctctaggcctttgtatagccatcaaacacagacgttctgacctgcctgcatggttaccatttctgatctgcagaaacggagagctgattgtaaagcgcagcataccagagatcgtcaagtgaacagccggctgtaattttccagtgtgctcatttccctgtcccagattagctctgtgtagttcctcaatacttcgagtttttttgcaacaaacaatgtgtagcttgcctgtgactctgagtaacttgctttgttcttccttactaaatctgcagctagagtctcctgggatattagaaatcggtattttatggacttatggaacggcgaaaattactgttgtatattgacctcgtttctgatgagttacagtggctgtacagtgtgtgcgcgcgattgcgtatgaccgaatgctgtttatctgttttctgaaatgttgcatctgaaaacaggctcagaacaaaaggaattacgcttggttctattttgcagttctcttttgagactagcatgtcaggctatttcaagcatatagagacccataagatcaaacagtgcggaaccccaaaaagacatcgccacaagacttgaaatgaacgaacagattcatctcagaaagacatgcactcttctcgttctacaaatctaaagcacacttactgaaattgcacacggaggttctctttaaaacctttttgctgtccgcaataaaatcaaaccgagataaagatcatgttctcatgagcctaggagtacaagtagaacagcaatttcagtacggtttatgtccatggggagctttgcagggatctagaaggatcacacctccaacgtccaacgtagaccattgaatttacaagtcaatgactcgtgacagtttctggatgcggttcagcaagaagtccccttgcttgatggtcgcttggtagaaggcattcctagcgtcaggtcggtttgtctccagaacaccagcaaccttatcgatcttgcagtgaagcttcccagctgcaatgaaccgcgacaattccctggaacaaatgaaagggagatattatctccacagcacaggaacagaaaagaatgttttgtcctacacaggaatcacaaacataaaactaatgcggatgggtgacagcacttactggtctatgaaatcaacagtcacaccaaatgctgcggccatcgcttccattgtcacactcttgtatgactccaaaaactgtgaatagacaacggtccgcacttccctcatatagtagcggaaatgaggctgaagatagcgatccaacttaatctgctccgtcatgccagctgaaaagaagtttagaccatatattcatatagcccagccgtacagactgtaacagtaaaactatagacagcttatcaagatactttacacttacagaatgcaacaaaaaatgacttgtactggcaattgtaaagggagttcagaaactcagatagatgaggtactttgccaatcactgccaaaatttctggtgcatctaccacctgccatatttcttgttagtgagtcaattaagaaaaagaaaagagagtgtaagaagtgaaattaccttttgttttagagatacacgatccaatgtgattatgcttgtgatgactgtatagaagacaaaagtatcatatggaaacaactcgtaagttgtgaaagttgagatggaatctaaaaataagctggcagctttcttgaagtttctcgttgccatgaagtataggccttcatatactttcaatcggttctttctctcccagtcgcctccttcctcaaacaggcttcaatcaacacaataaatagtcagatgtcattgctccagtatagatggcagaatggaacttcacaaaggcacaatcaaagctataacttacttctttgccttgtcaatggattttgagatgagatcaaagtccatgtggaaaaggcctatttgcaaagtgtagaacacaagatccattttctggccaacagctacagttttcccttcagtaactttaagctgctccagtgctttttcctgcaatattgatttcaaagaatgcaaatagctaaatctcaagcacacacttaatgtaaagtatagaagcacacaagtttataccttctctccaaccctcatgaagtacaaggatttcgccagatgggcctcacgcacttcgctctcacccaaattctcttcagcatcagcaattcttcatacatgaaacataattacttagttacttccagaggaaccaaatgattcttatcaaacttctagtaactgaaatattagatacagatgcgaagagcaagatcagaaagtagaaacaatgaaacatgcaaatcaccaaaaggacatatcttgactggaacctcaacttctcaaggaaactatttctaacaaatttcaacatgccgttcttccttcacattagtttacactggtattttgtctcgagaagttgcgtattgtgatccttagcaatctcaattacttctctacatgctaaattacacattgcagagaaaatgtacaaaatcatgaatatgtacatgaatctaaaacaaaaatgtggaaaaagtttattattatgtagtatagatttgcatagaggtgaattaattggccctaaacataattcataaattacaactaccgaatcaaatgcaagctatctaccagttttagcatctacatctcgcaacacagagtaagctaggttagctaaggcaaacggaccatatcaacacctgagttatcgcaaaacttatcgcatacgcaacacagcaaggggcggcctaatttttggggggctaaaaatctactactacttaaaaaataagaggtgcttccatcgtccgtcacaaataaataaaaacagcgaaaaaaacaggaaaaaaaaagatgtccgattccctggcaaaaaaacacccgatcccttaaaaagggaaaaaaaaagtccgagagacaaaccgtttaatgaataaaaaaagcgaaaaaaaaagagtccgattccctggagaaaaaaaatctgatttccctggaagagatccgatctgtattggattggagaaaagaaaaaaaacacttctctaggtgcttctgtcgtccgtcaaaaaacgggagaaaaaaaccgagcgaaaaaaaaaaagaaaagtccgataaaaaaacctggcgaaaaaaaaccgggcgaaaaaaaaacaaatatgtccgacaaaaaaaaaggaaaaaaaaggaaaaaataccgaaacgaatccgactacatcgacgcggtaaaaagagtttaaaaaaataaaaagaaaactgtcctattccaaagaaaaatgaattatatgtatcgtggagcaaaaaaaaaaaagaaaagtccgataaaaaaacctgggcggaaaaaaaccgggtggaaaaaaaacaaatctgtccgacaaaaaagaaagcaaaaaaaggaaaaaaatcgaaacgaatccgactacatcgacgcggtaaaaagagtttaaaaaaataaaaagaaaactgtcctattccaaagaaaaaggaattatatatatcgtggtaaaaaaatcgaccgggcgaaaaaagaaaaaaatagtccgatccgaaaaaaacaggagaaaaaaaaatgggcgaaaaaaaatttgtccgataaaagaaaaggaaaaagctgaaaagaatctgactccatcgacgcggtaaaaaaaggcgaaaaaaaactttccgataaagaaaaaggaattatatgtgacgcggtaaaaaaaataaaaaaaccatgcgaaaaaaaagataaaagtccgataaaaaaacggggcgaaaaaaaaacaaatctgtcctatccaaaaaaagccaaaaaggggaaaaatcaaaacgaatccgactccgtcgacgtggtgaaaacagggcgaaaaaattccaaagtaaagggagaaaaaaaatcaaaacgaatccgactccgtcgacgcggtaaaaaaagggcgaaaaaaatccaaagtaaaaggaattatatgtgacgcggtaaaaaaaatcgatcgggcgaaataaaccgggcaaaaaaaaatctgtccgatccaaaaaaaggggaaaaaatcaaaacgattccgactccgttgacgcgataaaaaagggcgaaaaaattgtctgtttctaaagaaaaaggaattatacgtgatgcggtaaaaaaaatcgaatcctattatatctagaaaggtttgacactatgtgaaagtggtgaaaaaaacccttcgtaaaagaaatgcacgagaaaaaaaattaaaaggacggaaaaaagcgcggaggaaaaaagtcaaatttatattcgtcgttttttagtccatttatatatcttctttatctctaatctaatctaatctaactataaaaagagaagtttctacagtatattaaaaaaggaaaaaatgcgcgagaaaataaaaacggtttaaaaaaacacgtgagggaaaaatgtcagaaaaaagcacaaaagaaaacgcgctagaaaataaagtttcgtagttctaattttctgattgttatcgacatggttatgcatgaaaaatgtatattatcattatgttttttcacccgttgcaacgcacgggcatatttgctagtaaaataaaatcagaagagaggaagaatccactcacttctcgtcgagcttgcggacctcctcgtcgatccgcgcgcgcatctcggcgagcagcgcgtcgtccggctccaggacgcccgcggcggccagcgactcgaacagcggcgccatgccatcggacttgacggcgtcgagggcgtcggagcggagggcgaccttggcgaggtcgtcgaggtcggggtgggagaggaggaagagcttgtgggccagcaccaggtggcgctcctgcttcgcctcctcgccgccggcgtccatgtcgttctcgtcggagttgggggttcgcggttaggtcggctcgagacgaggcgaggcgaggttggggcttgggtactgggttgggtgggtgagtgatgccgagtctgttgctgttgccgaactgatgaaagaggagtgcggcccgctacggcctaacagcccatgggccggattcagatacggtccccatgggccggattcagagccggtctcagcaggcaacagagctaacttaaccaaagaggtggatttgtctccggttttatttatgtatgtatgtcatccgaaaattcattaaagattttaaagataaattaacatgtaggagtaatatattactcaacagacatgtaagttcaaattcaacatatacaaaacaaaaaacaacaattttaacacacgaactttccgccttgttgaagatttgggggtgctacctgaagatttgaatggatggtcatcactatcatgaacaaccgagattcaatgagaattcgccctagctttttgtctttgacataaaaaaaagtttttcgtattattcacaatcaaattacttagttctaattctacttatatgtgtcaaatttaagcttgcatatttgtggagtgatattatttattcgatctatctcgtccttttctttttttcaaactttttgatgagtttttgggtggcatgcagcagaaggaattgtccttcagggacaaatagacttccccgctaaaccaagcacattactgattacatattcaagataactagaagaatgaagagaaaatttggttaaaagctaagtattcagaaacggggcaagtcataacccagcagtatgtacagatattcaaaatgaacaacaacaaaaagcatcactagatcaatcaccttcacaactcaaaaaccagtgagcgagatttcgtagacagttaattgaagttatctgagtctgacaagcaaaatcttaatctcctatgcaaagcagcaggcaaaaaccacaaaccaaaggtagcagaaacaaactactcctatcaatgcacagtgctactaccacctatgataagtatcatcctgcatgcatcatcacacatcatcaaggtagcagaaacaaactactcctatcaatgcacagtgctactaccacctacgataagtatcatcctgcatgcatcatcacacatcatcttcgacttgctagacaaaaatcaagtggaaacgaactactccttccgaatcatagctatagcttctggcctttcctgatctggactcaaactctgaataagattgatacgtgcgggggggacttgtccgggttagaccgggggaggtcgtcctcgtccgggaaggttgggggggacgtcgacgccgggggtaagtccatgtcctgggagtaggtcagcccgtcctcgtcgtcggtgtcaactagtgcgccatgaggaggattgccagtgccctcgtcagcagccacggcagtggtactgctgctgccgacggcagtggcagtggcgtcgaccttgacctcgtcgccggtgttgctgtcgtcagacccggcattggcagtgggatcaacctcgttggcggggtcgttgttgtcggacgcggtggcattgttgctgccggtggggtcgacatcatcgtcaatgtggctgtcagtgtcagtgtcggtgtcgaccggcggaacagcagggaaggcgccgggcttgaacagaaccaggatgacggtcgtgttgtcgcccgatggcaagccaaactgaacaagctcctcacagatgacacgcgcttctgcaccctcctgcatagcgatattaattggtcacagcaagtcagcaatatttggccacagcaaaaggaacaacagttttaacaacgaaacaatcgagcatgcaagatatttttttgacgtaaacatgcaagatattagtcacagcaatattgatcaaggcaaaaggaacagcagttttaacaacaaaagaatcgaacaatcacaaagcagatgacagtgtacttattagcacttgtttttttcttttttaaaaaatcggatgctttatattgcctgagtgaagtcatttcctagaatttgacacaaaatatttttgctattacagtaggagatctcttgtcctgccaagaagacaaactgagcaaaagaaaaggactcaccaaaagacggtcatgtgtgtgatcaaccacattttgatttgtcatgttgcacctgcatggaaaaaacatagtacagtaggtatgcaactataaatgaaactatatatgcatcagcaggagaaagaaaacagcatcacaaagagtactagtgacatcaaaatgatcaaataataattattgtcagttattttttgttcaaaatttaccagaggccttcagttgctatcacaagaaactccatgtcatcagttatgtccatctgacacagaaagggggattttccatcagaccccacacagcagtacaaacttcaaattcaaccaaatactaaacaaacatagttgcacttacagtcaggatgtccggattacatgtcagcatttgatcttcaggaggtaaacgttcgttcttcttgcaagcgaagtcccctgaaatgtaagtgggtacaacacatcagcaaatcacaacataatatgtttttttttcggtgctattatctgcaataaacgaaaaacagatccaggcaagactataccaattgatcttgagattgatactcttcccttaaaatcagtgaagccccattgtttcttggttacccacctccccattattttacgataactatacccaacagctactcctcctgcattctgaactctctctctttcagactcactgtctggtttatgatcgacggataatgcactggccttttgacacaacagaaacaagcacaaatgttaggcacgaaaataagtgagcatgcaaattaggtaccaacaagaaattcgataaggaaatagtcactatacctgaccatttcttgagagtacacaacgagaatcaccagcatgcccaacaatcaattggtcacctctgatgacaaccacacatgctgtgctcccttcatatgatggcgcagtatatgttgcctggaaaaagaagaaagaaactaaaggacataatagagaattccaacatagtagagatacaggttaaccaagaaatagctcacaaaagcaaccagacaaagaaaagcatttctgaaagccaaaccagtgtatatgaaagagataaccatagaagagatgccgcaaacaatacctcagtttagggtagtgccatactatgacaagaaccaaggtgcaataagaacttaataacctgtcaggcgtccaactcaccaaaccaggcaactgataagtaactaactggacctttttttacaggcgcaattagttgaggttagggttaaacatatctcttccaactccaaagtacatctcaagaaagaacaatagtctcgatatcacacacattcttccatttcctttttcatagatacaataagcactgtccaacaaatacagttttgagtaacttcttcaacatatggatattataagatgtttaggggttaaaggatcactacctgcgggaaaggcgaaaggttagcacagacaccagccttgataaaatacatccatccattattacgaggaataactaactccctccaagcatcggacagttgcaggtcctcatccatgctgcagaaattacacaggaacaatgatattccaaatttgcaagtgcagcatcattcagtgcaacaaaatgatatagactaggcgaaaataacctgtaaaacgcactcctcatcgcattacttagattgctgtcgtagtcttcatgattgcaaagctcaatatgaaatcgttttgcacaatatgatgctacttcagctcctgagatagaaaataaacaactcagaatggtggctcaagattactcctatgtgcatatagaagcttataaagcaaaacaatgtgatgaacacagcagatcagcacttcataggtatcataagaaaaatagcaccacacataaattaaccaacatgttcatcagtggctatccttttaattatcatgactgttaatattaactcacacccatgcagtgttttatccctcgtaaattaatattctgtttacgcagttcatgttatcctagaaagcacaccgcacataggtgattagtactaattagcaaacttggctcattatccagaactgtagcttaatatttatttgaaaattgacaggtaaaagtttcagcataaacagtaaagttctcgaaacatgcacatagataaacacatgacacacaaagacaaacaaagcatgatgtaaacagttatgccgacaatatggaggatttgaaaccaaaaaaaaaaaaaaaagagagagaatgaagatcaaacctccatggccatcataaacaccaaagaatgacgtcatggtatcatcaagatttagaatagctgcatgctagagaatatagagggcatatgtcagtcacagtattttacacaattacttacagatcagtaagaaatttttgcagaactatccttttttttgtcatacaaaaggctgcaagtttactcacagcatcttccattttctcaccccatccttgcatagacgacacaacatacttaattctgtcattctctttttcatcagtgaactttgattctacaggaaggctgttacccatagcagacctttgttttgctgaaaattaataacatgaatacaaatatacaataactttattgacaaatatggagaaagagtaaagtgaatacaattacaaaacactacagatcaattaaatacataagagctttggtaaaaacacgaaaaggagtcaactagacataacatgatatgacactatttatcagggcccctaaatgcatttttgagacatataacatgagagtatcaatcttcagttgcaatgctgcagtattttgcacattaatcttatatcttatacaagaatcaagcaaagaataattaaaataaaatattactgtgaacaaaatgcatacaaggttttgtaagaacgccatataagctttactgacacaaatcataacaccaaattccaaagtgaaatgaagaggaaacaaacagaaaaggcgtattgtacaaggacaatcaatttcctcccggtatggccacctcttcggtgtattaaaacttcaataattcgaaacagagtatgaagtgaacagaagaagaaaaacagagacagcagcgtgcacttatagtagaattcagcaagaagaatacaacatgacagcgtcactgagaagtaaaatataggtaacaaacatgaagaaattgtacaatcttgcagaaccaaaaccgttgggcttagaaggatcccaaatctaagattcaagagatgaaagcttctttgatatgcaaagaatcagaagatttctcatcaaaaagggaaaaaaaaacaagcagtttaaccaagctacacatgcagaaatcattgtatgaacagaacatggagttctttccaaacagaaactaaaccaagataacacgtcagagagaacatggagttctttccaaacagaaactaaaccaagagaacacgtcagagagacacatagagaagaagcatcctgcatcaggaacagcgaaaagaacaagaaggccgaaggcggcatctggttaataaattttcagaaactgaactcccgcaacacaccaaaattaactgaacaaactggaaaatacaagcagacaagagaaacgaattgacgtggtctaattttttgcgcacgcactggtagagactttgagacacacacagcaagatcaatacaccatgaagcttcggtgctcatcagcctcctcctccaactcagaaaaccacactccacctcaaacttcaaaaccatcgaagcaacaaaagcacggtacgggaagcctacaagagagggaaaaaaagatcaaacagctgtgatccttgccccaagtttcggatgacgaaacgcctcaagattcaaagagaggtcaagacgcggttgctgctcgatcaaatgccacaacagcgaaagacatgatcgaaccagaaaaaaccgcgacgcccccaaacacccaagcacgcagaaaccacaccaccaggaggagagggagaacaccaccagaagagcgagatcgaaggaaagggagaagaatctcacggcgctttgggaggacgtagggtttagggatggaggaggaggagaatctcacaactcacctcgcacctttcgccgctactgctcttgagatgagtacgttgcgagagagacagagagagagagagagagaggagagagatgcggaaaagtggttgtgcagcgaagcgcaaggagaagaaagcatcgcgcttaaatacctgaaccggacgcatctcggctgtcggatcgtctctcgcggctgatccaacgctcgaggagtgcaccgcccgtgtctggtggtccccacggagcacgcgccctcctcctctcgccctgcatgacccacattgcatttgcaactatagctgtggtgtccgttatgcacatcccacagctgacatgtggggcccacagtctcgcttctgtctcttcttctcgacgcataggcctctctctccgcgccaccgacgcgagctgccgcttcctgacagccgcgccgccacccacgccaccaacctcacatagtgcagaagccggagtggctttgttcctacgtgacaatcaaatcaatatttttttaaaaaaatcagtgggacccaactattagagagggaggggtgtgagagggaagctgatcaaattatcacaaaactatatattcgttgatcaaattatcatacattgatcgaatttatatttctaatccagtacattgatcatcaagttcgcgaatgtatgatggtatcaaagcttacaaggcagagacctgctgctgctgctgctggcctggccttggtatgaattgtgatccaccgattccagtgctcgtgatttctgaagatctcggaatagagctgcaaactggtcatgttggcctgcaaagagacaaacaagccaatggaggagttagattgaattgtgagaggttactgaatttccagcttactgaaatgggctctctttatgagtaaaaaaggagcttactgaaatgggctctctttatgagtaaaaaaggaatgatagagtaagtacgttacaggaaactaagggcccctttgcctttgatttgtaggaaaagtgttcaaaatttgaaagatttcaaccctttggaaaaaattcctatgaaagcctttgaaacaaaggattgaatcctatactatccttcaaaattcctatggaatggctaatcctatagagattttgaaggaaagttagcaagaggtccaacctcttggaaaaatttctttgagtctatctctctcatccgattcttgcgtttttcctgtggtccaatcaaacggttattcctgtgtttttcctgtattttccaatcctctgttttacacctgcattcctgtcagaatcctacgtttttcctattcctccgtttttccattcctgcgatacaaaggggccaaacataatgtgggagttatttgctctttattttcagatagtgaaatcatctcgcagtaaaattgctcttctttcaggctaaaatcaaagtagatgaaaatgagatattgtataacgtttacgctgaacacctgtatttctttgttggttgaaaaatgaccctattaatattgtgcgctcagccaataccataattgctctctacgttgacgaacaaaatacaaactagtgatccataacagatatatccccccatagtgaccagaatacttactgatatgcattatgtatcaggatcagcttctgcaacatgaagagcccatatgcatatcaattccaaaccagttggaatgtcctgatttctttctataagaactgatgagacatacatcaggtgcagcgctatcaatttgcaagaagttgcaaacaacacatagaccttctgacatatgcttcaggatgttgtgaaacagctctgttgaaacaaaagttaatgtcaaaattgtacctaactaataaagttccttaacacaggaaatgtctgtttaggcttggagtacccagatcttattgtatcaagaatagctgtggcaacagctgatgcttccggatgcattgtcatgcacttcatacagacgccaagcatgcatacaatttacctaggacaacaaagtagcgactgagcaaatcgataccatattaccatgtgatcttttatcatatcattgcatgagtgggagcataaaagcagcagcataaaccaaaagcatacaaaggaaatctattttttgaccactccgactgcaaatctttagcttttccaagaccccatttacgagattttcctgatttaagtatttaacttgacatgatctagatggaacctcctctttcataccagtgtgaacaattcagaagtgtcctgattctaagacttccctccaaggacctgcaacaggacaggaggtcccctgtccctgaagtagctaaatttcgagcatgtactatgtcaaccagaccacagggtaaagtatagaaaaatacagatttataccttctgcctgacacttatgaagtacaaggattcagctagatgggcctcacgcacttcaatcccacccaaattctcttcagcgtcagcaatccttgatacatgaaaaaaaattactttcagaggaagcaatgattcttgtcaaacttgctagtaactgaaacattagatacagaacaaatgcggagagcagaacggaagatatatgtgaccagctaaaaggggatgtgttgatgactggaaccacaattatactatttatgctctagtgaagttatatatcttgattttccttcacattagtttacattgggtttttttccttggtgaggagggtgcataaattacttttatattggttgggaagttgtgaattgtgatccttaggaatctatattgcttttctacaagcccaattacatcttgtaacaatgaaccaaagcatgcattgatgcacatctgtgagcctggaatcaagatacacgaacactggcaatatactgaagacagaattaggcacttggtatgcaaactctctcaagaggaacctcatacaatacataccgaccccattctgaaacataattcataaattacatatatccagtcaaatgcaagtgatcgacaagttccccaaagtaacctaattacctaacctaaggttcgttgaggaaaacgtatcgtagcaaagacttgagttgtcacaaaatttatccccacatagagagtgctacagcctacagctataagaacagcaacgggcaaacctaattttctgggcaataccgcaataagagtaacatgatgccaaaattgaggggaggaagaacccactcacttcccgtcgagcttgcggacctcctcgtcgatccgcgcgcgcgtagtccggcggccagcgactcgaccgcggcgtgcaggcggggagccggccgatggatagatggagagagacggcggatttgacggcgtggaggacgtcggagcggagggcgaccatggccggcgaggtcgtcgtcggcgtcgggatgggagaggaggaagagcttgcgggccggcacgagcaaccaggtggcgctcctgcttcgcctcctcgccgccggcgtccatgtcgtgccggtcactgacgagtctctcacttttttcagaacattttttttttttgagaacaacgagtctctcactctcttgctgttgccgactgccgagccgaactgaaagaggccatgggccggtttcagccacgaaatgcttttcagttcgaaaaagttctctccacgtcccttatgtacgaggtagagtttcaatcgcgtcgcccaattctaaaaccaggtataagcagggtttcttttcggaaagcaaaaaaaattcggtaggcaccattccgaacaaaatattttgaaattttaacacattttttttactaaatttgaataaataaacaccaaattcacaaatatttggaaaaagcaaaaattcaaaattaattttaatattttataacttattttgtcaaagaaaatttaccaaatcattctcttaatgcaacgcgagaaggtttcataaagtttcaaagaaaaagtgctcccaatcacatagtagagaacaaaacttaatgaaattaatagacatgatatagccgagctatcattactgcaaattctgaaagaatgagttaattaaaaagccctcattgagttggcataaaaattcaagttcgatcctccatgtagtgcgctcctacttcttcatacctagaagacgtttgagcggctccaagggaaagccacaaccatggtatgagttcttcgtttcagggctgcttgccccttcgcctcgataaggaggtcttccagccgtagaccgcttactcttcttctgatttattaacttatctttctgctttgtcactctcgtattctgaataggaatcggcaaacaggtacaaccatcctcgaaaaatcgaacaaccctcttcaccttactcaccttagtgtcttttacctcataagcattttccataattgttggccctacctgatagatattttcaacacttcgagttgttccgccatgatatccagaaaatgttggcatcaatacttgaggcgactggtgatacggaagatttgtgccgggatcgattacaaccgtagttcctcgttccatgtcgtatacacacaacactttcccattgaaccccgagtagtagacgcagttccctctcaagcccgttccctccgtatcaagtgacgctccaaaactgcctatcttaacgaagaacgctctgccacctagcgaatccaccttcacccacgctgctgatctttgcccctgcgttgtcgtcagattaatgctcaacctgtaaacgcctacacgcgcgacaatccggtcacatccgatcgggtgagagaagacaacggagtgcagctccccgtttgattccacgaagcaagtggtgcgtttcttgtacaccgttggtctcctgtcgtcgtcgacgccgtgtacggcgatcttggtgagcgtcagctccggcgagaactcgaggacgccgacaagcccgtcatcgccgatgaggagttcgctgtagaacttgccgtcgatcgccgtaaactggcgtaaaaacctgatgatgacgtcacggtgctcagtgttgctgtgctggtacggatgctgatggagcctcacccagtggttgtcgccggggcggcaataccagagctccgtgtcggcgaggtcgatgacgaccacgacacagctggtcgggtccatgggaccgcagcatgagaggaggcacctccggagatggctgccttcggcggcgaggacggtgccgtcgtggtcggggggcagcccgacacggcggccggtgaaagggtcccataggaaagtgcacggcgagccgcggtgcgccatgagcaaccagccctgcgccgtggcccaccagcggtggcctctcatcatgtcgtcgacgccgccgtcgcccaccctcgttggcgttggcgttggcgccagcagcgctctcttcggcacgctgtagaggaacgtggcgtcgccgtggccgccgaacagcagcagaggagcaagcttgggatccagagcggcagatgcgtcgactgcctcctccatgatttcaacggacggctggccgatcgatctttcggtaattaatccttcgtaggagacggccggtcaatctgtgctatgctttataaacgaggagagtttgtggcagcccgatttaagtgttgtctcgtgatttctgttcgaaatcatccgagaggctttgagaactagtatatatatatattggcatataggaaagagaaacgaagaaatctgcacgcctaaatctgcagcgcccatgtaagtaaatcaggaaaaggaaacatgaattcctacacgtacggcatcaaaattcaaaccaattataatctgcaccgccggtaaatcagttttttggcacggcatagagacggatcctccacattactatgcaaccgacaaaaaccaaccgggtggggtacaaactattacaagcggaagctgacctatatgtgatgcgagtccggtggaaacacgtttccgaagaagcagtgcagcacagaacgcagcacgccatgcaggtcacacgcgtgcccgaactctcgagattctccaatctccaatcacagaggcggccgctgcgacgacggcggcgcagctgggacaactgccggactggtcgtctctcccgttggacatgctcgtgctcgtcctgggtcgagccacccgagcttcgtgtatgatcagtatcatccgtcgcatgcagatgcagtgcatcatcacacatcatctccgtcttggacatcaaaattgagtggaactgtagtgaaccggtgacctcctcctgaatcatgaatcatgcatctacgggctgtcgtcaggagccgtgccctcgtcatcagctaaacttagtcatcagctgagtgactaagtttgcatgtttccgctgacagagatcgattcagcgcggctaaggattcaagatgccgttcctatcaatcaaggcggcggcggcggcacagagagagcaagcgagcgacaagctacggcaggaaggagagaagaattctagcacccggtgttagtatgagtggaagagggaaggacatggcttaacgatgccaaggggcgccgtggcgagatgacggtcgttcggcctcggcgtgaaccaaggagtggcgccacgggcaccggggtcggagaagaggaaggcaaaagcggcgagcttgctctggtttggcggcaaaacggtcgcggcggacagaggggtgacgcgcgcgcgggggaaacggcgagcggcgcggcggtggagcgggagcgccgtccccgtccgcaccggcacatgcgcgacgcgtgcggttgctgggccgtgaccgagcgctgggctgggtcgacatagaaaggaaaaagtacaccgaaggtccctcaacttgtcatccagttacaaaatcatccaccaaccgaaaaaccagatataacacaccccctaacttataaaccagtaaaaactagatccgacgtggcgactgagtcagtgtgggccttatatgtcagaatgccacgtcagcaagccacatcagcaggccggcctgtcccttcctcctctctctctctctctctcactcactcttctctctggcaggccagccggtggtggggaggaggtcgccgaggcgaggaggtccgacagccggccggtgatgtggcggcggcggcgacgcggtggcggagacacgggagaaggggagggcgtcggtagggcgaggcggcgttggcgggcgagcgcgctggcggagaggcggtggcagctgcaacgtgggagaaggggagggcggcggcggagacacgcaagtgccgcttccccacgcgcgcgtgcaggagaccgtcgccgccagctacgacaaccttgtcgccgcggcgcacgggttcctcgcccgggagggccacatcaacttcagtgtctccgccgcgttccccgcctctccccatcaacttcgaagtcattagtcgccgcttcgagctcaaccaaagaaaatgatctgtatgctggaatgcccagagcttccaatttcactgtctgagatatgtaacctgtttggttgttccaggtaaatgcaacaagaagttagtatttcagataaagttccagaaaaaaaaatggcgctatcaagttagttactctaacactaggcaaagttccagagaaaatgacgccaaagtaaacgaatctaaaaaagagcaaaagagatacagaagtttcagtcaaagaatctgaaattcagcaaaagtttcagagattgtgccaagttggtgactctgaaattcagcaaaagtttcaatgaatgactgaaatttagcaaatgatccagctaatgactgaaattcaacaaattttcagttaataaatctgaaattctaggaccaagttacgctgacagggacaagtgaagcaccgagtggaagatcagcacaagaagataactctgaacagacaggactttttgcaagcttgcaaagtgcagatgccaatcctcatgacatctattcttctttggttagagaaggcctgtttgatactggtgatgagattctgtctatggatacaggggaatctgctgatactcctatttcaggcctagcgtcaggtttagcaaatcttggcactgctgatccagctgaaaggggctactcaataaacgagactacaaatgaggagggatacttgattgaaggggatgatccatcaccatcaaacaaagacgaacaagatgaccaaactgatgcacatggtgagtctacgccagaggcccagagccacaagatggctgctccatctcccccagctgccgcccatcttcgccaccgagcgccgccgccgcgcttctccccgtcctccccgtccgccgactccatcctcgctgccttcgtgacctgctgccgccgccgccgccgacatgcgcagcagtgggatggaggcgaagaggctagtcaaggcgcgattctcccgtgcgctccgggagagggccttcttcctcgccggcctccgaccgctccccgtcgcacgaaccctcctctccgccgcgctccgcccccccacccccccccccccccgggcgccggcgcgcccaccgggcgcggccctcctcccctgtcggctatgctcctcgacaggacgactagagaagagagaggaagagacgtggtgactgggaggctcttccccgtgtgcaattaagaaagatagtatgggcttgtttggtttgaaaccctaccaaaatattggtagtaccaaaccttaggcacattttggcactaacaaattttttatagtacagatttggctccactctattgatttggcaaaatttggctccaatccaaaatgctaacatgtactattcaaaactaccaaagaattggtagggcaagaattggcatcaaaccaaaatggccctatatgtccctgtgccactaaaatatttgagccctccctttataccattgtcgaattttatcgcgccctccacaccgttccgttgctattccgtttagatttaactatttggcagctctgacatatgggcccgggtagaaaaaatgtcgctcttgccctttcactcagtcttctccctcgattcccctcttctccctcaggcggtcaggccgccgcccagctggggcaccgcgccgccgtcgcctcggcccggtcgtcgtcgtcctgatcctcgtcgtcggtgcgctgttcctcaacctcggtccaaccggctcctccagcttcaccatgccgtggatccgcatggagttcaacgaaccagtccacgttgcggtggcggctccgcctccgccgctgacgcagatgcaagccggcgtcaacacgagcggcgaggacctccggccgacaacctccgcctccgccctgacggcgcgctcgtcgtgctccacgtccagccgccgccgagcatcgccgccgggctcaaccccggacccatccccttcggcggcccgagtaagcaatctctcgcactcgtcttcgcggaaattaggacggacacttggtcctgtggctgtgagctgtggttcttgcgaattttttcggtcgagctgggtgggtctgatggcttcctggatgtgccgcgcggctgatcaggcgaggtcgctggcatcactagtagcaagcatcaatagtcctcgccgccgtcggccgtcgttgtgctggtcctggcatcactagtagcaagcattactagtagcaagcatcaacagtcatgaacaccagtagcaagtatcaatagtcctcgcagccatagttgtgttggtcgtcgtcgttgttgtcgcagcgctgccgcccccgtcgtcgcgcagcactgccgccgccgctgtcgtcgcagcgccgcccccgtcttcgtcgtcgtcgtcgtcgcagcgttgttgccgccgtcttcgtcgcgcagcgatgccgccaccgtcgtcgtcgcagcaatgccgccgccgccgccgtcgcagcgctgcccccgtcgtcatcgtcgtcgtcgcagcgccccgtcgctgtcgcagtgccgccgtcttctcccctccgctccttggctgctgctgctgcatctgaggggagagaggagagtgctaggagagagcatattggaccaaagggcaactaagtcattttactgcgccattacccaccgttacaacaaaaacagacggaatagtgtggagggcacgataaagtttaacgatggcagagagggaggcttaaactttttagtggcacagaagcaggcaccatctttcttaatggcatataggaaaaaacctcgttgactggtgaggaagagacgtggcatccagaaatgtggggctcacgtgggtcccacgctgactcagccgccatgtcaaataaaaccagaacaaaactactaaaggatctaaaatgaacgattttgtaagttgaaggatgtcatatatctgattttacgggtgagggatgattttgtaactcgatgacaagtcgagggaccttcaatgtactttttccacatagaaaggagaggctagctaatcgagtggaacgatttgatcctcaggctagctaatataactctgtcaaatgaaaaggactgctttgtatggtcgctctataagaatggtcaattttccgtcaaatctatgtatgtcgcgatcatgaactgtaatgttcggatcaaaaagagaattctgtgggacttgaaaattccactggagatcaaggtctttatgtagtttcttcacaagaaagtatttctaacgaaagataacctgggtaaaagaaaattggagggggcggagacaaacattgttctttctgctatacacaagagacaatccaacatcttttctttgagtgtcatgttgctcagtttgtttttggagatgtgtgttttttgtttttaatatccccccaccccgtaacgccaaaaacattttcgataattggcttagaggggtatctaggtccattaagaagatgattctaattggagctagcgctgtatgttggtcaatttggcgttgtcgcaatgataaagtttttaatggtaaacaattatctaaccctatgcaggttatcttcatgtcttcctactggctccacttatggtctacaatgctaccacaagaggagcaggatactatgcgcaatggtgctacactcttggaatcggtagccaagggtctcttattccactatgggtggcgtagtttcataagaattgctagctaaaatattttatgtggtttaacattagtcaataataaaggggagttggggatttgtcccatcaccttatttctcattttgatttacttttatcttacatttttattactattaaatttatggctgtgtgtcttatgacagaagccggagatgcaatccatttccattatctaaaaagaaaggagaggcagcccaccagaggggaaaatgtttgaccattttccaggaaattatttgaagaaatttggggtctggtttgatttggacttgaattcaaattggatatttgaactcaagggttcaacaaggagtcaagaaggtaaactgaggtccccatcggttggcttttttcctacggcttattaggaaataaaaatgaatttatagataaaacttttatatacgtgtttttatgacttaaaaaccaatggtgaaaaagaaactacgttgaaaatatcttaaaattaagtttgaaaatttaacatttggctttttctttgactgattaggccatccgatgggagcgtgaatatgaattcgatatttttggaattgggagaagtagatggcaaggattcataggaagggatatttaattggaaacctgaattttgagattcaattttggaatcaaattcaacagtacccaatacatagaactccctcctgcatcgctgttgcctgttggtttcccgcacgatcaagcggacgggtgggcaagtgaacgcggggaacggaaatgctactgagcgatcgcccagggcgattagatttccccctcctctccctccctccctccacctaatttattttttttttcaccatattactttcctattttagtaaatttatacacctaaagtttatacacctcaagtttacatatctaaagttttttttgctaaaagtttatatatccgattcaaatttgaatttgaattcaaatatttttatatatagtatttctatacatctaaagtttatacacctaaagttcatagacctaaagttcatatatccgattcaaatttaaatttgaattagatctgatttaaatttgaatttaaattcaaatatttttcatatatagtatttctatacatctaaagtttatagacctaaagtttatatacccgattcaaatttgaatttgaattcaaatattttctatatatagtatttctatacatctaaactttatagatccaaagtttataagtcaaaagtttacatacctgattcaaatttgaatttgaattcaaattttttatacataattttttctaactttctgtttttttttaccccccgcgcggggaaggcggaagagagaggtcgcaaattcaggatatctcttgaaaaaaaggagagaaaattttcgtgccttaatcctagttacagattcccgagaaaagattttgagtatcacagtcacagagactagaagaatgaagaaaactttggtcaaaaggaaactgggaaaaatactactagtagttcataaaccactaccatgcacagagattcaaaatgaagatcaacaaaagcatcactagatcaatcaccttcagaactaaaaaggctagagatgattcgtaaacaattaattcaaggtgtctcagtctagcaaagtagcacaaccaaactactactatcaacgggtcggtgctattactcgtctaccactaacaggatcagaattcagaatatataagttcccaatcggaaagaccggaactggcagtggcgtcgaccttgacctcgtcgccggtgttgctgtcgtcagacccggcattggcagtgggatcaacctcctcgctggtgttaatgaagaagtagttgtccacaatggtgatggttgcagtcgacaacgacaccacggtggcttcgtcggcagccacggcggtggtactgctgctgccgacggcagtggcagtggcgtcgaccttgacctcatcgctggtgttgctgtcatcagacccggcattggcagtgggatcaacctcgttggcggggtcgttgttgtcgacatcatcgccggtgtggctgtcagtgtcagtgtcggtgtcgaccggcggaacagcagggtaggcgccgggcttgaacagaaccaggatgacggtcgtgttgtcgcccgatggcaagccaaactgaacaagctcctcacagatgacacgcgcttctgcaccctcctgcatagcgatattaattggtcacagcaagtcagcaatatttggccacagcaaaaggaacaacagttttaacaacgaaacaatcgagcatgcaagatatttttttgacgtaaacatgcaagatattagtcacagcaatattgatcaaggcaaaaggaacagcagttttaacaacaaaagaatcgaacaatcacaaagcagatgacagtgtacttattagcacttgtttttttcttttttaaaaaatcggatgctttatattgcctgagtgaagtcatttcctagaatttgacacaaaatatttttgctattacagtaggagatctcttgtcctgccaagaagacaaactgagcaaaagaaaaggactcaccaaaagacggtcatgtgtgtgatcaaccacattttgatttgtcatgttgcacctgcatggaaaaaacatagtacagtaggtatgcaactataaatgaaactatatatgcatcagcaggagaaagaaaacagcatcacaaagagtactagtgacatcaaaatgatcaaataataattattgtcagttattttttgttcaaaatttaccagaggccttcagttgctatcacaagaaactccatgtcatcagttatgtccatctgacacagaaagggggattttccatcagaccccacacagcagtacaaacttcatattcaaccaaatactaaacaaacatagtggcacttacagtcaggatgtccggattacatgtcagcatttgatcttcaggaggtaaacgttcgttcttcttgcaagcaaagtcccctgaaatgtaagtgggtaaaacacatcagcaaatcacaacataatatgtttttttttcggtgctattatctgcaataaacgaaaaacagatccaggcaagactataccaattgatcttgagattgatactcttcccttaaaatcagtaaagccccattgtttcttggttacccacctccccattattttacgataactatgcccaacagctactcctcctgcattctgaactctctctctttcagactcactgtctggtttatgatcgacggataatgcactggccttttgacacaacagaaacaagcacaaatgttaggcaccaaaataagagaacatgcaaattaggtaccaacaagaaattcgaaaaggaaatagtcactatacctgaccatttcttgagagtacacaacgagaatcaccagcatgtccaacaatcaattggttacctctgatgacaaccacacatgctgtgctcccttcatatgctggctcagtataagttgcctggaaaaagaagaaatgaattggaggacataatagggaatcccaacatagttagaaatacaagtcaagcaagaaatagctcaccaaagccaccagacaaagaaaaacatttctgaaagccaaaccagtgtatgaaagagattaccatagaagagatgccgcaaacaatacctcaatttagggtagtaccacagtatgataagaaccaaggtgcaatgtgaacttaagaacctgttggcctccaacgcagtaaaccagacaattgatatgtaactaactgaaccttttttaataggagcaattagtcaaggttagggttaaacatatctcttccaactccaaagtacatctcaagaaagaacaatagtctcgatatcacacacattcttccatttcctttttcatagatacaatatgcactgtccaacaaatacagttttgagtaccttcaatatatggatattaaaagacgttcagggtttaaaagataccttgcaaatgcttgtacaagctgcagccttgagaaaatacatccatccattattacgaggaataactaactccctccaagcatcggacagttgcaggtcctcatccatgctgcagaaattacacaggaacaatgaaattccaaatttgcaagtgcagcatcattcagtgcaacaaaatgatatagactaggcgaaaataacctgtaaaacgcactcctcatcgcattacttagattgctgtcgtagtcttcatgattgcaaagctcaatatgaaatcgttttgcacaatatgatgctacttcagctcctgagatagaaaataaacaactcagaatggtggctcaagattactcctatgtgcatatagaagcttataaagcaaaacaatgtgatgaacacagcagatcagcacttcataggtatcataagaaaaatagcaccacacataaattaaccaacatgttcatcagtggctatccttttaattatcatgactgttaatattaactcacacccatgcagtgttttatccctcgtaaattaatattctgtttacgcagttcatgttatcctagaaagcacaccgcacataggtgattagtactaattagcaaacttggttcattatccagaactgtagcttaatatttatttgaaaattcacaggtaaaagtttcagcataaacagtaaagttttcaaaacatgcacgcagataaacacatgacatacaaagacaaacaaagcatgatgtaaacagttatgccgacgatttggaggatttgaaaccaaaaaaaaaaaaaaaagagagagaatgaagatcaaacctccatggccatcataaacgccaaagaatgacgtcatggtatcatcaagatttagaatagctgcatgctagagaatatagagggcatatgtcagtcacagtattttacacaattacttacagatcagtaagaaatttttgcagaactatccttttttttgtcatacaaaaggctgcaagtttactcacagcatcttccattttctcaccccatccttgcatagacgacacaacatacttaattctgtcattctctttttcatcagtgaactttgattctacaggaaggctgttacccatagcagacctttgttttgctgaaaatttataacatgaatacaaatatacaataactttattgacaaatatggagaaagagtaaagtgaatacaattacaaaacactacagatcaattaaatacataagagctttcgtaaaaacacgaaaaggagtcaactagacataacatgatatgacactatttatcagggcccctaaatgcatttttgagacatataacatgagatcatcaatcttcagttgcaatgctgcagtaattatacacattaatcttatatcttatacaagaatcaagcaaggaagaattaaaataaaatattactgtgaacaaaatgcatacaaggttttgtaagaacgccatataagcttttctgacacaaatcataacaccaaattccaaagtgaaatgaagaggaaacaaacagaaaaggcgtattgtacaaggacaataaatttcctcccgatatggccacctctttggtgtattaaaacttcaataattcgaaacagagtatgaagtgaacagaagaagaaaaacagagacagcagcgtgcacttatagtagaattcagcaaggagaatacaacatgacagcgtcaccgagaagtaaaatataggtaacaaacatgaagaaattgtacaatctcgcagaaccaaaaccgttgggcttagaaggatcccaaatctaagattcaagagatgaaagcttctttgatatgcaaagagtcagaagatttctcatcgaaaagggaaaaaaacaacaagcagtttaaccaagctacacatgcagaaatcattgtatgaacagaacatggagttctttccaaacagaaactaaaccaagagaacacgtcagagagacacatagagaaaaagcatcctgcatcaggaacagccaaaagaacaagaaggccgatggcggcatctggttaataaattctcagaaactgaactcccgcaacacaccaaaattaacagaacaaactgaaaaatacaagcagagaagacaaacgaattcttcgcgcacgcactggtgtagtctttgagacacacacagcaagatcaagaccaacgtgttccaaggagagaagcgaacggagatcaccatgaagcttcggcgctcatcaaccttctcctccaactcgaagaaaaccacacccaacctcaaacttcaaaaccatcaaagcaacaaaagcacgggtacgggaaaccaagaacaagagggaaaaaaaaaagatcaaaccgctgtgaaccttgccccaagtttcgggtgccgaaacgcctcaagattcaaagagaggtcgagacgcggttgctgctcgatcaaatgccacacagcgaagacatgatcgaaccagagaaccgcgataccaaacacggccaagaaaaatcgtagaaaattcggattccgaaacgccttaagattcgagacgagaagagaacaaggcgcggtgctacttgatcagtcgtaaggaagacgggcgtataacgtattgcatcaggaacagcaaaaataatttggttgatacaaattcagaaagtgacacctccgcaacacaccaaaacagaagcgaaaaaaaaaagcagagaagagaaacgaattcatggcgtctaacttctcgcgcacgcactggtcgcgccaggaaccatcaagatcaacctccatgaagttccgatgggagagaggcgaacggagaccaccatgaagttccggtgctcgtcaacctcctcatccgactccaaaaaaaaccacgcctcaaatgcatcaagcaacaacatcacgggtacaggaagccaagaacacgaaaaaaaatagagaggatcagagggcggtaaagaggttcaagtttcggatgacgagacgcctccagattcaagcaagatttcggatgtcgctcgatcaatgccactcagcgaagataagaacgagagaaccgcgacacgaaacaccaagcaaacaaacaccaccaccaatggaaaaacgaattgatgtggtttaatttctcgagcttgcactggtagaaatagagaaacggaaggcaagatcaagaccaacgtgttctgaggagaggcgaacgagatcaccatgaagcttcggtgctcgtcaacctcctcatccaactctaagaaaaccacgcctcaaatgcatcaggcaacaacatgtcaacatcacgggtacaagaagccaagaacacgaaacgaaaaacaaaaggatcgacgaaacgcctccagattcaagcaagagttcgacgcgcggtgccgctcgatcaatgccactcagcgaagacaagaacgagaggaccgcgacacgaaacaccaagcaaacaaacatcaccaccaccaatggagcaagatcgaagaagagtagggagaagaatctcacggcgctttcggagaagtagggtttagggatggaggcggcggacgaaaccacagaagaggaggggaggatgaagtgagagagagatctcacctcccacctttcgccgctgcgctcttgacacccccgagagagagagagagaggagagatgcggaaaagtggttgtgctgcgaagcgcaaatagttgtgcttaaatacctggatcgtcgacggctgatccaacgtcgaggagtgcccccatcctgtggctggtggtccccacagatcgctccccctgcacggacgtatctcctccgtcggttcgtccctcgcggctgatccaacgctcgaggagtgcccccatcctgtggctggtggtccccacggatccctccccctgcatgatccatccacatgtaaattttcaactacccttaaaaaaaaaaccaatcccacctacaatatgtctagattcgtagctaggagtttattttttttctttcttttgacagagtagaagcttcgtataattttcacacacaagctggatcaggatgacttccatacaatttcaacacgatcatgttcttttgtatgactgacgaaaattctagtatttcaaatctcagattaaaaaaaaaatcctgtaatcaggggcggatccaacgtg

SEQ ID NO: 68098 - DNA, 4522 bp, Oryza sativa
ctcagccacgacgactgtggcggtgaccgcgagcccgttggcatggaggacaccgtccacgccgcgtccctcatcgtaccggggcgcccactcgcgtccgtgacaagttacctggcggcgcggtcgaggcaggaggtgcgggagatggtggccgcgctggagagccacggcgccgagcagctgaagcagctgtaggttcccgggctggccaccgccatggagcaggcgcagcggctgttggagatgttcgccgccgacgaggaggaggtgaccaggaagaagctgaagcgcgcgagcgactcgccgccgggaggcgcggatgaacagcacacgaagcagagcaaggtggtcggggttgatggcgtcgtcaaggcttcttgacgcattgtcccctgcttctgatctctattctcactgatcaatgtgttattactagttgtcatcaactgtaaacctctgattttgtcatcaattgtaaatctcttttgtaaacctctgatcaatgtgttgtcaaatttgtaaaccaccgacagcgtcatcgtggccatgtcgaacttgacgatgctggtgttgttgtcgcagaggaagtagagcgcgttctccacgaggacgcttggccttcttgcctggatgaagtcgtcggggtggtgatcaatggaggccgggctgctccatgcctcggtctccgacgagtaaagggcggcgtgcgtggttcccgcggcgtcgatgtccaccagcgccacgcggaaggggttgccgccgtggcagtcgagatggttgcagccgtccacggcgcagagcaccgtcgcgctccacggcgtgaacatccagtgctgcggcgcgctcgagttgatgttcctccagcactccgccgccgccgctggcccccgtctctcagtcgccgctcgccgaagagaaaaaagagagggaggatgaggagaacatggtttatgtgggcctcacatgttactgggtcccatccatactaaaatgacaaatgggtcccacacattttttttatttctaatgccacctaagcgccacatcaacgccacgtgcaaaaaaaaaaaacctagtcaatactgccacgtaggcgccacgtcagcgaaaccgcactctaaaatcactgaggaagttaaattgcaccggttttaagagttgggggattgagatatccggttttgtggtttagagtcacgggttagatttcaatcacatttaaaggtcacagagtgaacttattccccagcaaataatcgctctcggccttcgtagttcgtagttggccttgtgacttttcctcacttctcgatcacacggcccatctgtaaatgcttttgagtttggtaggaagaataataatagcagcagcagcatcaacaatcatactcgtaaatcgtactaataagcataaacagcaataagttgatatgacacgttatatattgattcatactccctccgtttcagtcactcggtttgaggttacaaggcgtttgacattggacaaagttaaattgctttaagtttataatactatattaatttcgtcaaatcaataattacatatatttttatcataaatttattttgggttaaaaatattattacttttctttataaacttagtcaaactttaaacagttagtcaagacgtcctatgacctggaacggaggaagcagttaagatacgtaacttttcacgttaagatttgggacataaggagtactctttttttttttatgttgcaagcttacaatcgaccagccgcaatttgctgtagtttttaaacttcatgtaaactttgcgcaagcatgtatggatcgttcattcgttttatgtgtccgaggcattattggctgtggcatagtttagttcctaattttttcttcgaactttcaatttttccatcacatcaaaacttttctacgcacaaacttacaacttttccgttacatcgttccaatttcaattaaactttcaattttggcgttaactaaacacaccctgtgtttctatgagtgagttggaaacatagtgattaattagcacataattaattaagtattagctattttttaaaaaataaattaatatgatttttcagaaaatacatggtttaataatttaagaaaggtgaatgtggaaaatgagtgaagttgaaaagattgagtaaagaagacagcctgtgtgtacaggtacaatactatccagcaaataaaaaaatatatttttaaaaaggagaaaatctccaaagaaaaaagcagagatgcctttagcacagcgctagagtagacagacgcgtcgctttcctccgccgccgccgcctcctcctccgctccgcgcggccgtctcccacctctcgcgcctcacctcctcctcctcctaaaccctcgctaaaccctagcctcccacccccccaccccaccggggagcatgcactccaggctcctcagcgccccctcccacgcctccgccgcctcctcctcccccctccccttcgccgccgcccacccttgccgcgcctcctggacgccgcggcccacctccccgctgccgcctctatcgctgctgcgcgccaccgcctccatgcatccttctcctcctcccgaggggtaagggcccgtttctccctgctggtcttcgagttcgttgcgatttctgtatcattcgttggcgccgccgcaggattttcacctgattggattttttttttttggtgtgtggtgcttgtaggcatagcgaccagcctgtgcatggcgtcaccaacacggtcgtcggcgtgctggggggaggccagctggggaagatgctgtgccaggcggccagccagatgggggtcaggatggccatacttgatcccctcgaggactgcccggcgagctcggtttgccacgagcatgtcgtcgggagcttcaatgatggcgccacggttagcgagttcgcaaagaggtggtggcccctagttgcaaagctcttatcaagcttcattcggagaacacttgtttactttcaagctcttatggtttacaaactgttgtaaaaaattcctttggttgctgttaggtgcggggttttgacggtggaaattgagcatgtcgacgctgtaacactcgagaagcttgagaaacagggcatcgattgtgagcccaaagcctccaccatcatgattattcaagtaaactttcacttcttgttctaaccatctctatatttcgttgttgctaaattttagtacaagttatctttagtacctttttactgtgaagatgaaaccttgaattacagttagcacttgtgctatctaactagcgttatgcatactgttaacattctgagcacttttgctaactaggttaattagttgtggccatatctattgttcctacttcctccaaatagattgctactgtgcattttagttatttataaattttatggcattcataccatgtgtcacctggaaattgtatttgtggcgacacctcttttttagtacagtttgcatacaaaatcttcatgctacggcttgctgcttcatatgccattttatccttatctacttcatttgatgcatccatgttttatttcaggacaagtacaggcagaaaactcatttctcaaaatttggaattccgttacctgactttgtggaagtaaggcactaatttctatcttgttagaaactaattgagtgtctgatataaataaagtaatacattccaggtagatactttaagtagcatagagaaagctggggaaatgtttggttatcctctaatggtcaaaagcaagagattagcatatgatggccgtggaaatgctgttgctcacgacaaaaaagagctatcttctgttgttgcttgtaagttgataaaaattaatggagctgctttctttatttgaattcctaaaattatactctctcaaggatgctgttacttggtttacagtagtatttgacatttttttcagctgttaatttgtggcttatacttttgaacagatgatgagctgatccactcagctgtacaagtaaatgagctgatgaggattttttttttcatttttcccttgtagctcttggtgggtttgagcatggcttgtatgttgagaggtggacatcttttgtaaaggttagtatcaatttaatttttttgggtcaaattggcagctagtaatttaaatttctcttggtcaagtagacaactaacgctctttaagtgtctcattagattgatcaccaaacactatagctaatttaacacatttgtttcataattcagatatttttgaattttctaggccctttttttttgtaatttaaatcatcttcagtatcatggttcacatggcagtagatttaaggtcatatgcctgtgtagtcactaggtcatcgtgtaaattatgctacatcctggtacccctatggctctacagtcatgccgcattccttgttttctgttgattttaggatatcttctgcaagttcgttacatgataatccctatgggctgcagg

SEQ ID NO: 68099 - DNA, 6434 bp, Oryza sativa
acaaagtcttgacacgaaccttttgtacacatcaattcaaaatattgcatcatcaaaacaatcgaactctaattgaaaccaaccaaatgaaccatcaaacaaatcactaagccaaaactaacattccgatcaacttacagtatccaactgccgacgacgacgataacaagctctattaattatttgccactcttacggatggtgatagatgatttgtcactaaacccacatgtcatagatagtgagtgacaaaataattaattgtcacatcttaaaagtggcccaaagttaaatgtcccctaatatttgctccgtgatttggatcttggtggcgccggtggcggagttgcttgctcgtgctcgttccttctccatgatgatgatgcagaggcggagtggcacttgttgcggagtgagacggcaggatgacacaacgacgagagctcgtggcctcactcgccgctggtggtgatgggcatggagagaaaaagcgatgtaccatggactacgaagtggggggaatggatcgatctcttgggccttggctatcactggggagcagagctacagtcggtaggtggcggctagggttttctgatggggaggggatcgttctcgatcgattgagcgagaggagtgacgggaatgccgttttttttaacaaattgatccttttcaaaaacttattttaaaactagtccctacaaaaaacttcaaccaaaaataggccgtggactcagcgccatagacattggcgctaagttataacgtatcagcgccaacgacgttggcgctaaactctaatccgaggtggcatgaattcgctgagtcatcagatctcagcgtcaaggtatttggcgctgaggtccagacgatttaaatagctgcggcggcatttaaataagagtgagtagtcaagagaacagaaattattttgtaaaatacattaattctaaaagaatgctaggaggaagagaaaaggaaaaaaattgtaaagaataagagtgagtagtcaagagaacaaaaattattttgtaaaaattatttgtaaagaattgctagaaatgccgccgcagctatttaaatcgtctggacctcagcgccaaatacattggcgctgagatctgatgactcagcgaattcatgccacctcggattagagtttagcgccaacgacgttggcgctgatacgttatagcttagcgccaatgtccatggcgctgagtccacgacctatttttggttgaagttttttgcagggactagtttcaaaataagtttttaaaaaagaccaatttgtaaaaaaaaggggacgggaatgactatcggggacagctaactagggtcaggggatcgatcaattgagttgggtctttcccagatgagtttgggccgccaagctgctgcaatgtggcatgctaaggttgcagcttataaagctcgtgactcgctaacaagctatcagttcggctcgttagaaaaacacaacaagtcgagttgagtcaagctggtcaccagccatgagttttttcgtccagccctacctttgaggtgcttgaaaaaagcatggcctagtgggggtatccaagtttatttactgctatctcctttcagaaggaaacaaattattcttaccattctaccgagactcttctgccattgtatcgagggctgttcccaatattttggcggcctaggatcggacgaggtaaaattagaggcccttggttccaacaaaatgtaggataatatttattttattagttgcaaatatcttcaatatataaatgatacatcccatatatataatacgatatcaatctaatccttcattaggttgctctagacaaacaatatccaactagacaaaaatgaaattatcaagtagggaataggaaaaatgaatctaggagcaagaggaaacttttaaaaagctcagtcgtcgtacatcgagtgatccgagaagtggtcaactgaaaaatagatttgaggaactggtgcgaattaaaggtataatttagtaattagtagtagatcctttttaaaattttaatataaaaatatgttaatctagttaatgacatgattttataaaactttaaaataataatacttgaagtcatatataccaccttctaaaattcgtatggttttgtatcatttatatatcgtataatagagaatcataagaaatgtggttttataatataggccttgtttagttccaaactttttattcaaacttccaactttccatcacatcacatcacatccaaaaacttttctacacacataaactttcaactttccctaaacttccaaacttttccaccaactaaacacacccatatttacttaaaataattgcttacacccaaatttagtacctaggatcgaaataggaaaaattgccaaagtttggggctctgccgatttcctccagagagggccggtctgaccgctatatgtgggccggtcagaccgacaccagagggccggtcagaccggcgggagttcgagtcagacgccgtttttgtcgggtctcgggtttccttgctcgggaaggcatgtttcaggattccattggtttctagctcgagttggacgtggaggagggcctgtagagggcaagatcaacccctatttaagagacaaggccggttcaattgtaacccccgaacacataatatacttgaatcgctttttcttttatctttacttttagccatgttttttactttaccctagtttcagtctatctttgtcgatgtacgccgtaaatcatccgccgccgctgtgagagtgcgacacctctttgtaggtttgtcatgaaaaccttctgtttgcccacgagacaagtagttatcctcatatcgatctaaatcggcctagaggctgattttgatctctagatcagctctgttagccggtttagctctttttctataaaacccatcttgatttggccgtttggctagatcgaggtgattggcgactccatatcatcacaaggcgtttaggtactgcgatcgtgcttgtcgacttgttaaaaaagttgccaacacaatttttgacgactctgctggggaatcgatctattcgaccatattatgaccgaatttggtttaatttagttgtcttgagagtttcggccgaacggccgaaatcaatccatatgctgttagtctgaccgtctgtattactccggtctaaccgacgtaatcagtacggtctgacctcttgtacgacgccggtctaacctacttggtcggtccggtctgaccggagtagttgccgatctaaacggcagaaagctgcagcagttgtgcatcgggacagcaacaagcggccggcatcatcttgctgtacacggtctgaaaatcagaaatccaatcctattcagtttgctgtctatacgtgttctaaaaacaaaatcaggctattagagccgatttacctagaatagacaaaaccaaatcggtttctgttattgtgcattaggcaactgtcaccgagaaaaaaaatcatcaaagccattgcagcgcattggctgttattgtggaacatcaatttccaaaatttttgctagaaccacacaaaatttctgctattgttgtacacggaagatccgccgaccaaggctgctgatcttttggttttcggaatttgttacgtgcacacatcaagtatgacaaggaaatcaagaccatatattaatctattcggtcatcgatttcggctatgagttatatggccgaaattaatcaaggagtttcttcgtcaaccataacgagcggaaacgagatcaacaaactcactaaggaggatttgaacgaggagtagcggcagtactttgaagaacaaatggcagtgttgaaggaggaatatcttgcataatacattaggaccgatcaaggtattctcaaaagaaacgtcccgctacctcaagtcatagtttcactaaaggtaacctccgattcgcccaacccatccgttgctattcaaaaagttaatgatcgttgtctagatgcatctgctacttctgttttgcttctatacaatatgcttataatgctatggaaggatcaatgggtgtttatacagccaattgcacaggaatcggctatatgcaaaatcgagctgacggtatgaccggtcgtgacaccggtcagaccgtgcccaccatggccggtcagaccgtgcccaccatggccggtcagaccgtgtattataccggtcagaccgtgccaaccatagccggtcagaccgtgccaaccatagccggtcagaccgtgcctatcctggctagatcgggcctcttttggccggtctgaccgcaccattgaccaccggtcagatcgggccataggccggtcagaccggatgcttggccggtcagaccgggctatttatagccggtcagaccggttccttggaaatttctctaggttttcataccacgactagcagtactgattttaactattattcatcacctgttaatactggtagtcatgctacttcacatatccctaatacttacaatgatcctaatagaggatatcttcatgacaccgggtatggccaatataatcatattgcgccgcaacaaccacctcttaggccactaaacccaccaccaaatccaccaaggcctgagactatggaggagttgattagtgtcattattagggataaatttggaattgaagcaaggaatcgtgctagggtttaccaaaagccgtatcctgattattatgacaatatcccatatcctcgtggttatagagttcccgaatttaccaggtttagtggtgaggatagtaggaccacataggagcatgtaggtcaatttttagcgcaatgtggtgaggctagtagttcggatacatataaattgcgcttattttctttacctttgtccggtactgcttttacatggtttacttctttaccggcaaattctattcatacttgggctcaattagaacaaagattccatgattatttctacactggtgaaactgagcttacagtgtctgaattaacatgggtaggcagaaacatgatgaatctgtcactgattatattgagaggtttagagatgctagaaaccgatgttttagtttgaatataactgacaaggatttggccgacattgcatataatggattgcttgattctattaaagagagattgaatggccagatatttcttgatgttgatcatgtgttgcatgaagctctggctcaagaaagccgagtggatgacaatagcttaaatgctagtttggatgataatgcaataaccaatatagccgaaccaagtgttggatcggattgtgttactagtttaagcaatgatggaatagccgaatcaagtgatggtttggattgtgctagtagtttagacaatgacaccgttgaaaatatagccgaactaagtgacggttcaaattgtattacaagagaaagtgaaatagtattgtcacctaaaaccgagtcacaaatcgatcatgtgaatgttggaaaagatagtgacaatgtcttgcgggatggtaatgaaatagaatccaaaatagctatgtatacatatcaaaggccatatcctgaacacatagattcggtcccatacccgcaaggatttgatgtgcccaacttcacaaaattcacaggtgaggatgctagaacaacaatggagcatatcggccattttgttgatcaatgtggtaaggctggtagtgctgatttgcttaagttaaaattctttcctctttctttgtcaaactttgcatctacatgggttagtttacttgctcctaattcaatttctacatggtcataaatggagcttgagtttcatgattattttaaaaatgcaagcttgatggagcaaagaccgattgatgattcatcggtcacttatgatactattttggttacacctattgctaagaccggaattgttagtaatccccttcctattgctcctattgattttgacaacaagaaagtagtgattcggcctagtcaagccgaatccacaaaagggaaaagtgttattattggggatcctcggtccgagacaattaggattaataatgctaaggccgaagatcataaagttgtaaaggatgagtcatctagttcccagaagactaaaaagccgaagcttacttttgagatgcttatggctaagtacaagaaaggattagccggtcaacgatttgataatcagactagtgattcaaaaagactaagatcatctcgtaggaagagaattggtcaaacgctaaagcaattggagccatcaactataccaacttcatacaaacctccggttgtgatgccatggtatccatatccaatgtcactatatggttatcttttttatgtattacatgccatggatggctcaatcacctatgccatttg

SEQ ID NO: 68100 - DNA, 9264 bp, Oryza sativa
ccgcgtatttatagggaggtgggcgcaagcgacgacgtggctgacaggtggggcccacgctccgagccgacggggggctgacaggtggggccatcgctcccagcggcagtgctacagctgccggctcattcatgtggtccccaccatccaccgtccactgtatcatggagaacgggacagccatgctccattctttagggggctcgtctcgcccgttggatctagtgtgctgtttgggaagtttacggaggttgtttcagattaattacattttaaactatattatttttaaaaaaatatcaaatatatacatacatttagttttttttcactaaactctattaaatccataagaaatccagccaaaatttagaaatattgttaaattgccaaaattttggctaaagtttatttcgactataatctgaacaggccctaagatttcgagaatatgctagttggtagctaacttctgataatttagagaagttgtaaaccagcttctgaattctaagggcccctttgattgataggattggcaaagaattttcatatgattcaaatttctatggatttttttctacatatccctttgattcattggaaagaaaggcaattttccataggattgtattcctatgcttcacattttataggaaaaatagcaagaggtgtgatttctttgtgaactttcctttgtttatcccatagcattatcgaaggactcgtatttgtctttcttgtgtttgttaattcctgtaggatttgagcaacgtactacttcaattcctgcgttttttctattcatgtgttttttctatcctgctaatcaaagggcccctaattcattttctggattctataactacatattctcagaatttatgtgacaatctgaactgtttaggaagctgaagattctgtgaaaagttacagctactaaaagctccctaaacaggcactaggttgtgtttgattaccggttacattttatcacaactatactttgttagctaagttatagtagataaaaatatggtagatagattactagctataatatgtggtaaagttaataaaaatataactatgataatgaaccgaactcaactatggtagcttaaaaaatggtgtagtaaaacgtgataatgaatcaaacacctctttaatccgtccagatcaccggcagtcggtgagattgcactcgatcatcgagactgtaggacatggccattttgttgactatcagcgaggaccctggaccctaaccaataaccatctagatgatggacaattacattgattaatcaactacagaaaaaaaatagatggaaaattctactttcttttctgacacaagcgtggctaagacactgtcgagaggacatacatcgtccgcattaatactgttgatgtaataacaatcacttgggtgatctactccagttttatacaaggggcggatccaacgtggatgcaggggggattcgattccccccctacacccacaagacccatggatacctccggagcaatcctttcaattttctcgccataaatgataaactaatggtccctaaatagctgtaggttaaagaaactatataattaagtccatcattttttttttattcctggatccgccctgtttatacacatacaatcaaccaaacgcatcgctggctgcacgagggatacgagccaccccaatgcagccaatcaaacatacccatactacatcagcagtaatgcattgaagctgtttgctagtgaaaggtcattgtcaggtagctactgattgttattgctgcatggcacggtcgatgcagagagagagagagaatgcgacccatacatgtgtgcagatgtgctcatcgatcgtcgtctccttgcaagcgacctgtcggttgcggcaaaaccaaccacatccacatgaacacacagtcagtaacattaacagtaaaattaattttctctgtacctttgatatataatgcttcctccgtcctacgataacttcacttttcactcatcacacatatcaataaaagggaaaaaagctagaatatcttctaatttaacatatcccaaaacaatcgcccccaccactttaataagtctcattatatttgcgatctactttcacaaactctaataaagtgataatctaaaagtatttgaggacagattagatggtgaaaaataaaattattttagaaatgtacgacctgatcgtgcctgaggagtaaacaaatatactacggctgtacggcatatatggctcgttgcgtccctatcgaaccaatgctattttccaagcaaagaactatgaggcatctagcaaatccacagcatcgacgtgaacgaatatgcggccatggaattacagtactaattgccctaattttttttcctgtagaaaggagtataaatgtataattaataagatgatataaacgagctgtggaagttgcgacaaagagaacaagggagccaagagccaaggatttatttatttatttctcctttttaacttgggagtcttttgctattttcgtcttaattaagccgtcgatatatatcttcctgatacttctgatgatactccttgaaatctttgtgataccttcgatatactcgttaatatacggtgatacttgctggcaagtacactatgatagttgttgatattcgtatgtactatcttaaaataaaccatatgagaaaaaaaagggggatacatagtaggattatatcctgccataatgggtcttaaaaaacataatgagtgacaaaaagataagcgtggtcccctgtttttgctagccgagcacatttttgtgggcctaaagttcacaggccttgttattaacaacaaagttatccaggcttggaataagttcactttgggcccctctatttgtcgcttagtccgattttcgtcccttggtcgcaaaaccgggtacgacaagtcccccaactttcgaaaccgtttaaatgttgtccctcggcagtattgcatctggtttttgctgaggtggcgcctacgtggctaggtctttgtccaatgtgtcaatgtggcggttacgtggcaattagatccgaaaaaataatagtacacgtgggacccacatgttagtcgcacacaacttaaaaaaatggtgggcccatgaggacccagacgtcatcctctctatcctctctctccctgttctatcgctctccagccggcggaacgggatgggcggcggccggagcgggcgacggcggggcggagcggcggcggaggcagagcggggcggagccgaagggcgaagcggggcgggcggctgccgaagcggggtggagcgggggcgagcggatgtcgtcgagccgtcgccatcctcgccgcggcggacaccgtgaacgacgacgtgctcgcgcgcgggtggtcttcaactcgggggtgtccaacccggggaagggaggggggggggagctcctggcgccgtggttggaggacgccgaccgcgcccaacgacgacgagcgcgcggagaaggatgaggcggcggaggctgtggtgttcatcaacggggaggacgatgaggcgacgatctgtccgggttcaggggcctggttcttgatctctcttataggtgacctcaacgacctcaacttgatctgacgatatcatccaaagttgcaaactattttgtttatgatagaccaaattttgcagtgatcgtgttagaaagagataaaaacaatttgaaggaattttgcatttttacctcgaaatataaccaggcctgtgaacgttgtctgctggaagcgcgcaatttgtttggaattcatggcgaaggttagcttctctgcttccaaaatcatttttaacttcaccatcagttattcaaagttcattatttgatccaaaaacatgcaacagcagcgctcagaggggcagagcacacggcggcgatggcaggagcttggcgcttcgacggcgtcggttcttgaccccgtagccgacgacggcgaggagcgcgacggcggtgaggaagacgtagacgtcgtcgtcagcagtagcctccgccgccgcccacggccgtgctgccccgcgtccccctcgaggaggggaccgacctcgccgctgccgtcgcgcacgagggctccggctgctacgtcctcaccgtcctccgccgcgccctccgtcctcgccggaagcaggaagggtgccgcccgggtcgtcacgcgcgccgcccattctccccgtcggccgctgctcgtcggtcgtcctccccattggtcgccgcccgtcctggtgccccttctccccgccggtcaccgcccatcccggcgccccttctccccgccagtcgccgcccgtcgcgccattctcctcgccgacagtcacccatctcttcgttgcctgtcacgccgtccaccccgccggccgctgctcgtctcggcgccctagctgcatctcctcctcctccggcggccaccgccggacactgccccttctccccgccggccaccgcccgtcggccgtcgcgcccgagagaggagaggagggagagagacgaagagaggggagatggggagtgaggaggaagaagaggggagtgagattgacatgtgggcccatgtgggctccatcttttttaattattgttttgtgtaactgacatgtgggtctcacgtgtattattttttttccaaatcaaattgccacgtaagtgccatgtcaatgccacgtgggacggagacctagtcaaaccagtcacgtaggcgccacgtcagccaaaaccactacccaaaccgctttaggaccttatgtgtccggttttcgtaagttgggggccggttcgtacccggttttgtggttcaagacgaaaatcggactcggcgacaaatagagggacctcaagtgaacttattcctccaggcttgtctatacatactgggctgatacagtaaggtgtacagggagtagcctaatgacacgataaggaaagggagaaaaacccagcccatatgaagaggaggccgcggcccacggcctcttgactcggataacgggctcaccttgccataatggaccaactttatggcctaacgggcctgtgtagtaatgaacgaaggagaaggcaagatgaaccgtgctcgtccatacaaaacgttcagaatcgctttcaacaaaggaagttcagaatcgttttgtttcttggttttttatgtgacctagttttgatgctccggttagcatccatgctaatagttcagttagtgtgaagtgaattgtttcggtgaaccccgcaaaaaaaaaaagaattgtttcggtgaagatggtagattcagtcatgaattgtttcggtgaaccccgcaaaaaaaaagaattgtttcggtgaagatggtagattcagtcatccagacagtggtcctgtttggatccaaaggatattttttaggcctccctcaaatagtccaaatagctcaaaaagatccaaaagggtgagctatttgagggctatttggaaatagcccacccaaaaaaactatcccacccaaagagtgctaattggggctatttcaggtggggttcattgaaaaagtgtcttttatctctatctctctccatgagaaggtacattaaaagccaaatagctcttaaaatagcccttgaatccaaacaacttagggctattttattggaggactattttttttgctaaaaaatagctctcaaaataactctagactagttctccaaatagggccagtgtttgtttacaagtgttttgcactactgcaatgagatacagtacaacatgagctggttttagatgggtctactgaagtgcctgaaagataagacatttttattcttgagtaaagtgtactggcgttgtgtgggtgtgtcaactagttccctgaactctcaaaatgaatttttaggtccctcaacttgtcttgggtgtcacgtaggtccaaatgtgtttcaacctgctccgtgtgctgacgtggcatgccatggtggcgcctacgtgtaagtagaacccatatatcagccacatatagaaaaaaaataagaacatatttttttctcctctcttttttcatttatttttcaaaattaacacatcattttctcctctctttttaaattttattttttttctacatgattgacatgtggatcgcactgacatgtaagcgtcgctgtggcatgccacgtcatctcacggagcgggttggagcccgtttggacctatatgacacacatgacaagtttggggaccaaaaaatatattttgagagtttaaggatctagataacacatttgtacaagtttaagaaccgtccgtacacttcactctttattcttgcttactgtttggttttcttccctatggatgtaatgacacgctgacaggaatgaagacagtatatgatacctagcctctgtgttttcaacttctgcttgtggcagctgctaaattttcattcatctgactgtgtgaaggtaacagcttaaataaactccatttcacctgatatacagaaaaaacgtagcaaccagcaaaacagatgggcgggtaaaatgggagtagttaagtaaatcaatacatttgtcaatacacatgcacatttctagatatcaaagaagccaagacttcaaaggagacaaactttaagtaattactctaataattaacgatgaattacaatctttaagtaactacaagagctcgcatggaattcatgaaaattctacaccaatagtttcatttcagtacaatcaattttttgaaaaggctttcagtagtatcaatagtactaatcacttttgttgcaacaagtttcttgattatcactcgcaatcagacactaattaatcaacctagaggcttaattaatttttaaattttggcgggctttgcacccgaagaaggtgaaggatttcatttgttgggggcagctgatcagtccttggtaatggcggggatgcagctggagctcctggtgaggccgccatggccgtggtccctcgggctgttggacctcgacctcttgcggaggatctccctcatggcctccgtctgcatcagcaccgggttggcgcgccccacgcggttgaaccgcccgcacaccgccatgtgcgccgccagcgcctcctccgccgtcgccgtcgtccacccggtgccgccgtggcggcatctcctgtcggcctcggcgctcgccgcggcggcgcacaggccgcacacccaccgcccgcagtagcgctcccggacgcggcgcgcgtactccggcgtgcactcctcctgcatgccgcagcactcgcaccgcgcctcctccaccaccacctgctgctgctccgtgatctccggcagcttctcgccgccgccgccgccgccggctgccgcgtccgccacctgctgcttcttggtgagctccagggccaggtcggacatggcgcgctggagcccctccatcgagatcctccgcggcttctccgcccgcttccccctcgccaccgccggcgccggcgccggcgccgccgcagccgccgccactgcgccttccccgtttggcgccatcatccactaccactagtatgatttctagctgcaaaacgaatgctcaatttgctactcgatcagatgctgatgagctgactgattactaccgacgagtgagtatgaaccgaattcaatgtggagaagaaggtgatatcgatgagctatatatacactggccgtgcacgggaaagcgagcgagcgcggatcagattgcgtacgtcggcgtggatgatgagcccgtgacatgatcgacgaggaacggagcgagctggaaaaagaagggaggggaaagagggagaggtcgcttgaatgccctagattactctcactctcaggctctcagcatccattggctaattaagatcatatcgaacaatgggcaatgactaactcaattggccatgcagtgtcaccgagattgctgcgtgtttggacgcctagctcgtgctcgtgagctagatgctaaagtagatgctcgagttttcttggccacgagtaatcagaagaactcctgtgtccatcgatctgtgtggttacaaccttgattaattaattaattgcgtaaattaatggagtacaaaattaatcggtcactgcaaaattttagttgtgtgtcatactctcatcttctttcttcccacggtatatatatatagatctatctggccgattgtgttgtataaaaaaaaactctttttcttctaatatattggcgtgcaatatttttgcgcgttaaaaaaaatgtgccacactatcgtctctatgatcattcatggatagatgaatatatagatggcgcacgcgtgaaccacgttgtgtgtcaatctcgatctctaaacagcgagcgagcatgcaggtgccgtgtccatccatatgccgcgcgcgacgccgtccacaactccacaagcttccgctactacgatacccatcaagtccatcaccacctcgcgcgctgcgcgcatgtgtccgtcgtccgtccactcccaactcccaaccagctagcggccgccgcgcccgcgcgcgccggacgtccgcttcgccgcgtgattgcgtcaatgattattgcgccgcgcgcgcgcgcgctttccctggctgcacgagcgccgcgcgccgggcggggcggtcacgagatgtctgggcgagggcgagggcgagacgcgctggcttttcgattgtacctgccgccgatggcctcgatcgcacgcggaggtgcgatgcctttggctgggccgtgttcaatgagccgttctcttggcccagcaaaggaataagttcactttgtgacccttaaaaatgatcgaaatctaaaccgtgaccctaaaccataaaaccagatatctcaacccccaactcttaaaaccggtgcaatttgactccctcggtggttttggagggcggtttcgctgacgtggcgcatacgtggcattattgactcggtcttctttgcacgtagcgttgaagtggcgcttaggtggcattagaaataaaaaaatgtgtgggacccatttgtcatccactaaaagtatgggtgggacccactgacatgtggggcccacataaaccatgttctcctcatcctccctctctttctttctcttcggcgagcggcggctgagggacaggggccggcggcggcgggagggcacgcgggcaacggtggctgcggctcgcggcagtgggaggactaggggaacgacggcg

SEQ ID NO: 68101 - DNA, 4725 bp, Oryza sativa
gcggccgttgatcgttcgatctgcaagtatgttatcagtataatattataagataattttaggattccgtccgatatttagctcgcgatagaaatttctaacctattatatggatataatgcttgggtagattaaattaaaaacttatgataacaaaatatttataccagcaaaaatagtttaggatgtataaatcgaaattgggtttgccctagttcgtgaatagtaaagttaatataaaagaatcgactttcgcattcgacttccatttggatttatttggatttttatttgaattctaaccgaattcaaatcaattttcgcacgtactatagagcccgaggaagttgcggatccaagtgaagtccaagactcgcaagactttgagcaagacaagtcatcactgtcccttgaacatgttaatcccaattgcgaaattatttttatttacaaataagaataaatgcaatgatgaacatcctatttgtgaatatgccataccttgattattgtttacccttatttccttgtaaccatgattacgtatgagtccctagtcaactatgacaaatgcttagagatgctactctagaatcatgcatactcatatttatcaaatgctatatgcttgggcaattacctttgggaaggtaattgagatgcggcatgtggagacatgagcgccacattgccatgatgttgatgacatgatttgtgaaaggagaaataaaattaaacaactgttttcgactggggcggacggatgatttgggtggtatccggaaaaggctagtaccgtccccggtcaattaaggaccgagccatgaagttaagcttgaaacgacccccgtacaaccgcacttctcgtatgggtatagacctagcggaatagatggctgagcggaggcagtatccatgcatagtggtttcttgatgggtgaggcaggggctctacggtggggcagccattggtagaaccgcgaggcgggtgtctacagtggtgtcgccatcggtaagccatgagaaaatttaaacataattataacataatgcatgtgtgagtctttccttcccgtgtgcgccagaactcctctcgctgctagaaaccgtgtacgcctagagtgcatgaggatgtaaagttcatggagcgggtactgccaatgcgaggttatcgaaaagctttgccgtgacgcgtctcatgtgttgggacgaggctcatatgttggacagtcgtggagtgcgggtaaagtgtacatccactgcagtgtgagtaaaccaaatctattcgaatagccgtgctcgcggttattgagcactgggacatgtattacacttggctagactctaaattcttaacttgtgtgggatgggatattgcatgatgatttctatactgatggagccacttcctgagaggcgggaatgtggacgttctcataaaaacatgatgacttgggcgatggggggaagctatccttgggatcacaattgatggtggacagaaccgtattgtttaatatgaacactggtactaaaatttgatcagtctgtgctaggtcttaggtttgtgaaaagaattacaaaacttgctttgtgcaaaagaaccatagctatcttttgaatacccctgtcatatgcattgttgttgtggtggcttgttgagtacggttggtactcacccttgcaaacataaacttaatcagaggccggagatgaagcttcggaggatccctatgcctattaccaggagggtgatgaagacgatggcgctcagtaggtcttagttacggtcgttgcctgtggcaatggcgtgctcctgccttaactccgctgccttacctacttctgtttttggaatgtattccggaccgctcggtccgatgatttaagactgtgcctgcgggcctatgatgtaataattcgtacgagactctcgtgtatgtgtacttggtatttcatctatgaatttgtgtgtaccagactacttgatccagggaaatggtactgtttacacgattgattcctgttataaaaataagggtccacatatttccttataagtttgcatgtaggtactttcctaagaattagtatgaatgtgattgagtttcgaattttgagatcgtacaaaaatcaagcccactaatttcggtgtaattgctttatttccatcaataccgatttgtttccattttctatgtcattatatacttggcaacggtatcttctttgtcgctgccgccggtcgtctgtgatctgttgccttcgacgttcctctgcgagtttcttcgtcgccataactagtcctccacgctgttgtgcgccgctggacatccgtgagcgtgttcgtcatcgctgccgctagtccgtgagcttcttccagcctgctgtctcatccacagaggtcgactgcttctggcctggcagcatggttccaactgcatgccccccttccatgattggaggtcgaaggcttccggcctgcctgccatccaatcgtaatattcttttatagcaaaatacgcatggcttgagaattgttctcgctatggatacccttttttgaaggacgaagaatctcattcaattatttttcatgcttttggtcttttatggatacccccctccactcttcttcccgattcccccaccttctcgcgcggcctatccctcccaacccgagcgcgcgcccctccccttttttcttctgatcccccctccacccctcccctttcttgagaaggaaaaaaataaagggaaaaattgcatttaatgggaatatagaactcaagacctacaacttaaattaccacatggcactaaccagtaggctatgtctcaattgtgataaagttttcttagtaaaattttatcttctcatatgtgctaatccttgtagtatttggcacaaaacacgtagtaacgatactaggaaggttgttagtatacacttcaaaccatcttaatgcactatcacaaatcttttactacacaactacaatagcattaccatgagaattatagattactattgttaccatcatttaatttttatgagtaggggtcaccacgctattgattattgttcgtagaactaacgattcctaaattttagtatttactcttgctcgttactgctttgtactatgtgttactgcaaccccatagtaatattgttaaataaatatagtaacagtgtaactagtgtgtagtaacagaatagatataatcctagtctctctctccctctcatgatccctctgctttctcctctcccgatctctctctcttcccaaaaactaggccttcctctctcttctcaagaaaaccggtatccttccttcatgtatgtacttccacccttgtcatagtaacgccatcatgagatatagtaacgcgtccagttactacaaaatatataggttgttattacatttaactgactagtattactaggttaaagtctcacatgctaaccaaatacttgttaccgcacaaaagtagaagtgttactatataataggtgcatcttaccacttccaagtagctatgttactacacgataattgtagttttactatgtcatttttacaagatgaagatcgaattggtgggctataggtaaaatctatagggggctttgagcaaggtctgattgacgtaggagtgttttgaacaattttatacatttagtaaaaccatgttactgtatgtatatgtccttgttactgcaaattacacattctgttactgcatgtggagggttaaagttcaaaatgccaatctttgaaaagcaatatctcataagatatgcattattttttaaaaccgtttgcacagtgatgctatagtgttactgcatgtggagggttaaaacttcaaaatgcatctacgtactcccctcctcaagaaactgtttttcctctttctcaaaaaatcggtctgctccctccaatacagtgttactgcatgcctgtatatgacattactgtacttttgacaataatattgtggtgaattgcagtaaatcaggaattgaaacaaaaaatatatgggttcaaagtctcagatgctaaccatatacttgttactgcacaaaagtaaaagtgttactgcacgacagatacacgttaccacctgacagttacacattaccgcatgtttatgcagtaacactatccaagagctgcagtaaaacactttgttactgtaggacatatagaacgttactgcacctatggcagtaacatcgtggtgaaattatagtaaactaggaaccaaaagaaatatatggattaaaagtctcacatgctaaaaatacttgttgctgcacaaagtagaagtgttactacatagcaggtacattttaccacatgtttatgcagtaacactattcaagaattgtagtaagacacattattactacaaaacttatggtctttactgcacacttacagtaacgtcgcgctgagattgtagtaacgtataagatagtagtaacgagcagtaatgctatagtattactacttgtagagagtcaagatccaaaaaccccaagcttcgaagaacaatatctctgatgtgatgtatgatttttttaaaaccgtttgcaccatgatgttaggaaaaaaagtgcttatcaaaactagatccgtcatgactatatttcaactaaatttgaattgatgagcgactgtacaatctgtaaggcgaatgggagcggcg

SEQ ID NO: 68102 - DNA, 17732 bp, Oryza sativa
gttgtccatgggatggtatggaaggacacatagccgatttgaggttagcttttgagaggatcgccggtatggtttgaagatgaacccacttaaatgtgcttttggtgtgtcggcggggaagttcttaggattcatggtgcatgagagaggagttgagattgatcctaagaagatagagaagagtcgtgatttcaaagcgccgacatgcaagaaggaggttcaaaagttgctaggtaaagtgaattatttgagaaggtttatttctaacctagcgggtaaaatcgatgcttttgttcctatacttcgcataaaaaaagaagccgattttatttggggggggcaaaacaacaggaggcgtttgaagagttgaagagatatttgtctactccacccgttgtgcgagcgcctaaagccggaaagccttttcggttatatattgcctccgaagacaaagtcattggtgccgttttgacacaagaggaggatggcaaggaatatatcattacatatttgagccgccgtcttttggatgccgaaacgaggtatgtttttatagagagactttgtctattcttatactatgcttgtaccaaattgaggcattatttgttatctagcacatgcgttcaaatacacattgcctgatgaggatttatatcgccgaaatatagatgatgtcttgttggagtgcttagataaagatcaatctaaagtggctatgggagagatacatgaaggaatttgtggaactcatcaatcggcccacaagatgaattggttgcttagaagagcggggttctattggtcgaagatgattgatgattgcttcaaatattatagaggatgcaaggcttgtcaacggttcggcaatgtttaattggcacctgccgccgtgttgaaccccataattaaaccatggccgttccgagggtgggctttggatttcattggtcaaatatatccttcgtcatcaaaggggtataggtttgtgctagttgctacggattacttcaccaagtgggccgaagcaatgcctttgaagaatatgactcatatggaggtaattgactttattttgaagcatattatccatagattcggtattccacaaacattaactacggatcaaggtgcttcttttatgtcgaaagaagtgaagaattttgccgaatcttatggtattaaattgttgagttcttctccttactacgctcaggctaatggacaagccgagtcgagtaataaaacattgttgaagttggtgaagaagaagattgaggaatacccaaagaggtggcatgaggtgctttttgaagcattgtgggcgcataggatatctaaacatggtgccactaaagtcaccccttttgagttggtttatggtcaagaagccgttttaccggtggaggtaaatcttggttctcttcgtaatgtcaagaaagatgatttgtcaagtgaagattacaagacgttgatgggagataatcttgatgaagtcatcgacaagcgcttgaaggcattggaagagatagagaaagagaagaagagggtggccaaggcgtacaacaagagggtgaaagcaaagttgtttcaagttggagacttggtttggaagacaattttccctttgggtactcgatccaaggagttcggtaagtggtctcctagttgggaaggtccttatcgagtgtgcggcattgttcgagggaacgcatactttttggagacacttcaaggggagcgttttcagcgagcgatcaacgggaaatacttgaagaaatacttcccgagcgtttggcaagacgcttaggaggtactatggccggtaattgagttattgtcctaagaccaaaaacatgttctatgcttttagattcacgttgttcataaaaaaggcagggggcatgtgtttacacccaaatttggcacttaggattaaaataggaaagattgccaaaatttggaagtctaccggtttcctccgagtgggccggtctgaccgccgggcggtcagaccggcagtgtgtggccggtctgactggcaggtccgagtccgactgtgttacgtcgggtttcgaggtttccttgctcgggaaggcatgtttcgggttttctttagtttctaccccgagttggacgtggaggaaggcctgtagagggcaggaccaacccctatataatggacatggccggttcattgtaaaaaaccaatctacaatccatcaatcgaatcgttctttttcatattgcttttagttttctcttagtttgtccatctttgttggtttgcgccgtaaaccgtccgccgccgctgcgagagtgtgacatctctttgtaggtttgtcctgaaaaccttccgttttgcccaggagacgcgtagttatctagaaatcggctccgctagccagtttagttatcaaaacccatctaggtttagctctttgctagatcgaggtggttggcgactctaggatcactgcaaggcttaaggtgctgcgatcgtgcttgtcaatttgtcaaaaaagttgccaacagtattgtcgccgttccgggagtttcaaccttcctctctaccagccaccaacctccccgagtgcgcgtcgaccgggaacacaatatgccaccgacgtcgccgcactttggccactggaagcccgacgccccgctcgcccttttctctccctctctctcggctcctaactgaagagaaggaggaggtgatgggaggaagaagaagaggaggagagagaaagaaaagaaaggctgacaggtgggccccactacagtactatttcacattttctagatttaattcaaattccaatttttagaagcccatatctcctaaaccgtagatccgattccaatgaaacttggacctaaatttatataaattcaaatcctaccttttggcactaaatttgctattgtaatatttatttgaattttcttatttattcaaatgccgtttgaatttatgtttgccttttcaaatatttctttttaacccaaaataccctttagccactaaaaagccgccggttggaactttacgcctttcatgggaacgttcgtgcggtctaccgaccccgacgtcggaccgtcggttgtaaagcccggcaaaaccaaacctaaggtcgaagtgctgctcctggcaccccacgcctcgatgcgtatagtggtcggagcttcactattccatcgacctccatagcacaccgcacagttagctctcgggctctgtgtgatcctagccgttccgtggccactcacggttatcggagtaacacttccaccccgctaaagcttcacaatcttcttatccctctagccattgtattgtctatcaatatcggctagacacctaacctagtcgtcatactatccaattctaatgacgactagcaaacacccaaatcccagtcgatattcatcctacctcgatatcggcttaatcaaatgaaaccccagccagcctgctatccaaaatccataccagccatttactctccaactacctagaacctacacataaaatatagagcctggccgatatattgccctactcctcaatcagcctaaatataaccaaaccctaggtataatcctaccttaaatcctagtcattcttctacctgtggtatttcgaggatcggataatcaggttgcctatctcggatttatttgtgttggagcaaggcaagttattattcctcccctttgatcataataatcctatattctatatctccagtatcttgtgcattagccatacataatttttaatgcataacctgaatatatagcaaaccagatatatgctagattttgcttagccatgcctagttagacggcataaaatataatgaacttagattggaacagtacggaagaaatggttgatttccgggtggctagtactgttccaaccgacataagactgccaagtacatgtgaagaacatacgagtacgaccgcaattctcgtatgggcatagacctagctgactacgttatctagcaaaggtggtacttctgtatagtggttcttcttaagtcctcgcgtaggaggcaaatttatgccgcgaagggcaattatgatatttaccgaggcgcaggtaaatatacttatattgatagtccaggggactatattatggccatgtgattttattaaccctgattgcgatgacatggtgtcatacaatcagttctctctaaatacctcgagaatgccagaactcctcttgctgctgataatgttatgttcagagcgcatgggaactagagttcatggaacaggtaccactgatgttagtaaccgaaaagctttgccatgataatggcacgtcatggattgcgggtaaagcatacatctactgcagtatgaatattctcaaaactattcgaatagccgtgctcgcggttatcgggcattgggactcacaatggcatcttggttagaaacttaattccaaacattattaaatattgtttgtcgcgtcccaaaacgactctaaaatatatcctttaaattatgcctagaataattaaaatctgtgtgcaagccttcaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaaaggttttataaaaagaaaaactctaaaaagtctttttaccccctccccttcttgggccggctcggcccatctctctccctctctctcctcttccccgcggcccattcggctcctccccgcgcgcgcgccgctgacgggcgggcccgcccacctccctcgctgacgggtggggcccacccgtcatccccttcctcccgccgctcccgccgccccgcccgcgccctagcgccgccgccgccgcgaatcccgccgcctcccgccgtccccgcgcgcaataaagagggggaaatcactccccgtgattccctctccctttccccccatttttccctctctctctcgttcaaacgggcggatttgccccccacaaatctcgccggcgccattgatggagcccgagagcgccgcgccggtttccttctcctccggccgccctctctcactaccaaccctatataaaccctccccgcacctcctccgtccgtttccgccactcgccgcccttcctcctcgccggaatcgagctcgcgccgtcgctctctctctccgccgtcaccgccgagctccggtccgccgccgtcgtcgccccggaccacctcccacctcggcgccgcctccttcggcttcgccgcattctcgccgacctcgtccacccctccgtttcggtcgccatccgccggaacgccgtcgaccccatcgacccgagccgcgccgccgccttccttcgctccggtcgccgtttccgtcgtcgccgtcgacccggggtgagccgtggaccgccgcttcgtttccccctttccctcccctctctcggccgccgctccgccgtgcctatggccgccgccggcgaccataggggcgcgggcgcgccacctcccgccgctgcgccggcgtggtcgccttcgggtgcaccgagcggctgccgcgtggggcctggctgccagccgcccgcgcccttaggtgcggctgacgcgtgggacacacggcgccggccggtgcgcgcccgggtgcgcccggttcaccgtggaccgtgaggctgacgcgtgggccccactcccgtggacccggtccgcgcgcccctcccctcggttgacgcaataaatccatttttgaattaaaatttaaatgaagaaattcgcaaatattcatttaaagagcatataaacttcaaatggccataacttgcccatttgaactcggaattggaccgttcaagtctctaatttttccttaagaagtcaagaacccatttttgtgctttgtttctgctgattatatggagtttattagagtaaaagccttttcttttccgttggtcgtgtagacgctgcagcttcggaagatccgctcttcgtggaagttgaagccgacgtttgggaaagcgagcaaggcaagtcacatcatcctataacatattgaatcccagtttataaaattattttgatttaaattattgcattatcgctttatttaaattcccgcgttatcactgttttatctagccatgcctatttacctttgttatgaccttattattgtgattgttattattaccttgttcaccctagaataaacaaaaccccaactagtggacactctactcatggtaccactagtatgattttaggtagatgcttcgctgtttaattaggtaacattaggtggttttacaactctagactttgggaatattctcatcacctggacacattggaattgttggattattgtggaattggattcacacctctccctctattcaaaatccccaaaatggttttaggctgggctcggggtgcatggttttgatagtagcaccacggccatataaggaccggtcttcgggcctctgttgcaaagcactaccgtacttccacatgtctagtgggtaaggcttagtttgtggctcagtctggttataaacaaaagtacacggagcaatgtacccaagttagtgttttcattcttaaaacctgcttaacaactaaaacgtggaacggttggccatggttggcttgggacgagctgggacccagggtcgggttgccagttcggtctgaatcatcgtaggccttgggttaaggcaggttcgtgtgggttcacggccttgataaataataatgtatagttctagaatcgtgtttacaaaatagctttgagcaactaaatgtctttaaatgctgtttactgcaaaccctaatcctttatattatgattcccttgtactcccttgcatttattctgcacttgtgggtgtgtcttgttgagtacggtggttgtactcagtcttgctcaatttttcccaaacccagaagaggagcccctagaagttgaaggctttggtgtctagctcgtgcctgccgtcaagcgcctgtggtcgtcgccctagtcttccgctgtttcccgtttgtctttgtgtgtgctgggccttcgtcgcccatgtaataaattaactatttacgcttccgcttgataaactctgaaatgtatcaactcttggtgtaccttgcctcctgggacaaggaataatacacgcacgtaaggaacgcccgttgggttaattccggtcgtgacaagttggtatcagagcccccttgaccctaggacgagccgtagatcccaagccttagcaatattttcaaaataaaaatcctgtcttatttgtgaaaattctctagtctctctctgtcctgctgcttcatttattgtcaaaatctgacctttaaaatgttgcttttctttttgtttttgtttgtagatggccggtagcatcaaccgtcgtggtctggacctgactggcttcgttttggagctgcggggcatgtgcgttgtcctggggtatccgcatggagtggactaccagggcaggcagctcccggagcaggagggtgacgatgcagagctccacgctgcttgggaggttactgcagtgatcctcactggctcacccgagaggacttcgttgacagtcaccgcgggtggagattctttcttcgctgcttgccagaacgccgcactcctcgccatcggcactcttcaccagcgctacccggacgagttgcagcactcgccctaccgctaccaccctcgtcgcggaggagcccgcgactacgccaccttccgggatgctagctcggaggatgacactaccatcatgcatctggcgcgcatggtggaggcgtacgacgcggctcgtatcgacttccatcagatggtgcgccgtgggatggtcgagaacaacatgaagatcctggagctgcgtcaggagaatctgcagctgaagaaggatctagacgcagtggaggcgcagctgcatcagctcaagatcgcccagggagaggtctgtcgccccaagcgtcgccgcgtctgccgcagccagaagatcaccacccgcaagagcacctccaggcccgagcttgttcgccagtccttggcatggacctgcttcgtggagacccctcgtgccgagcccgcgcccgtggttcctcaggagggggaagcctccggcgttggtagcacggaggatgcgctgctgctcaccttccgtcctggcccgtcgcagcggtagacgagcagttagtaggcttgcgcgtgtgttctttctcgtttgtcttcttgttggagtcgtgtggggcatggttatgccggtgtgtggtataactgtgtcggagcctgtctttattttatttgcctaagcaacttgaactttaatgaaccaatttaatagcagtaataaattcaagaattatggtaatcgtgggtggttagctttaattgtcagctctctctgtttgctggttctgtgtggggttttcagatggtgacgaccaggagaaatgctaatacaggtgatggcaaccaacccgaaggcagcaaccacaacaaccatggcagcccacctctacctcctcctccgcctccaccaccaccaccagacaccaacgccattctcacccaaatcctcgcccagcaggccaacatgatggctgctttcctccaccacatccaacatccgccacaacataatgctccaccaccacccccacaacactccaaactcgccgagttcctccgcatccgtccaccaaccttctctagctccaataaccccgtggatgcgttggattggttgcatgccgtggggaaaaagttagacaccgtgcagtgcagcgatgaggagaaagtcatcttcgccgcccaccaactgcaggggcccgcatctctatggtgggaccatttccaggctacgctgccagaggggcagcctattacttgggcccgcttcaccgccgctttccggaggacccatgtgcccgccggagtcatggcccttaagaaaagggaattccgagagttgaagcaaggcaaccgcttcgtgatggagtatttgcatgagtttaacaacctggcccggtacgccccggaggatgtacgggaagatgaggaaaagcaggagaagttcttggcaggaatggatcctgagctgtccgtccgtctagtctccggggactatccggatttccaacgtctggtggacaagagcatccgcttggaagccaagcacaaggaactggagtcgcacaagcgtcgcttggcgagtttccgcaaccaacagggggctaaccaaagggtccgctacaccaatccctatccagggggatcctcttcacagcagcagcaacctcgctccgcgccccgacctcaattcgtggtgcgcgtcccacagccgcagcaacagcagagtcagcaagggacttgtgcgccccgtcctccaacgccagccgcgcagcttggtcaaggccgcagggacgttcaaggtccgcagcgtctgtgcttcaactgcttcgagcctgggcactttgcggataaatacccaaagccgaggcgccagcaaggccaagcgcctccccgctccaacaacggtggtaaggatgtcattcggggtcgtgtgaaccacgtgacggccgaggacgtgctgacaactccagacgtcatcgttggtacgttcctcattcattccatccctgctaccattttgttcgactctggagcttctaactcgtttatatctgtgccattcgtggggagaaatcagttgggggtagaaaggcttaggaaccctctgctcatcaccacccctggaggggttatgacagcaaagtattatagccctgccgtccctatagaaattcaggggattccttttcctcggatctgattcttctagacaccaagaacttggatgtgatccttgggatgaattggttggctcaattccaaggagtagtggattgtgcaagacgcactgtcactctgtaccgagggccggaacaaccggttgttttctttgcacccccaacctctgtcagtagttctgtcacgtcctgataaattcatcccgaaataaaaatcattcgctaaaaggaataatagaattaattaaaattcgaaaagaaattggcaaacactaaaaatacgtacaagaaaaattcaaatgtggcccggagaatttttgttaaattctccttggtctaaaaggagccctcaaattttacttgaattttcagagcaccggaaataattattaagcaacaaaaacaattaacaaagtttattaaaaagaaaacctaaaaaataatcctcctcttcctttgggccaagtttggcccaaagtctcccctctctctctttcggcccgccgccgaagtctccctttcctccctctctttctctccctctccttctctccctccttctcttgggccccccttcccctcggcccagctccctcctccctctctctcccgggctgcctttcccccccctcccctcccggcctgcccggcccaagccgcctctccccccccctctcttcctgggccggccgcccgacccaagccgcccctgcccgagccgccccctccttccctcatgcacgcgcgccgcacgtgcgctgacgccgcgcgcctcccgcgtgggacccgcctgtcaggcgcgtccccgacctccagccgccggccttcttcctctccctcccgtgaaccctagcgccattcctcctctaaatccgctctattcaagccggctctttccaaattgattgggggcaattaatccccattgattcctcttcgatttcccccgttttcccccttgaatgccgcccccaatcgccgggaacgcccgcgtcttcctcggccgccctccattgccgccggccgtggttctcgccgccgttccgacctcccccgtggccggttccctctcctctcctataaaatagaaccccctctttgcgttctaccgttttggtctcttcccaagctctcccgtggtctctagccacctccccaccgtcgccctctctctcccacgttgccggccgcctccagccgcctgtgccgcctcgaccgtgcgccggccggccgcgccgtcgcctcctccagcgtcgccgccacctcctccaccccggcctgccctccgtttcgcgcggtgaccatcggaggcgcactcccgccgtcgcccttctcattcctccttgccggccacctccagccgcacctcccgcctcgcccgtgcaccctccggccgcgccgccacctctcccggcgtcgcagccgcctcctctttcccggcttcgcctccgtttcgcggggaaatcaccggagacgcgtcctcgccggcgtccagtggcgtcgccaccacttctccgcctccggccgcctctgccgcgtccccggtgcgccggccgacgtcgccgtctcctccgttgacgtcgcagtgccgtcctctctcccggccaggccacggcgtcgcccgaatttcgccggaacgccgtcgtctccgcgccggcctctccttcctcctcgtcggctcgccaccccgctgcaccaccaccttcaccaacatcgcagcggcgtgttccacgccgtcccctcctccgctcagccgctgctgcctgccatcatcgtttcatcgtcgtctccgatcgttctcgtcgtcgacgtcccatcggtcgcccggctcgtcgtctcgcggcgccgcctccgtcgtcggcatcgtagcggcgtgttcctcgccgtcctcgtccccgtgcagccgctgccggctgtcctcgtcgcctcctcgccggtcccggtcgtcgtcgtcgtcgtcgtcctctcgtcgttcccggtcatcgtggcgttcgtccctccgtcgagccgttctcgtccgtcgtccgcgtccgtcaagcaagccgcggcagccccgtcgtcgtcttcgtcctcggctccgcgtcgtcaagcctcgtgccggccgcgtctcgccttcgcccaaggatcgccaccgaagccgtcccctcgccgttcgtctccgttgtgcccgtctgtctccgccgcgcccgttcgtcgttgtcgttcccacgcctcgtcgcgtggtggtaaggttccctctccctcgctgctctgtcctcgtcctttcggtgtcgcccgtgcccgttgtgcggttgtcggccccggtacccgtgtatcggcgtcggcagtcgttcgcttgtgcgcgtggtgaccgtgttagtgtgtccgctcggtagccgcgtggtttccacgtgtgcagtccgtgtggtgtctagtggagtccgtttgtcggccactcgcctcggttgacacacgggatccgcttccgtcgacccgtggaccgactctgtgtactcggtctaccgcgatcctttaggttgacatgtggggtccgcatgttaacggcgcagccttcctgtcttttccaggctagcgcttacacctgttttatagttgcaaagcctaattataataatccgcaaatctccatataacagcattaaacttcggatgatcatatcttggtcatacgaactctgaatcgacccgttcaagtctcctaatgtttgttataacctaaagaaccctgtgctttctttttatgtgttgttattgcttctttataggcttgtagctttgcttgtgtgcttcgcgtagcttctgtcgttccggaggttcccgaagcgtggttcgtggtcgtcgccgtaggttcggaaggccgttctctctgagcaaggcaagtcacatcatccttgaacatattgaatcccagtttgtaaaattatgttgatttaaattattgcattatcgctttatttaaattcccgcgttatcactgttttatctagccatacctatttacctttgttatgaccttattattattgttattgttattattaccttgttcaccctaggttaaacaaaaccccaactagtgggtactctatttatggttccactagtatgaatttaggtagatgtttcgctgtttaataggacaacattaggtggttttataactttagactttgggaattctcatatcatttggacactatggaatggttggcttatgttggaattggatacacacctcccccgctattcaaaaccccccaaaacggttttaggctgggctcgaggtgcgtggttgggttttgttagtcgtacctcgggcactataaggattaagctcgggcctctgttgcaaagcactaccgtacttccacatgtctagtgggtaaggcttagtttgtggctcagtctggttataaacaaaagtacacggatggaggtggatgaagtcgggggtcgatggacattctccagggcaaatgaaggctacacgagctgcggcccggtagtcgagatgtcgtggcagagggttggtgccctgctgctagggggctcaatcctgcctacctgtcccggaggttccggccgtagggggattgggtcggtactcttgtttatggctaggatgggttgggaactatgtcacgtcttccgtccgtataccgtggtggtatgtggcacgtggtcgcacgtgaggaagatgtgtcttgtgggtaaagatgtacacctctgatcagagtataatctattcgaatagccgcgccctcggttatgggcaagccgagcaatgtacccaagtcagtgttctaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagctataggatcgtctttataaaatggctttggggcaactaagtgacttttaaaggctgtttactgcaaaacttaacctctatattattacccccttgtactcctttgcattaattgtgcatctccggtgtggcttgctgagtactgtggttgtactcattcttgctctatctttctccccccttcagtaagagaagctttggagaagaagtcttaggtggagtcctggcttataccccagttgagcgcctgtgaagatggagccgtaggcccgctagtccgctgctgtttatttttgattgtcaggcgtgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagttcagaacttcatcagataggacagtcaaaaatccccatcgtcagagagttcggagacgtgtttccggaagaactacccggtatgccgcccaagcgagagattgagttccggatagatcttgctccaggaaccactcctctgtacaagcgaccctaccgtatggcagcaaatgaactggccgaagttaagaaatagttggaagagttgaaagaaaaggggtacatacgtccgagtacttctccctggggtgctcctgtgatttttgtggagaagaaagacaagacgaagaggatgtgcgttgactacagagctttcaatgaagtcaccatcaaaaacaagtaccctcttccccggatcgatgatctgttcgatcagcttaaaggtgccacggtattctccaagattgatcttcgttccggatatcaccagttgcgcatccgtgaagcaaatatcctgaagaccgcattcaccacgcgatacggactgtatgaattcacggtgatctcattcggtttaaccaatgctcctgccttcttcatgaacttaatgaacaaagtgttcatggaatacttggataagtttgttgtggttttcattgatgacattttggtatactcacaatcagaggaagaccatcagcaccatctccgtctggtgttgggaaagttgcgggaacatcaattgtatgccaaacttagcaagtgtgagttctggttgtccgaagtcaaattcttagggcacgtgatatctgctaaatgagttgctgtggaccccgaaacagtgaccgccgtcaccgattggaagcaacccaagacagtcactcaaattcgcagtttcttaggtttggcaggatactactggaggttcatcgagaacttctccaaaatcgctcgacccatgacacagttgttgaagaaagaagagaaatttgtgtggagcccgcaatgcgagaaggcgttccaaactctcaaggaaaagctggtttcctcgccggttttaatcttaccggatactcgcaaggacttcatggtgtattgtgacgcttcgcgccaaggattggggtgcgtgctcatgcaggaaggtcatgtggtggcctatgcctcacgccagctacggcctcatgaaggcaactaccctacccatgatttggagttagccgcgatggttcatgctctaaaaatctggcggcactatctcattgggaatcgctgtgaaatatatactgatcataagagtttgaaatacatcttcactcagtcggatctgaatcttcggcagagaagatggttagaactcatcaaggattatgatgtgggaattcactatcatcctggtaaggccaacgtggtcgccgatgctctaagtcgaaaaagccattgcaacactcttgaagtccgtggcattccacccaaacttaatcaacagataaaagccctgaacctaagcatagttagtcgtggattcttggctacgctggaagccaagcctaccttgctcgatcaaatccgcgaggctcagaagaacgatccggacatgcgtggactcctcaagaatatgaaacagggtaaagccgctggtttcacagaggatgaacacggaaccctatggaacggaaatcgggtatgcgttccagatgtcagggaacttaaacagctgatacttcaggaagctcacgagagtccttattccatccacccgggcagtacgaagatgtacttagacttgaaagagaaatactggtgggttagtatgaagcgggaaattgcagagttcgtggccctttgtgacgtgtgccagcgtgtcaaggcagagcaccaacgaccggccggacttctccaacctctccaagtaccagaatggaaatgggatgaaattgggatggatttcatcaccggacttccaaaaacccaaggtggatatgattctatatgggtagttgtggaccgattaaccaaggtagctcggtttattcctgtgaagaccacctatggagggaacaaactagccgagctctacttcgctaggatcgtgagtctccatggcgttcctaataaaattgtatctgataggggaagccaattcacctctcacttttggaagaagctccaagaagagctaggtacccgattaaatttcagcaccgcgtatcacccgcagacagatggacagaccgagcgtctaaatcagatcctagaagatatgctccgtgcatgtgtcctagatttcgggaagacctgggataagagtctcccctatgccgagttctcctacaataacagctaccaagccagcatacaaatggcaccttatgaagcgttgtatgggcgcaaatgccggacaccgctcttgtgggaccaagttggggaaagccaagtgttcgggactgatatactgagagaagctgaagcgaaggtcagaaccattcgggataatctaaaggtggcacagtcccggcagaaaagttatgcagataaccgtcgccgtaacctggaattcgcagtggacgattttgtgtaccttcgggtcaagccattgcgaggtgtacacaggtttcagacgaaagggaagctcgcacctcggttcgtgggtcctttccgtatcattgctcggcgcggagaagtcgcttaccagttggagctgcccgcctccttgggcaacgtgcatgatgtgttccatgtgtcgcaactcaagaaatgccttcgagtgccgtccgagcaggccgactcagagcagattgaagttcgcgaagacttgacctacgtggagaggccagtgaaaatcctggacactatggagcgaggagcaggaaccgggtaatccgtttttgcaaggtccaatggagcaaccacgccgaggaagaagctacttgggagcgtgaagacgagctgaaggcagcccatcctgatctcttcgccagttcctccgaatctcggggtcgagattccgtttaaggggggtatgtttgtcgcgtcccaaaacgactctaaaatatatcttttaaattatgcctagaataattaaaatctgtgtgcaagccttcaacaattaaaatgtgcaaagttaaaagtcaaataaggcttggaggatttttgtatatttcctaaaagcctaaaatgtgtaaataaattttagtggaattttcagagcaaaaataataattattaagaaataaacaaagttaaaatggttttataaaaagaaaaactctaaaaagtcttttccccccctccccctcttgggccggctcggcccatctctctccctctctctcctcttccccgcggcccattcggcctcctccccgcgcgcgcgccgctgacgggcgggcccgcccacctccctcgctgacgggtggggcccacccgtcatccccttcctcccgccgctcccgcc

SEQ ID NO: 68103 - DNA, 5834 bp, Oryza sativa
gcaatcaagtctatccaagtacagtaaccagttagccttgctgtttctacattatactataataagagtatatctgaatagtatatctagtgcagtttgctttctgtctccttcgatagtaaactaatttccatgaaaccctctcctgttcttggtttgatcgaaccttcctgtcaacctgcatatgcagaaatcctgtcttttttcagatagctccaatgactaaacaaatcatctcaacaacagtatcacaattcacaagtggtgaacaacattaatgccaggaaaattgaaaaaaaagttttttcccctcaaaaacacaaagttacagcttgattcttcaggcaaattaaatttaaaaaaacaaaacaagaaactaatgtttggtcgcgggctaaacgtgggcattgctggatggatagatcatagatggatctttccgtggtacgttcgtcgttggctggctgcgcggcggctggaaaacggaaaggaggagcaaaggtaggaggagagacgcctgaaaaagatcaaaaaaaaggaggaaaaagaaaaagaaaaaagctcgagctaagctaggcgacgcccatggcgagttggcgaacagcttgcagcgagctttgctttgctttgctttaatccaataatgccggtggtttcagatctcgcagccgcccctccccagagctcagagctctcacgtgtgtacgcgatgatcgtacgcgcgtactcatcacgtacgtgttcacctccatctccatggaaacgcagagagagaggagaagaagagagagaagattcagaaaagaaagtggaaaaggctatggtctggtctggttaggcatgcagtctcctcctttcttcttcctcgtcgatctctccgtcttttctttgtgtttgtggagaaagagagtgccatccatggcggctcgtgtccttctccttccttggtagtagtacacagtgcagtgcagaggtgtgggatattcggtgtagaggaatattctcgtgctagaatgtgattttcctataaatcatagtattaattccatattcccattaatcaccctgcaactgcaagtatgcaatcataagaaaacgggagatgggtaagaattctcaaaggtgtttctgcttgaccagcactgcaaaacggacacttcgtataagcccaatgatcacgcaatgtaccttttagaaaaagtccaccttgactcccttaaatatcggccgaatctaatctacaaccctgaaccgcaaaaccggataggacaactcccaaactattaaaaccggtgcaatttgactccctcgacggatttggagggcggtttcgctgacgtgccacatacgtgacgatattgacctggtcttcttccacgtggcgttgacgtggcggttaggtggcactcgaatttaaaaaatacgtgtgggacccatttgtcattgacaaaaaaaaatgtggggcccacgtgtcaccctctctcttccctccttcctcatccctctcccttctctctctttctctcctcacgccggcgacatggagccccgactccacctcgccaccgtcgatgccccggcgtcatctaccaccgaagccgccgtcttcatccgcccaagccgtcgtcatcaccacacccgagcccagctcgagctcgtcgccgaaccgccgccgccacgcacaaccaagtcggctgcgcgggcgccgcctccgcgcacgaccgagccggccgcacgagcacgacccgcagcggccaccttcccgtgtcgcctcttcccctcccgtcgtgcaccatccggccgggccacccgacaccgcctgggccgcctccagggcgccttcgcgttgcatcaaccgccgcctagcctcagcgccgcgctgcgccgtcgccggcgaactaggcggatgaggggcggagggccgtcctctctcccccttttctatctctctttctcctccctttctcttcttctgcggggagggccgggggatggggtggtggaaagggaggcgccgccggggggagggaggtgacgctgaggctgggcgatggttggccctgcgcgacggcccgggcggcgtcgggtggaggcggtccgccgctgcgctttgcgtacgcctctcaacctcaaccgccggcgccaacatctctcagcaagggcgcggcagcaagggcccgacggcgagggcgttggctctcgggccgcctcctccgttgccgtcctcctcgtcgaccaccccgccgccggcgccaacatctctgccccaccacacgccgtcctccttgtcgtccatggccgccgggagagaggggggagaggagacaggccttcacgccgcctccggatctccgtgccctacctccgcaccgccgccgggagagagagtggggaagttgccgccggatgaggagaatgggagaagggaagagtagttggagagagggggatgacatgtgggtcccaaaataatatttttgtgtgttaataacatatggtcccactgatttttttaattcctatgccacataagcgccacgtgggactaagaccaggtcaacaccgccacgtcagtaaaaccaccctccaaaatcactggaggagtcaaattgcactggtttcaatagttcaggagtcattctatccgatttttttttgttgaggggtacaaattagatttcgccgatatttaagggagtcaaggtggactttctccgtaccttttcccctgctcaagttggactccattcttgtgaggttctttgggccttaaccatcaaagcccattcctggaaaactgggcctctccctttaaggcccacttgaacggtacacacttccgttctccaattcgttctcaaatctcctttatatgtgtacttcctgagtttaaaatagaagatgacaaatgcaattgcattcgatctagaacagtggacgccgaagaaatgcaagattttcgccaaatagggtgtggatgtctaataacaaactagcaatctgtggctggccaaataatacctaatgcttgctttgccgtcatatccaaagacgtcctatcacctcctattaaaatgcagatacacgagaaaaatatgggacatgatctcaacatggacctcacttgagcaaatcaaaacgacgatacggtgtacaactacgatggtcatggtgcacgactttggccacctttaagggacaaaaaaaaaaaaagttcgcaccatcgtcctattaacgacgtgataaatttaaaaggagagaaaccatatactccctccatctacttttgatagtcatatttccaaatctaaaaattttatttttgataggcatatttcaatccaacaacttatcatcttaatgactttcttggatttaatgcatgactcttcattcttctacacgtgattggctacatgggcattgagacatgtaaatattaatgaatcgcttgtttacgaggaatgactagtagcatatttaaatggatgataagtagaattacttatccttgttctgtgtgccaagataaaaatataactatcaaaagtagatggagagagtattattctaacacagaactcccgaagatccttagaggtgaaaatcaaggagaccaaaacttgggtattaggagcaaaagacgcataccttatcttttttttttcttattatttgtacaacaacttgtactcctactatttccaatgaaattgacaccctctaattaaataccggttcattaaaaatagttgcttcgaattggtacaatttaagcacgaagagatcgactaaaaggagcatgtagcaactaagattcaacgatcagagggagaaaaaattggtaaaatgtaagagagagagagagagagagaggatgaaatggcagagatgatcaacgtcaaggcaacagggagacctcacctcaccaaatatgtaacgctcctgatcgcacaagattcaacagtttgctcgtttgatttggacgccggcgaaggcgaaatgctttcgaccaagcgtaccatgcatctttcaatcaactcacatatatgtgtcttcgattgctttgattgatatgatgatcaacccggcaattcgacctctaatcctctatattctctttcgttctatttgatcaatttcacttgagaactaattaattttccctcaaaaaaaaattaatttgttaatcaacatgtatatacttcctccatcagataaaaaaaaccaaaagggcattaatgagcaaggacattatcatacgtattgccgaccttgccgttgatgcgtcatttgcatcaagatcctatcgtccttgctgtatagatttagaacaattctatgactcttttccctaattgaagataaacaggcaagttgatcattaacgattaattcgataagacttatcgaaaccaaccagaagtaccaccacaactgcctcttgttttcgatatataatatatctatatagagggagatagggatatcgcaacgtgcgtgacaactgtgttctttaaactcgtaccaagtcatatatatatatgtacttatgttgtacatcagctcaagagaaaaagaagctagcaagcgatcctgtgcatctaagtcaacaaaatatgttgagattgacttatgggaatcactacatcaacttttactcccctatcaacaaatataagcattttttatgttttattagaaattaaattcacttgtaatctattatattattaagagaaccttgaaaagaatcattacttcattgtggagactagaaattcccacgttaaaagaaaaggatcttgtagattgcggtgggttccgataataacgatatagatggattaatatagttatatacaaaatacaattatatctatagagattcaatcctattgaaataaaatctaaaagttgtatataaaatccaaatcttatatatatgaaaatagaatctcggagttgtatatgaattgaactatatttctgcatataatggtttctatagaaataaaatttcagttgtatattaaatctaactctatgtgaattatatagctccgtgcaaaactgcacggggcaatcccctagttactttgatatttcaaaaactttatttgattagaggaattaaatcaagcctggcgatgcagtgttttgattggattggggaatgcattatattttagaaatgcttatatttataaataaattttaagaactataatcaatatatatgtacacttactctgttcatttcaaaataagttcattttccacctatcttacacatcccaataaaaaaactagaatatattctcactttatcaaatctcaacacaattattcctcttattatcaactcctaacatatttattcactacataaattttgatgtaacagttacttaaaaataaattacttttagataaatggaagaagctaaaaataagcgtattctaggggtgtttaggagagatggacctatgaacttattttttggagaccaaacactccctaagactgatcgagtatatctgtggatggaaagataatataccagtacaattgccgacagtagtgctgaaagggaagcacaactgaatgtccggatgtcttccgtctagctagccgtctgtacgtacacggtacaactgcagcgacaaacatctattggtaatttatttgtgcaagtacgatgcatttcaattcgatcggtacgtaatgtacttagtggtgtttagatccagggacttaactttagtccctgtctttagacactaatttagagtattaaatatagactactataaaactaattacataaata

SEQ ID NO: 68104 - DNA, 76770 bp, Oryza sativa
  unsure (1)..(76770): unsure at all n locations
ggcccaagtctctttttccctctcctgggcctgctcgcgccgggccgtttcagcccagtccaccgcgccctcctccctctttttctctcggtgccgttgacaggtgggacccagctgtcaggtcgtcttcttcctccagcctctaaccgccgcttgtagcaccgcaagccaccgccgatctccttccaaaatccggccaccactttcctcctctggccgaattgattgaggggaaataatctcctcgatctcctcttccttttctcttttggaatcctgggctaatttcgtttggaaaccggcagattcgagttcaattcggatcgatctctctcctctaaccctagactttccatctcgccgccggtcgccgtgggcctccctcgccgctcctagcccttataaaaggatccccgggacctcctctatccgccgccaccttcgccctagcctgtcgtcttctctagcgccgcctccgcgtggttctttccatagtcgccgccggcgagtgtctagtcggtcgctgctgtcacttcggtcgtcgccgtcggtcgccgttttcttcatcagcatcgtgaggtcgtcatcgtcctcgtcccgtcctccgtttccgccgtagcccgtcggagcgccgccgactccgtcaacccgaagctctccatcgccgccgtcagtccagccgcgtcgcgtcgccgttgcagccaccgccttcagttgtcgtcgccaccgtcgggatcgcgaggaggagcagcgcctcgtccaccccttcgttgccgccgtttcccgccggagcatcgccgtcaccgccgacccgaagaccgccgctgcttcaacctcgccgccatcgccgttcgttgccgtccgccgtcgttcgtgacctcggtgagttcgccgcgtcgcccgctacccgtaggtgtcctccgtttgcaccgccgcaccgtcgttcgccagcgagcacgtggtcccgagccgccgccggtgatgacgtcatcgctgaggtcagcgccacgtcacccgtagacccgcggtagatcaagttgatctcggccgtccgttttggtttagatcgatctcggccgatcgttccgtagatcgtcaccgtgcacccggtccaccatgagcctgagcctgctgacgctataaatcttttttccttttcaaaaataattctttattgcgtcataattcaattaaaatccatataaatgctttaatccggtttaatctttaaaaattcataactaatacattgtaactcggtttaatgtggttcaagttgcaaaagttgtataaaataaagatctacattttaaaattatccataaattgaattaaatttatttaatcttttttaaataggctttaattagattaaatcttgtaaaattcataattaattcatatgaagtcagaatgaggccgttcaagtctcataattcatctaaaattatgatttacatgattgtttactttatatctattgtttatttggtttttattagtctttttcctcgttttgcgtgttagcttgtcgtttccatcgttccgaaggttcgcgagtgcgccagaagtgttcaagaagattaattgaagaacgaatattgaaaggcaagtcacacagatcccaaacacaatcctttgagcatgttgatcctatatttaaattctttatttatttcaactatgcatttattttcgaatgtcaccgggtggtgtgaattattcctttgtatggccaatttgtattgattactctattccttgataccttgggttattataatttgactagttgagctttatatattggttcagctagatgttagacataattgcttagccatgcttagaaacattagcacacaattgggataactaatgtttcactattacttaatgatggatatttaatgatagctcacgatggtcaatcgtgattggttaattaattagtgtgccaactaaaacttgataatggtgggttgtgagcacatggttttgatggtcgtgctcatgacaattaaggactggttcacgagtttcgattgtgaaacattaaccgtgccgaccacaagccagcatgggcaacggctttaccttttgtatagcatggttcattgcggggcaccagactgagaagtggcggagataagccgacgggggtcgctggggagtccatgccttgtttataagggggtgattatgatccaggaacggtgcactgctttaagttgtgtcacgcccggaaattcattagtattttccgaactaatttgtgcataaaatcctcgtccaggaatcagccgaggtacacaaactgacaatttaatatacagattcatcaaaataactaaaacgataaatacttacataagaggcacttagtcctcaccatgaagaaaactgcagcggaaaataaaatctagcgaagcctcagctccactcctacaggcagctcaactgggatctaagccaaaggtcttctccttctggatcctttttcttcaactgaggtttgatgattattgcaagaatgagcatatgacatactcaacaagctacataacaaatatccaagtgcataaggataccaaaggatggcataatataggctaatttgcaaaagcatcatttagcaaagatttaagaatagtaaaacagtagagtaattaatcatccatattaatcaacactgaacagcaccccaatgctgcacaggcccaaccaaacctgaacaaccaaccccggtcgtacagatcaaacctccaaaacaggaattaaccattccaaaccaggagtcaaattaattatcacattactaccattaatgagtagtgtgggactaatcacgaaaacattgctcaaccctcccataaccgcgggcacggctattcgaatagtattactctggccagagatgtaccactgtacccacaagacacgattccacacatgtcgccatgccccgaagtaccaccacggcactgcaaagggggaaatcgtgacaatacccttcgcacaacacaactcaccacagtgcaccattcctggatcataatcaccccctcaaaaactagaggcatggactccccagcgacccccacggacttctcgccgcttctcagtctggtgccccgtaatgaatcatgctatacaaaaggtaaagctgttgcccacgctggcttgtggttggcactgttaatgtctcacaacagtagctcgcaaaccggtccttaattgtcacgagcacgaccttcaaaaccatgtgctcacaacccaccattgaaaagttttaattatcaattaattataaaaacacgattaaccatcgtgagctaccattaattataaccataaataataatgtagtataattcatcccatttgtgagctaatgttcctaagcatgactaagcaactataaataacatctagctgaaccaatccaatatataaggtccatgctagtcaaattataacccatagaaaaataaagtcatgtttggccataattaaatgggaaaggctcaccacccgatgacattctaaaataatgcataagttgaaataaaacaatagctttaaacgggttcaacatgcttaaagggttgctcgggatctgtgtgacttgccttgcaaacaagcgtcttcaattcgtcttgaggaacatctccaacgaacgaacgatcctccgaaacaacggaacgcaaaacgagaaaaacactaataaaaaccaaataaatagatagagcttgaatttagatgaattatgagacttgaacgacctcattccgagttcgtatgaattagatatgtattttacaagatttaattccaattaaacctatttaagaaaagactattccaaattgattaaacaatttacaaatgatttatagctgagacaaaagattaaaacattctccggtaaagaatagatcatatttggtaaatgacatatattaaaaaggaataatatgtcattaaaaagagatgataaatttatattaattttggatggccaagatggctctgatgtcagcgatgacatggctgtcatgcaggatcgacgccggcgagcatgggaacggcggttaccagagaaccacgatacaatgacgcagacggagggcaccgggagagagaggagatcaaggcgacccttaccaccatttacgcgacgacagacggcgagggagatggccggcgacgagctccaaagggtggcaaccttgggttgacaatggcgacggctttccggcgacgggcggcagcaacggaggggtggacgagcttctcctcacagctacgaatccaatggaagcaacggcgaccgaaggcgacgatagacgacgacgaacagcgtggccggagatagattagatcggcttcacggtgacgacgacgctccgatgacttgcggcttcgtggaggtggctgccgggcttgctgttatcgctgcgatgccaacggaggagacggcggggttcggcgaccacggagtcgacggcaaagcttcgccggagatcaaaacatggcgatggttcggccttcacggtgacggcgaattccggcggggtttggcgcaaaggaacgggtggccggggtagctctcacccttgcgaagccgagggaagcgacggcgcaggtcggggacgaccgaagaggcggcgcgacgtggctggagtggcagccggcaaaggagagagaagccgagcgtggcggcggcgctagggctagggaaaaattcgggaaaaaggaggaaacggaagaggagacccggggcatgctatttatagccaaaggaggaggagatcggctgggatacgaggggaaacggcggcggattagttagggttcgccggaaaaacggagctcgaaaccgcgtcgaattcacgcaatataccacgggattcaagggggtttcttggggataagatagaggagatcgaggggaatccgttcccacaactaatttgagaagaggagcaacggagaggatgaatttggtggggaggtggcgctgcacacgggcacggcagggaggagatcgacctgctggaggttaggggcgacactgtagcagaaggatgaaaacagacttcttaattaattcatacgaagtcagaatgaggccgttcaagtctcataattcatctaaaattatgatctatatgattgtttactttatatctattgtttattgggtttttattagtctttttcctcgttttgcgtgttagcttgtcgtttccatcgtttcgaaggttcgcgagtgcgccagaagtgttcaagaagattaattgaagaacaaatattgaaaagtaagtcacacagatcccaaacacaatcctttgagcatgttgatcctatatttaaattctttatttatttcaactatgcatttattttcgaatgtcaccgggtggtgtgaattattcctttgtatggccaatttgcattgattactctattccttgatacctcaggttattataatttgactagttgagctttatatattggttcagctagatgttagacataattgcttagccatgcttagaaatattagcacacaattgagataactaatgtttcactattacttaatgatggatatttaatgatagctcacgatggtcaatcgtgattggttaattaattaatgtgccaactaaaacttgataatggtggattgtgagcacatggttttgatggtcgtgctcatgacaattaaggactggttcacgagtttctattgtgaaacattaaccgtgccaaccacaagccagctgtcacgcccggaaattcactagtaatttccgaacttatttgtgcataaaatcctcgtccaggaatcagccgaggtacacaaactgacaatttaatatacaaatccatcgtaataataacgttacacacttacaaaagaaaagatcaagcgatggcttcagctccactgtcacgaccggaaataacccaacgggcgttccttacgtgcgtgcattaatccttgtcccaggaggcaaggtacaccaaaagttgatacaattcagagtataacaagcggaagcgtaaatagttaatttaatacatgggcagcgaaggcccagcacacacagagacaaacgagaaacagcggaagactagggcgacgaccacaggcacttgacggcaggcacgagctagacaccaaagccttcatcctccaggaactcctcttctgggtttgggaaaaattgagcaagactgagtacaaccaccgtactcaacaagacacacccacaagtgcagaataaatgcaagggagtacaaaggaattataatataaagggttagggttgcagtaaacagcgtttaaagatatttagttgctcagggctattttgcaaacacgaatctagtactatacaatgttaattatcaaggccgtgaacccacacgaacctgccttaacccaaggcctacgatgattcagaccgaactggcaacccgaccctgggtcccagctcgtcccaagccaacccaggccaaccattccatattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacagacggaagacgtgacatagtttccaacccatcctggccatagacaagagtaccgacccaatcccacctacggccggaacccccgggacaggcaggcaggactgagcccctagcagcaggacaccggccctgtgccatgacatctcgactaccgaaccgcagcccgtgtagccttcatttgccctggagaatgtccatcgacccccgacttcatccacctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagccgaaaccatttttggggattttgaatagaaggagcggtgtgaagccaattccacaatagaccaacaattccaaagtgtccaggtgatatgaatatcccaaagtctagagttgtaaaaccgcctaatgttacctaattaaatagcgaagcatctacctaaaatcatactagtggtaccatgagtagagtgtccactagttggggttttgtttattctagggtgaacaaggtaataataacaataacaataataaggtcataacaaaggtaaataggcatggctaaataaaacagtgataatgcgggaatttaaataaagcgataatgcaataatttaaatcataattttacaaactgggattcaatatgttcaaagatgatgtgacttgccttgctcgctttcccaaacgccggcttcaacttccacgaagagcggatcttccggagctgcagcgtctacacgaccaacgaaaaggaaaaggcttttactctactaaactccatataacaagcagaaacaaagcacaaaaatgggttcttgacttcttaaggaaaaattagagacttgaacggtccaattccgagttcaaatggccaagatatggccatttgaagtttatatgctctttaaatggatatttacgaatttcttcatttaaattttaatttaaaatcggatttattgcgtcagccgaggggaggggcgcgcggaccgggtccacgggagtggggcccacgcggcagcctcacggtccacggtggaccgggtgcacacggcttacgccggctggcgccgtgggtcccacgcgtcagccgcacccgaggacgcgggcggctgacggccgggccccacatggcagccgcggggcgcgcccgaaggcggcctcgccggcacagccgacgggaggcggcgcacccgcgccccgatggtcgccggcggcgacctccggcgcgacggagcggcgcccgagagaggggagtgaagggggaaacgaaatgggcggtccacggctcaccccgggtcgacgacgacgacggaaacggcgaccggagtggaggaaggcggcggcgcggctcgggtagacgaggacggcggcgttccggcgatcggcgaccgaaacggaggggtggacgaggtcggcgaggacacggcgaagccgaaggaggcgatgccgaagcgggaggaggtccggggcgacgacggcagcggaccggagctcggcggcgacggcggagatagagagcgacggcgcgagctcgattccgacggggagagagagcggcgagcggcggaaacggaggagggaagcacggggagcgtttatatagcgttgggagggggagagggcggccggaggggaaggaaaccggcgcggcgatctcgggctccatcaatgacgccggcgaggtttgcgggagggtttccaaacgaatccgagggagagagagagggaaaagtgggggggaaagggagagggaatcacggggagtgatttccccctctttattgcgcgcggggacggcgggatgcggcggaatccgcggcggcggcggcgctagggcacgggcgaggcggcgggtgcggcgcgaggtaggggatgacgggtgggccccacccgtcagcgagggtggcgggcgggcccgcccgtcagcggcgctcgcgcgggggaaggccgatgggccgcgggggagaggagagagagggagggagctgggccgagccggcccaagaggggaagggggggaaaaaggacttttagggtttttctttttataaaaccattttaactttgtttatttcttaacaattattatttgtgctctgaaaattccactaaaatttatttacgcattttaggcttttaggaaatatacaaaaatcctccaagccttatttgacttttatctttgcaccttttaattgttggaggctttcacacggattttacttattctatgcacaatttcgaggatgtattttagagtcgatttgggacgcgacatccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatgtcataatataggctcatttgcaaaagcagcatttagcaaaacatttaagagaagtaaaacagtggagtaattaatcagaaattttaatcaacaccgaacaacacacccatgcagcacaggcccaaccatcctgaacaaccatacccggctgtacagatctaactccaaaccaggagctaaacaaattattaccagttatagcatccataattattgtgagaggtgtgagactaatcacgaaaaacattgctcaacccgcccataaccgcgggcacggctattcgaatagttttactctggccagagttgtaccactgtacccacaagacacagcctcaacatcatgtctaccatgcgtcgcgatactggaaagtacccgaatagaggctgtgacaataccctctgcacaacacaactcaccacagtgcaccattcctggatcataatcacccccttataaaacaaggcatggacttcccagcgatccccgtgggcttatctccgccacttctcagtctggtgctccgcaatgaatcatgttatacaaaaggtaaagccgttgcccacgctggcttatggttggcacggttaatgtttcacaacagtagctcgcgaaccggtccttaattatcatgagcacgactctcaaaaccatgtgctcacaacccaccattatcaagttttagttggcaagtaattaattaaccaatcacgattaaccatcgtgaactatcattaagccatcattaaataataatgagtcataagttatcccaatagtgtgctaatgtttctaagcatggctaagcaatcatatctaataataattttgaatttaaatataggatcaacatgctcaaaggaattgtgtttaggatctgtgtgacttgccttgcaataatcggtcttcaattaatcttcttgaatacttccggcgcactcgcgaaccttcgcaacgacggaaacgacaagctaacacgcaaaacgaagaaaaagactaataaaaaccaaataaacaatacatataaagtaaacaaacatgtagatcataattttagatgaattatgagacttgaacggcctcattctgacttcaaatgaatttataacgaattttacaagattaaatctaattaaagcccatttaaaaagaattaaataaatttaattctatttatggataattttaatatgtagatctttattttacacaacttttgcaacttgaaccacattaaactgagttacaatgaattagttatgaatttttaaagattaaatcggattaaaacacttatatagattttaattgaattatgacgcaataatgaattatttttgaaaaggaaaagaggattattgcgtcagcgggctcgggttcatggtggaccgggtgcacggctgcggtctacggaaacgaacggccgagatctaccctatccacaacgaacggccgagatctaaacggtctacgaccggtctatggcggacggcaacgatgacgtcagcgatgacgtcatcaccggcgacggctcgagcggcgcatgctcgccggcgaacgacggcgcgacgacgcaaacggaggacaccaacgggtagagggcgacgtggcgaactcaccggcgaccaaaacaacggcggaagagcaacagacggcgccggcgacgaggaagaagcggcgacggtcttcggatcgacggtgacggcagtgctccggcggtcttcggcggcggcgaagcggtggacggggacggcgacgacctcgcgatcccgatggtggcgacggcgaccgacgacggcggctgcaacggcggcccggcgcggctgaaccgacggcaacgacggcgacggctagggctacgcggaggcagcgctagacgcgacggcgggctaaggcaaaggtggcggcggatagaggagagctcgggggtgcttataaaggggctagctagcagcgacggaggcccacggcgaccggcggcgagaaggaaagctagggttcggaggagagaagtcgatccgaatcaaactcgaatccacggatttccaaatgaaattagccgacgattccaaaagagaaaaggaagaggagatcgagaagatcatttcccctctattgatttcaccggatcgggaaaaagacggtcggacttggaaggagacgacggcggtgcggcgctagggttcgagcggcagccggcgcgaggaggaagacaggcctgacaggtggggcccacctgtcagcgggagagagagaggagagcggcggctcggatgcgggccagcttgggccggggaggagagagggagcggttttgggccgactgggccggggagggagagagaaagagagaggttttgggccggctttcggcccaaagccaaaagagacttttaaaaacctttttcaatttaaattattcatgaaatgatattccattgattaaaaatacttccttggctcaaataaatcccagaaaaatctaggaactatataatcaagtaaagtatttaatgaaattttatctggccctattttatattggaatttattaattaaaattagatcttctcttttaggcttttaagatcatttctaataattccttttaaacaacaatttataatttaaggatttttaaacaagaaaagctcttaacataattataattagatcattaatgatcaaataattactgaactgttctttgtatcatttaggaattgagctccgaaaaatccgagaaaatttcagagagtatacttaatcatggagaatttaataaaaattaaatccatccatgctttatatttaagaaattttatttcccacatttaacttcacttgtaaattaaagaacatttaatataaattctaataataatttattaaataatttataaatcctgaaacaaaaatcaggatgtgacaccagcgtgggcaacggctttaccttttgtatagcatggttcattgcggggcaccagactgagaagtggcggagataagcccacgggggtcgctcgggagtccatgccttgtttataagggggtgattatgatccaggaacggtgcactgctttgagttgtgttgtaattaataatgatgtggtaattgatggtaattaattagctcctggtttggaatggtacattcctggtttggagatagatctgtgcagccgggtatggttgttcaggatggttgggcctgagcagcatgggtgtgctgttcagtgttgattaatattgatgattaattactctactgttttacaattctcaattgtttgctaaatgctgcttttgcaaatgagccctatattatgccatcctttggtatccttgtgcacttgcatatttactgtgtggcttgctgagtatgtcatatgctcaccttgcaataatcaatcaaaccttagttgaagacaagttgcgaaggagaagacgtttggcttataccccagttgagctgcctgtgggagtggagccggagcttcgctagaccataattccgctgctgttttctcttttcttttataagtatgtaacgttgtattattgatgaatctgtatattaaattgtcagtttgtgtacctcggctgattcctggacgaggatttaatgcacaaataagttcggaaattactagtgaatttctgggcgtgacattacacaaatgcagcggaaaattaaaagataactggagctaagccttgacttggactgcaatgggaacaccactccacaggcatcctcgacggctcggatgaagcctaatcctcggaaaagccaccatctgacgcatactcaaactctggggtttgggaaaaatagagcaagactgagtactacccactgtactcagcaagtcataccggaataggggtatgatgcagggaaatatcaaaggagagctagagaggtttatttgcataaagcaagcatttataaatagtagttgaaagcagtaaaacagttgtgataattaatcaatattaaccttccactgtccaacgctacaccacgttgcaacaggcccaaccatacacctagactattcaattccattaggctagactagggtgagactaatcacggtgaatctggttgaccgcccataaccgcgggcacggctattcgaatagttttactctgattagaggtgtacaactgtacccataagacacagccccacgacacgtttccttgtgccgacatgccaccacgacataccggatagaggccgtgacaggacccttcgcataaccccttctaaccaagcacaccacacctcaggtttcaccccaacgcctcgcaaggcagcgcgcagtctcctctcgtgcctacgtgaatccggaagtcgcataggccgttacagggcccatccaaactccatcacgcccacccttgcctggatgcgtcagctagaggaaagtgacactacaagcccagccgttgcccacgctggcatgtggtaactacgaggaattcttctagggtttcccgcgaaccggttcttaagtgccatgggcgcgaccaacaaaaccatgcacccacaacccaccatatgatttattttaattaagaaacgccgggacggtggctctaatccaacatcaacactagaacctgaagtctatacattaatatgatttcccccattgtgtgctagttgaactaagcatggctaagcaatccctagtccagtatctagtcatgttatatcccaagctaacaaaggaacatggtacacaaataacatggctatagcagtaggtaaacatcccatggtattaatgtaaaacaatgcaatatttgaaggaaaacaatagaacctttgcaatataggatcaacatgttcaagtgacaagcatgacttgccttgctctgctgctggaggaacctcagcgactatttcaaagtacaccggagcgtcgggagggccggaatctaagcgacatagaaagcaaacaatacaaacaggctataagactactgaaaaagagaacaaaaccatttttaatggattctatgaatttttgttgatttattgagacttgaatgggcttaaacggagctcggatgaattagatatgaattttataagattcactgtgtttttactataaatagaaaaatccttaattgaattattgcgcaataaataaatcacgggagagagaggggcagcgctgacatgcgggccccacaaggcagcgactcggggagggcggtccggggaggagcggcgcaccacgtggtgcacacgtggcgccgacgcggcgcacacgcggcggccacgtggcagccacgcgggcagccggaccgacggccccgatctaccgccaggtagattggacggcggatgcggctcgcggccggcgcgcacgggcacggctcaagccgatccgcggccatggcgcgaggcagcgaccggccagcggcggagggcggcggcgtcgcggtgacgcgggcggcgatagcggcggctaagcggttaggcagcggcgcggcggctaagcggcgcgggagtgagggagaaaggggaggaggggcctcaccgacgacaatcgactacggcgagcgacggagggcgatggcgacggcgggacgagcaccgggaccacctaaggcatcaaaagggatgagttagagagggagagtgaaaccatggatggctagggcggcgaccgaaggcgccggccatggcgaagctcaccggcgcgcggcgcggacggggttccggcgttgaatcccgacggaggaggggtggacgggacggcccgcacgacggcgcagacgacgacgtcgatggcgcggctcggcacggcggctagcagcggcggcggtagcggagacgagggcgacggcgctagggcgatagagggcacgggagctggcgattgcaaaacgaaaaagtgagaggagggaacgggggtgctttatatagacccacgagggtcgatcatggccggggagaccacgatttcgccgccggagtggggagaggtggggagaagagaaaggcgggattcaaatgttgaatccccgccgtcttgagcgcgggcacgggcggttgagagggggaagggggcgcgggggacgcgggcgcgagcgcgacgtgggcgacgtggcccggaagacgcgggagcagggtgcggcggcggttgcggggcgacggcggcgccggctggaggtgggagacgggcctgacaggtgggccccacctgtcggcgacccggggagagaggaggggtctcgggcgactggctgggccgtagccttcggccggcccagcggggaggggagagaagagagaatgggccggcggcccattcgaaagagaaaaaagggaaaaaggaaaagaaaaagaaggaaatgaattttcctaggattaaataatgcttgtgctcaattttaattggttaaaattatttctagagctctgaaaattccactaaaaatcttgttagcgtatttcgacatgtagaactcaagaaaaattccacatgccaattccgattattatttacattaattcctttagggtttctctcttgcttttacaccgatattttcttgagaccatttataaaatcaatttaggcttaggagaagaacttcagggtgtgacaacatgttactgcaccgtcctgggatgagagctgagaagaggtgggtggtggggggagttagtaggcgggtttgaccggtgggagggccctttgaccgaaatggaaggtgggttttgggccttggtaaggagggggaggtgggtgtgatccttgggagggaggagggtatagaatagctatattatacccggctgtagaatagtttttctatatatacatatacatatatgtatatattatagatatgtatatatatatatatatgtatatgtatatatatatgtatataagtatatatatgtatatatatacatatacatatacatatatatatatatatatgtatatatatgtatatatatatatatatgtatatgtatatgtatatatatatatatacatatgtatatatatatatatacacatatatatatgtatatatatatagcatcagttaatttacctatataggatacccatatgggactgcatggtgcccgggctccgaggtataaaacatacaaattctctcaaatttttaaaaatattcaaattgtgagtatatacctaggtatatgaatttgattcatacatataactaacaacaaaacaactcaaactcaactttatttcacaattcattattacatacctaacgaattatatgtttgaatgttatatacctagaaccaaaatctaacaaaaaaaagttcaaactcagttcaaacttgtttgaacttcttagtaaagaagttaatgttcatatctaaacatttaaaaaaatttcatactcattcaaattgggtatatactcaatttgaatcttggagcccatactccatgtagcaccagttaatttacctaacatcctgaaaatgtgtcaatttctaatcctgcgtcatgccgcttctcatgttcttaataacttcctaaacttaggacaatataattagatagacctcctagtactaactcacacaaaacctttctggtatttaagttcttttgtgattttcatttaaaatacatgtggttgaatcgagatatttcttgatttggtctaaaaccttgttttgactaaaatcgtttattcaaatttagtttgaaaactccttttattttcatgaattatggtccaagaaaccctccaactttacccttgaacctaaaccaaatccttgcaattccaattttattggaattaattgtcgacccatcccttacctatccttcgattccaaacctatccttagtcccctttccaaattcttccttttgatctagccactgatttaattcatgtggcttgatttccttctcggtacaaaaataatattacaaatattgtgaataattgctcttgtgctaagagaatagactttatccctccaccctaaattcaaaacctcatttagcccatatctaaatctctaaatttcataccaaatattttgggctaaaattctatttactctactccctccatattccctccacatactcaaaaatattcaaatctagagccatattatttatggtgttgaatattttgaatttctatttgagtgcattaaataaactccatctttaaaatattgcactcaaaccaactagaggaatatttcttttggaaattatatccaaatataatttccttctgaaactctctcattcaattttccttcaaattcaaactatgcaaatcctattccaaaatttagaaatcagttgtcttagtttgggccgaaaattcctcttttctccctttggtccatctccctccttggcccatgtcggcccagctgagcagaggcagccgccaattcctcctttgtgggcgcgcgctcgacgccgccgcaactgccgtaagcagctttgtcaccgccgcccacaatcttgccaccgccgctgccgccttgccgaccacgccaagccgacgccgtgccgtgcacctcttttgtcacgcccagaaattcacgaaccagaatttctaagttgaatgtgcattaaatccctgtgcaggaccagccagggtacacaaacgacaattgttgacatacagatccacgtcttacaaaaatagaaaagattacaaatgcagcggaaaagataaaagcgagctaaaccgggaagcttgacttcagcagcggggcgactccactccacaggcaatccttgacggcagcgacaaaaccaacttcaacaagacagctccaactagaaagatcttcagctctggtgtgggggaaaagagagcaagactgagtactacccactgtactcagcaagtcatactggaagaggaggtatgatgcaggatataaccgaaggaggctaggggttcttttgcataaagctagcatttaaaagcagtagttgaaagcagtaaaacagctgtagtaattaatcaatattaaccaatcactgtccaacgctacaccacattgcaacaagcccaaccaaccacctgaactacaccagttcattaagctaaactaggggtgagactaatcacggtgaatctggttgatcgcccataaccgggggcacagctattcgaatagttttactctggccagaggtgtacaactgtacccacaagacatgattccacacatgtcgccatgccccaaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccagccgacccaactccatcacgcccaccctcgccatcggtgtctaggaaagggtcgagctatacttcagatcaagcagttacccactcccgcttgtggtaagcacggtaggtctcccagggtttcccgtgaaccggtccttaattgccatgggtgcgaccagcaaaaccatgcacccacagcccaccattcagtgtattttaattaattaacaccattgcggtggcaccaatccaaaactatgctcatagtcaaagtctgtgtaataatgtgatccccatttgtgtactagttgagctaagcatggctaagcatttcctaaaccaacatctaataattttgatacccaagttatcaatggcatatggtaaacaatatgtggctgagtaataggacccatcccacatgacattgtaaaagaatgcaagctttagtagaaatgcgggatatttgtaaattgggtacaatatgatcaattgtaatgcatgacttgccttgctctcgcactgatgagaccacaacaacgtcttcgagaaaccgcggatcgacgaaacggcccaaatctacgcgacaaacaaagcacacaagcaaaacatgctataagactactgaaacaggaaacaaaaacatttttaatggattctttgcatttttatgaatttactgagacttgaatggacttaaacggagctcggatgaattacttatgaattttagaagataaactgtgtttttactaataaagaaaagtccttaatcaatttattgcgcaataatacccagggctgacgtcagcgaaggggggggcagcgccggcaagtgggccccgcttgtcagcggctcaagagaggggagggggcgccggcatgtggaccccacggcagtggctcaagggggaagaggaggtggcgcccggttggctcggctcggcttcaaagccgaccggcgaccagggcgaccggcggcggcgcgcgagcgccggcaacggcaagcgacggcgcgggagacggtggcggacggcgcacaggccggcggcggcggccgaaggcgatggcgagcgcagggagcggcagcgcgtgcgggacagaggaaaggatggaggagaggagctcctcaccgtgagcacggcggccggcgcgaaggatgaagacggcggcgatgaccggcgatgcggaggcacggacgggcggcggcgacaccctaggagaagatggggaggcgttaggagaggagatgatgaccacggcggcttgaattgccggccggagatggaggggagggaaaaactcaccggctcgcgaggggagaggcgctccggtgggattctggcaacgagaggcggtggccaggaaagctcttgcggcggcgaagctaacggcggtggtgggttggcgcggcggcgactctagcagcggcggcgcacggccgaaggcggcggctagcggcgcgagcgcgaaaggaggcacgggagagcgcggcgaatgagggaaatgggagaggaggtttgggggatcgtttttatgggcaagagaggggcggaaacggccggcgatgtggggagtggagggagagagagagaggtggattcgaatgcgaatcccgcccatttttaggcgggcgcgagagcgggaagaggttgtggaggggcgacgacgtgggcgcagggtgcgggaaaggcgcagaaggcggggaaggcgtgaggaccggcggtttcggtggtggttggcgccggggcgtgggcggctagaggtaggggccgactgacaggtgggccccacctgtcggcacccgaaagagaaagggagggagggaggacttcggggaggggaaaggaggagcgggccggcccagaaaggggcgccgagcgcggggagagagatgggccgatggccaatctagagaaaaaggaaggaaaagaaaagaaaaagagaaaaaggattttcctgggatttaaaattgcactttggtgatttttaattggttaaaaatcctgttaatcgattgcgacatgtggaacccaagaaaaatcccacaatgccatttccaattattaattgcatttattaatttgggattcaactctaggttaattagaacaatttctccggacgatttacttaacaaatttttaaagcaaggaaaagggagaaacttcagggcgtgaaatctttcctcgccgcctaactcctctgcggccaccacgtgcatgcgacgctgtcgccgaccaatgggacatctctttgtaggtttgtcctgaaaaccttccgttttgcccatgagacgggtagttatctagaaatcggctccgctagccggtttagttatcaaaacccatctaggtttagctccttgctagatcgaggtggttggcgactctaggatcaccgcaaggcttaaggtgctgcgatcgtgcttgtcaacttgtcaaaaaagttgcgaacacgattttttgcgactccactggggaagagatccgttcatcatcaactcgacttcgactttgccatgacgaagccgccatccaagacggaggtggagccatccaatgtgataccggtcacattggatgacttcgaaggaaaagatcgtcaagctatggaggagtacatcaacgagctcacacgtgaggcgttgatgagagcaagtactaggactcgtcaaggcgtgatcatcaagcccgggccacgtcccaagctcactcctgacgtggtaagcaatgatgaggtatcacaatctatccaacaacaaattgcatctacaatagattcatctatggttgcttttaaagatcggttagatgtaatgtttaagggtaaatttgatgagtttttaaggatgaagttcgattctcttatggacgattacacattaaaggataaagcctctaccactgctaaccaacctcctatagatcaaacgggtagtaaaaccgacggaacggcgttcacggccggtcagaccgggtattaccccggtggtcagaccgggtctcaagctggtccgaccgcacatcttgacactggtcagaccgggccctgggccggtcagaccggcgcaattgttccaatacagggaatagatccgatgactaatgctagttatttatatcactttagaacatttaatcctcctgtatctattgctacaagtagtccccaagttcccccacatgttcctaatgcttataatgatgtttctagggggtatcctcccgatactagacaaggccaatataatcatattgcgccacaaacacaacctattaggccaccaaatccaccaccaaatcaacatgggcctaataatatggaggatataattagtgatattattaagaatagattcgggattgaaactaggaatcgtgctagaacttacaaaaagccatatcctgattattatgataatgtgccgtttcctcgcaattatagagttcccgaatttgccaagtttagtggtgaggatggtaagaccacatgggagcatgtaggtcaatttttggcgcaatgtggtgaggctaatagtgatacttttaaattgcgcttgttttctctatctttatccggtaatgctttcacatggtttacttctttaccggcaaattctattcatacttgggttcaattagaagaacaatttcatgattatttctatactggagaaactgagcttaggttatgtgatttgacatcggttaagcaaaagtataatgaatttgtcattgattatattaagagatttagagatgttagaaaccgatgttatactttgaatatagctgatagagatttggctggtcttgcttttaatggtttagttgctcctcttagagaaagactagatggccaacaatttcttgatgttagtcaactcatgcaaagggctctggctcaagaaagccgggttaaggataatagaaaacttgctagaccatttgacaaaaagcctaatgttaatgtggttgattaccctgaggctagtgatagtgaggaggagggtgatcatgatatttatgttgccgaatggtcatggactaataaaaataagccttttgtttgctctaacctaatgccgactccttgcaaagatcggcaaagtgaggttaaatatagttttgatgtggccaagtttgataagatttttgattatcttttgcaagagaaacaaattaaattacctaaaggccatgtcataccttctcaagaagagttaaaacatcgagcatattgtaagtggcatgattctcattctcattctactaatgattgtaatgtgtttcgacgacaggttcaatcggccatagatgaaggacgattgaagttcattgatggctccaagatgaagcttgatcatgatccttttccggtgaatgcaattaatttcaatgataagaaggtgttgattcggccagagcaagccaaatctactaagggaaagaaagtggtcattggtgaaccaaggtccaagatgatagtgccaaagaagccggaggttggtgtttgaaaggggaataggagtggagcttcaacttctaaagcccctaggaagaccaaggtgacttttgatatgcttttggagaaatatgagaagcaaggtggtgacaaaattcgcaacaaagggaaaagaccaagatcacctcctatggagcgatttggtcattcaccaagacggtcgcattcaccttcatatcattatccacaagacatgtcatggggttcctatccaatgccgctgccgggttatccttatccttacttcatgccatggggagcaacgccgccaatgttcaatcatatgcctccaatgcaattcaaccaagggtggggaggaccacggaggccaattcttgagcgtttgtcttcaccaaacggtagccgattttatggtaagaattgggctaatgaagaaaaaagggaagggaagcgcgtcaaggtggaggagaggacttcagaagtgaatactatcaaagtagggtcttatgatgtgccaatacctatcggagatggagttgaagtgtccccgaacaaaaaatctgaagccggtaccagctcctcgcaataagccggtctgaccaggccttatggccggtctgaccgcagtcatgtgaccggtctgaccgttccatcaggccggtctgaccgccggccctatagcagtctgaccgacgccttaggccggtctgaccgtgctccggatgtcggtctgaccggtgcatctggctggtctgactggtggtctacggccggtctaaccgggctccagcgccggtttgacaggaggattgcaaagggcaatgtggaagcttcatcgtcttcaaataaagttaatagagggcattatttacctcctggaacagagccgaatcctaagtggatgcctaaggatttgacggctactcaaaagagaaggttgcaacgtcttcgggcccaagagctaagagagaaaagggccaaagagcaaagggataaaatgtttaatgagttgcgaccaccaccggtatggatgcctaaatccatagagaaggcataacccattgatgtagaagagaaggaagaacaatcggttgataaaggtgaattgtctccaaaagaagacatggatatcaacatggtatgtatgttgcttatggagttttgtgctatggatgaagccgaggttgctcaattctcattaggtcctaaagacgcggtttttgagaagcccgatgagtcgaatcgttacatgaagcctctctatctcaaaggccatgttgatgggaaaccggtctctaggatgctagtggatggagatgccgccgtgaacttgatgccgtattcattattcaagatgttggggcgtgaggatgatgagttgaaaaagaccaacatgattctcaatggcttcaatggtgaaccaacggaggcgaagggtatcttttcggcggagctcaccgtgggaaacaagacgctaccaaccgctttcttcattgtcaatgtgcaaggtaactacaatgttattttgggtcgttgttggatccatgccaattgttgtgtgccttctaccttgcatcaatgtttaattcaatgggacggtgatgatgttgagattgttcaagcggatacatcggccgaggttgcaatggccgatgctacttttgagtggcgtcatgggaatatccaatgcttatcggggagggatctttctagttatgattttattagtatctccgatggcaaatttgtacttatctctgtaaagccagctagtgtagcatggctaagccatgtaaatttgtataatgagtaaagaggctaatttagagtggttacaaaagagggtgcaagaatatcggtctacaaagaacgatattggtgaaaccgttgaagattttgatgaagtaaaaaagcttgggaaagggtttacatcggccgatcctttggaagaagtagatataggtgatgaaactaaaccaaggccgacttttgtaaacaaaaatatgaaagccgattataaggttaagataatcgagctacttaaagagtatgttgattgctttgcatgggagtatcatgagatgccgggtcttagccgtgagcttgttgagcatcggcttccaattaaaccgggttttaggccttataagcaaccatctcgtcgttttaatcctttgctatatgaccgagtcaaagagaagattgatcggttgttgaaggcggggtttattaggccatgtcgttatgcggagtaggtatctagcatagtcccggtggagaagaaggggagtggtaagattagagtttgcatagattttagagatttaaataaaactactcccaaagatgaatatcctatgcctatagccgacatgatgattaatgatgcctcgggtcataaagtgattagttttctagatggtaatgccagctacaatcaaatttttatggcagaagaggatatgtacaagacggcttttaggtgcccgggatttattggtttatttgagtgggttgtcatgactatttggttgaagaatgccggtgcaacgtatcaaagggcaatgaatttgatctttcatgatttgttaggtattatcctagagatctgtattgatgatattgttgtccaatcggatggtatggaaggacacatagccgatttgaggttagcttttgagaggatgcgccggtatggtttgaagatgaacccacttaaatgtgcttttggtgtgtcggcggggaagttcttaggattcatggtgcatgagagaggagttgagattgatcctaagaagatagagaagagtcgtgatttcaaagcgccgacatgcaagaaggaggttcaaaagttgctaggtaaagtgaattatttgagaaggtttatttctaacctagcgggtaaaatcgatgcttttgttcctatacttcgcataaaaaaagaagccgattttatttggggggggcaaaacaacaggaggcgtttgaagagttgaagagatatttgtctactccacccgttgtgcgagcgcctaaagccggaaagccttttcggttatatattgcctccgaagacaaagtcattggtgccgttttgacacaagaggaggatggcaaggaatatatcattacatatttgagccgccgtcttttggatgccgaaacgaggtatgtttttatagagagactttgtctattcttatactatgcttgtaccaaattgaggcattatttgttatctagcacatgcgttcaaatacacattgcctgatgaggatttatatcgccgaaatatagatgatgtcttgttggagtgcttagataaagatcaatctaaagtggctatgggagagatacatgaaggaatttgtggaactcatcaatcggcccacaagatgaattggttgcttagaagagcggggttctattggtcgaagatgattgatgattgcttcaaatattatagaggatgcaaggcttgtcaacggttcggcaatgtttaattggcacctgccgccgtgttgaaccccataattaaaccatggccgttccgagggtgggctttggatttcattggtcaaatatatccttcgtcatcaaaggggtataggtttgtgctagttgctacggattacttcaccaagtgggccgaagcaatgcctttgaagaatatgactcatatggaggtaattgactttattttgaagcatattatccatagattcggtattccacaaacattaactacggatcaaggtgcttcttttatgtcgaaagaagtgaagaattttgccgaatcttatggtattaaattgttgagttcttctccttactacgctcaggctaatggacaagccgagtcgagtaataaaacattgttgaagttggtgaagaagaagattgaggaatacccaaagaggtggcatgaggtgctttttgaagcattgtgggcgcataggatatctaaacatggtgccactaaagtcaccccttttgagttggtttatggtcaagaagccgttttaccggtggaggtaaatcttggttctcttcgtaatgtcaagaaagatgatttgtcaagtgaagattacaagacgttgatgggagataatcttgatgaagtcatcgacaagcgcttgaaggcattggaagagatagagaaagagaagaagagggtggccaaggcgtacaacaagagggtgaaagcaaagttgtttcaagttggagacttggtttggaagacaattttccctttgggtactcgatccaaggagttcggtaagtggtctcctagttgggaaggtccttatcgagtgtgcggcattgttcgagggaacgcatactttttggagacacttcaaggggagcgttttcagcgagcgatcaacgggaaatacttgaagaaatacttcccgagcgtttggcaagacgcttaggaggtactatggccggtaattgagttattgtcctaagaccaaaaacatgttctatgcttttagattcacgttgttcataaaaaaggcagggggcatgtgtttacacccaaatttggcacttaggattaaaataggaaagattgccaaaatttggaagtctaccggtttcctccgagtgggccggtctgaccgccgggcggtcagaccggcagtgtgtggccggtctgactggcaggtccgagtccgactgtgttacgtcgggtttcgaggtttccttgctcgggaaggcatgtttcgggttttctttagtttctaccccgagttggacgtggaggaaggcctgtagagggcaggaccaacccctatataatggacatggccggttcattgtaaaaaaccaatctacaatccatcaatcgaatcgttctttttcatattgcttttagttttctcttagtttgtccatctttgttggtttgcgccgtaaaccgtccgccgccgctgcgagagtgtgacatctctttgtaggtttgtcctgaaaaccttccgttttgcccaggagacgcgtagttatctagaaatcggctccgctagccagtttagttatcaaaacccatctaggtttagctctttgctagatcgaggtggttggcgactctaggatcactgcaaggcttaaggtgctgcgatcgtgcttgtcaatttgtcaaaaaagttgccaacagtattgtcgccgttccgggagtttcaaccttcctctctaccagccaccaacctccccgagtgcgcgtcgaccgggaacacaatatgccaccgacgtcgccgcactttggccactggaagcccgacgccccgctcgcccttttctctccctctctctcggctcctaactgaagagaaggaggaggtgatgggaggaagaagaagaggaggagagagaaagaaaagaaaggctgacaggtgggccccactacagtactatttcacattttctagatttaattcaaattccaatttttagaagcccatatctcctaaaccgtagatccgattccaatgaaacttggacctaaatttatataaattcaaatcctaccttttggcactaaatttgctattgtaatatttatttgaattttcttaatttattcaaatgccgtttgaatttatgtttgccttttcaaatatttctttttaacccaaaataccctttagccactaaaaagccgccggttggaactttacgcctttcatgggaacgttcgtgcggtctaccgaccccgacgtcggaccgtcggttgtaaagcccggcaaaaccaaacctaaggtcgaagtgctgctcctggcaccccacgcctcgatgcgtatagtggtcggagcttcactattccatcgacctccatagcacaccgcacagttagctctcgggctctgtgtgatcctagccgttccgtggccactcacggttatcggagtaacacttccaccccgctaaagcttcacaatcttcttatccctctagccattgtattgtctatcaatatcggctagacacctaacctagtcgtcatactatccaattctaatgacgactagcaaacacccaaatcccagtcgatattcatcctacctcgatatcggcttaatcaaatgaaaccccagccagcctgctatccaaaatccataccagccatttactctccaactacctagaacctacacataaaatatagagcctggccgatatattgccctactcctcaatcagcctaaatataaccaaaccctaggtataatcctaccttaaatcctagtcattcttctacctgtggtatttcgaggatcggataatcaggttgcctatctcggatttatttgtgttggagcaaggcaagttattattcctcccctttgatcataataatcctatattctatatctccagtatcttgtgcattagccatacataatttttaatgcataacctgaatatatagcaaaccagatatatgctagattttgcttagccatgcctagttagacggcataaaatataatgaacttagattggaacagtacggaagaaatggttgatttccgggtggctagtactgttccaaccgacataagactgccaagtacatgtgaagaacatacgagtacgaccgcaattctcgtatgggcatagacctagctgactacgttatctagcaaaggtggtacttctgtatagtggttcttcttaagtcctcgcgtaggaggcaaatttatgccgcgaagggcaattatgatatttaccgaggcgcaggtaaatatacttatattgatagtccaggggactatattatggccatgtgattttattaaccctgattgcgatgacatggtgtcatacaatcagttctctctaaatacctcgagaatgccagaactcctcttgctgctgataatgttatgttcagagcgcatgggaactagagttcatggaacaggtaccactgatgttagtaaccgaaaagctttgccatgataatggcacgtcatggattgcgggtaaagcatacatctactgcagtatgaatattctcaaaactattcgaatagccgtgctcgcggttatcgggcattgggactcacaatggcatcttggttagaaacttaattccaaacattattaaatattgtttgtcgcgtcccaaaacgactctaaaatatatcctttaaattatgcctagaataattaaaatctgtgtgcaagccttcaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaaaggttttataaaaagaaaaactctaaaaagtctttttcccccctccccctcttgggccggctcggcccatctctctccctctctctcctcttccccgcggcccattcggcctcctccccgcgcgcgcgccgctgacgggcgggcccgcccacctccctcgctgacgggtggggcccacccgtcatccccttcctcccgccgctcccgccgccccgcccgcgccctagcgccgccgccgccgcgaatcccgccgcctcccgccgtccccgcgcgcaataaagagggggaaatcactccccgtgattccctctccctttccccccatttttccctctctctctcgttcaaacgggcggatttgccccccacaaatctcgccggcgccattgatggagcccgagagcgccgcgccggtttccttctcctccggccgccctctctcactaccaaccctatataaaccctccccgcacctcctccgtccgtttccgccactcgccgcccttcctcctcgccggaatcgagctcgcgccgtcgctctctctctccgccgtcaccgccgagctccggtccgccgccgtcgtcgccccggaccacctcccacctcggcgccgcctccttcggcttcgccgcattctcgccgacctcgtccacccctccgtttcggtcgccatccgccggaacgccgtcgaccccatcgacccgagccgcgccgccgccttccttcgctccggtcgccgtttccgtcgtcgccgtcgacccggggtgagccgtggaccgccgcttcgtttccccctttccctcccctctctcggccgccgctccgccgtgcctatggccgccgccggcgaccataggggcgcgggcgcgccacctcccgccgctgcgccggcgtggtcgccttcgggtgcaccgagcggctgccgcgtggggcctggctgtcagccgcccgcgcccttaggtgcggctaacgcgtgggacacacggcgccggccggtgcgcgcccgggtgcgcccggttcaccgtggaccgtgaggctgacgcgtgggccccacccccgtggacccggtccgcgcgcccctcccctcggttgacgcaataaatccatttttgaattaaaatttaaatgaagaaattcgcaaatattcatttaaagagcatataaaattcaaatggccataacttgcccatttgaactcggaattggaccgttcaagtctctaatttttccttaagaagtcaagaacccatttttgtgctttgtttctgctgattatatggagtttattagagtaaaagccttttcttttccgttggtcgtgtagacgctgcagcttcggaagatccgctcttcgtggaagttgaagccgacgtttgggaaagcgagcaaggcaagtcacatcatccttgaacatattgaatcccagtttataaaattattttgatttaaattattgcattatcgctttatttaaattcccgcgttatcactgttttatctagccatgcctatttacctttgttatgaccttattattgtgattgttattattaccttgttcaccctagaataaacaaaaccccaactagtggacactctactcattgtaccactagtatgattttaggtagatgcttcgctgtttaattaggtaacattaggtggttttacaactctagactttgggaatattctcatcacctggacacattggaattgttggattattgtggaattggattcacacctctccctctattcaaaatccccaaaatggttttaggctgggctcggggtgcatggttttgatagtagcacctcggccatataaggaccggtcttcgggcctctgttgcaaatcactaccgtacttccacatgtctaatgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacactgtcacgtcctgataaattcatcccgaaataaaattcattttctaaaaggaataatagaattaattaaaattctaaaagaaattggcaaacactaaaatacgcacaagaaaaattcaaatgtggcccggagaatttttgttaaattctccttggtctaaaaggagccctcaaattttacttgaattttcagagcgccggaaatatttattaagcaacaaaaacaattatcaaagtttattaaaaagaaaaacctaaaaataatctctcttcctcctttgggccaagcccagcccgaagtctccctttcctccctctctttctctccctctccttctctccctccttctcttgggcccctcttcccctcccggcccactgcctccccctcctctctctcccgggccgtttcctcccccctcctctcctcctgggccgtgtcccggcccaagccgcacccccccctccaggccgatccgcgcccccgcccgtgctgcgcacgtgcgcgcgctgacgacgcgcgcccgaccgcgtggggcccacgcgtcaggccgccgtcgccttcttcctccagccgccgcccggcttctctctctcccgtgaaccctaatccttccctccctcaaatccgtgtgattcgctcttgggattccaaaattaaataggggaaattaatccccattgaatcctcttcaatcccccccaatttcccccttgaatggcgcccccaatcgccgggaacgcccgcgtcttcctcggccgccctccattgccgccggccgtggttcccgccgccgttcccgctcctcccgtggccggctctctcccccatcctataaaatgggatcctcatcccccgttctctcgttttagccccctcccgagcctccccgtggtccctatccacctccccgtcgccctcctctctctcccacgctgccggccgcctccagccgcctgtgccgcctcgaccgtgcgccggccggccgcgccgtcgcctcctccagcgtcgccgccacctcctccaccccggcttgccctccgtttcccgcggagacccccggagctgcctccccgccgtcgcccttctcgtttctccgcgccggccggctccagtcgcctctcccgcctcgcccgtgcgccgtccggtcgcgccgtcttctccctcggcctcgcagccacctcctctccctcggtcagccctccgtttcgcggggaaagcaccggagacgcgtcctcgccggtgtccagtggcgtcgccaccacctctccgtctccggccggctgctgttcgtcgccggtacgccgaccgacgtcgccgtctcctccgttgacgtcgcagcgtcgccctccaccccggctgctcctcggtttcgccggaacgccgtcgccgcgccggcctctccatcctctttgtcgccggcgtcctttcggcctctccttcctcctcgtcggctcgtcgccccgctgcaccaccaccttcaccaacatcgtagcggcgtgttccacgtcatcctcgtccccgtgcagccgctgccggctgtcctcgtcgcctcctcgccggtcccggtcgtcgtcgtcgtcgtcgtcctctcgccgttcccggtcgtcgtggcgttcgtccctccgtcgagccgttctcgtccgtcgtccgcgttcgtcaagcgagccgctgcaaccccgtcctcgtcttcgtcctcggctccgcgtcgtcaagccccgtgccggccgcgtctcgccttcgtccaaagatcgccgccgaagccgtcccctcgccgttcatctccgttgtgcccgtctgtctccgccgcgcccgttcgtcgttgtcgctcccacgcctcgtcgcgtggtggtaaggttccctctccctcgctgccccgtcctcgtcctttcggtgtcgccccgaacccgttgtgcggtcgtcgaccccggtacccgtgtaccggtgtcggtagtcgttcacgtgtgcgggtggtgaccgtgtagtgtccgtgttagtgtgcccgctcggtagccgcgtggtttccacgtgtgcaacccgtgtggtgcctagtggagtccgtttgtcggccactcgcctcggttgacacacgggatccgcttccatcgacccgtggaccgtctctgtgtactcggtctaccgcggtcctttttgttgacatgtggggtccgcatgtcaacggcgcagccttcctgtcttttccaggctagcgcttacacatgttttataattgcaaagcttaattataataatccgcaaatctccatataacagcattaaacttcggatgatcatatcttggtcattcgagctccgaatcgacccgttcaagtctcttaatgtttgatataacctaaagaaccctgtgctctctttttatgtattgttattgcttctttataggcttgtagctttgcttgtgtgcttcgcgtagctttcgtcgttccggaggttcccgaagcgtggtttgcggtcgttgccgaaggttcggaaggccgttctctctgagcaaggcaagtcacatcatctttgaacatattgaatcccagtttgtaaaattatgttgatttaaattattgcattatcgctttatttaaattcccgcgttatcactgttttatttagccatgcctatttacctttgttatgaccatattattcttgttattgttattattattaccttgttcaccctagattaaacaaaacctcaactagtggacactctactcatgacaccactagtttaattctaggtagatgcttcgcaatttaataggacaaccttaggaggttttataattttagactttgggaatattcatatcacctggacactatggaatggttggcttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtccggttataaacaaaagtacacggatggaggtggatgaagtcggggtcgatggacattctccagggcaaatgaaggctacacgagctgcggcccggtagtcgagatgtcatggcagagggttggtgccctgctgctagggggctcagtcctgcctgcctgtcccgggtgtcccggccgtagggggattgggtcggtactcttgtttatggctaggatgggttgggaactatgtcacgtcttccgtccgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagtcagtgtttcaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagctctagggtcgtctttataaaatagctttgggcaactaagtgacttttaaatgctgtttactgcaaaacttaacccctatattattatccccttgtactcctttgcattaattgtgcatccccggtgtggcttgctgagtactgtggttgtactcattcttgctcaatcttttcccccttcagtaagagaagctttggagaagaagtcttaggtggagtcttggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacacacagggccggtgtcctgctgctaggggctcagtcctgcctacctgtcccgggggttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtataacctattcgaatagccgcgccctcggttatgggcaagccgagcaatgtacccaagttagtgttttcagtcttaaaacctgcttaacaactaaaacatggaacggttggcctgggttggcttgggacgagctgggacccagggtcgggttgccagttcggtctgaatcatcgtaggccttgggttaaggcaggttcgtgtgggttcacggccttgataaataataatgtatagttctagaatcgtgtttacaaaatagctttgagcaactaaatgtctttaaatgctgtttactgcaaaccctaatcctttatattatgattcccttgtactcccttgcatttattctgcacttgtgggtgtgtcttgttgagtacggtggttgtactcagtcttgctcaatttttcccaaacccagaagaggagcccctggaagttgaaggctttggtgtctagctcgtgcctgccgtcaagcgcctgtggtcgtcgccctagtcttccgctgtttcccgtttgtctttgtgtgtgctgggccttcgtcgcccatgtaataaattaactatttacgcttccgcttgataaactctgaaatgtatcaactcttggtgtaccttgcctcctgggacaaggaataatacacgcacgtaaggaacgcccgttgggttaattccggtcgtgacactgttgcatttaaaacattataggctttcttcctttatattctttgctttctgcaagtaaacctagctctacaaaaatattaccatttcatgtatttattgttgatcaatataatagcttgctgagtacgttgtactcacccttgcttcaaccccctttttcagagtcaatttggagttcttatcgaagccgggagtttaatcatataagttagtctcattctaacttaattctcaagtataaattagataaatggtttaagtctataacaaaacactagaatttagtcattctatagcttctgctgtaatagttagccacaatcttgtaaataccctattattttttgtaagagaatccccttggaagccttgctcaaatgtatgcaatgaagatccagattgttgaacctgtatcaatctactgatccagggcttgatacagttaaacatgtcggtttccgaatcattagttttgggacccgacaatatgtatgtgtgtgtgtgtatatatatatatatatatatatatatatatatatatatatatctgtgtgtgtgtgtgtatatatgtatatatatatagaaaaactattctatacccctctctctccaacccacctcctctccttctaagggcccaaaacccacctcccaccttagtcaaaggctagtcaaaggtaccccacgtcagtcaaacccgctagcagtgacttcccccaccaccccctctcttcttagctctcgtcccggaacgacgtagtaatgtcttcttcatcgtacagtgtcacgtcctgataaattcatcccaaaataaaaatcattttctaaaaggaataatagaattaattaaaattcgaaaagaaattggcaaacactaaaatacgtacaagaaaaattcgaatgtggtccggagaatttttgttaaattctccttggtctaaaaagagccctcaaattatttattaaacaacaacaacaattaacaaagtttattaaaaagaaaaaagctaaaattaatccccctcctccctttggaccaagtttggcccaaagtcctccctctctctctcggcccgcggccaaagtcctctcttcctccctctctttctctccctctcctcctctccctccttctcttgggcctcctctccttcccctcggcccagccccctcctcctccctctctcccccaggtcgcctctccctcctctcctcctgggccggccgccaggcccaaaccgcgcccccctgcctgagccgctccccttccgcgtgcgcacgtgcgttgcacgcgcgctgactgcgtgcccgaccggtgggtcccacccacccgatcatctccttcctcccgcccggcatcctctctctcttctctctcccgtgaaacctagcgtcgattcctcccctaaatccgcgcgattcaaaccgggaattccaaaattgattagggggaattaatcccctttccttcctcttcaattccccctaatttcccccttgattcgtgcccccaatcgccgggaacgcccgcgccaaccccggccaccttccatggccgccggccggcttttccgccaccgttccccgctcctcccgtggccggctccctccccacgcctataaaacgaatcccctcgctccgttctatcgttttagccccctcccgcgatctcccgtggtccctagccacctccccgccgtcgtcccctctctcccgtgccgccggccgtcttcagctgcccctgccgccgcgttagcacgctggccggctgtgccgtcgcctcctccagcgtcgcagccacctcctcttcgccggcctgccctctgtttcccgcgaagacctccggaagtgcatccccgccggcaacagtggcgttgccgccactgttccgcctccggccacctctgccgcgtcccctgtgcgccggccgacgttgccaccacctctcccggcaccggaatgccatcctcttccccggccaagccacggcatcgctcgtatttcgccggaatgccgtcgcgcgcgccgcctcttcctcggtctcatcggcacccactccggcagcccctttcgccgtgccagtgcgccggccgacgtcgccgtctccacctccggcgtcgcagcggcaagatcgccctcggcctcgcctccccttcgaccgaacccctctgcggtccatcgtcgtcgtctccgttcgttctcgtcgtcgacgtcccgtcggtcgcccagctcgtcgtctcgcggcgccgcctccgtcgtcggcatcgcagcggtgtgttccacgccatcctcgtcttcgtgcagccgctgtaggctgcccacgtcgcctcctcgccggccccggtcgtcgtcgtcgtcgccctctcgtcgttcccggtcgtcgtggcgttcgtccctccgtcaagccgttctcgtttgtcgtcctcgcttcgtcaagtgctgcagcctcgtcgtcgtcttcgtcctcggctccgcgtcgtcaagccttgtgccggccgcgtctcgccttcgtccaaggatcgccgccgaagtcgttccctcgccgtccgtctccgccgcacccgttcgtcattgtcgttcccatgcctcgtcgcgtggtggtaaggatctctcctctcgctgccccgtcctcgtcctttcggtgtcgccccgtacccgttgtgcggttgtcgaccccggtacccgtgtaccggtgttggtagtcgttcacgtgtgcgggtggtgaccgtgtagtgtccgtgttagtgtgcccgctcggtagccgcgtggtttccacgtgtgcagcccgtgtggtgtctagtggagtccgtttgtcggccactcgcctcggttgacacacggggttcgcttccgtcgacccgtggaccgtctctgtgtactcggtctaccacggtcctttaggttgacatgtggggtccgaatgtcaacagggcagccttcttgtcttttccaggctagcgcttacacatgtcttatagttgcaaaacctaattataataatccgcaaatctccatataacagcattaaacttcggatgaccatgtcatggtcatacgagctccgaatcgatccgttcaagtctcctaatgtttgttataacctaaagaaccctgtgctttctttttatgtattgttattgcttctttataggcttgtagctttgcttgtgtgcttcgcgtagcttctgtcgttccggaggttcccgaagcgtggttcgtggtcgtcgccgaaggttcggaaggccgttctctctgagcaaggcaagtcacatcatccttgaacatattgaatcccagtttataaaattattttgatttaaattattgcattatcgctttatataaattcccgcgttatcactgttttatctagccatgcctatttacctttgttatgaccttattattgctattgttattattatcttgttctccctaggataaacaaaaccccaactagtgggtaccctattcatggttccactagtatgaatttaggtagatgcttcgctgattaattaggcaacattaggtggttttataactttagactttgggaattctcatatcatttggacactatggaatggttggcttatgttggaattggacacacacctccccctctattcaaaacccccaaaatggttttaggctgggctcgaggtgcgtggttgggttttgtttgtcgtacctcgggtactataaggattaagctcgggcctctgttgcaaagcactaccgtacttccacatgtctagtgggtaaggcttagtttgtggctcagtctagttaaacagaagtacacggatggagatggacgaagtcgggggtcgatggacatctctaggacaaatgaaggctacacgagctgcggctcggtagtcgagatgttatggcacagggctggtgtcctgctgctaggggctcaatcctgcctgcctgtcccgggggttccggccgtaggtggggttgggtcggtactcttttttatggctaggatgggttgggaactatgccacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagcctagcaatgtacccaagttagtgttttaattctaaaaatttgcttaacaactaaaatgtggaatggttggcctgggttggcttgggatgagctgggacacagggtcgggttgccagttcggtctgaatcatcgtaggccttgggttaaggcaggttcgtgagggtgcacggccttgattaataatattgtgtagctctaggattgtctttataaaatggctttgggcaactaagtgacttttaaatgctgttcgctgcaaaacttaacccctatattattaccccttgtacccccttgcattaatcatgcatctgccggtgtggcttgctgagtactgtggttgtactcattcttgctcaatctttcccccccttcagtaagagaagctttggagaagaagtcttaggtggagtcctggcttataccccagttgagtgcctttgtaataatgtaaatattatcgatataataaagatgtgccttttgtatcatgtttgtgtggtgtaccccggcttttcctgggacggggattaatacactagcgttcgggaaaatgcaaattttctcggtcgcgacatgcagtaacaccgtgttttacttgtagtaacagaattgaaattcagtcatagtatagtcatgatggatctacttttgataagcactttttttcgaacatcatagtgcaaacggtttttaaaagtagtacatgatatgagagatattgcccttgaaagatttgtttttaaaaatttaactctccacaagtagtaatagtatatcaaaagtgttactagtgcatgttttgcgttaatgcaatcacatcatgtcgttactacaagatgtagtaacgattataagttttatattaacatagtgtgttactgcaattacttgataacattactacaagaatatggggaattggctcggtttactcgtgtgttttaatccatgttttttttatttcaggtttaccacaatttcaccacgatgttactgccaaatatgcagtaacgttctatacgttctacagtaacaaagtgttttactgcagttcttggatagtgttactgcataaacatgcggtaatgtataactggcaggtggtaatgtgtatatgccgtgcagtaacacttttacttttgtgcagtaacaagtatatagttagcatatgagactttgaacccatatattttttgtttcaattcctgatttattgtcaaaagtgcagtaacgtcatatacatgcatgcagtaacactatattagagggagaagaccggttttcttaagaagagagaggaagaacgatttcttgaggggagtatgtagatgcattttgaagttctattctccacatgcagtaaccctatagcatcattgtgaaaacaattttaaaaaataatacatatcttgtgagatattgcttttcaaatattggcgttttgaactttaacactccatatgcagcaacagaatatgtaatttgcagtaacatgggtatatatatgcagtaacatagttttaccaaatgtataaaattgttgaaaacactcctacatcaatcagaccttactcaaaaccacctacagactttacctatagcccacctattcgaccttcatctcgtaaaacagacatagtaaaactatgattatcgtgcagtaacataactacttggaagtggtaacatgcacatattatgtagtaacacttctacttttgtgctgtaacaagtatatggttagcatgtgaggttttaacccatatatttttgttttgattcctggtctactaaaattttactatgacattactgccaaaagtgcagtaatgccctatgtgttctacagtaacgtcacgtgttactgtacttttaccacaatattactactggagcataataacatgttatgagtttcggtagtgaaagatattagaattgataatcatattactttctcacaaaattcttgaaacaaataaaatcattagataaattggttagaagaatgtgctttgaactatgaggtcatgggttcaagtcttgaatttagcaatttattttttatttttctagaaaagagaaaaaatgtttcaggaagaaaaaacagaaaaaaaggaaaaaggaaagagagagatcgggaggaggaagggggagcgaaaaagaaggcgggagggggaagcgacgggaaggggggatcgggagggcgggagggatacgggataaaaagggtaagggggtgtagaatagttattctataccctgggtgtagaatagtctcaccctataatacacacacaatctacaccgttgatgtgttccaagattcgtgctgcaaaatatacctaaccttaaccaaatgaatgcttactatagggagaaaagattaggattgggttggttcacaatatatataacatgtgtgttgcattttttaccaaataaattttttcaataacaatcatatatgacatttatatatctagtgcattgtatttctctaacccttattttgtttagtcaaaatgagaaaacaatatatctattatatcaccaaattgtcatcttgcaaaaatgatacttccaaaatgatatatatcctaccatcaaaaactacataaacaaggtaatttatataaacaaggtaaactaaataaacaagttttgcatactagaaatacaaaaattacaataaacaaggtattttacacttgtaaaaaatatagtataacgtaaacatcatgcatggtacattttattagcacctaatatactcaccctaagattcgtgcaagctatatatagggtgtatattgtgggtacatgtgaactcgcgtgcaaaaaaatccaactcatatatatatatatccataagagacaccatagtgcccgggcaccatggtatcaaatacacaaattcactcaaaattttcaaaattttcaaattgtgagtatatacctagttataagaattcgattcatacctatacctatcaaaaaaaaacaactcaaatttaactttatttaacaatccatgattacatacctaactaattatatgtttggatgctatatacctagaaccaaaatctaacaaaaacaagttcaaattcaattcaaacaagttcaaaatctaataaagtagttaatgttaatacctaaatatttgaaaaagtttcatactcatttgaattggatatatactcaatttcaatcatggtgccgggcaccatggagtcccatatgggtaccctatatatatatatatatatatatatatatatatatatatatatatatatatatatataaatatatggattgtggttcatatgcacctcaatccgcttgttgacacgtgtacacatggctccggtgcaaccgtgtgttggaaactttttgtgacaagttgacaagcacaatcgcagcacataaacaccttgcggtgatcctagagtcgccaaccacctcgatctagcaaaagctaaactaagattggtttttataactaaaccggctagcggagcctattatagataactacccgtctcgtgggcaaaacggaaggttttcaggacaaacctaaaaagaggtgtcacactctcgcagtggcggcggacgatttacggcgcaaatcgacaaagatggacaaactaagagaaaactaaaagcaatatgaaaaatgattcgattgattgattgtagattggttgttacaataaaccggccttacccccttatataggggttggtcttgccctctacagaccctcctccacgtccaactcgggatagaatccaaaaaaaacccaaaacatgccttcccgagcaagtaaactttgagacccggcgaaactgacccggactcggactctgccggtcagaccggccacacaccgccggtttgacaggccctcaccaggcggtctgaccggccaacacacggcggtcagaccggcctaatcagaggaaaccggcagacttccaaactttggcgatataaatcttcatgcacttctcccatagccactttagattgatcattatctaaacacttcaatagaactccatctatattttggcgatataaatcttcatcaagcaatgtatatttgaatgcttgccgccgaattttccgatcaaccttaagtttaggatctttcaaatatctaatcaaaggaattctccaatccacttctgtttcctgggcacaaatgtccgaatttacaattaattcggtctttgaatcaattgcggcgtgccaccagcgctctgtccagagccggtcagacccgccgtgcaaggccagtcagaccacccggggtggccggtcagaccagcggtatgtggccggtcagaccgcccctggtcaccgatcagactggccgtgcaacgccggtcagaccgcccctggtcagaccgcttagcaagtgtgagttctggttgtccgaagtcaaattcttagggcacgtgatatctgctaaaggagttgctgtggaccccgaaacagtgaccgccgtcactgattggaagcaacccaagacagttactcaggttcgcagctttttgggtttggcaggatactaccggaggttcatcgagaacttctccaaaatcgctcgacccatgacacagttgttgaagaaagaagaaaaatttgtgtggagcccgcaatgcgagaaggcgttccaaactctcaaggaaaagctggtttcctcgccagttttaatcttaccggatactcgcaaggacttcatggtgtactgtgacgcttcgcgccaaggattggggtgcgtgctatgcaggaaggtcatgtggtagcctatgcctcacgccagctacggcctcatgaaggcaactaccctacccatgatttcgagttggccgctgtggttcatgctctaaaaatctggcggcattatctcattgggaattgctgtgaaatatataccgatcataagagtttgaaatacatcttcacccagtcggatctgaatcttcggcagagaagatggttagagctcatcaaggattatgatgtgcgaatccactatcaccctggtaaggccaacgtggtcgcagacgcgctgagtcgaaaaagccgttgcaacactcttggcgtccgtggcattccaccggaacttcatcaacagatggaagccctgaacctaagcatggttggtcgtggattcttggctacgctggaagccaagcctaccttactcgatcaaatccgcgaggctcagaagaatgatccagatatgcatgggatcctcaagaatatgaaacaaggtaaagccgctggtttcacagaagatgaacatggaaccctatggaacttaaacagctgatacttcaggaagctcacgaaagtccttattccatccaccctggcagtacgaagatgtacttagacttgaaagggaaatactggtgggttagtatgaagcgggaaattgcagagttcgtggccctttgtgatgtgtgccagcgtgtcaaggcagagcatcaacgaccggccggacttctccaacctctacaagtaccagaatggaaatgggatgaaattgggatggatttcatcaccggacttccaaaaacccaagacggttatgactctatatgggtagtcgtggaccgactaaccaaggtagctcggttcattcccgtgaagaccacctatggagggaacaaactagctgaactctacttcgctaggatcgtgagtctccatggcgttcctaagaaaattgtatctgatcggggaagccagttcacctctcatttctggaagaagctccaagaagagttgggtacccgcttaaatttcagcaccgcgtatcacccgcagacagatggacagaccgagcgtctaaatcagatcctagaagatatgcttcgcgcatgtgtcctagattttgggaaggcatgggataagagtctcccctacgccgagttctcctacaataacagctaccaagccagcatacaaatggcaccctatgaagcgttgtatggccgcaaatgccggacaccgctattgtgggaccaagttggggaaagccaagtgttcgggactgatatcatgagagaagctgaagcgaaggtcagaaccattcgggataatctaaaggtggcacggtcccggcagaagagttatgcagataaccgatgccgtaacctggaattcgcagtggacgattttgtgtaccttcgagtcacgccattgtggggcgtacacaggtttcagatgaaagggaagctcgcagctcggttcgtgggtcctttccgcatcatttctcgacgcgaagaagtagcttaccagttggagctgcccgcctcattgggcaacgtgcatgatgtgttccatgtgtcgcaactcaagaaatgtcttcgagtgccatccgagcaggccgactcagagcatattgaagttcgcgaagacttgacctacgtagagagaccagtgacaatcctggacaccatggagcgcaggaccaggaaccgggtaatccatttttgcaaggtccaatggagcaaccacgccgaggaagaagccacttgggagcgtgaagacgagctgaaggcagcccatcccgatctcttcgctagttcttccgaatatcggggtcgagattccgtttaaggggggtaggtttgtcacgtcccaaaacgactctaaaatatatcccttaaatgatacctagaataattaaaatccgtgtgaaagcctccaacaattaaaatgtgcaaagttaaaagccaaataaggcttagaggatttttgtaactttcctaaaagcctaaaatgcgtaaataaattttagtggaattttcagagcacaaataataattattaagaaataaacaaagttaaaatgattttataaaaaaaaaaccctaaaagtcccccttccctcccttgggccggcccggcccatctctcctccccccctctctctctctctcctctaaccgcggcccactcggcctctccccgcgcgcgcgtcactgacgggcgggcccgcccgccaccctcgctgacgggtggggcccacccgtcatccccttcctcccgccgctctcgtcgcctcccccgcgccctagcgccaccgccgccgcgaatcccgccgtccccacgtgcaataaagtggggggaatcactccccgtgatcccctctccctttccccccatttttccctctctctctcgcgttcaaacgggcggatttgcccccgcaaatctcgccggcgccattgatggcggccggacctcccgcaccgatttccttcccctccggccgctctctcccccttccaaccctatttaaaccctccccgcgcctccctcgcccgtttccgccccttgtcgcaccgtctccccgccggaatcgagctcgcgccgtcgccctctctctcctccgtagccgacgacctccggctggccttctccgctcgccgggaccgtctcccgccccggagtcgcctcctccggcttcgccgcaccgccgtcgaccccgtccaccccctcgccgagtccgccgaccgccggaacgccgtcgaccccgtcgacccgagccgcgccgccgccttcctccgctccggccgccttttttgtcgtcgccgtcgacctagggtgagccgtggaccgccgtctcttttcccccttcccttcccctctctcggccgccgctccgccgtgcctatggccgccgccggcgaccataggggcgcgggcgccgcctcctaccggccgcgccgagtggccgccttcgggcgcgccgagtggccgccgcgtggggcccggctgtcagccgcccgcgccctcgggtgcggctgacgcgtgggacccacggcgccggccggtgcgagcccgggtgcgcccggtccaccgtggaccgtgaggctgccgcgtgggccccactcccgtggacccggtccgcgcgccccctcccctcggctgacgtaataaaccctttttaaattaaaatttaaatgaaaaaattcataaatattcatttaaagagcatataaacttcaaattgccataacttggccatttgaactcggaattggaccgttcatgtctcaaatttttccttaagaagtcaagaacccatttttgtgctttgttcctgcttgttatatggagtttattagagtaaaagcccttttattttccgttggtcgtgtagacgttgcagcttcggaagatccgctcttcgtggaggttgaagccgacgtttgggaaagtgagcaaggaaagtcacatcatccttgaacatattgaatcccagtttataaaattattttgatttaaattattgcattatcgctttatttaaattcccgcgttatcactgtttatctagccatgcctatttacctttgttatgaccttattattgttattgttattatttccttgttcaccctagaataaacaaaaccccaactagtggacactctactcatggcaccactagtatgattttaggtagatgcttcactggttaattaggcaacattaggtggttttacaactctagactttgggaatactcttatcatctggacactacggaatggttggattattgtggaatgggattcacacctcaaaatggttttaggctgggctcggggtgcatggttttgatagtagcacctcggccatttaaggaccggtcttcgggcctctgttgcaaagtactaccgtacttccacatgtctagtgggtaaggcttagtttgtggctcagtctggttataaacaaaagtacacagatggagatggacgaagtcgggggtcgatggatatctctagggcaaatgaaggctacacgagctgcggctgtaacatcccggcctagggcttaataggattaatagaatactcatatcaacaagttacaactttttttccggaatccaatctccaaagaactccagggttaagcgtgcttggcctggagcaatttgggatgggtgaccgaccgggaaattcttcccgggtgcacacgagtgaggacaaagtgtgcagaaaagacatgtgttgatctgtgagggcagtctatgacctatgaatgaaagctatcagatgtaagcgggcccggcctgggggaaggcgggacgttacagcggcccggtagtcgagatgtcatggcacagggccggtgtcctgctgctaggggctcagtcctgcctacctgtcccgggggttccggccgtaggtggggttgggtcggtactcttgtttatggctatgatgggttggaaactatgtcatgtcttccgtccgtataccgtggtggtatgtggcacgtggttacacgtgaggaagatgtgtcttgtgggtaaagatgtacacctctgatcagagtataacctattcgaatagccgcgccctcggttatgggcaagccgagcaatgtacccaatttagtgttttaattcttaaaacctgcctaacagctaaaatgtgtaatggttggcctgggttggcttgggacgaactgggacccagggtcgggttgccagttcggtctgaatcatcgtaggccttgggttaaggcaggttcgtgtgggttcacggccttggttaataatattgtatagctctaggaccgtgtttacaaagtagctttgaacaactaagtgacttttaatgctgtttactgcaaaccctaaccccctatattatggctcccttgtactcccttgcatttattctgcacttgtgggtgtgtcttgttgagtacggtggttgtactcagtcttgctcaatttttcccaaacccagaagaggagcccctgggtgatgaaggctttggtgtctagctcgtgcctgccgtcaagcgcctgtggtcgtcgccctagtcttccgctgtttttcgtttgtcttcttgtgtgctgggtcttcgccgcccatgtaatagattaattaattacgcttccgcttgttaaactctgaattgtgtcaacttttggtgtaccttgcctcctgggacaaggaataatgcatgcacgtaaggaacgtccgttgggttatttccggtcgtgacatttcggcatccaaaagatggcggctcaaatacgtaatgatatattccttgccatcttcctgttgtgtcaaaacagcaccaatgactttgtcttcggaggcaatatataaccgaaacggctttccggctttaggtgcccgcaccacgggtggatgtggacccccgtttttataacaagaatcaatcgtgtaaacagtaccatttccctggatcaagtagtctggtacacacgaatttatagctgaaataccaagtgcacatacacgagagtctagtacgaattattacatcataagcccacaggcgcagtcttaaatcatcggaccgagcggtccgggatacattccaaaaacagaagtaggtaaggcagcggaattaaggcagtggcacgccattgacataggcaacgaccgtaactaagacctactgggcgccatcgtcttcatcaccctcctagtaataggcatagggatcctccgaagcttcatctccggcctctgattaagtttatatttgcaagggtgagtaccaaccgtactaagcaagccaccacagcaacaatgcatatgatagggatattcaaaagatggctatggttcttttgcgcaaagcaagttttgtaattcttttcacaaacctaagacctagcatagactgatcaaattttagttccagagttcatattaaacaacgacggttctgtccaccatccattgtaatcccaaggatagcttcccgccattgagtcgtcatggttttctgaggacgtccaccttcccgcctctcaggaagtggctccatcagcatagaaatcatcatgcatcatcccatcacacacaagttaagaatttagagtctagccaagtgtaacacatgtcccggtgctcaataaccacgagcacggctattcgaacagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatgcactctaggcgtccatgtttctagcagtgagaggagttctggcgctcccgggaaagagaagtctcacacacatattaaattatggttcaagttaagttctctctctcacacactcatggcagtcctaccgatgatgacaccgatgtagggcacgcctctcggccctacctcaacggctgtcccaccgtagtgcacctgcctcactcaggggtgaaccatctatgcagggatactgcctccgctcggctatctaatccgctaggtctatacccatacgagaagtacggttgtacgggggtcgtttcatgcttaacttcatggctcggtccttaattgaccggggacgatattagccttttcccgataccacccaaatcctccgtccgccccagttgaaaacagttgtttaattctatttctcctttcacaaatcatatcatcaacatcatggcaatgtggcgctcatgtctccacatgccgcatctcaattaccttcccaaaggtaattgcccaagcatatagcatttgataaatatgagtatgcataaatctagagtagcatttctaagcatttgtcatagttgactagggacttatacgtagatcatggttacaaggatttaagggtaaacaatactcaaggcatggcataatcacaagtaggatgttcatcattgcatgcaatttttatttgtaaataaaaataatttcacaattgggatcaacatgttcaaagaatagtgatgacttgccttgctcaaagtcttgcgggtcttggccttcacttggatccaccactccctcgggctctatagttacgtgcgaaaattgatttgaatttggttagaattcaaataaaaatccaaataaatccaaatgaaagtcgaatgcgaaagtcgatttctttatattaactttactattcgcgaactaaggcaaacccaatttcgattcaaactattttgcgggtataaatattttgttgtcataagttttttttttaatttaatctacccgagcattatatacatacaataggttagaaatttctatcgcgagctaaatatcggacgaaatcctaaaaatattatacgatttaatttagtctataactaaatgattaaatataatacacgggtaaaatccctagtaattaaatccgaatttctaccgtgaatcgattacttatagggattacccaaaaataatctataataatatataagaattcatctaattgtttagctattaattacatctaaattactactgcgaattgatttcttatagaaattaccaagaataatccataatttatattaaattttgcaattctacgactataataaatctataattaaattctaattattttaaattttctaaacttccctaatctccctctaatttcctatttatttcccttttctttttctccctttctttttctttttccttcctttctttttcttttctttttcccccttttattttctctcccagctcctttcttccttcctctcttcttttctctctctccctctcggcttcttcctccctccctctttctcggctttttgccctcccggcggcgacggcggtggacgcgagggggaaaaggcggcggcttaccgacagcgacggtcggcggcgacgacagcgacggcggcgcaaggcggcgacgcacggcgcggcggctccgggacgacggcgcggcggcttcgaaggtggcggcgcggcggcatgacgacggcggaataatttaaattgaaaaaggtttttaaaagtcttcttttggctttgggccgaaagtcggcccaaaaccccctctctctccctccccggcccaagtcggcccagtccgccgcagccgcgcgcgccctcgctcgctgacaggtggggcccgcctgtcggagtcgtcgtctacctccggccgccgccgcccgaaaccctagcgccgcgccgccgctgtttccttccaaatccggccgctcctttccttctccggagaaatcaaaagaggggaaatgtttcccgagatctcctctaccttttcccttttggaaacatcatctatttcggtttggaaatcgatggattcaagatcgaatcggattcctctctctctcccgaacccgaggtttccttcgcgtcgccggtcgccgtgggccttcgccgccgccccctagcctctttaaaaggatccccaagtccgccgctacccgtcgccaccttcgccttcatctcttgccatcggaagcgtcctagcgccgtgtgacctagcgccgtcgtcgtcgccgccgctccagccgtgcgccgccgtcgttccagtcatcgccgtcgctcgggaaggtcgtcatcgtggtcgccgtcgcttcgccgtcctcgtccgccccttcgcagtcgctgttgaccgccggagcaccgtcgccgccgtcgacccgatcttctccgccgcttcaacctcgtcgccgtcgccatccgttgatcttccgccgcttctttggtcatcggtgagttcgccgcgtcgcgctctacgtcctggtgctctccgttcgtgccgaagcgctgttgttcgccggcgagcatgcgtgcccgagccgccgagccgctgccggtgctgacgtcatcgatgacgtcaccgctgacgtcatcgtggcggtttgccgtgagccggtcgtggaccgatcgatctcggccgtccgttttggatagggttgatctcggccgtccgttcccgtggaccgctgccgtgcgcccggtctaccgcaaaccctagccgctgacgcaataaatctctttttccttttcaaaaataattcattattgcgtcataattcaattaaaatctatataagtgttttaatccgattaaatcttcaaaaattcataactaattcatcttagctcggatttagttggttcaagtctctaaatttttttaaaattgagatctacatgttaaaaatatccacatgtactgttcatgcttgtttatgtgctgttttggtgtttttgctcttttctgtttagattccgacgtttccggagagtccgttttcgcaggagaagattttgaagagttccaaggccagcaaggcaagtcacacagatcccaaacaaccctttgagcatgttgatcctatttaaagctattgtttctattcaactattgcatctattttcgaatgtcattgggtggaattaacctattctttgttatggcccttttgtacttgattactttattccttgataccttgggtgattataattggactagttgagctttatatatattggttcaactagatattagatataattgcttagccatgcttagaaacattagcacactattgggataacttatgactcactattatttaatgatggcttaatggtagttcacgatggtcaatcgtgatttgttaattaattacttgccaactaaaattttataatggtgggttgtgagcacatggttttgatggtcgtgctcatgacaattaaggaccggttcacgagtttcggttgtgaaacattaaccgtgccaaccacaagccagcgtgggcaacggctttaccttttgtatagcatggttcattgcggagcaccagactgagaagtggcggagataagcccacgggggtcgctggggagtccatgccttgtttataagggggtgattatgatctaggaaaggtgcgctgtagtggattgtgttgtgcgaggggtattgccacagctcctttccgaggtaccgtggtggtattgaggcacatggtgacatgatgtggggctgtgtcttgtgggtacagtgatacacctctgatcagagtaaaactattcgaatagccatgcccgcggttatgggcgggcctaataatgtctttcgtgattagtctcacacttctcaccataataaataatgctataattggtaataatttgattagctcctggtttggaatggtatattcctggtttggggatagaactgtgcagccgggatggttgttcagaatggttgggcctatgcaatagggtatgttgtatagtgttggattaatattgtttaattatcactgaactgttttataattctcaaatgtttgctaaatgctgcttttgcaaatgagccctatactatgccatcctttgttatcctgtgcacttgcatatttgctgcgtgacttgctgagtatgtcatatactcaccttgcaatcattcatcagaggaagagttctacagtggtgctgatggtgtggaggattaggtgtagccttggtcaagctgcttgtggagtggagccgtctgcgccgtttatcttttattttccgctgcttagatctttattgattgagaggaactatctacctctgtaatgacattttattcgcttattaattagagtaataattgtactctattatcaatttgttattgtgtgcctcggctgattcctggatgagggttcacacacatgtaagcgtttggaattttggatagaaattccgggcgtgacagacgcgcgcggcgttgggacgtcgatggcgacggcgacaacggtggcgcgcggctcggggagggacgcgatgggcggcgacacaacggcatggcgcaacagcgacgatgggacggcgcggcgcgggcttgacggcgacgggacggctgcgcgaggctcgaggcgacgcggcgacgagacggcagcacgcgcggcacgggggtggcgacgttggctcgagctcggggcggctcggcgatgttggcgcggcggcaggcggcgatggcgacaggcgggcggtgtggcgcgggcgcgtggggcgcgaggcggccaggcgcgacgggcggcggcacgtggtgacggtggcgacagagagaggggaaagaggagggggctgggttaggggaccacgtcaatcacctacgccataatgaacagtgtattttcctatttatcccgattttagtttatttccaatataaatttgattctataatttctaaatcttgcataaatgaagtttactcaatatttgtgttatcttaactaatgaattcaccctagattaatattactcatattttatttgtataatttatttgaatttttaattaggattaattcttatcccatcgcatttaaattcaattgatccaaatatggtcgcgataatattttatttatttctatccacacctaatctttattttaaattatatttattttaccaatttatttttagggtttattcctaattaactattctttactcacgattaatgaacttcgaaatcaaatccaaataaaataagcgaataagatcggcatgatgcaatcaatttaaaaagtttttgaaaatccatatttttagagtttagctttttgtcggtcgaattttcatggtgttacagtggagtagaaaaatacttcttcaacccttcaaacccctttaatagttcgattattttaaccttataatcggctctcatgtttttgtttacaaaagtcggccttggcttagttccatcacctatgtttacttcttccaatggattggccgatgtaaatccttgaccaagcttttttacctcatcaaaatcttcaatagtttcaccaatatcgttctttgtagaccgatattcttgcaccctcttttgcaaccactctaaattatcttctctactcattacataaagtgatatgacctagccgtgctaaacctgccggctttacggagatgggtacaaatttgccattggagatactaaaaaagtcatagctagaaagatccatccctgataagcattgaatattccaatgacgccactcaaatattgcatcggccattgcaacctcggtcgatgtatccgcttgaacaatttcaacatcatcgccgtcccattgaattaaacattgatgcaaggtagaaggcacacaacaattggcatggatccaacaacgacccaaaataacattgtaggaaccttgcacatcgacgatgaagaaagtggttggtagcgtcttgtttcccatggtaagctccaccgaaaagatacccttcgcctccgttggttcaccattgaagccattgagaatcatgttggtcttcttcaactcatcatctccacgccccaacctcttgaacaacgagtatggcatcaaattcacggcggcacctcgatccacgagcatcctagagaccggcttcccatcaatatgacctttgagataaagaggtttcatatgacggtttgattcatcgggcttctcaaaaactgcatttttaggacctagtgaaaattgagcaacttcgtctttatccatagcacaaaactccataggcaacatacataccatgttgacatccatctcctcctttggagatgactcatctttagcaaccaattattcttctttctcctctacagcaatcgattcttcaatgtctatggacttacacctccacatcttcgtaggtggtggtcgcaactcattgaaccttgtatccctttgctcttcggcctctctttccctcaattcttgggcccaaagacgttgcaacctcctcttttgagtagccgtttgttgatgtgaaaaacacgaggcctgggggatctgcttaactccagtgcaggtccaaaagcttgcctttatgtgtgtgagcgtgccagttgatttgatcctataaccaacaagaaataaagacaaagaaaacgcggttaaatccacaaatgatagccgattggctagctgtcgatgacgtatcatttatctttgggccgatgtcacatatagatcgatcggcagtcatgaataagtaagaaagaactaaatctactcgatcggctgtagatattaacaatatataaaccttatgtcgatatatagttaaatcaagtgattgggatagatcggtcgccatgccgagacagtataaatcacttagatcgaaatatatattaacaacaaaactatatatgttcatagcatagccgatcagatagatctagcatgtatcggctaatactccgataccactctatattaagatattaaagcaagcagaatatatcaaacaaaagcctaatatacttaaatgcaacaagatcataacataaagagcggatttaacatgtcaatcaagcatataagacataaagtagttaaatcaggtaagattggctgaaaccccgatactaccctagtcggcaaccagaaagtaggctagagattgagattctaatcacgacttataaggtcaaactcaattgatacagctataagtatgaaaagaaggacaatatccatacaatcaagccgctggttgtttcatagagtggtggatatcctatataatctaagccaacattggtatttaacctaatcggctgccttctaatgatagatgttagccgattggaggctatataacaatattgtcaaagattatataggatatatgataactcgacaagttacacaaacaagattagagtatcataaagatggaagcactaatcccgagaacgcaagccgccataacaagttttacctctagtagaagatcgaaaccgatgcagctcaactcgaaagcaagaaatcatcgaaacaaaatgaaagtaaaagggtggcgatgcgtcgagatagtactgaacgtgtcttgttgtattccatggggctcggggtctatttatacacgagattacaaaatatgttcgtgtcggacacgactcttatctctaacaaactctaagataccataagtctttgcgacagacttttgcccaaatatatctataaagaaattacataaaatatcctaattaacagatacaattgccttcttaggactcaatccgtgcatggcaatcctcatgaagcacattaactcaacccgacaacgtgtatcgcaccatattgtcggtatcggctcaatcgaccaaccttgtccgactcgaactctgccgatcctgctcgtagccgattcttgctctgtttccggaacaacttctttcttggattccgcttcgattcatctccatctccgattcttcgattaccaaatttcgttgttaacaccgttaaatccttaggcatccaccttggtttcggctctgttccaggaagtaaataatggcccctgttgagtctactcgaagatgacgaaacacccgcactacttcttgcaaatctcttgtcgaaccggcgctagagcccaatcagaccggacttagaccaccggtcagactggccagaagcgccggtcagaccgacattggatcggcggtcagaccggcctgatggcccagtcggaccggcagtagagcggcggtcagaccggccagaaggcctagtcagaccgactgactgcgatgagctagtcccggcttcggatttgttgctcgaggactctccaacttcgtttctagaagatactggcacatcatgagaacccactttggtggtaatcacctccaaagtcctcgcctccaccttaacacgctttccttccctcttttctttattgactcgatttttagcataaaaccggctattgtttggtgaagactaatgttcacgagctggcctcctaggtcctccccatccttggttgaattgcattggaggcatatgattgaacatggcggtgttgccccccatggcatgtagtaaggaaaaggataacccggcggcggcattggataaggcccccatgacatgtcttgagaacgatgatatgtaggtgattgcgaccgtcttggtgtcgaaacaagatttcggcaatacaaaaagggggtggctatcaagcaggaaaagtggatgggtttggaggcaatgaattttatacaggttcatgtcctctcaatgagaagtaataccctactcctatccgggtattgatccgccgagtgtgttattgatcgtatgatctgggagaaaagttatgccccaaaaggcacccggacccttccttatattgtgggaggagtctgtattacaagatacagcccatattcctaacggaataggcaaataaagataaaatacaatcgtaaccgactaggaccccgggtatttcctcgatacacaagttaggaatttaacccaagtcccttaaagatattttatccgcatatggtatccctattcccagtcagatacacaagccgtgtgggtatggggtatccataatctccacagtagcccctgagacctttacagtcgacgaaataatcttctctttgagtcttcaacatgatgatcccgagtgcttcaattattcctgccttggtgtcccgagtgcttgaatcaaagactgtgaagggctaaaaaataaaaagttaggtgcatcgactagatgcacctaattagatgtagctcccgactatgtgattagttgaataaaactaaacatatagtcaaggtacattaaaacatccatccgagtggttttatgaataaattaccgaagtaatcatatagctaagcatatgcgacctttaattaaacattaagcctactgctttagcttgattattatacccaaaaggtatataaaggtccaagtaaaaacactctaaagatctgtcaatcaatatatgcgataaaaaattcgagtaaaaactcttaaaggatttataaaatgtcgcataaatgataaatgacaagtctagatagtctaatctatgacttatgccattatcgaattaagcatataacaagccaagagaatgacaattttaaattggtcatctcaatataatccgaacagctttgcagcctaaaaagggcagcaaaattagtatgacacttttctgctgggcacctttttatttgcattgtagcaattccaaagaattatctaactgcttcaaaaagtattttaacggtatttggctattttgttgtgagcattatttgccaaagcaaaaaatatgcctaagtccctaaggatcacaaacaaccacaccgaaagtgaagttgggctgaaaatactgttaaggcccaggccgataagtatttcccgataccctagcgaaataatcgcaaaaatataacgccgcttcgtcttcctcattgcgatctccttcgttttccccatttttcgctacagtgccaaagctgcgccagcgaaagctagggttcgcaaacacacaccaatccacctcttccgaagcttcatgcctctgcgaaaaatcctccgcacaaccacttcatcaatctcccctccaatctccgccacccttgctcccaatttcatcatccatctcgcatccatggcagaggagagagaaagctttgagagtcaatgggccccctccaatgtcacggaggaaaacttgaaggaaatggtggtgcacggcgttctcccggcaaaagaaatcatcggatggcgtccagcgtacggcgaagccttcccgacccccaacactcatgaggtcgtcgtatggtggttttgtccttccaacttcgaagttctttagggggattctagaattttatggaattagtttgcatcatcttaaccccaactccattgtacatattgcaaactttgttcacgcatgtgaagccttcctggggaataaggcgcattttgccctattttgtcgcatcttctttttgaaaccccagccaaacaaaaacaagctatgtgtcatatccaaaatcctaaaccagcgcttcccgagtactcttgtcttcccccaaaatatcaggaaacatggaactcacttccaatgggagatgaaaccgctcaagccctcaccttgttaaatcgtatcatgaagctcaaggagcaaggtctgcaaggggaacagatcactcggcactttatcaaaagctgactggcacccatcaaggagaggtctcgtactgccttcgagtttgatggaaaaaatgatcccaatcgtgaagatcccgaatccctcgaattcaaaattatgaaggagagaatgtacaagattctcatctgccatagtggtcagttattcacatatactaccagtggtgccatattacgcattcaaccctcctcctccagtgagtattgaaaactctttaatctccttgcgatatctgctcttctttgtaatgttcttgactaagggtttgaaatgtcatcctcaggaatttgctttgatgaagtctgatccatcgactgctcaacgtcgttctcctcgccatcattccagtcaaacctctggaggtccaaaaattcaacatgtcgcacaaacgagtagcccaaagccgactgatcagacgggccccagaaaaaggaagctggtcttgagtgacaatgatggtgatgataccgaaaaagccagcaacaaagagatgactggaaaacagcctaaataggctaatccgccaaagaagaaaacattcagccgtccaatacccaaaatcagaaagtaaatccatacagcaaatgtaagtatcatgtctatagtttcacttatccaatcggcaaatccactgagatgctcaagtatgtaatgtagagaatccatcttcaaaatgaagcgaaaaccgcaaccatcgagaagctagttccccatcttagtactctggatgaaaccagggaactagctaggaaaacataacatgatctcagggaacgggttgctgagcttcaaaactccaatttcgaattgagtgggtcttcaaaaggtaactttactcctactcgacccattctgacttgatgttgtgtttaaataatcattgagtatatgatagtccaagctgccaagattgccgaattgaagaagcgaattgaaaccctcgagaaagacaaaggcagtcttattaaagagagggaatcggccatcaaagatgttgaaggtaattgtaatagaaatccaagataagcttgctgatgcctcctagtcctgatctgaatataactgttcatgtagatcgcaagatcaaatctcaagctcaattcgacatcttggtgaataaaattaagaatcttgaaggggctagagatgaagtcgccaaagctactatgcacttaatccaagccatgttctataataacaacggtccgagtacaattgatttagttgaggtcttcgacaaattgcgagctgctccggacacgtgctttaaaaatatcaaggaggctggaagcatgggagcaagcatggcgttggcgatgactaaatccttgtatccgaaaatcgacattgatgccattgatggctttgcagaagaaacaagtgaagaggatgccctttgatctcatcaatgatgcctagaaggacgccgacaagattgcgctgatattgttgagagatttcaagataacaatcttggtccgactgggtttcatgattccgatgatgaaaaaactgagtctgaccgaactttgtaattcaaacgatgtagtctttgatgatggagcctcaatttgtacaatactgatatatttatgctgtgcttgataatttaaattcggtctctgatttcttaaaagtttttgtcaaaccttattgagcctaaaacccgaaatgttatcaaaaaactctcagtcctcattaaccaagctaaaaaatcaaacaaggcaatgataaatcaagtaaacaaattgaattgataaaaatcacactccattattattatgatagcccccgactgataaatcaagaagaaacttgatgttggcagtcaaagaggaaaatagtgtacaaaggtaatgcctaagcataaaacgacgaagatgctcgatattccaagagttttcgacgaccgaaccatcttcatgcttgagtcgataagaacctggccgagtaacttccgagatgataaatggtccttcccataagggagataacttatgcctatctcgcgtagattgaatcctcctcaaaaccatatttccgactaaaaatgcgcgtgatctgacattgcttgtaaatatcgagccgactgaattaatgctgcttcttgggcttcttccaatcggttgaggtcatctactcggtcgtcttcatagtgctcctctttgaaattgcgaaatcgtaaggattcaaactcaacttcacttgacaacattgcttttgctccataaactaagaaaaacggcgattggcccatagcccgactgggtgtagtgcgaagagaccaaagtactgatggtagctaatcaacccatttgccggcataagggcgcagtcggtcaaaaacccgtgctttgatgccttgaactaccataccattggcgcattcgacctgtctattggtcatagaatgtgctacagaagcataacaaatcttgataccaaagtcttcacagaagtctttaaacacatcactagtgaattgggtaccatctataatgatacgattaggtaccccaaaccggtgcacgatgttgatgaaaaaatctcgagctttgtcggtagtgattgtgacgactggtttagcttcgatccacttggaaaatttgtccacagctacaaaaagatgagtgaaaccaccagtagcccttttgaaaggaccaaccatatcaagcccccacaccgcgaacggccaggaaagagggatagtttacaactcctgagttggtaagtgaatctgtatgggaaagaattgacaaccttctcatgttcgcagaactctctcggcatcggatactgcagtgggccagaaaaaatcctgtcgataagccttgccaaccattgttcgtgcggcagcgtgatttccgcaaatgccagagtgaatgtcctgtagcaattgtcttccttcttgcaaagaaacacaacattgcagaattcctgagggacttttcttgtacaactcagcctcgatcatgacataaagcttgctgcttcgagaaatccgctcagcctcgtcattgtcttgaggaagctcttgcttagtcaaaaatttgatgaagggctctctccaatcggtgtcaattacactgacttcttgagtacctgccgtctcgatcacatcctcccttggtactgtcggctcataaaggtgctcaacaaaaacatatgaaggggctacttctcgctttgaaccgaaattagctagtctgtcggccgcttcattgtcgtgcctaagcacatgagttaactctaagccatcaaatttgtcttccaatttaagtacttcctgtcgttatgcagccatattatcatcaaggcaggaccactctttcataacttgattgacaaccaattgggaatcaccgcggaccactagacgccgaatccctagagatactgcaatcctcagtccatgaagaagtgcttcatattccgccacattgtgtgacgcagaaaagtgtatccacagcacataactcaatctttctccagtcggggaaatcaaaacgacccctgctccagtacctgaaagcctcttcgacccgtcaaaatgaatagtccaatactccagcttctccacaggtgtgtcttcttggcactcggtccactcggcgacaaaatctgctaaagcttgggacttaattgaagtacgcggcttgaaggataaatccaaagacatcaattccagggcccatttcacaattctctcatttgcctcgcgattgtgaagtatatctccgagaggaaatgatgtgaccattgtgaccgagtgactttgaaaataatgggataatttcctgacggtaattaaaacaccatataacaacttctgtacctaaggatatcttggtttggagtcggccaatacctcgctaacaaagtaaattggtctttgaactttttgaacatggccatcctcctctcgctcaacaaccagaactgtactcatgatttgcgatgtcgccgacacatttaacaatagcggctcttatggatttggtgaggccaggaccggaagagttgtgagaagtttcttgaaatcatcaaaggcttgctggacttcaggtccccactagaaattgtcagtcttcttgagtaacttgacaaagggcatccctcgctcaccgagtcgtgaaataaaccggctgagcgccgccatacatccagtcaatttctaaacatctttctaggaactaggcggtttcatgttaaggatggcatttattttttctgggttggcttgtatgcccctacgagacaccataaagccaagcagcttccctgacggtactccgaaggtgcatttttcaggattcaacttcatcctaaaagcacggatgctagcaaaggtttcttctagatcagcaattatgtcatccttctgcttggtcttgacgactacatcatcaacataggcttcaacattgcgaccaatttgagttgaaaaacatctctggatcatgcgttgataggttgctccatcattctttaatccgaagggcatggtgatatagaaataagctccaaacggtgtgataaatgaggtcttcaagcagtcgaattccttcaagttgatctggtgataacccgagtaacaatccaaaaaactgagtagctcgcagccggctgttgaatcaaccacctggtcaatgcgaggtaacccaaaaggatccttaggacatgatttgttgaggtcggtgtaatcaacacacatacggcactgtcctgtcttcttccaaaccaaaactgggtttgccagccagtcaggatgtaaaacttccttgatgaagcctgctgctaacaacttggttaattcctccttgattgcatatttcctatcttgcgcgaaatggcggagtcattgtttgatgggtttagcgtcttctttaacatttaaggagtgctcaattacctctcttggaataccaggcatatcagatggtttccacgcaaaaatatctttgttaccttgaagaaaggtgatgagcgcgctttcctattttcaatctaactcaccgcctattacagtagttttggagggatcagatagatcaaagggaatcttcttggtcttggcgtcgtcttctccggtgatgtgaccatggctaccatggatgcaaccattgctcacatcatggatgaacaagaagataccgagatcacgtcctccaagtgctggaatccgattcggccacctattacaccgccgactttaaacggcggccgaatctgcatacgacctccgttttcggcccgtgactacttgatggaaagctctcggagccctctttccaacggatccagcatcgtctctgaattccatctcgtgtggccagaatcacaggaacaaggtgttgcgtcacctattatgggcctgtgagcttgtaacttcatttgggaccctggcccaggtggggcctatgtggggtgcgccccaagctggtgcagcacgccactaggcacccctaggtcgtcctcccacccctatatatagctaggtaccccttcagggtttctcggggttttgtttagatgaaagtttagccattgctacttccttgcagcgcgtgtgtcgatcgctaaggcgcaacacaacgtctcgtacggatgtagtcggatcgtcaacgtgtctcccaagtcgtagttatcatcaactcaccgaaagatcggccaacaatagccttgagtgtcgagaggagctcaggattcatcaggtggtatcagagctttcgttgctcggtgagtttttatctacctataacctgaaaattgccatacaaaaaaaattgtatcctgtacctagccatatattgtgccattgcattgttcttttcagtttttgctttgttgagtttgtgttgcatcgtcgagtcgtgttgctggtcttagcgtttagtctgtttagagtttcgagttctggtcacatttagtaccactgtcgtcaccatcatcgtgtctttgttgtcgtcgggacctacgaaaacactgccacggttcaatttttgtagttttcagaagtttctgtcggttagtttagcagttgcatcttggtctctgtggtctggtttgccttgtgccgtggtcgattgcgctcttgcgcctgagttggatggaaggaggctgttgcgcgtgagttggatggaaagagattaaattggtttttgttgtgcttggaaagaaaatagtagattggatcagtttccttttttcctctcagcaaatctggacgtgtgcagtatccttccgctaccgcccaccaccacgctgagtcgactccctccatctactctcggttccacctataccgtgagttgctagagagcttggtaaaaaatttttgagtgttggattcgacatctgtttgcaaaaacagaacctatgggacgagcgcattccatttttgtatagtccaaatttttgggtttgcacttttgcatttgagtccctgtaatttgtatatttacagttgagtccttgtaatcttgcattaaggtccttgagttggcttttgctgaaaaaaaaattaaaaaaaaagaaaaaaaaggcagaaaggtgctaaaaagaaagaaaacaaaagccgcaccaacaaaaaaaaaagaaaagaaagaaagaaaaagatagaaaaaaaaagaaagaaaagagaaaaatcagttgtatctttgagtttgctttcacatatcagagcgtgcttgagttgtttctagtactatcttgtggtatcgtttgtgtctaggctcgcgtctctcgtacgttctagcctaggaccagcacggtacttaactttaaacaatgatcttcgataacttcgttgcaggcacttcttcggttgcggttgatgtggccagtcggatctcgtcccgagcgagtgtaatctcacatgtctgagccatctcacagctttctttgtcgcaggtgatagcttgcttgatgttgctccgcaaagatatgactcctctaggtcctggcatcttcatgatcatgtaggtgtagtgtgggactaccatgaatttggctaacgccaggcgcccaagtatagcgtgatacaccgtctcaaaatcagcaacatcgaagcaaatattctctgtgcgaaagttctcctgagtgccgaaggtgacgagcagagtgatctggccgagtggagtagaggacaaccctggatgactccatgaaagggtgtgctactcgtcttcagctcagtacgagggatctacatatcgtccagagtcttggcaaaaaggatattgagtacactgccaccatcaatgagggatcgtcggagcttgaagttgtgaaccactgggtccagtaccagggggtaccaccccgggtggaccactcgattaggatgatccgagtggtcgaacttgattgttgtctctgaccaccgaagatattgaggcgtgtcgggctggacggcgttgatctccctatcaatcagcttttgcttccgttttgactcataagcttggggcccaccaaagatatggttgagctctttgcgagaatcttgaaaaccagtcggtccatcgtctttatcatctttcttctttgaggtgctctgatctccatctatagccttcttcgcttgcttggcgtatttctccgcaaactgcttgtagatgaatcaatctttgggaggcttgtgtctaaatttgccgactaagagttcatgacagacacccttggtgaaagcggctatgatgacgtcatcggtgatgtcagaaatctagttgcgttgctcagaaaaacgtcgaatgtagtcccgaagggattcaccgggcttctggatcacattgtagaggtcgaagtgggtgccgggacgttcaaaggtgccttgaaaattggtgatgaagtgctcatgaagctctgcccaagatccaatcgtgccacggggtaacccataaagccaggaccgagcagaatctactagatctaatggcaagtaatttgccatagccttgctatctcctcccgctgcgtggattgcgaggccatagacggtgagccatgactcgccatttgttttgccgtcatacttctcgataccagtcagcttgaaactagccgaccaatccactcgacacaggtcacttgtaaaggatgcgactccatcttcatcgtcgtcgtagcgatttggtgaacggtatggttggtagcctctttctgcaaggtgtcggttgagtgtttcgcgaagatcgacgggttgccgacgacgtggagagcgaggctgttcaacacagcgttctctgtatctatcagcaggcgagtgaacagaacgttcggcataatccctgctcctgtgattagatcctgaagcagtcatgctaaggcttggttggtgataatcttgagatcggagaggcggaacctggctgccagtcggcgtgcaaacgcttgctaagttgactgggtccgaggcggcgatcatggtcttcatctggttgataatgttgaggacgtggttgggcgcatcttcctggagcagagtatcccagagagtgattgctgctattgcattctgctgtggggtgagaaaaaacgctgtcccttcgacgtcctgctgtccaatgagttctcgtgctcgtcgcccggcttccggtgtgcgttgtcatcgatcttcagcctctttcgcggcccgctcgtgttgctgctgctcacactgcagccggtctcactcttgcacttgtcgctcttcttccaatcaacgccgctcggcttcttgtcgtgtacgttgttcttctgcttcatggagttgacgctgttctgttgtctcattatcggccatgaaaacaccgaaaaagagaggcgtgtaattatcttcatagccatcatcgaaatcgtcgaggttgctaaagtcgtagttgtacctgaagtcatcgtagtcaaggatctctgttggctgtgaatcaacgcctggagagctgaggtagctatccaactcttctgttgaaaccgtcccgaggggctgaagtatgacgccgacttccctgaagcaagattgcatcgaggccgaggccaggtcccatctagacctatgagaagaagatgcctttgtggtgaaaacaacagccaaatcgtcagggagcttcatcaggatcggtggatagccgcatcgtcttgatttggtcgtgtcgaagtagatgagatctcgtccgagtggtttgaggctaactcggataagatagtcttgcggtagatctcgaccgagttcgggagaccgaacgggctcttcccaactattttgaatccgagtcgaggagagaaatcttgccgaagtcatcggtgatgaagttgaggctgccgaaccggtatgcctgaccgggagggaaggcaaagtcatcgatgctagaaacgaatcccatcgcactgatcggcgaaaagcttgatgcaacccctgcctggcgcgccaactgttgaaacaagatttcggcaatacaaaaaggggtggctatcaagcaggaaaagtggatgggtttggaggcaaggaattttatacaggttcaggccctctcaatgagaagtaataccctactcctgtcaggggattgatccgccgagtatgttattgatcgtatgatctgggagaaaagttatgccccaacaggcacccggacccctccttatatagtgggaggagtccgtattacaagatatagcccatattcctaacggaataggcaaataaagataaaatacaatcgtaaccgactaggaccctgggtatttccttgataaacaagttaggaatttaacccgagtcccttaaagatattctatccgaatatggtacccctattcccagtcggatatacatgccgtgtgggtatggggtatccacaatctccacacttggtgaatgaccaaatcgctccccaggaggcgatcttggtctttttcctttgttgcgagccttctcaccactttgcttctcatacttatccaaaagcatatcgaaggtcaccttagtcttactaggagctttagaacttgaagcttcactccgattctccttccacacaccaacctccggattctttggcaccatcatctttggcctaggttctccaatgaccactcctttccccttagtagattcggcttgctccagccgaatcaacaccttcttatcatcaaaattaattgtgttcaccggaaaaagaataatgattaagcttcatcttggaaccatcggtaaatttcaatcgtccttcatctatggccgattgaacctgtcgtcgaaacacattgcaatcattagtagaatgagaatgagaatcatgccatttacaataagctcgacgcttcaattcttcttgagatggtatgacatggcctttaggtaatctaatttgtttttcatgcaaaagataatcaaagatcttatcacacttggccacatcaaaactatacttaagctcactttgccgatctttacgaggagtcggcattaaattagaacacacaataggcttatttttgttagtccatgaccactcggcaacatacatatcatgatcaccctcaccatcactatcactagcctcagggtaatcaatcaaattaacattagacttcttctcatatggtctaacaaatttctttttttttgaaagaaagcactgtaggggaagcccccacagtttaaattttataaaataaaaccaagatatttacaacagattaatccaatttacaagtatatctctctcaaacaaattaagcctatggactaaaagggagagttcattcttaaagaaagctctccaggaggcaatggaaggtacaacattattaaaaattaaaccattcctttgcttccaaatactccaagcggcatagagcaccttctccacaaagtgtatcaaagatccatctacttaatccaatttgtacaaccggggaaaaagtatatcaaagatccatctactccatgtttcagaatatgccctcgcactagataagcctaatcaataaacggacgagcagctgagataaaagcaatttggtcgttaacgacccatagcccttttgttatccgagtaatcagagaagtgcactcaacaggcgcagagaattttatactttctaaccattgccttatcatacatttcacaggagcaattttgataatcaattcatcccccctaatgggtctcagatcacttctaggaaacaaagtcatagcaatccatttgtgcatgagcctaagtgtaggattatggatatcattccttttaggtttcttgcaaattggagcaccagaaatgtcttcccaaaacctatttttctcgaacccagaaattcctttctggagatcgattttacaggaatcgtgaaaaccaagaagtgtacttaagcctttccatgtaagtgtgtactccttatggaaaaagtgaaaggaaatacaatcttctatttctttcaaagtgcacagaaattgcaaagtaagcaaacgagaaccaggctcatctaccacagcaaatctctgcacatagtaggcttgcctctcccgatcactgacaaggtcgaggtcggtgtccttcaagagttgtcgcggagcttcggcgtcttccatcgagacatcaactgatgaacgagtactagtctcttcatgatggcttggtgaagagctggaccccttgaatagacgagacaatcaccttctcattctgtacaatggagcaaggacggactaactcggcgggggttaggaatgacaagaattttacccgccggttagtttcaccaaagcaacttgtatatatgcaactaagtgtttgaatttgaaggaaactatcaaagcttgaatgaacttgagagcaaactttggagagggaatgaaaatgtgttgaaatggggtggaattccctctctcggccggctggcttttatagggtacccacaacggtcataaatgacatgtgggacccactagccgttgccctgccaaaagtggcaggtagccgttgccaggccggttcggccgaacccctggtgggcccaaccggccccacttttggccgttggattccaacggtcagtgtggttgtggcatagtgaattttcgttgaaaaatttattttggtttgctctaaaaaattcatttgaagaattttctcaaaattcaaaaatcctaaatgcaattttgaaattcaaacatgtggtgatgcaaaaattcaaaatgttgaaagcaaatatgcggatacataccaatttacctgttggcgaaggtcgcgtcatttaaagtccgacgtgcaagaccgtacctccttccttgctagttcgcggattttccacccgtctccggaggtgatggagtgggcgtctttggcttcttcctccacaccttccttgattttggtgcggacagcggcttcttctgagccgactgctctagcttcttggccggtattgaggattttatcggcgtctttcaataacggttcctgggcatcgttgtttccttctccaggaaattctgcatgaatttcaccaagctatccgttttgggtggctccacttcgaccacttgaatattctgcaggtttggcccgtacttgattctgaccatggagcactgttccgtccttggttgaaactcaaacttttcctccttcccgttgatatggaaacgaatacttcctgttcccacgtcaatgttggctctcgcggtgctaaagaacggatgccctaagatgagcggcgtctccttctccgtgtccatatctagcactacgaagtcaacaaggatgaagaaatcctgtatcttgactggcaaatcctccgctatccctgccaggtaacggactgacgaatcagccagttgaaggcgcatccgtctcagtgccaacaccgtgaagttgagcttgtcgaagacgtccttgggcatgacgctgacactggctcctaggtcgcacaaggcctgctcgaactgttgtgccccgatcgagcagttgatcgtagggcaccccagatcttcttctccgggagcttgtggagtattacgttgctgcattgctccgtcagcttgaccacctccgttgttgggagtggtctctcgnnnnnnnnnnnnnnnnnnnnnnnnnnnnnnnnntccatggggccg

SEQ ID NO: 68105 - DNA, 3194 bp, Oryza sativa
gggtacgttgaaatttcagcacgaatggtacgtataaatgatgatgatagggcgcgctgacagatgttttgaaaaccaccgtggtatgtacgttaggccttgtttagtgccaaaaattttttttcccaaaaacatcacatcgaattttggacacatgcattgagcattaaatatagataaaatgaaaaactaattgcaagggggggaaatttagagacgaatcttttgaacctaattagtccatgattagccataagtgctacagtaacccacatatactaatgacagattaattaggctcaaaagattcgtctcgccgtttctaggcgagttatgaaattagttttttcattcgtgcccgaaaaccttttccgacatccggtcaaacgtatgatgtaacacaaaaaaaattttatttcgtgaactaaacaaggccttagtagttagggcctagctaggttcgtacacgactacaatagtatattctcctatccatagccacaattatttttaagaatcttagctgagattaatgtgttttcatgaaatctgatattactttgatgcatgtctcttagaattattacgacagacaatagtactctataaatatgtatatgggataaattttagctcataacacgccgattagctcatgaaatgaacatatccaagccatcatatcttacaattttttatttttttttaaaccccatcacttctttagctactgcagaaagtctcctaataaaattatttccctatggaaagtttatgaatataaacttttcttttgtagaaagtttgtgtgtagagaattttaatataataggcttttatctaaatggagagtttaaaaaattggacaaaaaatattgaacaaaaggtattcacgctccaatggtggcatgctgatttttcaatctgcgcatggagacgataattctgaataaatacaccctagttatatggtagttattcagtggcgcactaattacgtaatgcgtgctagcctttgccctaggtgattgggagattagcaatggaacccgatctatagacgctaaaaaaaactaaaactctctactcataaactttctacaaaataaaaatttatgctcaaactttctacatgaaaaaaaaatgtacgatgaaagtttctacagtaattaaaaatattctagtggaattttaaaaaaaattgtaagactgttaatatgatgaaacaactcagcaaatagaagttattatgatttcatctaataaagaatattctactccctccgtttcacaatgtaagttattctagcattttccacattcatattgatgctaatgaatctatacatatatacctatctagattcattagtatcaatataaatatgagaaatgttagaatgactttcattgtgaaacggaggaagtatatgtggaaacatgcgtgtaccatgggcaaaacgatcttgaaaaaatcccacatggccccactcaaacaaactaattcatccatcccataatataagatttttgaaagacaaacatatttatttaaaaaaaaggtaaaattaaatagaagaatattgtgattggatgagaagtggaagtagcagaaattgaaaggaagagaatgttgatggataagtggttatattttcgaacatctgaagtttaaaaattgttatattttgagatgaatgaagtagttactaagatggagctacacagcatgtgctaaccctaccgcgtgacccgcccacattcccgatctgtttgcatgaatcgaatcacacaaacgttcacacaatacggtttctgcactcgttggcctcctcccctcttgttttggtgcaataagttagcctagagtactactcctacaactacaacaatagctttaccaacactggattgggatgttcatatccaacacctagagctctactccctccatcccagaaagaatcatcctgaagtggatggatcactacctaatacaacaaatttgtggtagtgtcccatatatttctaagttgattctttctgaaacagagggagttctaagttgattctttctagaacggagggggtattgcatagattccacaattagatccttgttatgagtcaacattgatgtgtgtgtattggtatgcttgtcttaattagagattttactgttattgagacaataattgtaggaactaaaattttacattaaaagttttggaacctcgaattacctagtacatgaaatactaaattttatactactactagaaaacatgacacctcggtatcatattaagatgataaaatcaccctagtcttaataaattataaatttcatagaccaattttggatgaaagcatgtaactgttgaccagatctataattttataattttgtagtggacaacttttttaacttaaaaagtttagatgctcaagtaatcgtcaagtcgtttgaccttcagacaaggttaataagtaaaaaaatatttagatggtgaaacggaattatactttgcaatttatcattaaaataaactaaatattcataaaatttctaacaaaataaagtttcaaaaggaaaatactccgtaaaaaacaatttctttttcttggggtatatgtgaatgctactaacattgatatatataggtgaaacagtagatagtcttcgcgtgaaaagagctcatggattgaaatcctagaaactacgcgcgcgtgcctttattctcatttcatgccaaaagtcatatgacttgctgcataaacgacactaatcggcttcgcacctgcaataattagctttcccgtagcagtgtgtacccgattttatgtcgtgatttcacatttcctctttaattcaaatatagtcacatccaactcgtcactcaatgcatatgccaaccacaaagttagcggactagggaaccggataggattttgtaagtctcgcaagaatcatcacggtgaaagagattgcaatgagaaaaaagaacatagtgattccgattggggaaatgtaattctaaaaaatagcatattatatgtatcgcgtcatatatccgctcgatcgctctcgctagctcacgtcagctaagcagacaattgagcaagacattctacagagagcgaagtgagcatgagtataacttaaatcatcatcaccacctgcggtgattaat

SEQ ID NO: 68106 - DNA, 14564 bp, Oryza sativa
gacgtcgtccccccgccagccgctttgccgccgcctcgcctcgcctggtcgctacctccgccgctgcctcctctgccgcgccgttgtcgccgtttgaaggaggagagagagagatagaagagagagactgacatgtggggtccacctattttttaataaataaattgttgatggactgccacgtagaccaaaaccaccgcggattgggttcaggggggtaattcgtctggtttgcatagttggggatgaagaatgtccgattttgttgttcaggggtgtaattcggacaaccgcgatacttcggggggggggggtaattcgtactttttccttaaaaaaatcaacataggcctcttctcctaaagtgatttgaagggagtattatttggataccctctctagtctttttctttttctaaaaaaataaacgaactggcacacaattgtgataatttctttaaatatattaggagaggaaaacaaaatcacatcaccaccacatgctagcagctccaaacatatctatgaagaaaagagctagcaccaagccgggcgccgctatgcgtgattgatcggtgatagtctacgagggttgcgaacgcactgctgaaccgcagttcctaaacagtagtttctcgatcatcctcgcagagcagggttggaaaagggagagggcaagagagaagacgatccactcaaccctcagccaacccagtggcgacaaccgacaaaacgttgaaaaccacattgagataataccgtgacggcaggaaaacaagatctcaaagatgatgcacccaagatggttatgacgttgaagacgccaccatcatccgtgaaatgactaggctttcacccggagaatcttgttaggagggagagagcatgagctcgacaacacccaaaagggaggaaacaacgcgacacgttatcattgctggcccgaagaactccgatcaaggcttttgcctatggttcccttcccctaacctgttgttagcaaccttgtgtatccaccacccaaaaagcctatgtcaacatgcagtcctgccacgccggccttgtcagccgaacactttcacgttgccggttgtgcctgttggccctggcgaccacgtcctctcagcatcggcttcatgtgctgcgggccttcagctcgtgccgccaacgaccgcctcgctcttctagcctcccggccggtcacattaaccgttctacatgccgctaacctcctcctcgtgtgccacctgtcacggcctcgtgcgcaaccaacctcccttcgcgcttgccgcgccagccacccacatgtgtcattgcctaggacggcgtcctcgcatgtggacctccgtcgatgcttacacgctgccccgtcgccccgggcgttacgtgaccccaacttctccactccttgctgggccaccgtgcatcctccccatcaccaccgcttggtttcactcgctgagccaccagatctgaccatgtgagaactggatccaacgctaacatgcatatctgatcaccgacgaccaccactcaaaacccttcctccgatatttggtagcactcggaccgctgccaccagaaaaggaggtacggtagagagctctgggacccccgcccttcgcccgccgggctttcggtcgggtggcagtgaggcgaaaaggaggagggaagagggtggcagcccgtgccgccctagggccgaacaacacgagggctctccctagcctcaaaggaatggaacaaccaaaccctcatggcgcacatttgcacgcgcttcaccagctgaccctttagcccatatgcttgtagagtagagcgtcataaattctcacctagctagacttggtcctcccactcccactagcgtgctgactacatatatatgatcggtcaatcggtggatgaaatcaaacatgcaacatgtcttcaccgatgctcggcgatcctatatatcgatcctatagacagacatcgatccaaccggtctcgctagccatcctcagcactgtaccatggaatcgtccggtaatactccctccttctaacttttttaaatatgtttgaccgttcgttttattaaaaacttttatgaatattatttaaaaatttgagtagtagtagtatatttaacaatgaatcaaatgatagaaaaataattaattattacttaaattttttaataagacgaacatgtcgatatttgatgtcgcaattccggtatttgcatagtatggggattgttggtactaggatatatgcgagactgaggtaaaagagatggagacagggatttttatacaggttcgggcccctgaattgtcaggtaataaccctacatcctgttggccgaagccggtcgttgctcttattcatcataatcacaccagtacaatatttggggatagtctatctaactgttgtcgacatgacggtctgaagttctgactcgtagtcgacaacagggtagtcttcctcctcgaatccgtgcccgtcgagatcagagatagcgctttcgtctctcctgacagtatctggagacaccgtaggggactagccgtgcttatccctgaagtcgatatccggcgtcttgtcttggcgtatgttggcttctatattgatcttctgtcttgatctattgttccgtgtcttctatggtgggtgtgtcccctctcctcctagagggtcttgtatttatacccataggtgtccccttgtccaagtagaactagggaaaccaatatggatacaatccgagtagtacttgtcgttttcatgtagaactctggttgtctttccttatccggaactctttctatatccgtaggttgtttctgtataggatatgatatatggtgagtcctgtcgagatttagtcgactactattaggtatgtgatagaacagtcaaacatgtttaaaaaaaagttaatggcgtcaaatatttagatatttagagagagggaatacaacatgaggtccggtaggagtcctgtggctggttgccgctgggacgtgctactcatctcggacaaactagctatatttatagcgctaagatatatcccgtcacgtattaaatttatttatttcagaacagagggacggaatagatgacaaactagctcgaccatctagagaacggacctgtttcaccaaccggcttgaccggtatgtaaatatgcatgggctaataggccggaaaaaactccgattcgccgatctcatcggcccttgccaagcagaagcctaaggccgttttctggatgggccgtgatctcgctttcaaaaaggctcgtctgctctgcgacaccatttgacacttccaccggtggccggcggccgccgtccgccgcctcccgcgattcgtgtgtccgacacctgtgccacaaccgcgacgtacgaaagccaagccaccgcccacaagtttttcgtcagagagtgtgtggatgagtacgtgatttccacttgtgtgccactatattttgagcccagtagtgggactctgcggttttaagtactattgctgcgctccagcccatccattgcgtggtcggcgtgggggcaaatttcgtttatatggttatcatgatttttttgtgaacgatgacgttggttatcgagtgatttgttaacgatatgatgatgcactccaccaccaaagactggtcatataaaatcgctgatatcaaagtgtcatactacacttctttgttgcttgatatcaaagtggtgccccgatgactatttattcttgcttcgtccctgctcgattgtaaaagtgaacaagctctaggtgtaactcatttggctatattccttacgatgaaacctgtatattcgacttcaagtcttttactaagcacgaatacttatgtttatgactaatttttttaattatggatggtgcctctgtgattactttgtcatatatgtttgctcaatctactagagacgctcgaaatggaactgcactaatttttttttaagtatagaagtcctataaaaatcatcgcaaacaaattaccaaatcaacctatcatcaccattataatggtaaactacctatgtttcatattatatatcgttctgacttttccatagtcaaacttttctaagtttgacttaaatttatagaaaattatagcaatattatcaacacaaaacaaacatattatcaaaatatattcaatagtaatttaatgaaaccaaattggtgttgtagttatggctgtttttttataaatgatcgaaaaaaagtcaaaaacaacttataatatgaaatagatggagtattaaaatacgtgggcatggttaggatgtgtctacgtatatatggatgagtgcgacacacgtacgtgtgtataagcatacgtgtatactatatcgttttgcgtaataaacttaatgttgatctagatcttgatctttatttttagagaaaagaacaccaactatcaactatgtacgtgtcgagaaaatgaagaaaaaaaatgtgagtacttgtgaccaaagtgacacacacgctcactcagctcgtcagcttcttccacgcacgcgttgacacgtcggcacgggaaccatcctctatatatcgtcaccaacctgctgcacccgagcgtcgcaggtcaacacacgactgtaggcacgtgcaacaagctagatggaggagcagcagcggccggtgcagcccgccggcggcggcggcggcggtggcgcgccgccagaagagcagtggcgcggcgccgtggaggcggcgctcccgggaacgccggcgtccgccgcgtggccgcacgtcgccagcttctacgccgcgcaccgctacctccctggcatcgacgtgtgcgagcgcgtcggcgacggcggcgaggatggtggcctcctcctcgtccccgggtgcgtccggcacgtggcgtcgagcgcggcggggctgtgggcgcgggaggagctcctagaggcgccggaccacgcggcgcggcgcctccggtacgccgtcgtcgacagcaacatggggttcggccgctacgtcgccacgctccgcgtcctcgacggcggcagcgggtgccgcatcgcgtgggcgttcgagtgcgacgccgtgtgcggcgaggggtggagcgaggcggcgctggtggcgcggctcgccgccagcgtggacggcatggccgagagggtgcagcaagccgtggcggcggaggccgaggcgcgcgccggagaagaagaagaagacggagtcgctgggtgacgtcaacgtcgccatggcgggggcggcgtctggttcggcgtgtctttgtcgtgtcaggacgtcgcgcgtgcgttgcgtgcaaggtggctgattgatagagagattttctgtcgcttttttttttttactgtagtgctaccatggatcgatcagcggcggtgatgatctctacatgaaatttatctcgtgccactattaggtcgttttcatttttgcgatagcttttcatggaaaaatattataagaaaaaaattgtgtataaagttttatataactcgcaccgcttaggtagtgtttgggatgggagagatttagttagtgtttgggatgagagagatttattttattccctctcaaaaaaaaacataagtaacatactcgtgacaatctaacataaaagaaacatgcaatgatttatagaaaagtttctctttttttttacgttcttaaataaatattgcaaagtattgttgctcctgggtaagtttatgttgctcctaccttttacttaggctgtgtttggatcaagcggtgaaaatttttgtcgtatcatatcggatatacggacacatattttaagtattaaacgcctgtaaactgccaggcgaatttattgagcctaattaatccatcattagtaaatgtttactgtagcaccacattgtcaaatcatggagcaattaggcttaaaagattcgtctcacaatttacacgcaatctgtataattagttattttttcgtttattttttcacgaacgcgcaaaaggattgcacgtcaatatattagaataaaaagagttttagttacacaccacagttagaagaaaaggattgcacgttattttttcatttatatttaatactccatgcatgtgctcaaatatttgatgtgacatggtgaaaaattttgccaggggatctagacaggcccttatttaatattgtcatcaacatttaccgttcatgataagatatcatcaaacttttgtaaatgttaaataccaataactaactcacatgattatatttttttaaaaaaaatcaacggttggtttgtctccgaagagtattgggaggtgaacccatctcccatgcacggaaaacggagcagtttattagcgcgtaattaattaagtattagccttttttttcaaaaatagatcaatatgatttttttaaaacaacttttgtatagaaactttttataaaaaaaagtaccgtttagcagtttgaaaagcgtgcgcgcggaaaacgagagaatagtgttgggaacttgctcttgcaaacacacccctcacgatattacaaacttgttctaatataaaatcaattactaaaactttaaaagttaatcaagcctggtttcgaacgtcaaatagtacttcttcacggtggaagtatgtacttgcttggtttggcaggaacaaaaggacgtgacaattgcacaaaaccaacaccaaaacccacaaatccacagcgcatcataggtacgaaaatctaatctgatggatccatccgaatatctgacgcacaggcgaggctgaccgaccagcttgtttgatgaggaaatgaaacggtcgcccgactagtgaccgagctttctttcctaggtcaccgcactgcaatgcacatggtgtggagcagtgattttattgttccgaccaaccgttcgtccgttcgccattgctggtccaatccaagaaggcaaaatttgctacaagacattcaaaaaatgtgtaattagctgaagtacactataaaaacgtgtatttactgtagggcatcgtaaaaaagtggtaattggctgctggacacccatagcattattttattatttttggaggaaaaggagagagaaacaacgattaaagacaagtttgcccttggctcaaatgaccccaacgtgggccccacatggaagtcccctctccctctccctctccttcttcccagacaagccaggtggcagagcggcaatccgcggcggcggtggcggcggtgccgaccacgttcgccatcgggaggggggctacgtgcagccacgccgccgtggcctcggccgcgtcgccgcgcgctgccggctgccggcgctcatctacgtgctcgactcggcgatgagcggtgccgtcgcgctcatggcggagcgccgcgacatgagtgggaccgcccggccgggatgttggttgtgttggagtggacgctcaagtgcggcggcggcggcggcccggcgctcatctccctcccggcggcgtcgttcttcgccggcaacctcgctgggagcttcctgctcacgacgctcgccgacactcatctgggacgaaggaagatgctcgtcatgtcgctggcgaacatgtccgtcgccgtcgtgatcacggccttctcaccgaacgtgtgggtgaacgccgccctgaggttcgtgtgcaggttcggcaggtccatggcgggcacatccgcgatggtcctatccacggagctcgtcgggaagtggtggcgcaacacggtgagctttgccgggttcgtcttcttctccgtcgggttcatgtcactcccggcgctcgcgtacatgttccgcgaggcgtcgtggcggaccatgtacatgtgaacgtcgctcccgtccctctgctacaccgtcctgctctacttcctcgtctaggagtcgccgcggtggctgctggtgcacggccggaagcaagaggccatcgaggcgttgcggcagatcgcgtcgctcaacgacggcgaaggcattacaatgtcgagcttcaccatgctggatatgtgcgccgtggaggtgggggacggagtggccggtggcgagggcatgttagccatgctgcggtcgatatgtgagtggtggtgggcactccagaggctggcgacgatcacgacggccagcttcagcatcggcgtggtctactacgggatgccgctcagcgtgggcagcctgagcttcgacctctacagcgtagcgtacaacgcagcggccgagctcccgtcgtctttcctctcgtggctcctcatgggcaggttcaaccagcgcagctcggtggtcgagctcaccgcggtgtccgggctgtgcagcctcgcgtgcgtcgtcatcccggcggacccggaggccggcaccggtggcttgcgcctcgccgccgagctgtcctccttcttcgcgtcgtgcgcgaccacgcgctcgtctaggacaacggcaagccgccgtggcctcggccgcgccgccagcacttgcgctgctgcgcccggtcgtcgccccgcaccgccccgcgccagccgcctcccgctcaggtgtacgctcgcgtggtgaggaaggggatagagagagaagcaagaagaaagaaccgagagaagagagagaatgagaaagaaaagaataaagaaaaagaaaaaaaatcaaagggtaaaaccgtatttacactgttgtttctctcttcttttcctccaaaaataataaaataatgctgcaggtgtccagcagccaattaccagttttttacgatgccctacagcaaatacacgtttttacggtgtcctctaactaattacacgttttttggatgtcctgtagcaaattttgccgtccaagaaactgcacaactccccccacctactccaggagtagtccgcacatgatggtcaggtcactaggtcggcagctgggatgtgccatggttgtacttgtcgttgccggctgctaacatacgattagtcttggactcttggtggttgcattgcactcttgcagaaaggtagactagctgctgcctatcatgaataggaaaatagttcaaattactcccgtgaattattgtgacggtacgaattacctctatatcagatttcggagtggttttggtcccacatggcgcatatgtagtagtctagtcagtatagaaaatattaaaaatgataggggccacttatcagtttgtctcttctctcggtcaccatatgtgggtcctactttttatactgactgattgccacgtgtgtatccggtaggaccaaaactgcttcggagtttatcagagggcaattcgtccggtataacaagataagggtgaagaatatctgttttttttaattgaggtggtaatttggattttttccttacgaatacgacttactacgtttgttccaaagtataaatatttttagatcattaatttgttatcatatgctgatattattttttagttgtattaatggttaaattttaaattttgaattcactgtattcctctcgcaagcacgtgattagctgaaaatgtatggatgtctgtgcattagaatcagtgcatcagaaatgactatattatcgtacaaattttgaattagtattttcaaaccgagggagcagtactttgttttgggtgtgtttagttcacgttaaaattggaagtttggttgaaattggaacgatgtgatggaaaagttggaaatttgtgtgtgtaggaaagttttgatggatagaaaagttggaagtttgaagaaaaactttggatctaaactcggcctttgtatacttcatcctattttaagcgcaaccataagttttcgtatccaactttaattgtccgtcttatttcaattttttttatgattactatttttattgtcattaaatgataaaacatgaatagtaatttatgcgtgagatatgtttttgacctttttaaaacaaaataagacgaacgattaaattagatatggaaactcatgtctgcgcttaaaagatgaaaggactagtatccttgaccgaggtattatgctgttgataagaataggaggtccactcttgttgtctatgcttgactgagaagaatcctcttgccatgggaggaacaatcaaccacacaaattgaatatccttatatccatcctacacacgctaaaagaaagatcgacaaatttgatgggccagtagcagtactaggcaaactgcagcacaccaataccagtattagattttatacaaaactgattgaaaatgtccaattcagcggcaggggtttccttaaaaatcttaattctattattgcgggtgtatatatataattacagatcacaaaccctttttcagttttcgacccagtcctacatgaaacaatcaaccaaaatcaccacttgaagcttgtagatcactttcagataattccatcaagaatgagatcaatgacatacacggccattttcctaacttatcatacaatttttcttttctcctttttcaggcaaactgctctccttcacacggtttgcagagctagcattcgctccatccagtcgatgatgtctgtggcgatctcatcacgctcaggctcaaagagcagatcgtgcaagaacccatcgtacagcctcagatccttgtgcctcgatgaggcctcgttgtagaggtcctgtgaagccagggggtcggtcacccggtctgcggttccatggaggaccatgaatgggacggtgaccttcttcaagttgtgcagcaggtaggaggagatgcgtaggatttcatggccggtccgaactctgatcggcccggtgtaaaccagcggatcggagtacttcgctagcagggcagccgggtcgcgggacaccgggatgcctctcttgttagctcccttgaactgaaactttggtgctaacagagagaatattggcgccacagcctgcaagattcagatagttggtatgcacttatcagaatgtcgaaaaaaaaaccaagatggtccaattttttaagatttgcacatcaaggacgagattaaatgtagttctcgtaagcattaattttgtacagattgtttttctgccgggcatagtttgtgcagattggaaaattctaaatatataatgcaatcattttaataagcgcatacaggtcatagtatatctgtttttctaacgttgaatagaatacaactgccacagtttctcgcagaaggtttgataagatggcaaatgataagttgcttaaaccaattttgcaagctgttttaattaattgaaatatacctagttcttcaaaggtattcatgatcttcttttagcaagttatgcagatgaatctacttttgctgacctagaggatgcttattccatcaaaacaaacacagtttagaaataaacagggtatcagaaaaagcagcattacccctacaatgggatgagcaggttttacacgcagagctggtgaagttaggatgatgccttccagttttgctctgatacgagggaacaatgatgcctggaaaataccagctattgataagcacaagggaaagaagaacatgaagcatgtaaaatgaacatatctgcagccaaaccatttcaagttttcaaccaggctattttgttaatgctttgcaccattgctctgcccgtcacgatatccattattcacaggcccagaggagtagggtcagtttctaaacctggcctaaatagagctgagaaaaactacttattgttacaaggcataccttcaaaacaacagctccaccagtggagtgaccaagaagaaaacaggggacccctggattctcaagcacaattttaccaagaagtacatcctgtttgaagataataaaatatttcataagtaacagaatgaaggaataattgcaagacagacttgctattttcagacttactatatcttctacaacataatctagtgaaggcacataaccatgtagaccatcgcttccaccatggcctgacattgtatatggagatgttagagttagcctgttaatgttcaaaataaaagtagaaacaaacagatgttgttgatacaaaaagcgatgcaaactgcatggataaaatcaatgaaattgcctactgtgtttggttagtaagtgtgcattgcagggtcaatttgtgctgtgagtgaacagagtgtggtaacattagaatcatgagctagaagttgattctgaataaaatttcatgcttttgtccataacaaacggtaatactctgttatcaataagactacttcactttcaatatcaaatgaaatatttagctggttctaaatttctaattagtcatactccttctaatagacaatccccatattttccaatgactttttggctcacacaaaaactcagttagttatattaggtccgacaaaatgggtacttaaacaaccccaaaaactaatttcatgtgcattctgacccaaaccactgtaacttacctaaatgtaggactaaaactagccatccaaagagtgaaagaggcaataatgcatgtccaagaaaccaaactagttctcacctatccagtccattgcatatactccaaagccacatgatgtgagcagctccgcaaagtgcaaataccttccactggaaatacgggatcaaaaagtatttaattattcttttgacaacaaagaggaaagaacatgtatattgtatattaaggtgtgtggtgggtgggggacttaagaggatatatagccttacctgtgctcattaagcccatgtatgatgaccaaaatacccctaaagtaaagagaggaaatgatcagtataaattgaaagtggaagcaattgtacaacagtgtcactgcaaagtaaaaataaactgttcttaacattagcattgaaacacatgctaccctcgtaaatagatggttcaggctaatgaagaattccactttgctgcaaaagaggcttcaacagaacaatactcttcaaaaggtttcagctgtagggttgtcaaatttgccagcagcgtcaagggtagctgatcagctacactttgaagtattaaacaaaggtggttggttcctatttcaatctttgttcaatgcagcgtttgactacagtatcatttaaaatgtgaacagctgaacagagctaaaccagcaggtcatgggaataagaataatccacagtttggttatacaacattggggcaaaggaataaaaaaaagcttcctccttttcttgatagctaagctattcagggtcactttagtttaagccatcacattcagacgttttcaacgataacaaagatatagcaatggagcaaaggttgtgagataaggaatcgctttgattctgctaatctacccgattgtgcttaaattggtctcctaaactaaagcctaaaggtacacgaataaagcttctataatctcttcttatccattagtactagtaagttaccagcactaaacatttcataccatcagagagaaaaatactctgcatcagaagctgtcgtaaacttagccaactggtttgtaagagagtatgacaattggcaagaagtccatttgaccattatatcgaactactcctacctaacaattgcagaaccacggatgaagacaagattatgcagcggcgaactacttcaattgcagcctagccggtgcaatgaatgcaagaacgttgcccggtatctgaggccggatgtgtgtaggagacgtgcattagacggcacgtctctctcagagagactcgcagatgcagcaacagagtttcagcaatgcgatttacgccacaaatcctaccgtgataaatcaaaccactaaattattatgatccagatgcagctcatcttcacgaatgtctaatcggaactgaaattaaccgtcatttcacagctagatcaccggaaatttcagcgaaaacaatctggaaatttgaccgaaactgccaccagctacaagcctacaaccaaccaaaagaaaacgcttggagaagagacaaaagaagcctcttccaattccccaactcgaggagaacaaaacgccaccccaattccgaaacctgggatctctctccaccaagaaacaaaaatcccctaaaattcagaacgaaatgacgaataataatacagtaaaaatattcacaggaatcagacgagaataaaaaggtagtcctcttgcgtaaaagcagagccacaaaacgcccttcccccaccaatccaccaatgggagaagatcgattttaaaaaaattgaatcgatgtgtccaacaagaaaacgaaatcgccataagccaacaaaaaaaacaagccactgatcccctccacaacaatccaaaccactataccgaaggaaaaattgatcgccgaaccctccgtgctcacctcatctcggcggcggcggcggcgggcgcccagacgcggcagaagagcgcgttcctcctcgccccggggacgacgaacgtctcccaccgcctcgccccctccccgtccgcgtcctccaccatggccacctcctccgcgagcgccctcctccgccgcacgtcctccttctccgccgccctcctccgcgtcctcaccgccctccc

SEQ ID NO: 68107 - DNA, 3301 bp, Oryza sativa
tcctgctactaagtttgagctttgctcaagcttggttggcgttacagtatagtcctagagactatttggcgcgcggtgattttacctacatgaggtatttttttggtgattgatgttttcatgctacaagaggaaattcgtctcaaggtggagattgttaaatatgtgatccgaattttgggcccacaatatattcggattagttttctagtaggacttcatgtctatcctattaggtgtctttctatttcccctatatataatcttgtaagccgtacgggaagaggtgacgttcccattgtgattcccctacgtttgtaatcatctcctctatagtgatcattgccggtcggcgcccgtggttttttcccgcaagggttttccacgtaaaaattcatgtctccgttgtgcatctattttcataacagttcactcctcatatgttccaccctttgtatataagctaatgtgattgggcaccaaactttgttagttggaagatcgtaagaaactgcaggttttcatagacatcctgataaacaccctagacccctcattaataccggtttggaagggctataactctcggtttcgacggttttaaaactggcactaatggccctcaagcaccgcaccagacaattccatgtgggtatcgtcggtgccggttagggcagcgaaccgccactaatactcatttttgtgcaaaaacaaatacaatcaattacttacttaatccatggtcacattgatccagaacacagctttcttgcatacacacatttatatacaacaatccagaatcactggatacaaagttttttttatttcttgcattcattcctcatctattgcaaacagtggagaaagcaggaagatgccaagtgcatctgtaatacagttatgtaatacagcaaaaattaggtgaacaaaagtttgttttattctgcaccgatctcattaaaatcgccgatcaacttcagttcagtaatcctgttttttttttcctggcaccgtccttcctttttgagtaagcatgttgtttccactctttttcttcctttttaataattgtggttctctcatcttaattggattgaaaaatcagacgccattttcttcctttcttgagactcattgttgttgatgcaactcattccctcttttctcagatgaatatagagtactactgctttatttcaggttctccagtaaatcgtgcatgaaaatctgataggttattggtcttagtctaaaatttacattcagtttgcgtgacatctgagtattctgcagttcatgacttctttaaagttgtcctgatgacaagtacttgcagttgtactttgctacgagaatgaacttgtcaagaaaacctctcaaccttaaagttagtaggaaaggttattgttggaaaaagaccattatatttcctctgtttattcacaccattgcttgtgttactgaaggttcaacgtgtcggatttttcttcagcacattgcaattctgagaagcatgggctgtatacagcagtctgaagacaggcattccgaccttacctgcaccctgatcgagctcgactaaaagtccttatggaaagtgatttatctaggacagatcaatgaaaataacaagaccagctaaaaacccagcaatcatggtggggacatatacagctagcagatgatggttcatggtggctactctgcacttgcacaatcaaatgaagtatatgaactgacctttagtttgctgcgcagccttgaggatgttgatgtttaaatgagtgtttaaaaaattaaaattattagcaacaaaacagagcatacaagtatagaacaacaaaatagatcaggtatggagacatacttgagggagcatacaccttactgtttacatgatgaagaatagttataagtgtttgcccaaattgccatcatttatacttttttttgtggaagcaatgggaatcctccaatttatatgctagtgtgttgattatatagcctatgggcatgatagctgctgtcaacagaagctttttatacaaactgctatcttactgaccaggatatatctttttggtacctggatgttgcgatcaatgttccatacaacatgaaataatatctgagtgacttgagcattgacaatgaacatttcttttagtaatagagaactggccacattattatttgctgaaagaaaaaaatgccatgggattttcagagtaagcatttgagaactacttagattatctgcctggtacatgtgagtaccttttgcattacatgtttggtaattatcacagtatttagaactttcctccacacaaatttgtatatgtgatgaaaatagaaaatgttatgggatatgcatatcaaggaaaatagactaacatgatccaactaaatttagtgagcagaaatttgatcaaaggtcaattcagaaaactgcaaccccaaaatgtgcattactttgccaatataaaaaaaactagaaaaatataccaccaccattccattagaccattactaaataacatggaaaaattacgagatataagtaaaacacacaattatatagaacattatacacattacagtaatcctaggaaatgaagacttctagaattagtatggtcctcgcaataacataccaccaagggactccaatattataaatattctcccttcggtacattattattttattaacttctagctaaatcaactgaaaggaggctctccactattgattccattgttggccttttcttcctatcttcctccaagcaggacacagccaactttaccaaagtttttgcttgcaagtagttgaattcatcacccactctgaaatctacgaactctgctaaccacaatgatttctcattgtccaatctataacaaatcatcttaataaacttcttgagcatctcatgcaccttcgtcttatcctctccaacgattaaatcaaagactcgtcttcctgacactagctcaagaagaacgactccataactatatacatcaacctttgctgttattggtaaaccagatatccattctggagcaatgtaacctatggtccctcgtgctcgtgaaacattttgattagagccagatctactaagcagctttgccaacccaaagtcagtgatcttaggttctaaattctcatccagcaaaatgttctctggctttaggttgcagtgaatgacccactctaggcactcatggtgaagataagccagtccctttgcaacgcctaaagcaatattaaacctttgcttccaat

SEQ ID NO: 68108 - DNA, 12737 bp, Oryza sativa
  unsure (1)..(12737): unsure at all n locations
gcgtcttgatataacctatgtctgctgcctgcaggtcgactctagaggatcccctgatccattctcaacatactctaagaccagcaatctatggaatctttctgagcaaaaaccatatattcttactaggttcatatggttgattcttgaaataacatgcaactcatcctgaaactcctccctattttgcgtgacattttccaacttttttatgaccactgctcgatcgtcatccaatattcccttatagacaactcctgaacctccccatccaagctcatgtttaaacctttcagttgccttaaccagctctctatgactatacattcggaaatgactagtcatcaccctgtagccttcctcagctatccatacttgagatgaccgcatctccttcctcaagacaaagaaccatgcaaatgcgaagaagaaaacctcaacaatgaaaaacacaccgataaacccatagaagtagaaccattttggttcctccccaccaatcttattcatgttacgaactgcctctgtggttattgtgtttaaatgatcacagtcaagtccacttagtgtataatcatgtatactagactgtggaatgggtttttttgaaacatccaaacttgaaggaagtttgatatacatcgttcgcacaaaaggtgttgggaaagtccttccattaaagagaaaagattttggatagcatgtaccatttccttcttggtattgaaatcccttgcatgtgcagtcacttatgcaagtgttccaacacacctcccaaggtaccttttcaatacagtgttgatcagaaccccaaaaatcagtgtttcgaagttgcaaaaatgttacattctgtttaccatcgcatgcaatttcgacaataggcttgcaaccttgtgtccagttacccggattcctcatcttataaccaggtgggcatgaacatcttggtgtaggtgaatagtggcagattccatatggaccacacaaaccatgagtcatgcatgtttgaggttgagcaatccatgaaattgtccatgttccatctgagttattcaagctatagagtctaagattaccatcataatccaaggtaagccttcttttaatccccaagcttctatcagaggcaacacgggcttgatgcttagcaagatcactcgaaaaaaattctccataatcatcaagactacctatccttgtactgttataaaggttcctattattctcatagtactggtaatcaggatctggccagtatacgccggaaacattagtgtcatcatatataagtgacaatatcgactgatcgctgaaacggaaggtatagtgactaggaacctgtaacccagtggtagagactaactttgttgtagcgagaatgcgttgagtaggaagcaaagtatctgtcggtgaatcgaaactttgccaaacaatgtttccactggagttcttcaagacaaggttaccagtgttcaataattgaacatatcgaacattagggaatttaccgtcagtttgccacacgactgtgccgtcatagtcagtgaggactatgtttccatccttgcgcagagtgatctctgatctccttgagtgcacgggacggccacggtttgcgctccatacgatggccttgtcagctgaattggagtaccaaattgagaaggtgaaggcgctagtgatgttgtaggcgttagtgatgttgtagaagccacatgagaatgtgccatcagatgactgcaggatgttggtttcatactcttcaacaaaaagagaggatttcagtggtagaatatcatgagttgcagcactcaatggtagagcaagcaaaaagagggtggcaagcccagcaagggaagtagaaagaaatggagcatccatggttgcagtcttggagagatggtctgagcttcagagattggatgagcatagcttgactactactttgttgcatgtggtgcaatgtatcttgaatgacagttctgatttagtcagaaattcacagtgcggttggtgtggcgttttggaatacttctctgcagtttttgacttttttgaagttatcctgcagagaacttctggttgggttttttttctattagaaaatgacatttaccttgaatatatagccaaaacaaacatccctaagatgcaccttgaataaattatctgcaaagagaacatttggatatgcttgaaacaagtgatcaaaatcggtattcagtaggtccctcccatgcatgaatatacagccgaatgatgatgcttcaggatgactcttatctcttcgttgaacttgctagaatggtcaaaaaaatatatggatcagttccggtcagtcactatatttgaacagggtcagtaacttgagagttctaaacttctaatgcaacatcactgtctagataattgttacgattatcctatccatgtatcattctctggattggattcttcaggtccaggttcgtgcatatgggagcaaacaatactacaattacattagcttggaaggaacaatctaacttagtgagtgtgatgcaagttttgggaagtccaaattcataatccacttctgaataaacatgattcattgcatcatattccaaaaaatatgaatgctagaaaggtattaaacatgattcataatccacttctgaataatcattgcatcatattccaaacaactgcattgttactattactggcatatcattcactgaccaacaaaacgaaaacaatcatgcgaatttgacatcaagataccattattgacatataattccctgaccaacaaaatgaaaacaaccatgcaaatttgacatcaagatgtaactgtagataacacgagctgagtagagatttgtgtatggaagaaattgccagttcttatcaacagcacctttcattcaacaagtttgctttggggaagatgatagctgtggtctcagacagggtgaagtgcgatatcttctgacctctctgttggcatctgttgtctcttccagattatgtcccatctcttacgaacttccttgctgtattctacagcagcttgctcgtaattcaaagaaagaactgctcgaagacgatgatgcagagctccttctctttgaaaaacctttccatagaaaacgattattgtccttacaatagatcagtccaaagcataaatgactgcccctagatcttcattggagctatctctgcaataaaataaatcagtgtagtactgtcaaaactaataatctatggaggactccggggttcagcaactgaccctactcgagtgccactgcattgttatagctgccaagcactatgatgcattccttcttctctaggtgcagtgccgttgctcatgacagctgattttcttagcttgcacaagcttctaagatcttcaccagatgacactctaccaccgacgtgtcaagagttgcaaacaccatagatggtcaagagattaagaaaatggtttgcggtcttctaagccatatgattcttgaacttcccaagtatatccttgtagaaatgatacacatataagcattataagaatgctcatataaattgccttcctgatcattaggctaattctctgacaaatgccactttgagcttccaacaaggccttcagtgtttgtctggcacatgtgattctataactcgtaactactttcctgattgtgttccacagtaaaccgaaatggactgtccatttcatcaatgccacgacatcctgacaaaataagacctagcattttccttcttacattatagacagggtttggatcaaccaggcatcccttactgtaactctctctaagaaggacatgctgtgtgcttcctttggttgagatgtagaaaatgccaaggtgcttaagaataagctcccgcaggtttacctccataccaaaaggtcttctgaagtgggacaacctctcaagtggtatcatcttttctactgtcaagcttaaaagttcatgaagaatgccaacaatacgtttctcgagccgcccgacattgtggattggatgcaaatcattcttatcataagccttagtatagggaagcctctgccagttcccaagcttttccctaaaaccattctcgatcttaaagccggctggcaagtttataggaaaaacatattttgtctcagattcagctaaccatttttctgtatattccttcgctcttcattcttcaacatcagctacagctagactttcatccctagtgaccaatgtcagagtatcaggggaacctagagaaaaatcagactgatggtttgttagtatagagcacctatagtcatcaggcaggccaagttcccttcttatgagccacaatgcatgcatattcagagttccatctttcattagcatgaggagcttcttcagccgcttaacaatagcaggctcattttccctgatgacagcatcttcttctgcaatcaattcagccatttttggggtgaccttacagcattcattccttttgactgggtgcacataaatgtaaaaaatgtggggatatttcttaaggaaagcgccaatctcaatatttaggccaacctcatgtctccacctggagaggagttggagagatgcaaagccattcctctgctgagatatcaactcgtgtaaatccaaagctagcctcaggttcttcagttgaatcatcagcttgtccagtttatgatctcttgttctgccttcctgtcgagttcttgctgaatcaactggttttttccacctcctctgtatggtgcaattataaggaccatgctgaaacaccgcatcccatatgtgccttctgaggggaaagacacgcagatttctttgaccaaacgctatagatgccattcagttgtatattcagaatcaggccttacttagagctcacaaaacaccatcggcatgcaaaaatggatatgtgaatcaatgtcgatttgtcaatctgcaacaaagaaattggatgcattgttatctgtaataccaacaaggtaaactaacttgtcatctgtagaaacaaccaaatatggaggactaattaattttcttttattattgttccacaaggttgtgcaaaatagcaaagaaacgcaggatgacaatcagttttggaagaagaaagtgacagaaccttaaccttgctaggcatttcgtcgaacatcatgtggtcaaggtggaggaagcaaactctaccggatggaggaaggccgtcgaacgcacacgtacggacaataatgtaggtgatgccgacgagaacaacggcgacgagagggatcgacgactctctgctttcccctggctggcgcttctgattggcttctagctagagttggggaaactggaaaaggagagcgtattggggagcttctcctgtctgccgctgattcgcctcggctctgccgtcggccagtccgccatggcgggttcgccggatagctatggaccattacttggtgtacgtcagagaaaagaaattaaaattatacattgtttttggctttttcagttatatacatactcttgaaaaaaaatagaaaaatatatacacgtaccattacgtgtgaacgcacgaccaattatttggcgtggcacgaaggtgccggaccgatggttgggacaatcccgcgccgtggcacgtggtagccgattgggaagattgtcctagccgttggtcccctaccgcgccaaacaattagtcacgcgtcctcgtaccacggtacgtgtatattttcataattctttcaaaaacatatatataactgcaaaaattctaaaaataatgtatattttttacttcttttgtcagtgtgtaatgaacatcttcccaaaacaacacttgatttttcattagtttttcaaacactaccccacattcatgaattattcattcatgttacataatgaaagagagatgaggtagttaattaattattactaattgtgatcacagtcgtatccaccagggccaccaaaggcgacattgatgccggggcgatagaggtcggggccatcgcccttgatgtcgtagcacttggggtgggtgacaatggtgttgacggggtcgtcgacctggtcggcgccggtgtaggcgatggcgaggtaggcatggatgcaggctgcgttctggaggccatcggaggggtacatgccactgcccattggggtgagcgtgtgccgccctcccggcctcctgtccagcacgtgccctcccatctcgttgtggaagctctcgatgaagggcgccgcgaacgcgctctcgtggaagtagccgatcggctcatccatcagcgacacccaccacaccgccggcccatcatcctgcatcatccactcttatatataattaatcaatttaatttctgaatactaaaacaagttctgttgctaaaacaaaattaatggtacgtcctgcgatacggattgagaagcctcctagctatccctttcccaatatatagcatagattactcatgctagctctatgtcttcctacacaagtgttagtcatttgtgatttctatagttgattttattgaataaaatgtgtggaacatgtaatttattgttatgtttgctggttgaaaattgagatgtgatttctaaattgtgatttttgggattatatatatagacttacagtttaacaagataatatcgcatgtgtttcatatggagataagcatcaaagtatataattatttaggacattataatatgacaaataattttcttataaagaaaattttattcaaaatgcattaaggtatattgtcaaatatcgtcgtagcgttagcatggatatattaattactagtatataattaatcaatctccttttattacatatatgtatcccataatcattgcaatacatatatacgtgccgcgtaccattctcttcttcatccttaaaaatatataagtatatttctagatacttaaaaaaagtatttctaactagctagcagctgagtgatgtttatacgcaatgcaacaagaaaatattatatactccctatgtattttaatgtacgacgcgccgttgaatttttaaacaacgtttaaccatttgtcttattcaaaatttttgtacaaatataaaaatatttatgtcattcttaaagaacatttaatgataaatcaggttataataaaataaatgataaattacataattttttaaataaaatgaatgatcaaacgataataaaaagtcaatgacgtcatacattataatacgttataatacggagggagtatgttttaggacagatgacctatgcaccctgtatattacgacgtgggtgaagtaggtggttccaccaaccgtggaaaacttgtcgtatttagcaccaatggcgtgctttttgctggtctggacgaaagaacactcaaggttgaagcactttaatttcacgccaccatcgttctgcatatatatatcccatgcattaattacaccagtgagtagctatagagcactgtagactgtgctgtacataccagctgacatcaccaactttaactagcatgcaccaaattaatttgtgtcatcttcttaaagaaaaaaaagagttttaagaaaattagctagctgttttaaatctagctagtgctctatctaactatcttaccactatgcaggtaagaggagtagaggactcctactgatcctgacagttgattatccatcatgtgcaatattgaataaaagaattatgtgatccttctattaatacatcacaggaaagtaataataataataataataataataataataataataataataataataataataataataataataataataataataataaatctaattagcgtactaagaattaggagattcataggggcctacatgtcaagaaacaactgaatatttatttttggtatttaattcaaacattcaattttctgtagaatatattcaaattaaataaaagtgaccaaataatttttgtacttctaatgaaaacagtatgtatgcaattcgttataaggtaggagagacactttacagtggagtatatgtagagccgaggaagatcgtcaccaaaaaattgagggtaaacctgcatatataaacaacaaattaacgtaacatacgttggtatgtacgtgacacatatggtatacatacatataaaagtgataactggccggtaacatatacacatacaaaaataaatatatagaaatggtaacgggcacgtacggcaattccgagagcaatttggttgtcgatgttgggtggatctttgcctggattggcgtaaattccctgactgttggactggcgatggcgaggagaattcagagggtcccaccccaactttccatataggaagccacgccgatgcaccgtgatatggcccattcactccatatgccgctgcaatctgcgcacacatcatactaatccatcatcttatatatgtttaatttgatgattaaattaatataatcactagtgctatactccattcgtcaaaaaaaaaaatcaaccttcctttaaaaaaaatcaacctagaagaagatttgaccttttctaatataataaatctggcctacctttatccaaattcatgatcttagaaggggtcggattgagttttcttttttctgatggagggaggatagtagtattattacttacttctagattataattattattgccagcttcatcatgaatactgtttggaggcacctaccgcttcgatgccatgcctgctccgcgaatttgaacgagttgtttcctcccaacaccaccatcttctcaactatcttgggacgatccacgcttggtttaaactgaacaatatatattcatcacatacatcagtactagtagctcttaaacagcaattagttctttgatcttaattctctccttaatttactactccctccgtgttttaataaatgacgtcgttgacttttcgaccaatatttgaccattcattttattcaaaatttttgtgtaaatatgaaaatatttatgtcatgtttaaaaacatttgatgataaatcaagtcacaataaaataaataataattatataaattttttgaataagacgaatggtcaaaatttggaaaaaaacagtcaatagcatcatacattaaaatacggaggtagtattattttctttctaacaattgcatacatacatgtataaatggttgcatttcttaaaaaactattataatattctatatgttttatatttaaaacattttgattttggtctttccatctctcgtctaaatttactaacatccatatatatttgagtacatatatgaaacatatacatgaatctattcagaatctaaatgttttgtagttataattataacgtgaaatagagaaagtagtaatcgacaatgaaaatgttcagacgtatgtacagcaccaggattttatgatctttgagcaatggattcttgaggcttggttgcttgtatatgtccacgcagtcaataatatcaccgcactcgctctgtcaattagaaaccaaagtgagacttaattagcacatgaaacttttttggggggtaaggccaatgatcactggaaaaattactgcctggaccaaaatgacctcagttgttcagctatatataaattcatgaattcaaccagatcgagtatatatgaagatgaggaatattagatttgagaattcatcttgtgattaacaaattaaacatatttatactatgatatatagctaatgcatggatatctgccaagtagtaaccttaccaatcctaaataaagaagattaacataatgtagaaattcttacctctatggtcttgataatgtcattgggatcgatatgtacaccatgaacagtagttgtcgttgaagccaacaatatgcttgctgcaaagaatgcaagaagagacctcattctctaggagtcgatcttcaggacagtcgaggatcataccgttagcaaacaagataatatggaggctttatatagaggtgtttgtggtgcatcgataagataattatgtattaatccattgctatcatttttacattactacacggaaataaggaaaggaggaataatgcttccttgtattctgtaaaattcatgattgattaattaataccataagtaagtctgctggtaaaattcaaatttcgaatgcaagtgtactaaccatattttggtggagtgtcacgccccgaactagtaccgaccggaactagcccgtgacgctccaatttaacctgttaatcgataccagtcccaggacacagtgctggtatcacaggaagacagattatcacagcaacagaggtctctttattatagagtagatgtacagtcatgttgggctgcggacagatcccgagctcacaactgcattacaaaaggaaaacggaagccgggacttggaccaaacaacacaggcgcgacttgggaaccaggccgaaaccctaaaactcatcgtagccggcttgctcctggaagaactcatcagcaggatccgcttcgtcttcttcagtgactgggggggattatttatatagagcaagggtgagtatggggagtactcagcaagccaagggaaataagtgtttaatgcaggcttcaaggaaaggccgttgtttttgcaattgattttagttgaactcttttctgaaaacaactaagtgagtgcttctcaaacgacacggttgagacagtgcgtctcgtccggtcggagtatgtgcaatgtatcagcctttagacttgattcaaggttggcacccggccaacagcttttcaaacggccacccgggcctacaactttcaaacggccacccgggcctagctgatcccatcagctgcagatttttcaaacatcgaacccctttccacaacagcaatttcacaagcagtagtcaaacaaaactacgctaggaatcacctcacatccgcccatgaccgtgggcacggctgttcgaacagtttgttaacctctgcagagggggggtacactttacccacacgacattactaacccggatcacccagcccatggggatcagccacgtcgggagacctccaagctttcatgacaaggcatttccaaagccgatacaggtttaccatatgccgacgagaggggtcccagaccaacaacaggttaggtcccagaccatactgtgccaggaagcccaggggtcctccccgacaccaccccggcgaatccacatgtctctcgacatcaaggctcccctgataagctagttactcagccaggggtgtcccattccacccatatggtcgtacttgtcttatgtttggatgaaattccaaggaatcggtccttaagtgcgagagcgggaaaaccgtacacccggtacgttccccggtccgcggttttggaaattcatttagttcacaagcaccgacccaggtgtcgggttttccaagtcttttgtaaaactcaagttttacccaagaagttgctcagattttaaatttgaaggcgcccttcggtactcgcacagattgcatgatttccgaggcgcaactgggtggttacaagggaacatggtataacaattaacaaaggaaggatcaaatgcaacaaactaggtagatccgccaatctgccttgcagacgggacaacagattaagtgcggcccaagggaaaaggagcggaccagccgagctaaatgggccggccggcccaaggtggcccaagtgcgcgcgcacgggaggggaagagagagagggccggcggaccgggctcaccgtgcgcggtcccgggtaggacccgcttgtcagcggctcggctcaccgtgcggagggagcacgcggcgcacgcgcgcgggcgggggagggacgcggtgcacgcgcgcggtctgcggaggaacggatgcggcgggcccacgcgcagcctcacggttcgcggtggaacgcgcgcacgggaggggctgaccggngtcggcccgtcccaacctcggctgagctggcgccgacgtggcgcctacgtggctgccacgcgggccgcgggaaggtagacgacgacgccgtccgggacggcggacaacagcggcgagcggcggagcgaaccacggcgataccggcgaaagcgagcacaccgggtggttgcacgagacaaggggagacgagccacggctcgggattcgccggaggaagcttgacggcggcgaatcgcggcggcggcaaccggcggggagggaagaggaaaccggcgacgaggtcacgaggggccgattcccggcggtgagagcatctacacggccaagggaatccgatgctagcgtcggattgggcggagctacgccgagcgaggctggcgacgagcgggtgctacggagctcgagcggcgatggcggcgagcacacggcgggcgacggcaacggtcggggcggcgccggctagctacggggaggctactcgtgctaccaccgaaaactaagggggggagatggagtgaggaggaagaacggagggaggcatccccgaggtgaggagaggcgctgtgacgagaggccgacggcgcgggagggatctctccggcctcgggccggggaagaggaggaagacgagcgcccggagtccccttccgcgtcctagtgcgcaccggctcctccggcacacacgcgacggctgcggtcggtgagagggacggcaatggcgcgggcgagaaaca

SEQ ID NO: 68109 - DNA, 3799 bp, Oryza sativa
actgtagcgcgctggaaaacgtccaaacgaacacagccaagtgtcgcggttggctggatggtacgcagacgtcgcgagcggaaataaatggagtcgtgctcgcggctggctgtgggggacgagtcgcgtgattgggccatcccagcgatcgatcgagcgagcgagcgatcggcggtcggtcaggttgacgtcgcgaccgaactgaattgaatttggatggcgatctcatccctgatcctgtcgtccccggctgtgtgggtcacggccaaagcgcattgaattcccccttggtatcgtcaagcagtacactactagtatatgtggctgccgaatgagaggcagtcaatcagctacggatggatggatgctttggctcttctcttatcctccatccgtcttattataagcagagacggtatttttcgtgtataacgtttgattttcgttatatttaaaacaatataaaaaataagtcacacataaaatattattcatgttttattatctcataataataaaaatactaatcataaaaatatttcaaataaaacggtcggtcaacgttggacatagaaatacacaactacacttaatggagggagtacaaattttatcatgattttcgttagcacgtctgaaataaattttttatatacaagttatttttaatatagtattagataaatagattttttctaagtttaaaataattaaacctcagtaatcacgcgctaataacttttttgttttttcccctaactttatctttattttaaaaaacgaacagcaacttactttatcttgcactgctctgctcctttcccgcggctgagcttggctagctgcgatgctgccacaccgttggttggtcctgcaccaatggccggtcgagctcgagcatctcggtcactagcaaaggacaacaaagtcatctctgctgcatcgtactactacatagtacatggacctattcaaagctagctaaagctttgagcctttgacgggcaagacgccaagcaagctgaaccccggcctggccggcacggccggccccaacatcggcggagagcccggccggccggccaacctgcgctgccgctgccaccgagatcgacctcaccgaccggccggccaccaccacgatacggttgcctgccgcgcgtcatggcgtgttggcactagcaagcttgtcacctactctctccctccgtcccaaaaaaacgaatctagagttggatatgatattttctaataatacaaatatatatatatatatatatatatatgtccagattcgtagtactaagatgtgtcatatcggtattaggttgtttttttagggacggagggagtagctaccaccgccggctgggacggtagggttgttcgtcctccggcgtcgccgtacacaccaaggggagaaagactgtatgcccggctggtcttgtcgacctccgggctgagttcgggagtcaaggtttcgacacggaaaacccaacaaagaattagtatataattaattattaattaggtattagtttatttttttagaaatttgattaatatttttttaaaagcaacttttcaatagaaaaatttaaaaaaacttactatttagtagcttgtgaaacatattcgaaaaaaagagaaagagattggcaaagttggaagaagaacaaagcctagtcctaggcccggaccccgggtgatgcaaggcttgacgtacgtacaatgctgtggttggccagcgatgtcgtcgacaagttgtctgattccatggatcaatcaattgatcgaccaatgtatatatcaaagcttatgtttaagacttagagggagaatacatgtttacagcccacaaaatacacttaggatatccttaacgtgtttaagttcaatagagatataagatgaaattcgcactcttatatcctttggtctataacacatactacaatgtataagccgagactcactaagagaaaaaaaaagaccctactcaattaggattcagagaacaacatgtatattgcatagggataaaatgttttttttttctggtctagccttaagtataagattggccatagcaatattcttttatttacttatctctcaagacaaaaacaaagcaaaaatactgctttgctttttaaggttacttcttgtaacattgtggttgctcttataatgaaacttcactaatctatcccaggcgtgttcaaattaaggagggcgaacacacggacacacacgtcatttttaaaggggtaatgtacgctgcaggacgcactcaaagcatgcacgccgcgtatcaatcttacgataatttgttgttttccgctgtactgagatgctcaactgatcgtgcatatacaaggccacaaagagaccaccagctagtttggcctggtctagtttccaactttttctttaaacttttaacttttttatcacatcaaaacttttctacacacgtaaatttctaactttttcatcatattgttctaattttaattaaactttcaattttaacgtgaactaaacccacctttagttaaaagtatgcgctgttgcactggcaagcagagctagctagcacggtcctgcagaactgaacctacagatcgaggccgatgcattatcgtccgaggaaattatgatcgaggttgcatatgcatgttgccgtgtcgggtgccggccggctttgcgtcgccctgtggcatgtgcatgtttgctagctagctactgcatgatttctaattccaaattgctacttcctctattctaagggtgtgtttagtttcacgtcaaaattgaatgtttgaagaaaaaagttggaagtttatgtgtgaagaaaaattttgatgtgatggaaaaaataaaaaattaaagaaaaagttggtaactaaaccatcactaattaagtttatttttcatcgattccacacgtatcaatacatgtaaaaaactaaaacactcttattttattaaatcccagtgtagctatatatatatatatatatagacacacacacatagatatatatatatatatatatatacacacacacacacacacacatacacatatatatatatatacacatatatatatatacacatatacatatatatatatatatatatatatatatatacatatatatatatatatacacatatatatgcacacatatatatatatatatatatatatacatagatatataatacatatatgcatatgtatatgtatatatgtatatgtatgtatatgtatatgtatgtatatgtatatgtatgtatgtatgtatatatatgtatgtatgtatgtatatatatatatatatgtatgtatgtatatatatatatatatatatatatatatatatatatatatacacatatatatatgccgcgtgtgaaatactgaaattaagcgtgcatgctgcgtaagcactgacgatcaaactacgactctgcagtttaatcacgttgtccctgttgctcccatcttcaacgtgctccaaagtcgccaacattatttatacgcgactaaggcttcccttcaaacttccaaaaattccatcacatcgaatatctgtacacatacataaaatattaaatgtcgataaaaataaaaaccaattgcacagtttgcatgtaaattacgagacgaatcttttgagtctaattgcgccatgatttaagaatgtgatgctacattaaatatttactaatgatggattaattaggcttaataaattcatcttgcagtttacagacggaatctgta

SEQ ID NO: 68110 - DNA, 12105 bp, Oryza sativa
acgcctcccgttgcaagccgcgcgcgcgtgccgtggtggccgaccgcccggtcgccgccgccgtcagtctctgcacgcgcctgtcgccagtgtcgccgctccgctccaaaccgccccgccgtcatcgccgtcgtcatcgcctcagccccgccactcccgcgctagcctccaagggacggaggcagggcctccctcctccctcagccgcgcgcccccgctcacctcctccttttcccgaatcggcaaaggggcaagccccctttctccccctccttttcccctttttcctcctcgccggcgtcatcctccctgtcgccactttggccgcgaccgccgagcgccagctcgcgcccttgaccgcgcaagtcggttcccaaaccgacattgccgcccatttaaaccccagcctcccctttcccttcctcttccattcgcctccgtgccattgccgccgcccccgtgctctgtctcgcctccgccgtccttcgccaggcgccgggagaaccggtgcgttcgaggatgcggaaggggacttcggccgcgccctcttcttcctcttccccggcccgaggccggagagattactcccgcgccgtcggcctctcgtcacagcgccccgtcccgcacggtagtgtctccctccgttcttcctcctcgctccatctcccccccttagttttcggtggtagcacgagtagactccccgtagctagccggcgccgccccaaccgttgccgtcgctcgccgagtgctcgccgccgtcgccgctcgagctccgtagcacccgcacgtcgccagcctcgctcggcgtagctccgtccaatccgacgctagcatcgagttcccgtagccgcatagatgctctcaccgccgggaatcgacccctcgtggcctcgtcgccgtttccctcttccctccccgccggttgtcgccgccgcgattcgccgccgtcaagctccctccggcgaatccgagccgttggctcgtctcccctcgtcctgtgcaaccacccggtgtgctcgctttcgcctgtatcgccgtggttcgctccaccgttcgccgctgtcgtccgccgtccgttccggccggcgtcgtcgtctacctcccgctagcccacgtggcagccacgtaggcgccacgtcggcgccagctcagccgaggacgggacgggccgaccccggtcagcccctcccgtgcgcgcgttccaccgcgagccgtgaggctgcgcgtgggcccgccgcatccgcgttcaccgcgaaccgcgcctgtgcactgcgtccctccccgcccgcgcgcgtgcgccgcgtgctccctccgcacggtgagccgagccgctgacaagcgggtcccacccgggaccacgcgtggtgagcccggttcaccggctccctctctcttccccgcccgcgcgcgttctgggccgtcttttgggccgtccggcccagttaactcggccggaccgctccatttcccttgggccgcgccctagccgcccgaggaaaagtctatcttccctccctcatccttttctttttccaaaagggtttaaataaatcctttttccttcagaccaaaaatccaataatattaaaaattcaatatcttcccaaccgtaaatccgattgactccgttcaacttccaaaattccccaaatctcgagatctatctaatggcacgcttagaggtcattaatagggctttattttcgccgtttgttgagttgtcccgtttcgcgtgtagtttcggagcccgaagacccgcagtgcgaggatttcgaggatcaagctccggatctcgagcaaggcaagccacctttgaacatcttgagcctatatttgaaatttaattatattgcttgcaaaatattatgcattgataggatcgcacttaatcggttgtcccgtctgcaaggcagattggcggacctgcctaatttgttgaatttgatccttcctttgttaattgttataccatgtccccttgtaaccacccagttgcgcctcgatattcgtgcactctgtgcgagtatcgacggtcgccttcaaacttaaaatctgaaaaacaacttgggtaaaacttgggttttacaaaagacttggaaaacccgacgcctgggtcggtgcttgcgaactaaatgaatttctaaaaccgcggaccggggaacgtaccgggtgtacggttttcccgctcccgcacttaaggaccgattccttggaatttcatccgaacataagacaagtacgaccacatgggtggaatgggacacccctggctgagtaactagcttatcaggggagccatgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggttgatccccacgggctgggtgatccgggttagtaatgtcgtgtgggtaaagtgtaccccctctgcagaggttaactaactgttcgaacagccgtgcccacggtcatgggcggatgtgaggtgattcctagcgtagttttgtttgactactgcttgtgaaattgctgttgtgaaaaggggtttgatgtttgaaaaatctgtagctgacgggatcagctaggcccgggtggccgtttgaaaagttgttggcccgggtggccgtttgaaaagttgttggcccgggtggccgttgaaaagctgttggccgggtgccaaccttgttttaagatttaaagactgatacattgcacatactccgaccggacgggacacactgtctcaaccgtgtcgtttgagaagcacccacttagttgtttcagaaaagagttcaaataaaatcaattgcaaaaataccagcctttctttgaagcctgcattaaacacttatttcccctggcttgctgagtactcctgtactcacccttgctctatataaataacccccccagttgctgaagaagatgaagcggatcctgctgatgaggagttcttccaggagcaagccggttacgatgagttttatggtttcggcctagttcccaagtcgcgcctgtgttgtttggtccaagccctggcttccgtttcccttttgtaatgcagttgtgagctcgggatctgtccacagcccaacatgactgtactcctactctataataaagagacctctgttgctgtgatattctatcttcctgtgataccagcactgtttcctgggactggtatcgattaacaggttaatttggagcgtcacgggctaattccagtcgggactagctcggggcgtgacaagttcacaccaaacttcccccaaacttttaactttccatcacatcacatcacatctaaaattttcctacacacataaactctcaactttttttcccaaattaccaactttttccaaacttctctccagtttcaggaactaaacacagcctcagtttgagaattgacacacctaggaatttttttaaaaaagaacgattcgatgctaggctcaatccacatactggataatgtcaactatcaacaagaaggagattagcataagcttggcacaatcactttcaatattgaaattaaccaacacacagagcaagtgtgtgtgcccaaaatgttcaacgctgatgcaacgaaaatgaattaagccgcggtgctagctgcatgcatgtaaatatgtaattgagattgattcgaatcgaagagcagttagtagtgatgaactgatgataataactactgatgcacatgattgacctgaaaaacaaaactctaaatttttttccctgtttctgtctcctttgtggggtttgaaatggaaccatagaaagtgcgagtcgtatgtatgcacgtactacctgcagacacgatagatgattccatatcaaaatcaacataaacgcatatacaccgtacgtatgcttgaggattagtatctaacaaggtagttatacctttgtcctataataattatattttaaaatttaaatttatctcgaaatagttatcacaatagagtatcaattgttccatcaataacttatcatttatttttttaattctacccttaaccaccctctcgctcttgcctatacattatatctagtaagggacaccatagttttctttactcaattcttaatatatgctacatagaattataattattttaggacatataaagtatatatttatctgtaggtatttcaggacgaagttaaaccgatatcattagtgcctttatgtttagtcagttgtaatcttgtatacaaagatgtaattcggagtccccctcatctagatcactcatgctattcatcgtatttagacttttttttataaataaaaggaatgcatttttaaatgaaaaagtacgaaaccgataagttaacaccgagccattttttctaagttaaaattaatttataacgagccttcttccgattagtttgtgtgaataggacaacaacaaaaacctctaaaaaaaaggacaacaacaaaaaaaaacttgaaataattaacacaaactaatttaagcatgcaaaggccaccagtttaattaaagtgcaaaaattatcatttcgtctcatatgcatgatatggcagatacaagttgtgcgggcaatgcaacggcaagcccacttttttttttatctcgtctcctcgtgaactctacatatatagagatttatcacaagcgaggaaattaattaaccgaggaaaaattacacgcagccatgcaggtagaaaaactcgaaacccacatgtcagtgaaacaattttgacgccacatagtcccttatatatatatataagcttctcgtgctttagtattcgcgctcgctcgcccatgccgcggcggcgatggcggcggcggtcggcgggctagccacggtagtccggcgttggcgcggcggacgcctgctgctggaggagctggcggcggaaccactcgatgaagtcggtggccttgtcgtcgacgcggccgtcgacggcgccctccggcggctcgacggggaacggcgagtcggtgacgcggagctgccgcgtcccggcggggctgcggccgaggctgagcgccagcaacggggacggcgtggcgccgggcatcgacgacagcggcgtctccccgccggcgccagcagcagccgcggcgtcggcgttgagcatctcgaagacgcgggccacggcggaggcgtcgagcccgccgtagttgctggcgccgccgccggcgtggcgtgagccgccgcggccgcggaacctgaaggggaagacccccggcgcgtaggacggcgtggtggtgcagctgaactccacgtccctggggttgtggtggaagaacgacgccgacagcggcgacgacgacgagtcaccaccccgcgccaccccggcgccgcctcccatgaccgccacggcagccgcgccgccgtgcggctggtgggcgaggaggacgtcgcggagcgccctgccggcgagcttgccccggccgaggagcaggtggaggtccatcatgaggcgcttccggcacagcccgcgccgcagcatgtggtacaccgcgcgcagcacgtgcatcagccgcttcccgaacccgggctccatgccgccgccggccggctgcacggccctcctgtccgcggtggcctccgtggcgccgatccgagctgacagcgacagccgcaatgcagcagtgagctgagatcgagagcggaatcgaggtgggtggcaatggcggtttctcgctttggattttgcagctttggagaagggtggtgttggatgggtgggtggtggatggaacgaatgggaagaggaggtgggggcggtatttatagaggaggaggaggaggccggaggtggtggtggggatgaggtgagctggcacgggtggggcccacgtggtagatgggacttaagaactaaggaaaggggaagggaacgttgcgagttgcgggtggtggtggtggtgcaacggtacgcgcgtgtcacggtgcgtggctcgagccgccatcgcgaggattgatcgatcgtgccgcgagcgaacacatttttgcctgttcgatctctcttggtaatcaacctatcaacagtttttcctattgagcatgaaacatcagaagaaattatcatacaattaagtattaaaatcacgagaagcaatcgaatcacacttgaaacgttttactctaatgtatgaaaacattatgtttcaagtactggatcatcaacatatcagcatgcatcaaagacaaaaagtgtgaaacaccatcgaaatccatgccacaacattttgatacattagctgaaacgtcgaaaggtcacaaaaagtaccactctagcttcatcctcctttctagtatcccctcccacatcaccgattcagaccaggttaaccccaatgccaaccggctcctagccatgcacatcgccctgcgttgattcggacttcccctcgttccttcgcggttggtacttaaggatccaaagccctcaagcttggtgtgactggattcaacaattgcttgggggaatgatgagcagggttagaaattccggaatgaaatttccaaaccccccatgcgatattatttcatctgcaattatttttttgaatttggtaagattttgttcaaatttgagtaatatttattcaaaagttcgaaaatttcagtatatcgatgacctccaatagaatcggtcaaaccgaaaatttaaaccctaatgatgagtaataaggaagaacgggagtgtggaggcgagcaagggcgcttgtctcaacagttgctaggatgggggtgagtttgggtgcggattcccgatggtggcaatagttaggcacacacatttaccatcgatagggaggaatgatgcagggcacccgattttttttttatcggtcagatcatcttccaagttgtaaaccacagccgcttttcttctctttgtgtatgtttcttagacgaattcacatcaattatttattccattgcatggggtgctagttaatttaactatagtgcatacatccaccaattatgaaagtgaagctatagtaacaataatatacgagctgaagggaaagctttactcctgatgccaattatttacacgataaaaataaaagtgaaagtcagaagagaggattatgttgctataacactagctctacaaataactaatggtccggtcgccttccaggaagcttccaagcagaacacacagtgccattagcaagttgcaaatcttgaaatatcgcgacatatacaaacgggtgcttgcaacgtccaccttgcactactggatacatacgattttgccatgcatatttggtgtggtgtactgtggtgccaagctaactttggtcccgtcgcttctctcgctaattaagcaagcgaggcgcccctggaattttaggtttcttaagtcccctgttttttcttttgtttgagttcataatcagggttcacaatcccaacaaaaatcagcctgaatttcatgaaaactggaattcccggaacggttcgataagagaaactactcagttttctgatcatgttttaaaagaaaaactaagttttacagtttattcaaagtttatctgaatttcattggtttttacgggtttactaattgttttcagggttgttcagattgatgatatttcaaaccataccaatttttgataaagttactaaagatgtgcatctattttttttcaccaaaatttgttaaatacataagaaatcctggcaaaaattagcagtattgccaaattgataaaattttggtattgtcaaaattttggtaagatttattttggttacaatctaaacaaccccttcgttaaaaccggagataccgcttgtgcggttatcggtccggtaatgggattgtgaacctattcagaagtcgagtctccttttgtatgcggcttttcatatttgatccttcaggaaatgaagtggcacagtacatacaaaaaacatgtaaattttctccaaaattcatatgttccgaagatcattggtacaccaacaattgttacacgtactactcaaagtggcctgctagctagctaggcctctatatgcgtatagtagtaagactatacaaagtgcatgcctcttttcaccaggtgaatccatcaaataaatgtactgcttcatcccgtgatgctatagcccggtgaatattccttcactgtatatgaatacctaacagcttccatttactaaaaagttgaaacctaacagctgagttaaaaggaagatggagatgtacttcacagtgcagtggtaagaagtgtgtgctttcaatccaagattccgtatgtaatctctaacatgctcataattttttttaaaaaaaaatatttggagggacgcccctctttccaaatatccttttttttaagttgaaaagaggatagatattttagcagtcctaattgcggcggctagcagctgcaaatgttaacaaggcgaaccacaactaaaacacacacaagtacacaacatcaggtcaatgcatgcaatgaagaaagctgaaagctgctaggagaagaaaaaataaacatctgctgcgaagaaaagaatataaagtttgtggcactaatactcaattatattattatatataccaaattaaagcacgccccctgcaagtggtgataagagaatgtcagcaactgatcaaacgcaattagaaaaccaaactgatcaacaagcgagtaaaaagtggctaaagttcgttgcagagtatatcgtaacgtgcctactttgctttgcattagccagctcgaaaacaacatctcctaaagccactttattaccgctaaaacgccggtgcgaaattaccaccgggatgatacggcaaattaatttcagttcccacacatggcacgcatggcagatcgaaatcaaatcaaatttataatcgacaagaccatgtcttggtcaggattcaggaaacaatatgcatcatacggatgcgtaaagtataaatatactatgtacacatgtgagttaattaatcaatcaaaatggagtatctgtgttcttttgcacagttacaactgtacaagttgataagatcaagatagtggattcgtacgtacaaaggtataaatatacggacgattggatgcttgctgaacagttttttagcaaagcaaattgaaaggaagagccagaggacgaatgggaaatgtgtcaaggaaacggaagcaattaggtctgaattattggtgtgtgttcatttatggacaggttggagaaaatggaattaatgacaaacaaataaagaaaggtttgctggtcgcaagcagggtggtatgaaaaaaaacattttttatttaaacatgctggcacatatttttctttacattgttttagcgaaattgattctaattcttcaaagatcctaagatcatcatcacagattggcaataatccatcccaaaattatgtttttgggttttctaatctagatatagtaggaagtaaaaaaactagagaaaatccaaaattaattttccaaaactaaaaagtgggtcattctattgaactaccaacagaaatctcccgttttcctctaacctcacatggaagaagatcgcccctcatgagggaaggagagaagggtcacgggaatgtgagattgggaacatgagaagcggcgtcactccctctcaaatgacgagagcgaatattacagggacaataacttcaaaagtttggaaaaagagtagggtatctgttgtactagtttttagatgaaaatcctaaaattccaggatggagaatggagtaggggcaccattggtgatgctctaaatgaatgtccctcatgtaccttttttgtcgaatataatgcaaatggtgaaatttcgtaaaagaaatttttgtagagtatagtgctatttttttttctagaaaacgacaacactgatctaatatacatgttcagtttgatactttgattaaaagtaacaagttggttgcagagattaatcataaacggagattgttcaacattagagcagacctacttaaaaaaaataaacaaaacaacctctcaaaagatgtagcatacagctagcttgttctcatttcccagtcaaatgaaaaggagagacactcccggtttttggaaaagttcaaataatataaattccttggtgttcaagtgaggaatttatctgcttttctttcttcttcctcggttacttgtatggcggcatagcttagctagctttggctaaagctagcactcatgagcccggagctcaaagacgaaggattagtactactctgctttctaagggcccctttgaatcgtaggattgaaaaaagggaggaatagaaaaaacacaggattttggtaggaatgcaagtgtaaaaacagaggattgcaaaacacaggaaaaatataggaatgaccgtttgattagaccacaggaaaaatgcaggaattagatgagagagatagactctgggaaagttttccaagaggttagagtggatgttaaatttcctacgtttttgctctagaattataggagtaggaaagtttcctacgtttttccttttctcattcctacgaatcaaaggcatgaatagtgtaggatttcaattcctttgtttttcctccattttccctccaattcaaagggggccttaatttccttggagtttattggattcatatctgaacttactttcctggctaagggagcccactgtatggagtggatgctaaggaatgcatggtttgtgagtgccttttagtaactttgctaatcatggtcggttcttggttagtttacagcaaatgacagaaacatatgccagaatattacaggttcacagctcacagcattatgctcaagtgctgagtgaaagaaactgaattctgaacaatgggtgcaactatgcaatctttgtggaactttgagttccactcagaggaaaacactacctttgacaatatttatttatttgatgggatccacttcaactgaatatccatatgcagtacatggtctatataattaattaatttgtgcatttaatgacagttttgttgccacagaaaagatttggagactgttttagctgccaaatgccaaaataattgtagggcagcaggcctggtgctcaagttggctggtgctccccaacatgtgtcccctctggtggatgtagagaagaaaaaagaggcaattccatcaacaaaacacaatcaaaagcaacactagttttaggcacttttcacccttttgccaaaccaggctccctttgcttttttttttcttcttccttgatgtgcttttgattttgatccgtcaggctaagtgcgctgtagagtgtggtactacttggtagtagtagtacctagctagctagattccacacatcaacttccaatttgtggaagatttaaagaaaaaagggggattgcattatttggaaagcttataattagctgaaatgtgctaggacagaaaaggataggagtcttgaaagtgtaattagtgtgaagttgagaaggaaaatggcgttcattcttcttttgtaaaacaagtcagaaattaattatggccatcattcttgattccatcagttggctaagattatttcaggtcattccatgctatatgcaatatttgtaatagttgattttccactattttttagaaaaaaagtagagtgaaaaaataatcttagccatccaataagcaaaatggcatataagaaaaaaaacaatataagtaaaacttttatgtatgtgttattcctggtttaaaaaccaatgctaaaaaaatgaattacgatgagaaaaccaaaatcgactacaacattaaattttaaaatttaaatttgaagggcatcttataagctagtaaaaggcaagcgatgtgattcaaaatctccttttgttgtataggctgtttggtcgtacttgcatagtttggtaacaaagtgtcatcaccttcttcttacaataattggaaagcttgagatgtc

SEQ ID NO: 68111 - DNA, 757 bp, Oryza sativa
  unsure (1)..(757): unsure at all n locations
gaggtgataagaaattagtgggggagcgtcagaaaaagagtttgggggcggcggaatagaatagggaaggttgagtatagaataaggaaggaaacatcaaagagcaaaagcgacttagatgttaatgaggcgagagatctataacggtcgacatgcgcgtgaagggtaaaggtagaggtgcggaataagacttataaagcatggatagcaagggaggggcgtgcgtacaagagggagaatatgcaataaagaaataagatgatggaaaggaaagcgagtggtcgatggaatgcggccatcgtatcgatttaagatataaagtgggagatggccgtataggtattcggcccatcgaccccgggagaggcaaaatagacttttgcggaggaaaatgatttgaaaggatttggattcggaattgaactcgacgatagatcggggattgagatcttaagatggcacggacactagacgacaagcgaagaaacaaatttcgcaattagggtttttaagagataattttcccgctaggcgccacgacggaacgggcgctacatggagaaagtccatttttctccctcaactatagggcggttttgggtcgtgtccatcaatcgtacactccggtataaagacctcctcaacaaaagaaaaaagatcaatttaactccataagcgatgctaatggtgaggtttcctccgctgtagtgttgagattcnagtcttgtngngtgcaagcgaagtgcaaataaaccac

SEQ ID NO: 68112 - DNA, 547 bp, Oryza sativa
  unsure (1)..(547): unsure at all n locations
tgtgtgcnnattgatgatgactacccgngacgcctgcaggtcgactctagaggatcccctgattcatcttcatgttgcggtgttggaaatgccgctgagatgggtgtagcctttatagggacgggtgactttggtaagggcagagaaaatgaagctggggcttcttgaggctgttctgatgaggagcaaggtatggatggtgtggcataaactaacagtggatcagttgattgagtttccacatcatatcccaaaatagtaggaaactttggtgctaatgagcgcaatggctccaagtctaagggtagtttgtcactctctgcttcatcttccgagttctccatggtgaactcttggagaaattctggcagtagcaaaagcagaagtcattaaatagtctgaacataatacttgtatgatttcagcatgatgaatgatgtctcagaatttgatatgctaagaataagtgcgcaagatgaatataaaaaaaagcattgttcagtgcaatacaacgtagaccgaagaaatcgaataaaaagaaatagat

SEQ ID NO: 68113 - DNA, 598 bp, Oryza sativa
agccatcaagctcagctacttgatcgatctcctttaaaacggtagctgagagccttcctaacctgcttcccttcatcaattctgatagctcctctgccactcaagtacaattattcccattaattcgctccattgctgcacaattaaagttagcagaagctgctaggagaaatggagaggccgggtgatgaacatgatgactgcaggacggttcctctgctggagcctaagcatgctcatggcgaaggcagcaacaacaagcaagaagaagatgaagaggaggttgggtcgttggggcggcgggtgttggtggagagcaagaagctgtgggtggtggcgggtccttccatctgcgcgcgcttctccaccttcggcgtcaccgtcatcagccaagccttcatcggccacgtcggcgccaccgagctcgccggatacgctctcgtctccaccgtcctcatgcgcttcagcggcggcatccttgtaactatcctctctacccactacacttaatactatttaattacattttgtgtttaaactaatctaaactttgttttccaaattttccatcaaataactctcaaactctgcccaattt

SEQ ID NO: 68114 - DNA, 2896 bp, Oryza sativa
ggtcacacaccgcgaccggtcacggaccggataagcgtgcgctgcgccgcattaaatgcggcctggcgcgctcgtccaacccgctataaatgcggttaggtgagtcccgctgtgctcacctaacccacacacgtggtgccaaaaccacagggggtcggggcgccccagccctcggggccgaaacgggagcgcctgagccctcggggccgacacgggagcggcccaacccctcggggagacagagggaggggtggccacgtcaccctcgggcccgatcccccccccccccgagagggtcaggccacgtgggtgaccgcggctacccaagcctctagtcacgatacccccggccccatgtcaccgacacgtacgaaaccatataaaatttatcaaaatttcaaatttcgaatttaaaagactaccatggtttttcttttaccgtaccccgtggtaagcacgattatcggcgattttgggaaccttggatgttacatatcctaatacaaagaatttgtatacattccgttcgaggtttagtttgttttgggacgaataatagagtatgtctaaattcatagttagaagtaatctttttttttatggatgaagtatataggtcagtgtcacgcccagaaattcccggatagaatttcaagcagaatgtgcattaaaatccccgtccaggaccggccggggtacacaaacgacaatgttgacattcagatccacgtcttacaaacatcataaaagtcttacataaatgcagcggaagaaaagaaagacaacaagagctaagccttgactaaaactgaagcgggaacaccactccacaggcatcctcgacggcacggacaaagcctactcctcggagaaaccttcatctgacccgaacttgaactctggggttgggaaaagtagagtaagactgagtactacccactgtactcagcaagtcataccggaataggggtatggtgcagggaatcatcaaagaagagctaaagtggttcatttgcataaagcgagcatttataaacagaaattgaaagatttaaacagttgtaataattaattaatattaatcatccgctgtccaacgctatcccacgttgcgacaggcccagccatccacctaaactatccaaattcaaaagattacactaaggtgagactaatcacggtgaatctggttgaccgcccataaccgcgggcacggctattcgaatagttttactctgatcagaggtgtacaactgtacccacaagacacagccccacgacacgtttccgtgcgccgacatgtcaccacgacataccggaaagaggccgtgacaggacccttcgcataaccccctctaaccaagcacaccacacctcagatttcacccccactcctcgcaaggcagcgggaagtcccctctcgtgcctaggtgaatccggaagccgcataggccgtcgcagggcccatccaaactccatcacgcccacccttgcctggatgcgtcggctagaggaaagctacgctacaagcccagccgttgcccacgctggcttgtggtaagtacgataagttcttccagggcatcccgcgaaccggtccttaactgccatgggtgcgaccagcaaaaccatgcacccacagcccaccatgtgatttattttaattaaccaacaccaaagcggtgttactaatccaacaaaaccattagaaccaacagtctaaacattaataggatttttccccattgtgaactagttgaactaagcatggctaagcaatccctagtccaaactctaatcatgttataaccccaagctgacaaagaaacatggtacatcaatagcatggctacgacaataggtaaacaacccatagtaaccttataaaacgatgcagtatttgaacgaaaacaatagagcatttgcattataggatcaacatgttcaagtgacaagcatgacttgccttgctctgctgctggaggaacctcgacgactatttcgaagtacaccggagcgtcggaggaatcggaatctagcgacatacaaagcaaacattgcaaacaggctataagactactgaaacagggaacaaaaccatttttaatagattctacacatttttcttgatttactgagacttgaatgggcttaaacggagctcggatgaattagttatgaattttagaagattcactgtgtttattactatacaagaaaaaccttaaatcatttattgcgcaatatattccaggactgacgtcatcaaggcggggcgcggcgccgacatgcgggccccaccggtcagcggctcggggagggaggaagggcgccgacaagcgggccccaccggtcagcggctcggggagggcggtccacggcggatcgggtccacggaccggggaggagcggcgcgccacgcggcggccgaaccaatggccccgatctacccaagggtagatcggacggcgccgggagctcggatgaattagttatgaattttagaagattcactgtgtttattactatacaagaaaaaccttaaatcatttattgcgcaatatattccagggctgacgtcatcaaggcggggcgcggcgccgacatgcgggccccaccggtcagcggctcggggagggaggaagggcccccgacaagcgggccccaccggtcagcggctcggggagggcggtccacggcggatcgggtccacggaccggggaggagcggcgcgccacgcggcggccgaaccgatggccccgatctacccagatcggacggcgccgggagctcgcggccggtgcgcgcgggcacggcgcaaaccggcccggcgaccatggcgcgcgacggcgcggcgcacatgcggtagcggcgcacatgcggcagcggcgcaaga

SEQ ID NO: 68115 - DNA, 16037 bp, Oryza sativa
tgtcatggccatctcggttgctaagacaaaaccttgtgcaaggaatcaaataagagagaaacacccaatagtcatcagattcaaaatcgaggccaggagatgctgggtggaggtggatgggttggatttccttaagacagtagggtctggatttcctagagaatgctattggctctggtgctggcagcatggacgtacgtcgggtgatggcgacggtggcagggcgacggtagggcgatggcggtgcgcaatcttgaactcggcgcgaaggacaaggtgtacaatgggacgagattaaaggtgcaatcagacaggcccctgaactcacttataatacaaataagcgggtaaaccggctgggtccgcaggtctgcccgcttacacccttagatacacttgtccttaccccctactagatctagttaccaacacaaatatccggtactaccatcatactcttttcaaattagtggtgggatatgtcactggtacctcctgtagtcctgttacctggtagtaatagcagttggtggtcctaaataaaatccctgttagaaaatagtataagatcctctaatatcccttcgtttagtcatacgtggttacattttataggatctcgaagtgatgagtgttgatgaaaaacacgaggcctgggaaatctgcttaactccagtgcatgtccaaagctcgccttcgggtatgctagcgtgccagtggatttgatcctgcaatcaacaagaaataaaggcaaagaaaccgcggttaaatctataaatgatagccgattggctaggtgccgatgacatatcatttatctttgagccggtgtcatatatgtatcgatcggcagccatgagtaaataagaaggaactaaatctatttgatcggctgtagatattaacaatatatactccttatatcgatatatacttaaatcaagtgattgggatagatcagtcgccatgccgagacaatataaatcacttagatcgaaatatatattaataatgggactatatatgttcatagcatagtcgatcagatagatctagcatgtatgggctaatactccgatactactctatattaagatattaaagcaagcagaatatatcaaacaaaagcttaatacacttaaatgccacaaaatcttaatataaagggcagatttaacatgtcagtaaagcatatataacaagtatagttaaatcagctaagatcggctaaaaccccgatactaccctaatcggcaaccaagaagcaagctagaggttgagattctaatcacgactcataagatcaaacaactgatgcagctataagtatgaaaagaaggacaatatctagacaatcaagccattggaattttcatagagtggtagatatcatgtacaatctaaaccaacatcgatatttaacctaatcggctgacctctactagtagatgttagctgattgtaggttagatgatgatattgctatatattatataagatatatgataactcgacggattacataaacaagattagagtatcatagagatggaagcactaatcccgagaacgcaagccgccataacaagttttacctcttgttgaagatcgaaaccgatgcagctcaacccgaaagcaataacttgtcgaaataaaacgaaagcaaaaaagggtggcgatgcaccaagattgtattaaacgtgtgtgttaattgattacatagggttcggggtctatttatacccgagaattacaaactatgtccatatcggacatgactcttatctctaacaaactctaagataccataagtctttgcggcagacttttgcccaaacatatctctaaggaaattacataaaatatactaattaatagatacagttgccttctcaggactctatccacgcgtggcaatcatcttgaagcatatcgacccaacccaatatcgtacaccaagtcgtattgtcggaatcggctgcatcaccaaaccaagtctgactcgaacttagccgatccaatcgtagctgatccggactccagccgatttttactctgtttccgcgataatccttatctctgattccgcttcgatctaatcttcctttccgatgccgatattaccaaatttggtcgttaacaatgagatatattaatagtcttcatttatttgaacgtgtatttaaagagacacattcacaattatgtgtatacctcttattatctctgtaactgaaaaagaaagacattgttttgtacattgggtttgaagtttgtatattaaattatactaacggattaaaattttatattttatattaaattgcttgattatattaataattacaatttcatatcaattattacaatgctttagatagatatcacaagtgacatgatttaccaattttcttccataagtttcttttctcgagtacatctaaattattaattccctgcaacacgcgggtatatatatatatatatatatatatatatatatatatatatatatatatagacacacacacacacacacacacacacacacatatatatatacatacatacatacatatacatatacatacatacatatatatacatacatactacatatacatatatacatacatatatacacatatacatatacatacatatatacacatatacatatacatatacatatacatatatacatatacatatacatacatatacatatatacatatacatacatatatatacatatacatatacatatatacatatatatatatacatatatatatatatatatatatatatatatatatatatatatatatatcattttcttcaagagaagacgttgaaaatttttgggagaatattccaaagttcaataattaccaaagagcatcaaatatggtagatattctctcatataatccaaactagcatgaatgcagaagacaacaagtcacaatatgcttaaggtaaaaatccaacttctcgggaataaacagagcgcccgtgattagaagaagacatatgactctctgaaaaacccgtgatgctacagtgtgataaaaaatatgagtgaagattgagctccctcttcggcttctataaaaggggaagctagcgaagccagaaggataccaagaagcagcaaccctcagccagagtctcatgagccactctctaagctttagtggtagaaatctgttaagagttcacattgatagtatattgaagcaaggagtgtaatataaattgtgtaaggtaagcaacccttgtgtgtacaatccctcggggttccctaaagggaaaaccatatgtattctattttgtggtaatgtagtagttttattaagctttccttgctcgaccttgttatgtttatgttagtttaaattctacgctaatgaccctataggagagatgcccttcagtaagttctcatagttcaccttgcatgcagcaggtaaagagaaccttttatctgttgaagaagtgttcccttcgggtggaactgcctggggagacggtagaatttttatctcacatgaatagacccaaggacgggattagggtaaaagcttaagctactccttcagcaaaatagttagacatatggtgagtaccgagtaggattacacatctatcgttgcacgctcggctgtcccagtggtttcgccaacccattaagatcttgaaaatttaaaaaatatatacataaatatccatggagaaatatacattaaggtaaatgcagtccactatatggattcttctgccatctttacttgccaaaatcctacttttaagtcagatttcgagaaatatcccttggatattcaactgtaagtaccgagtggactgcatagatgcaggataatactagtatgatcatccaaactagcatgaatgcagaagacaacaagtcacaatatgctgaaggtaaaaatccaacttctcgggaataaacagagcgcccgtgatcagaagaagacatttaactctctgaagaacccgtgatgccacaatataaatgtaattattttcactaagctataccgaagatcatagttggcactctaataatagtcaattaaatttaattgttgatttgatatataacttctatataaattggggaaaaagaaaagacgatttggagcaaaaggttgaagagttatataaagaacgaaaacaaatagtagagcaatattctgtttttagtactaagctaaatactgctttaaaattactacaagaatataaggcaaagcaaaataaaatttcacaaaacagtgattacatcaaggaaccaaaccatggctctgataccagcttatttctccacggataattttgctgccatgttccaaagaaaaatgcaaaatatatttaatggaacaaaatgggttaatgcataacgtataaaaaattcaattatatgtaaaatcaacataataaatcctaactacataattaaaacacgtccaatagaggcgaccccaaaggatatagaagaattattaaaggtagaggcaataagagaaagcaggagccctcatagatcagctgcatttatagtaagaaatcatgacgaagaagtgagaggtaaatataggatggtcatcaattacaagaggttaagtgataatacatttgaagatgcttataacattcctaataagcaagaatggatcaatagaatagtagacatttctcgaaatttgacttaaaagcatgattttggcaagtaaagatggcagaagaatccatagagtgaactgcatttacctgtcctcagggacattatgaatggcttgtgaagccactaggcctaaaaaatgcacctgccatattccaaagaaaaatgcaaaatatatttaatgacaaccaagaatttatattagtctacatagatgacttattagtcttttcaaaaacttacaaatagcatattgctcatctagaaatatttttttagaaaggtggaacaaaatgggttaatcttatccaaaaagaaaatggaaatatgccaggagaaaatcagtttccttggtcatgaaataggagaaggcaaaatacacctacaagaacatattgctaagaaatttttacaatttcctgatgctatgaatgataaaaaggaattacaacaattcttaggaattgtaaattatgctagaaaccacattcaaaatttagcaaagttagcaggaccattatatgctatattaagaaaaaatggtcagagatattttaattctaaagacattaaattagtaaggttaataaaagaaaaggtgaaagaactaaaacctctagaattacctttagaagaaaactattttattattgaaacagatgcatcgcagcagggttggttcctgtattaaaacaaagacctgctaaatactcatctaaatcagaggaaaagatatataggtatgcctctggaagacaatacagatcgagaaatcctagaaataatcaacgcgataaatgcttttaggttatatctagggtttaaagagtttacggttagaacggactgtgaggtgatacgtagatattataatcagcttaatagcaagaagaattctactaggaggtggatcttatttgaacaaatcattactggaaatgactataaagttgtatttgagcatattaaggggaaagataacaatttgcctgatctactttctcgtttacctattttgcaggtatgaagaaatctatgaattataatggagttgaattcttcacttttggggaagataataaactcagaatattcccaccaaactcttataaatttaaaccaaaggaccatataatcatatatgaagtgcaagaatgtattctggacaatttttggtatcaatataataatatgaagggctatatcctatcaatattaaatagtcttgctgaatattttcatttgataaatgaattaatgccagttgcaaaaaatattgaagccatacagcaaaagcccatttatgtggtttttgaaggaagagtaccaggcgtctatatatcctttgaagagataatatctcaaaaaatagacgcaaagctaacagtaggaatatcatggaagaaatataaagacattgaagaaccattaggacaagctaggaaaatattgggaataaattattatctagagccagcggcaaaggaatatattcaaaagtgcaagaggctagaaacaagaaaaatccagagcccccacattatacaaatataaaggaagaagggtcatccagaaaattgacatataaagaatgcttaacaaagggattagaccccttagatagtgaatatattgatttaaagataaatgaaaaaattgcagaagtctcgactcagtgaaagaaagatttaaaggaagaaattttcaaagaattaaagcaagaattaaatgaaaattttgaagctctgaagaaagcatatgatgagaaatttgaaatagccttttctgatgatgacactatggatatcggtggtcatgggcaaccagacgaatagttattatatataaagacctcattgataaggtattatcaattatacgggcatggtagaccatatatctatatctgttgaaaataaaaataagattacaaaggtctgtcgttatatcattttcttcaagagaagacgttcaaaattttgtggagaatattccaaagttcaataattaccaaagagcatcaaatatggtaaatattctctcatataatctaaactagcatgaatgcagaagacaacaagtcacaatatgctaaaggtaaaaatccaacttctcgggaataaacagagcactcgtgatcagaagaagacatataactctctgaagaacccatgatgccacagtatgataaaaaaatatatgagtgaagattgagctccctctccggcttctataaaaggggaagttggtgaaacagaaggataccaagaggcagcaaccctcagccagagtctcagaagccactctctaagctttagtagtagaaatttattaagagttcgccttgctagtatattgaagcaaggagtgcaatataaattgtgtaaggtaagcaaaccttgtttgtatcatcatccctcggggttcccgaaaaggaaaaccatatgtattctattttgtggtaatatagtagttttattaagctttccttgctcgacctgttctgcttatgtgagtttaaattctacgctaaggaccctataggagagatgctcttcagtaagttctcgtagtccaccttgcatgcagcaggtaaagagaacctttatctgttgaagaagtgttcccttcgggtgaaactgccttgggagacggtagaatttttatctcatatgaatagacccaagaacgggattagggtaaaagcttaagctactccttcaaccaaatagttaagacatatggtgagtacagagaggattacacatctatcattgcacactcggctgtcccggtggtttcaccaacccattaagatcctgaaaatttaaaaaatactccctccgtactcataaatgaagtcattttggacagcgacacggtctccaaatcacaactttgacttcttgtttctataaaaatatttattgaaaagtgatatatgtatacttttatgaaagtatttttcaagacaaatctattcatataatttttacattttcaaactaaaaaacttgagagttattcatgatttatattctcaaggtttgacttaaacattgtcctaaacgactttctttacgagtatggagggagtatatacataaatatccgtggagaaataagttactcggtgcgaaatcaacaagaggcagcaaaatagcaaggtgaccgtgtatctctactattataaaaattgaagatatttttaccggtacttttggtacgtcatccgtgtttgaatccgtttttaagttcaatcgcttttggaaatacagatccatgtttaaatcggttttaattttgttcgtttttaaaaatacagaaggagtcgtataagaaatctttttaaaaaacttgcgtgctaaattgagacgattggaccctaattgcggctcatgattttgtaaaaagaatatccaagcgaattcccacggtgaattttaccttagctataccgtacaataataatacgattaaaatagcattcacctgttgcaacgcacgggtattaagataatcctgtaagctatatccaaagggccaaggcgtagccgagcacgtacgttaggtatagcagctgccacgaagagaccgccgttgagttgaacgaagaaaagtcctagtcgattatatttacgtcatctcggcctggtcaaactctcccgcgaccgtatagtatgcgccgctgtccccgtgtgcatgtgctagctatcacgatatatagtacttactcgcgcatgatcgacccacaaaaatcgtttaaaatttggagcacaaactaattcttcttatcgttgtccaattttgatatagtttcgtaaccaagatttgttaaaaggggatgtttctagtttcataaatccttatatcgaagccgtgattatatttttttatttaaatctacggttacttcgatgtatatcattttggatgaatcattcttttatatattttccttgatgtcatgattcaatgtacattcagttttatatatagcaataattgcacttcataggttataaatgtatatgatgtacggatggttaaaattaaatttaagtataagaaaaatctaaaagttactactattatctaaacgatgcatgtgacttcatacgtatcaaacgttttattctttttattctaactatacatgatatatatacatactaccttcgttccaaaatacttgtcatttttatttattttttacgtttgatcattcgtcttatttaaaaaattatgtaattattatttattttgcttgtgacttgctttattatcaaaagtattttaagtatgacttattatttttatatttaggcggtgtttagatccaagggtgtaaagttttggcgtgtcacatcggatatacggacacacatttgaagtattaaatgtagtctaataacaaaaaaaattacagaatccgcctgtaaactacaagacgaatttattaagcctaattaatccataattagcaaatgtttactgtagcaccacattatcaaatcatggagcaattaggcttaaaagattcatctcacaaattagtcgtaatctgtgcaattaattattttttagcttatatataatacttcatgcaggtgttaaacgttcgatgtgacagtgtgaaaaatttttaggtgagatttaagcagggccttacataaatttttaaataagataaacggtcatacgttacaagcaaaattaaggtcaaaacgatatctattttgaggcggaaggaatagataggagcacaccatgcgtgtacgcacactgtgtaggagatgagtatcataccttagctactacggagtactactcaacatatcgtacggcaccggtaggaaattatggccggcgcagtgtctagctggctacataatttactacagaattggctatttttctaaatttatagtattagaatatctcgttatatccacataacgtatggggtatatacggaacattgggagtactagtagctaggtaggtcggtaggtgactgatctgatcctgaccgttgaatgtgatcaagtgatctgttgaaccctctctccaatgatcacattgctgcactactattagtcacgtgtttcacatgcatttctttgaaagaaaacagtgcctcatgttttttgttagaaaatctttcatacagttgattagttagttcgctaatttgttgggattagtcatcgtcatgtaacgacttgcacaacaaactcatttctaatttgctctctctttgttttgccgccgcccacgcaatgtatatatctactgcagattccttccatgcatgcatcttaattaacttctccgaattcatggattccaaatgaataatgaataagatgctaagctaggtttaccaattaattggctaattggcaaccaaatggctaatcatcatcaccatcatggcatcatcatcaaattttctaaacgttgcaccggaaaatcaacctagactggaattccttccaatccttcgctatagctagctagctaccacaacgatccaaaagttttgtcaaatatttagaacggggatagctaggcagtgtcgacgaagatgtgatgtgatctctgaatatctgaaccgtcgtctgatccacaaaaagcttcccggctccggacgctagctgctccatcccatcaattctctccattctcgcttgcatccagccaaaccaaattgaccgtggactgatcacatttatactgctacatcatccgccgttaatatatattttgagagaccatatcattgatagatacatgcatgcatcctactaattcgcccagatcaacggccggtctcgagacgtactcgccggtaatttgccggaaattgttatacgttttccaagggaagatgtctttttttatgccatctaaatagttatgaaacattttgattaattttcttttcacgggatagattaatatacgatatgtatcactctgtaaatatgcatgttcagaatttcaacccctacatgttattgtaaaatgataaatatgactgtgaaaatgcgtagactagtagagttttttttttcattttgttacaatgcaacttggtattcatgtttgtaaagtaatatatctcatattaatatatcttataaaaaattatatttttaagttattttggtggcttacaagaaacgatgggatcgatatattccttcgaggggaaaacaaggaacatttcccaatttgccattaatctactctcactcatcacagtcatcatgctagttgatctgcacgctgatccgatccggccggaaatttcgaacttaattagcacgtggattaattagttggcaaaagctaagtacaagtcattgtgtggtcaattgatcgactgatctgttgctccccgcttctgcggctttcattggctataaatacgcagatatgtgctcactgcctagctaccagtcttgcatctctaactatatatacacatacatgtagcatcctgctccatcttaactagctactactagtgatgagcagaatcaacctcatgcagtaatatgctgtgctgatcgaattaatttacacatatatagatagatagatagatagatcgttcgaccaatcgagctagcttgagcaaactgattgacctggtgaagtggtataattaacgagcagatcatggaggattgcagcagctggatccatggctacgccaacgctaacgccaccgccggcaacaacggcttcatgtgcggctacgctgccaggtaggtgttcaaacatcttgatgatcaccgtgacacgatcgatcgattgatcgcgacgacgacgataataccatctgtaaattagtcgtctctgttcttgagtggtttggctgatcagttagttaattagctacttcgtgtttgcagctgcagcccagtagagtttcagcagcagcaacagctggtcggctcgcagattgagcaccacctcaaccaggcaagcttgatttgcaatttattcgatcaagaaacaatgcataaaatcaaagaaattttaggatttaatttggtaggtgtcgcgttttattacggcatgcagatcagcatgcagatggggatggatgacgagtcggcggtgtacgacggcgcctccatggtggacgtcctcctcatggcttcctcgtcgccgcaccaccacgccggcgccggcagcttccagtactcctcgccgacgtcctcctccgcctccttccgctccgcctccgtctcgtgcagccctgagagctcggcggcggcgacgacgcacttcctcggaccgccggcgccgtccgcggcggcggcggggttccattacccggaggtctcctcgcaggcgccgttgccactacccttgccgccctacgagccgcagcacggccaatacaccaccgtcctctcgccgccgccgccggcgccagagttgccggcgactactacgccggcgaccggcggcgcgttcaggcggtacgcgcggcacctccgcccgaggaggctgcccaagccgggagggtgcgggcagaggatgttcaagacggccatgtcggtgctcaccaagatgcacgtggcggcgacgtacaaccgccagtactactaccagcaggcggcagccgccgccgcgtcggcgtcggcggccgaggcgccgccgtccggcaaccagctgcagcacatgatctcggagcggaagcggcgggagaagctcaacgacagcttcctcgccctcaaggccgtcctccctcccggctctaaggtatacatacatacacgtatcaatacgtacatttgtacgtatacacatgcatgatcattcatcaacattttgttcttttgattagtgatcttgactagtaatatttgcttcaatcatttcttcctttttaatggtagaaagacaagacatcgatactgatcagagcaagagagtacgtaaaatctctcgagtcaaagctgtcagagctggaggagaagaaccgggagctagaggcgaggctagccagccgccccgccgccgccgccaagaacgacaaaggcgagacggcggcggcgccagcgccggaagccggcgatgagacgaagcgaaaggacctagtagagatcgaggtgacgacgagcggcggcggcgccggagcggcggatgcggcggcggcggcgggaggagatcaagagacctgcacgctcaacgtagacttgcgcggcggcggaggcggcggaggcatgagcacgacggacgttgtgctccggacgctgcagtgcctgagagagcagatcggcgacggcgccagcctcgtggcgatgagcaccagcgccggctccggcggccgcccgcctcgtgcaaacctaacattacagctcaaggtgtaattaattaataaaaaagcattctactaaagaagttaaaggaaaaatctgtctcacatctcagtgatcagaaaaaaaaaagaagaaaaagggaggtgccatcagtgcaaaatagcatgcatgcatgcaagcacattgttgacagcatgattgtacatttttctctcttaagataatggaaaaccttacacatatttcatactagtagcaattgattcagctggcatatgtggacatgcactgttcttgacagcttgattaattagtcttgacacttcagttaattaattcactctgctctgctgactatcctgcgagccgcggaaaagtctgcatgatgaccgataatgatggagggctaataaacatggcacttctgaagttagtgatttcaggtcaacattaagaatcaagcgtgcaagctgactattataattagttgtcgtacgatgacgtgcatcgtcagccataattagcagacacaaatattatactctgaaaagtaaaggaccgtgatgtcagactggtaaaggaattctacaccactgtaaaaatcctcagcaacgttcgtacgtatacacgatcgcatccatgaatcttcaggagttgaaatttgagaaatacgtaacggcgacagttcctttactcccttgttctatattacgagtccttcggaccttttttcgttattcaaattcgttattttaggttatgtatttaattttaaaacagagaagacatatcattatagtttgggcccatgtgtcagacatgtacttactagattatctaatcctacttgcctccttgtgcccgcaacgcaagcccccacccaagaaaatcagaaaaaagaaattcacaaaatgacctcgtgctttgtttttcagaaaagtcctactaccaacccatttccagtcataggggcaaagagaaaaatttaatcttcatatgatcaaatcaacatgcaacgcacggttatgctacaacagggagttaaaaattgtagtttttgttagtaaaaaatatatagctttctaataaatttgcttgttctggttgcatcctttaaaatgtatagctaaaattacagaaaatgacgattttaacttaaataaccgcatacttttaaaatatactcttaatggtctattcaacttacagattatggactctcacagatagtggtgaaaatgctacagaatattctgatcatacctgctttcttttccctttttccgaccatgttagcattatcttgttttcatccagaatttcgaagaggcaagatgtaacttttgaaaaacaaatcaccaacattttctttagaaatctattaaaattaactttactgctttctaatattaattttattcatttatgtcctcaaatgtttttgtcattaggtcagtttcatccctataaaggaattgggcccaacttatttaagtcatgacattgttcgtgttatgctaggtgatgcagtgttagcgagagaaaattgagattatggcattatcaaaggtgggttttgccacaatgccattcggcagattggtttcgttgaattgccactctcaaaccgtgtgccattgctggaatgcattctctcatgaaaatacccttggacttcttacacaacttgttttcttaccatgttagtttgctcatctgcagaatggtattttaacgaaacccacttttgacaatagcgtagtctcaatttgcccgtagtccgtctaggctcatgtgaattattcatcgaaattatatataattaaaaaataaaaaaaattataaatattgtttatacgtcatgtttgatacaactccacatcttaaatttgcgctggatttaatgtttgtatgttaaagtatagccgtttaaaatttttatcttatttaaaatggaaacaaactgattgatctaaatgttatcaacataataacgaatttagatctatggatttgtggagctacgaatatatatatacagcttaaaaaaaactttgaatctgaagccgtgttaaaaagggccatttagttatgattgtttggtctctcaatttttttctaggtccgccattaacgatgacgggatcaaggtaagaggccgggacagccaaggacggcaccgtggcatgcaatgaaaggtcgtcgccggcgacaccttttgtcagcgccgctgcgcaaccgccgagcgctatatatagcaagctagctagcgagctagtagctccggcgacaccgagctaattaataaccgacacataccgctgctgcaagtttcgacgaggcttcatgcatgcgtgttgtctcactcaccgacgacctacgtacatgccgttcgtgcagttggccgggtgcagtcaaaacgaagtagtaattggtagtatggtagctgcggtcgtaacatgggagcagtatttacttgaattatatgtacacttattggggtacgttgaaatttcagcacgaatggtacgtataaatgatgatgatagggcgcgctgacagatgttttgaaaaccaccgtggtatgtacgttaggccttgtttagtgccaaaaattttttttcccaaaaacatcacatcgaattttggacacatgcattgagcattaaatatagataaaatgaaaaactaattgcaagggggggaaatttagagacgaatcttttgaacctaattagtccatgattagccataagtgctacagtaacccacatatactaatgacagattaattaggctcaaaagattcgtctcgccgtttctaggcgagttatgaaattagttttttcattcgtgcccgaaaaccttttccgacatccggtcaaacgtatgatgtaacacaaaaaaaattttatttcgtgaactaaacaaggccttagtagttagggcctagctaggttcgtacacgactgggctgcaggaa

SEQ ID NO: 68116 - DNA, 820 bp, Oryza sativa
atgacgctagctagctcgagccccataggtggaccatgacacaccatgaattggtaggggcagacaaatacacggactgctgcctccaatagggagacatggctaaacaagacgagagaatcaacttaagctcattagggcttatctagtgggaagatgtcatgctatttgcacgcttgatcaaccactccgttgtgcaacgtgctctgccgccgtctttccgttgtccttgaacgacataaccaatgctgttttgattgtttaattaggtcgctgatgacgcgtgttaattaagtaggcgccattgcgttttcggatataggtctagcaatctgaagcacagttcttcctcagtactgaattgtggacaagacgaccattaatttgtcattttggttggagtcgtagagattagttgatgaagcagctggtttgtcctgaagtatttgacaaattgagcaagaatttagtcagtattgttgtttgaaagtacaattgatcagcgtactatatgtacaagtggtgttatgcaagctactcctagctgcagggcactcgtttggcgccgatgatcagagccatctcaatctactcgaaaggaatcttgagcaggcaaaggtatattccgacctcaactgtaaagtttatctaatcctttcaaaatggataaggattgaaactttgaagatgcaaatgctagctagcccaccaactagtcctttgcatagtacaagaccaattatatatcagcacattcagacaagaacaaattgtttaatttgtaaggtccaatgaatcaacgacaaagtagcatgtttct

SEQ ID NO: 68117 - DNA, 643 bp, Oryza sativa
aaaaatgaaatgggttgaatcttaagcctcggggagtaaccggaaacataacaaaggcacagtgccatggtaacagggatatagattagctgtgaagaaatagataatcctcctataagtatgactgaaataggtaactacactaatttggcacactagtctaagatactaagggaacagctttaaggttcaaaccttgtggcttgaaaaatgaaagacacgcaaagataagtatacagtttaagctttgtgtacgtaccttcacaaggcttggtttcaactcccttgattgatacccccgatcgttggaaactttattacttgtatctacagagaaattcctggtagaatggtttctacaccagccggctatgaactaaaagcaggggcatgaatggaacggtgaatttgtaaaaggggtgtaaaatgttgtggtgaaggaaaggacaaaggagagtacctcaatatgtgaactctggatcctgcacaatgtagagaacagtaacataagtaacattagtcacttttgactagcaagaagcaacctcgttaaaaactactctcagtaacaagaacaacaacgctaaaagctcctgatttaagaatgcatgttggatcaataacaagttttgttatctatcat

SEQ ID NO: 68118 - DNA, 631 bp, Oryza sativa
ttttgcggggacttaccccacctttttataaacagatggaaacttgtatggatgccgtccgaatgacctcctgataggacggcccatacctaccttcacttccgccggaagcatacgccacgtgggccattgtgtctgcctcaaacctctaatcatagatactcctgatcccatgtcacccacaaaaacctatacaactcaaccatagagcactaactctccaaaataaaaacaaagcataaagggtgaccatgccccaaaattgtattgcatgtgtcactcttttttacatacggctcgattctattcataccccagaattacaaaatacctccataatacacacaactattatctctaacaaactctaatataccataaatctttacagcaaacttttgcccaaacatatctctaaaaaaattacatacaataccctaattaatagatacaattgccttcccaaaactctatccatgcatgacaattatcttgaaacacatcaacttgaaccctatgacttacacccagtcatattaataaaaattggctatattaaactaatcggctgtatcagctaaccccctccaactcaaactatatcaacctgaccttaacccatttggactgc

SEQ ID NO: 68119 - DNA, 642 bp, Oryza sativa
ttttaatcttttcatgcagcgtttaagttgatcaaaggcagcctccaaattgctgatttattttctgggattatttgtattttgctggcgagggaagggggtaaggggtgcacttttgttagtgaaaggttgagtatggcattgacacaatgggatcagtagtatgtcaaattctgattaataaaaatatacctcggtaaaattccttcccacaatcttcatttccaatagcaacatacttcagtgggaaccgttcgggatgccccattgcagatctaacagagccccatgttgattctgcgcttccccttgaaattcaagactatccaatacatcctataaatagaaaaaaaataattgaacttaaagaatgacaaatgcatagaaaacattttgttttgctacgatggcatctgcaataaggaaaagtcaaaccggaataatcctctacccagttctatttggatgactattcttacttttggcatttaacgtaccttaacaaaaaggttcaattatgatggtatcaacttcatcatggtggcttgatccctaaatttcaagggaaaattgtaagctggtaatgggcatgctaacaatgaaaaaaattttgttaaacaggaaaatttaaattattagaat

SEQ ID NO: 68120 - DNA, 26965 bp, Oryza sativa
tgggtcatatctctatctaaattaagtttttttttaatggagtactcagcaatgatagctgagtagttgagtagatgaatcagcaattgatatgaaataattcatgttaatacaaggaattatagctgtcatgcccgtgagcaatcaagaaggatttgctgctctagctagtggccagaatgcgtgtcgtgtttgatttacctacaatactcttgtatacatgtatgatagaatctctctccaaccatatctttttaaaaggacagatgcgttagagacttgtattccacgatttttatattttcagcagacgccttgcctaccatgttaatatttttaatggtgcagtaacagacccgtcttccaattaataatttatcttctttgctatagcaacgtaacgaccgtcaaatgttcactgcagagagggatgacctcatccttcgtgccgtctgtatcaggtgatcaattttattaggaaatcagctaagctgcccccaaaagtaaataagattagcttaaggtgataaattagtatatagtaatcccaaagtagcaagtcagcaagtggttttattattttaaagaaggacggaatctttccgcttcccttactagttaagatttgcaaccaaccggcaatgcgatgcgattagaccagaccactattttaacgtttcatacacatcaccctacaagatcccgaccatagtgttttgacgacttgacctaggtttacatttgcaatatcttaatcccctcgaactcccaacggtgcaacattagaaaaaaaggtgcgcagaaaggaacttaccaggaactgtctcgatgcatgaattttggcggggaagcagaagctgaactgacgactgttcaaaggtccaaggaaaatgaaggcctaatcctgatccatgtcccccctgcactgcgagtgtcctgccaccataaaccggagcctgcaacagctgaccagaagcaaggacaagaatgcagagcagaacgatcaaactctacatacctggacgttggattcttagctctcgagctatgtgaaatacccttctcatctgtggaaaatacacaactaaaggggtggacaagattgaccagagactcttcttcatcatgcactgccgtcatatgcaatacaatgttgatatcatcatatacggcgtaagacgaacatcttccattgaaagttacagcacattagtagtctcctttcaatcagtaaactgttgtgaaaactggaaagtatgcagttaaaatgaagttatggcccttacctgggatagcaactccattggctcctgatatttccacgaaacgggaattccaccaaacaagtaaatttcataatactgcttacttgagaatagtaagcaagtcataatcctaaagcattggtattctctccttgacctacatgtattatactggtttaacgagacatagagaagtcatattgtgtcagtccaccatatatagatgcaatttcacatagactagtcgatagtattacattgaatagaccatggggaaaaacaatattccaaccagatggcaaaactcttgccctgcctccaatccgtctaaaaggaaaggaagaaatgtgcgcacgttttggaagtcagttgctaaaaaataaggagtctactactctattctgtactggtcaattatgatgcatgagaggaaattagttaaccaatcaggcagtgcggtaacaaaatcccaaggtcatcctaattcctaagggaagaactgaaaattcattaaccaatcagcgagtgaggtaagccggtaacagatttcagggcacggtaggtccacgtcaacactctgtaattcactaatttatgcctcaatcttccataggtaaaaagtggtaggctaaccccataagcccctccaggcctccactaccaaaaaaaataaacacacacacacacacactgacacaccaacccccgggagagagagagataggtcgttctcaaaagaactccagacttcatgagcattcttactatcaaagctttgaagattagggagttttgtcgttgctcgatcgacacctattagacatcgtcactttgcttcattttctactcgcagattatacatcatggaaggatctcattacacgaaaaaaaaaagatactttccccttgtcgcttgaatggtaaactatatgaaaatgacagtcagagaggaacaattggttcatctgttaccaagataatcgtatagaaggaagaaagttgcttgcttagagtggtggtgaccttgagcaactgccaccttttggtcaataggagtggctctaaattaacaggaatttgcgtacagtactacagtggtgtattaaaaaagaacccgcttacatgcctacttagacaagccagcttctagaagtttattgctttaactacatatgctttggtcccaacaatagtattacagtgtacgtttattatgaaaagttgctcctttgcatcccttgtccattcatttgtgagcatgtgatgcggtaagcatttcatctatatacattagcttgggaggatctctgcacgatccaggcacattgccaccttatccaactccaactcgggaacacattactttggtttgaaccgatgaacccaataaatctcagttttggttttctgtttactgctcaaaggcaaagaccaaaattagtgttggccatgagagctatacgactatccatcgtagctcattataatgcggatggcaaatgtcatgtaactggtagtagtaggactactaatttgccatatgtggatggcaaatctgtactgattttgcatgatatagagcaaaataacctccataatgtattgttagtgggacaaagtaagcagcagcagatgctctgcagaacaagaagatgggggccacaattgtttcgaacgctatgtgaaccagtatagaaagcacatggagaaattttcattggcataatggcgtttctcaatgcaatgcagtctgtatcccaaaaaaagcccatggtgaggaattaattccgcagttcagtatagagtagcacatttccaaatgcaacgtgtgtgccgggtcagagcagcacatttcctaaagcataagcttaaacgagtggatgcaaaatgtgtgtagcaccagaagaactcctgcaacgtagattgtccagtctccactctaaacatctccaatccaacacccaaacaccctagggaaagtctctaattactttggtccgatagcatcctgtgaaggttacagcgtaacctactaatcaggtccccaaatttcagagaacctactaatcacatccccaaattttagagaagtacagaaacgaattaatgcatcaatctactgtctagaactcaaatcacgcgacaggcatcacatcacattgatccgatcaacgatcgatcggaacgcgaagcgcgcgcgcgcgcgcacacccatcggaatctccgagcacccaaacgcgcggtagatcccgcaaccgagccaccagaaaaaaccctagggtgttcgcggcggattgtaccttgagcggagccagcccgagagcccgccatcgcggcggcctcggggaagacgaagcgcgggtggaggaggccgttcatccatcggcagaatgccactcccctcgggccagaactccggcgtgctctgctcgccacccccaaccgccgcggccgccatcgccgccgggaccgggagcgcgagcgcccgagaagaagtgtgggttgggcgcgggttgccgaggcggcggcgcggcgtgagttgggccgagatgtgccctcttgggcccagcatatatatgggcctcgagtcaggaccgtctaagaaagactatgggccttactctcgtggcccatccaactcgaccgcattttacaaaaaaaaaaaaaaaaaaaaaaaagagcaaatttcagctaacctcacgtttttgcataaaatcctacttcctccgtttcacaatgtaagtcattataacatttcccacattcataatgatattaataaatctagatcaatataaatgtggaaaatgctaaaataacttacattatgaaacggggagtacgtattataatcagtgacacgtaacatgtgattctaaagtttcacaaaatcctacgactatatatttggtaaacatttacttaaaatttcaaaacatagaatgcatataaaactttgagtggtcgatttcttgattaagattatcagtttaactcttcactactttgaaaaatattgttttagatatgttgaaatcaattgcattttttttaaaaaagtaaggttttattaaacatttagacataaaacatgtagttatgtaccccaagtcataatacatgacttccacgtagaagttaactgcgagacaagatcgttgttattatggagcacaaagaaatcacacacaggtaacagggcattgattctcaactcctgaatcaagtctagtttttactttctctctaccaatttggtacatgaaaacaaggggaaaaggctgcataacgttgacaaaagttggataaacaagagggattcgctgcaattcacagccctggatcatcgctggatcggatccaagacttcctgtggagccagcagcgcgtgaaacacgcccagtcgccatctgaaatgaaaaagctcttccggccccagaccgaacttaacaatgctcacttgacacggctcgaataaacaatgcagtgtgacagcacagttctgcgtgaatcacacactcagatcctgcaaaaacgaatgggaagtatctcagttttcatacaagagctgcataaaaaaatgaactggaaaaaatggaaatagcagataaaagcaaaattgcagggcatgaggtacttcaggattcctgattgtttctgtttcagtgacctttcaagttaacttattaggtggatcgtgcgcaactaaacaagacatgttgttgctgtcttgctgagtatatcatctggtacagtggtgaactcaaattcccaattttctacacatttacgaatggttaattttctacaaagaagatttgcaattgtcgatgtaaaaatttcaagactaaacatcatgaagtttccaggtaaaagattgacctaacactcaaatacaagggaaacatacaagaaatacatgcacacgtaaagcatcgtatgaagaaacaactgacactgaaaagggaagctgtaaattgccattatgatactgtacgaaatgagatggtagtggttagacaaacaaccaaatagatgacaaagtaaggagtacaaaataatttgcatttgcagtcaacagttttagaaataatttaagaagctccctctaagaaagaaaaaaaatatagagaagcggttgataagtccaggtccaggaatagtgtatctgccgggaacaaagaaaatggaaccagaacaaattgcatcaaatcttctgaaaactacatttgaattcagctcgttatatgtatctgtgttttcattatctagttcacatttgacgcacaaattcaatgcctcgattgactgcgtcagcaaactaataagtgagttcgattaaattgttggttagctggacctaattccaagagaagtggtgaatgggtggcctcccacaacttcccaaactacatatctcataaaaactacaaggacctgttgatccatagatttccatcaaacatatcagtattttgctccttcatgatatccatgtcttttggttgccattaataatttggcatcaatgacaaccagacaaacaccaaaacaatcgacaaccagcagtgcagtgttatatcaggcagtaatgagatggcatgactactacgattctaaaaatccctccgtttaacctgactggctgactataatgaatgcttgatatcacaactcacttgtacagttgtacttggattactatttcacccagatcttattgaaattttctgcattcctaaaagtttttcagatgacaaattcagatgtttctttcctttgttgctacaagccattgataaatcaggtaagtagcatgacaaatcatgtaaatcaggtaatgtgtgatttttttttagataatgtatgaatacaagagtaagttcccagtatccatggagcaagcacaagttaaacatgtactagcaattattatgatcaaattgagatccaaaaacagcgccttagctgctctatctactactacacaattaaagtcttgcaaatcattttagcaaagaagcgtaaaactgattgtgtccacattaaactgtaatgatcacaatacaaaagaagagattaacaaattgtacacaattcagcggtaaaaacagaaattcatacacaatactgacatttgtaggaatggaccaagaatgaagaatcggaaggcaacctcgaactagtgagccggctgcgggggcaccggcgtgtaccagcggccgacctcatcatcgacgttctcctccgccttgtgcagcgcggcgtgcagcacaacgagcaggaccccgatgagcagcgaggagacgatgttggcggtggcgccggtgagcaggaggaggacgagcgtgacggcggcgagggcggcgagcacggcgccgtccccgacgacgcggccgaagagcacgatcggctcgtcgcgtaggaagtagaggacgagccatgcgaccatgcagacgaggaacacgatgagggaggccgggtgccacaggagggagaggaagacgacggcgaggaccacgatggcgtagttcatggcgtagtgggcgaggttggcgcgcacccggaggtaggcgtcggcgaggctcggcggcaggcccagggcgtgcgggtccgcgagctcccgccacggccgccgcgtggccagcgccgtcgcgccccgggccttggcgcgggagaagaagtcgagcggggaggccccgccgccgccaccgagtgggagcggcggcggcgcggcccccgaggaggaggaggaggaggaggtggggattgtgccgtacttcgacatgggagatggtcggcggcggcggcggggggtcggatccgggaggggaaggggaagggggggatcgggaggaagaagatgaatgggggaaggaggagggggatcgtggggagatgagccgtactaactggagggcgtccagtggcacgacaagggaacgtgactctcgagggggttccggatggcaaccgtcacccgttcttttttcaactttgtgtccgccaaaaaaatactaatttgtatacttcaattttatttttttttctcattacatgacggacacatacgcatacgcatcactatacacgcacactcacaaatgtgtcgaataacccatgatctaagaaacatatctctaatcttaatatacacctattgaaaactcacctacatgtatataatatttagggaaaattataaccataccattataattttgcaaaatttgagatatgccatcctgacccacatgtcattgaatcatgtgggtcctacatatcattgagataccgatagcatatctcaaactttaaaaaattataatggcaaattataatatttatggtactgagatttgaaccttggtgcgtttcagcaaaacatctccaattatttgaatataatgtagaaacttgtcataattttgacaaacatattttgatgtcctgcgaatatgtgatattttgcactttatttattaggtgtgatctaatgtatactgacattcacaatattacaccaaattatgggaatccaatacacaaaatgctatattggtctaaattttgttttcccttggcttttaactttatctgtctttgtactctatttcgttcctataaaatcggttactatcccatctctcggatatgcagatagttcactccatttgtcgcgagattgtccatgtaaccactatactcacattacgccaaagttgtatgtgcatgcacgtagagctagtaactagaatgttaataaagaataaagttgaaagaggagaaagctacaacagagatagatatgaccgtccgaacaagatggcgccatccttaccgttgctaggtaccataaagttgctgcagcaaacgccgccacctacgtcgtgtccccagtttgcgcttctagctccaatatctcggtcttcttgtcctcccttcgcagcttctttgtcaacttactctcgtccatgccaccgcttatcactagctagctagcagcagacaattcacggcattgattctatgtcgtcttatgcgtaatgcactcaacaacgtcgcaagatccagaagtactcacggtgggaggacgagggaagccacaaccattgcgctaagggaggacgaaggaacgccaataccgacattgctcaagctcattatcatcatctccgggtgggagaatcagcgcatataaccatccccatctcttcttcctcctcttttcagcttcgacctgataccctaggtatcaactaatattatttaggtatggtattgataaggaaatagctatgcgtccgacggatttgtacgacatgcatccgattgcggcttgcattggttcgctggagagaagccaaagatggtgattgatgcacatggtatggtcggacgcgggtcgtacgaatccgtcgtacgcatatcagtgctgtattgataataagatattatatagttgatatatgtgacgagtatctacgagtatcaccaatttctgaactatatttgacgtgttcctccaatttccaaccaaaaaaaccaacctttatgtcggcatgtcgctatcctatgggctttgagcccacaagaaaatagatgcgactgatcttgggccaacacatagcccatactccaagcccacgctactggtggtaggtacacgagtaaaacaaaacgtgttcttgcctgcgtatatacggtgtacgtacacacgtctagtacacgatcacacagtcacacgcacagatccacacgattccaaactcccaactctcgactagaaccgactccaatggcggcggcggcggctgctgctccgcccttcgccgccggcgactcgccgcccccgaccgggttgttttctcccccgcaccaccaccaccaccgccggcgccgcccccgcgccccggcgttcctccgcctcctcccgcctccacctcctcctcaccgccgcgctcgccgtcgcgacctcctacctcctcctcatcctcccccgcacgcccctctccgccgcgccggcgcctgcggccgccgcgcgggcgcaggtgaagctcgagaagccggtggtgatcctcatctcctccgacgggttccgcttcgggtaccagcacaaggccgcgaccccgcacatccaccgcctcatcggcaatggcacctccgccgccacgggcctcgtccccatcttccccacgctcacgttccccaatcactactccatcgccaccggcctctacccttcctcccacggcatcatcaacaactacttccccgacccaatctccggcgactacttcaccatgtcctcgcatgaacccaagtggtggctcggggagcccctgtgggtcaccgccgccgaccagggtatccaggccgccacctacttctggcccggctcggaggtgaagaaaggcagctgggattgtcccgacaagtattgccgccactacaatggctcggtaccattcgaggagagggtcgatgcgatccttggttactttgatctcccatctgatgaaatgccgcagttcctgacgctttattttgaagatccagatcaccaggggcatcaggtgggtcctgatgacccggccatcacggaggcggtggtgcggatcgatgagatgattgggaggctcattgctggtctggaagaaagaggagtgtttgaggatgtcaatgttatattggttggtgaccatgggatggttgggacttgcgacaagaagctggtgtttctcgacgaattggctccatggattaagttggaggaagattgggttttatcaatgaccccgttgctggccatcaggccgccagatgacatgtcgctgccagatgttgtggccaagatgaatgaagggcttgggtctgggaaggtggagaatggtgaatatctaagaatgtacttaaaggaggatttgccttctcgacttcactacgcagatagttatagaatcccaccgataattgggttgccagaggaagggtataaagtggagatgaagcgatcggacaaaaatgaatgtggaggagcacatggttatgacaatgccttcttctcaatgagaaccatatttatcgcgcatggtcctcgttttgaaggtggtagagtcgtgccatcctttgagaacgtggagatatacaacgttattgcttccattctcaatttggagccagctccaaacaatggttcatcttcttttcctgacacaattcttttgccgagtgaatgatcacatatacatgtgactgctgtggttttggatgagaaaggtcttgctgttggtatcctcctttagtcgtaattgcacttgtacacttatcatattagattcgtgtcactagtggctattcactgcctgaatgcaaatgctgctagtagagagtatctttgtccttatggacaacatttgctgttgttatcatgtcttatccttagcggttttcttatgcttaaattttcatgcaagttcaattaagctcgcattctctgcttaaaatgatgtccatcctgttgataagagattaaccagtcctagttctatatttaatttcagccaaccttttacccactgataataatttgatttatgtatctcctgttaccctgaattattcatagtcactgttagtttcttctgatcttctggtgatctaggtgtactcattccaacatatggaactgttgggaatcataatagacgaagtggtgtttttactttcctggaggatcttttcatggctttatcaataaattgtgtagcaacgtaacaatatgcacatgagcattaacaggcctttatttctctggtattagtattacatctgttatcagttctttgttgctttgttcttccttgttattcacttctgtcaccactttgctccttgccagtaaatcaaagcagttgctatattatgtttgagtattttggaaaaggccaacaattaaacatagatttcactcttccttttttttttggtatgagcaaataggatatctgattgggaagactatttcgttggcccctttttaactcttgaatcagaaaaaaaaaatcaggtctatgaatattccgttccattcccagaagaaaaatatgatgataccaacttcttaaaagcatagtttagagtttggagggctgcaaattgcatagtgtaaatatgtcgtgtccataaatagtttccttgaacacatcaataacatcattgttacttacttacttttgcatgcctctctgtgtatggttaaaataaccaactaaacataaaacattgttggccattttcctatctgaaaagagccatcgttttgtttgtttgccaacttttttgtgcattcatacatgtgtctctataagcttccttttcttttgtctcatacctatttcattatattatttgttctatctgttgaatccaggctgatatgttctaccttattttcacctgttggtggtcttaggttctttattttattgatacagaggttcaacctcttgaaaggtgaaacttgctaactgctcccatgccgttctgagaatgcttgttagctttcatcgaatactattatgttacattctaaagcctttttttttgtttaaattgcaaccatggtcctttgttgaatttccatagatttgtaatgtttttttctcctctaaaactatagttgatgcttggtactataactttgaattggttgctttgccgtctgtttgggcacatggtctgcacagtactttcttctacttcattttatggttcttgggaagtaccaagagatattggtacatctgactgtaatttttatgtgatatcacacagcgcctcctagtgttgaggaaccacagatgaactctatgaggtatggcaagttagctcctactgttgttgtattgagatgtactacaaattaacactacaagctatagtaggtatcttctcaaggaccacaaaaaaaaacttcacttcttcagttcttaaaatgtcatggatgtgcttaggatttcattctttttatttagatcaaagattggcaactcctggattttctcctccctgaacaataaaatgaaactgcaaagtctgctgggcaatctgtaattttttttgcaatatgggatcaggcaatgccccgtcgtgttatttcctgagggatgttgaaaacttagtacatttgagctactaaaagagttgcaaattataacttggttcatttgaattaactcatcttttagtgggtgcaagttgggtttgtgggtgtatctaccttgtcattgcaagaaatcgtccaagcatgtagcacagcaaccctttgaaacacttgacttacctattataatggcaaggatctgcacatttactattcatgaatacagtttcttgtctctccatatcttattgagttggttgtcttatgtgcaattgctacattagctgggttgtatatgcaattttgtcaagaaagatgatctaagcatttggttgtatttagtgtacagatagcgcatattgaaaaacacaaccaaacctcagtacctccgtcatgaaaactctgacaaccttgatagtttctttttgctattagttctgctagagctcatttttatgtgatttttggaactaaatacacaatatattgttgtttgttgatttgagtttttcaaaagttaattgtcatggtagattctgcagaggttggtgcaatcataaatcttgttctggctcttctgattatcctgggttaggttctgtattcaagaacactgccagttagagcttagagggcaaaattacttcattgcaggtaggtaaatgccttcatattctgcactgcacatgtttgtttgatactgtagacatttcatgaattagtacttcataattattatccaaaaatctttaagtttcaagcaatagaatgtcctgaatggtgaggctgtttctaattcttttcattattgaaattttcttgatgtacttctgatattttccatccttttaggtttaaaggaaagtagaaaagacagaaaaatgtgccaggcctgactgaatagattcctgatttcctgtaaactaaatcacatggttagccgaagtgatcttgatgaggtaatctgtatagtattttctttagtattcagtcagcaagatcagtttatggggatggaacagtaacactagttcttgccccatttgatataaagattgtattagttcataactttgcatgttaaatagttactgtctttctaaaagcagcataactttgagaaatcagaaatggtatagataaatagccttggagagaacatgtttatcttgttttttactgtacctcattattactgtacgtagtagctgctgataatcacccagcctcactgataaatgcaacccgacaggagcacaatggtcatacaatctagtgggcctttcagcgtagttgggtgatgtcctgcaagcaggggggccataagttggtctctgaaactatgccatgaacagatggagataaatgtggcaatgaacactagcaaacgtggccttattctaagaatcggcttgcagggaccggtaacacacggtaacagtgcaactgtaggggctataaagagtgagggtccagttgccacccaatttcttagttttaataggttcttttattggttcggtgatgcaggcagtcgatatatttgttgtccactaacttgcaagctttaattgctttggttcatattagttgtttgttcatgattatggtgtgtgaccttaaagatgctgctgtatgaactagatctgtcaaacagaagtgtagggactttctatactgttgtcacagctccgttgtttggaaaaatctatgttgagtagtgctcttcctgttttatcttttgctattcgatcatatggctctattcatgattgacctgcatgatttgccaggataaacaagtggtacactggtgcatgcatcgtattttctcttacgtatttgtattttatgttaattgagaatatctagctagttcctatgctatgcacttctgcatatcacttggctcattggctgtgcagagcaattgttcatcttttgtcttttaccattgctcactgttgaagtgttccctccatcatttgcagagttctgtgataatgtggcggtctgccaggaggaacaggtgtactgcaatcagctgcaggaactaccagccgattattctgtaggcaataattcccagaactgaagcctgagcatgccgaacctactgtttctctatagatcccttggtaagtactattgtctgttgattcactcgaacaataaatttacctcagccatcccacactttttccccaccatttctgttccgcatagatttcacatccattattcagagttgcacaaaccactatcacatatcttcacctttaccgttcgggagcactcccatggtaacaagagaatactcaagcttggcagtgcacaatggtgcaagactgcaggataatctgtatacactcattccaaggaccaaaagtgagcctgtacttttcttctgttacccccatacagggatcctttgctcctggctttgttcaatcaacttcctagcccattctcctcctgttcatgtgtcttgcgcccacactcgtaaagccctaaactgcacttcgccagtgtcctcgtcagtcgtcagctgcatgcaataggagcacgggccctgggcaaggtcactattgagatcccttttggcttgctgatgggtactgctaccaagaaatattgttctaacctttgtccttgttgcactcttgcctcattgattccttttgttccttcctttatgatcccaatgtgatgcttctctgtgcgtacgctagggcctgctttgtttttgcatgtgactttccttctttcttccactaacactgcccaggattgagcactcggtcatcatctaatcggtatttcaagcttcaaagtgttttgatgcctagctagcttcttttgtttgttagggttagggtgagaagaatgttcgaatgattgtggggatataatcaagctgcttttcctgtcaccttaatcatgcaatttctggtaaatcctaatgattggtgtccatctatccatgagtgggcagtctgagccacatccaccctaccaccccatataagtgctaatatgtgcaggaaacaaaatttcctgaattattttcgtgcaatgagtgatgcatatgttgaatttaaatgcctaaactataatcaattgtgatatatttttctaaagagttgttcttatgcagaactatggctcttcatatctgtactctcagcagcctgcttcatattcaggtcaggagtcttactctcttttttctcagttacaggtctttgtagtaaaagttgcaggctccaataaaaatgaatttgtaggtaaaacttttttatatgtgttcttggtgacttaaaagccaatgctaaaaaagaaactacattgaaaatatctcaaaattaaatttgaaaatttaaattttggcttattctttggctgtttaggccatccgatgggagcctgcatcttacttttttccatagataaatcagctagaaagaatattgctttgaagagtttttttaccttaccgaccggtctaattatcacatcatattaatacccaaagatgcaaccaacaactcacggcatttctttcaaagggattttaataaaaccatggcaattccagctaatacacgaaatgctttcccttttgctgcctttgctctttcaccgttgttgttaagtgtaaggctctttcacttaggagtcctagttcaagctaaaggcttttgaaaaggaaagggggagctctagtatgccactaaggccatccttgcacttggctcatcacttggtgccttacaacataatcaaaagctccgatccttgcgacctcctattggacctaaaaggctaaaaccatgaatgttctcccgtgtttgttaatcaaatcactggtccaaagctagagtagaaaattcccgcgcatgaggggcacataagcataggggaaaaagcacccttgatcatgactaaacaagtgatcagagtgtgatgctaatcattttagtaccgtgcggtttgggtccggccacatcattgccttataccagagtctgttcaagaactgatgcagagctgtcacttgcatgaatattattccctagctgatcaatggttttgctcttcatatctgtgggctgtggaactatggttgatatcataggtggccctccaaaattgcactgcattggcgccaacttggcagatagtgtatataaaagttactccctctatcttaaaatataattatcctaacatttaaattttgtttcaaaacataggtacttctctgtttactccttatctcaatcaatcataatcatatcttatttaacattttcacatatttcctcattgtaaccaaccataattatgtctcatttaatttcagttatctccttaatccctataaaaaactctagaagtgcttatatatattttaggatagaaggaatattatgtaaacggttagtgtgttcaacatcaatcctgtgatacagtatcactgaaaactctgttgatggattagatcactctttactgatggcgaagtgtcgcacgagccgagtgactgatatttccctgtggagccttgtcggaagcgagagtaccagtgctactagtgagtgatgtaacgcggcatctcgcatggtccgtaagtttgacgggcgatcgacacgacgcagccgggattgcgtttgcatgcccttgcagccctggaggagggagtgcgtgtgcgccgcggattgggccggagccattgcgtggtttcgtaccagcggcaaaggaaacgtacctgacctgcagcgacgtaccacgtacctatcgcttgccgttgctgcgtgtcgctgctgatctctctctgatgttgatgatgatggtgatgataatgtttgtgttgttgctttgttttttaattaattacttctacctgcgtttattcttttggggttcgtttccgttcgtgattgatgtgatgtttgtttgttcgtttgtttttggagcagggtgtcgggcgaggagcgatttgtttttgatactgacttgcaccaatctatttggaaacagtaggtaagttactgcatctgcgtactttgatttactagtttggaaaacactggagttgcaagaaaatacttctacgtctcctgtgtcatcctctattctttgtgaaatgggttgaggttagccatatgtccaaagattaccaatttatgataaacaggaaacgcatactacgtagctatacgtgtgtcaggttcgtagttacgatcgtgtttcttatagacggaggggtacatgatatggtaacattgatttcgtaaggtttgtaaacgattcaaatacttaggattttattcctataatgccctttggatttaagtgcattataatgtccttttgattttcataagaatgagcttttaaaattatatggatatggtttcctatagcccattctgaaggaaaaataagtatgagttccttggccccagttgatttaaattaatgagctagcagattatggatttgattatagggataaattacatattttaagaaaggttaagttgcattcatggtacattaatttggcatgcgagtgtaatttagtacatgaacgtgagaagtgagagttgtagtgtgataagggtgtgatttagttgaagaactaataagtgagcatatgggtacaacaacttacaagataggttcgattatggtacaataacttaaaaaatgatataacaattaattttttcgagcattttgtcatacatattcagtttttaagtactaattttgtcaatataatcgtgaatatttgcatactttaatttgtttattctagtaattaatatataaacttatgatggtggtgcaaattggatgagcaacgtaattccttattcttatagattaaatttaagattttaaggtaatatatgtagaattactatgtgatggcatattgatatcacgaaaaaactcacctagcattcggtaaccaaaatatttcatatttaaacaagttgatctaccaaaatagtaaattccgaagttcttgtaatagtaaattacactcacttactactgttgtactcggacattcaatttaaggtcttgtactggattacatccacttattaattgttatgttgtgagtgtaatttactcttaaaataaacttaacaactggagtagattgagataagtggtctatcaatgcactagaagatttttttttttttgagaaaacgtactttttgaagcgtgaatatgacctagttattgttttattttcccttgagaagagttattgtttctctccaaacaaaattccttcaaatttcctatgatatatttctcttgaaccatccaaatgcattaatattactagtgcattccagaggagcttttagacctgcattccaaactcatgtgctcgatgttcgatttctaatttttttttccttcctatgttttgagaatttttcttccaaaagagcttttattttggacctactatgagggtcattgcttgcttcaattaaatgactattttctctgttccaaaataaattaatttttagggttcaaaatttgattagaaaatatgatttatactctcttgcctaccatttctccacaagtcgacaagttttccattcaatacccttagaaccaatagttttttaattaacttggggtactttggatttttttcctcactgttatttttttaataataaaggaatctctttattttgagacaggagttgtgtggtgaacatgttttgagtcttttattataccttggatagtctatagtactatgagggaggatagtatggcactctttttgttgggtttcagtgggtcctgttcttttcttcaacaaaagttggataaacttttggatactcgtgacacgcttttgatactactaaacggtatattttgtacgaatattttctatatgaaagttgttctaaaatatcatattaatccatttttcaagtttgtaataattaaaactcaattaatcacacgttattaccacctcgttttgcgtgaaacacttaatctttatcttcatcttcaggagattcaaacaccatcgtgtatagaaatttgctcctttggagagttttagccattttgaaccacgtgaaaagatagtaatgcccttgtccttctacacatcatattagggctgtgaaaagatagtaatgcccttgtccttctacacatcatattagggttgtgtttagatccagaggcgtaaagttttggcgtatcacatcggatatacggatacacatttaaagtattaaacgtagtctaataacaaaacaaattatagaatccgcatgtaaaccgcgagacgaatttattaagcctaattaatctggcattagcaaatgtttactgcaatcccacattgtggcgcaattaggcttaaaagattcatctcgtaatttacacgcaatctgtgtaattagttattttttcgtctatatttaatactccatgcatgtgtcaaacattcgatgtgacagggtgtaaaattttaccagtaaatctaaacggggcctagatccatccatccatctgttcgtcgggttcgttgttctctactctctctctctccccatctcttctaatgtcggtcgccgcccgggatcaagagtaggaggctagtcgtcgctaggctcaaccctccccaccacttccccttctttctttccctgcctttctctccttctcatggtccctccttgtcgccgtcggggagccagagcaagagtctggtcatggaaggacggaaagagagcttgaaaggaggcttgttggccaacttttcgtccgtggagctcaatttctcttgccctcgccagcgacacctagtttcgtcaaacgtggaaaaaagaggccacagaggagcaaggggcattatcgtatttagatgcggttaatactccctccgttcaaaaaaaaaaaaaaaaaccaacccaagaggagatgtgagacaatgaacttggacaaagggctgtccaggttagcttttttgggacggtggaagtatgtgtcaagaagacaaacccgagggtggcaaatcatcggtgtagtagtaatgaagtgagtagcgttttatccattgcaacgtataaactaacattttatcaaaacccaacatagagagtagcatattcgtcttttttcttattattgataacggatttagggtattctttagttctactatttgtgttcctggtcgacagcgatgtgactggcttcatctccaagccctttcaaaccagtcgtgtgcgcaaattaagatagcgatcgcactcaaccccgtgcacaaatttgtcgttagacgccctactactgctgctactactaactactcccggcccctgcctagcactaggaatcttttgctagcctagtggtgaatgctctcactctattctagaaattggtctcagctcccgtctcccggtgccaaagaaatcttttctaaagtttgttggtgtgatgtgaacggtgtgtccgataaatcaatgtgctgctgcccccgggttgaccacgatgtaaaatctttccgtgcgcacgtttttaaaattgctaaacgtttattttctacaaaaattttctatagaaaaattgatttaaaatatcatattaatctatttttttaaaaaaatagctaacacttagttaatcatgctctaataagtcattctgttttacatgtaatgtgtatgggatgagtttccaactcaatattggaaatgaacctttttcaaaatagtcaattggagcactctcggcaaaagtgacaccaggcaaaagtcaaattcgtcctactcatgcattgaaccgttgcctacacccgaattacccttctcaatcatattagagctctaacttctaaatttagcttcagaagttaagtttggagtatagttgtggagcagcataaacccaacttcacatctctagtacatttttgtgtaaatgttttactcaattccgctcctattttaggtggagctgaaactatttggctgggctctagctccacgagaggtggagctggagttgtgctaaacaagcctaaatcaaacatagtgtggagcttaaacattaatttgtaaggccaatgtgaaagtatgtgttgaggtattacagtataaaactcaggaactacaatgcaaatttcctaaagctggtgggctggtgaccaatgttagcctctactccatgagggcatgttcaatgcgtgcccctggagattatccttagcacactccatcgatggccgtttgcttttttgtccatgccgtcctcttgcgatggaacgtgtgcctctgctggggacgtggccctcgctcgcttttggcaggggatgcgcgttgggcgcgagcatggcttgtggacaccgttcccaccgaaaaatttcaccttccaccccttgcccctctcactcatcgccctcacggacgccggtgacgggagagagagggagagagagaggccagcagcggtagcggcgagggagagggagagaggtgagagtctgcggtgagagggagaggacaatgacctggagacgatgccgacgacgacctgcgtgacctcctccgccggtgccgcgacctcctcctcgatgcggcgtggccggcgtcgctccattcgatctagccgcgagggggccagatccgcacacgacggcgccaaatatgctgcctccgaccgccggcggtgacggaaccgaggtcggcaacggcggcggggcgaggctagcgcgaggcggggaggacaatgacggccaccgcaacccgcgcgccactcttcgtcggcggcggcgacgggcggcggcgagagagaggtggcgaaagggagagagaggatgagggagagagccgcgacgcgtgagagagggagagagaagggagcagcggcggcggatgggcgggaggcggcggtgacgggagagtgcgggaggaggcgatgagcgatggtgagagagagggagggagaaagcgtcggaggaggtgccgaggaggggtagttgaggaaatttaataccgtgactttcgtagggatacccactgtgagctagagtatcttcatccagttttttcggattttgaggaacccatctagttgtggcctttattgagagacgagtgtccatatgagtgtcttcagtcagagaggacaccctgtgtcttccattgtacatgccctgaaggaactacaatgcaaattttctaaagttggcggggcggtgaccaatgttagcctctactccatgaaggagggcagggtagggtgggtttcgtgtcccttgtctttcatcgctgcacaaagaggagggcaaagttgtttgtcaaacttgatggccttcttcatccaactcttgttggagaaaagaacgggaactatatttcaactattgcataaaaaaaatctagtacggaatgtgatacagtctagacatggttctttttatgtgacgaagaaagtacattgaccaggttgccaccgttgcagatagagtaaagcatcgtgctagtgcatacacgcgcaagattataactattcacttcggtggttcatcatcgcgtgcatcgtgatgtcttaaaaaaaggggtaaggctagtgcaaacataagggttatcatacttttaacttgttatcacatagatgaaccatcctcacacacacaagattataactatggcaaaattggttatatagcatcgaacttcggtgagaggatttttcccctccatttttaaaaatttgtcgctgagagtttatatctcaagtttggccaatactattttaattgtgagtttgcatatacttagtagttatgcattacatcctaaataaaaccatatagtttttatttggaaaaaagtacgaattacccccctagctatcgcggtcgtctgaattacccccctgaaccacaaaaccggacattcttcacctcgaactacacaacccggacgaattactcccctcgacccaatctgcggtggttttggtctacgtggcatacgcgtggtagtccagtcagcgttctattcattaaaaaaaaatgtgggacccactctcttctctctctcactctcactctcactctctgtcatctttctctctctctcactctctctctctctctctctcacgcgcacagcggcgaggacggggggccggaggcggcgtcgaggatagcggcacgcacgcacgtgaccggggaccggaggcggcagcgaggacggcagcacgccccgcgtgctccgtcgacctccgggccacgctttccttccttccccttcaccttcccctccatcagatcggtaccgccgccgcaggagctccatcacgcggcccgacgactgacacctccacctctgggaaggcgatgtcctcttagccgtgctccccacaggttggtctgtttggctcggcttcgctggctcgttttactggtgacgcacggctagttttcgatgtaatgtctcattgaggtggcctgactgcttgcatgatcgtttttgcatgttgttgggcagcgcgatgcatattgggaggccgtgatgcccaacctgaagccatcggtgaccacgacggcacgagctttggagtacagggaggagatcctcagagcgctgcgccgctgcctccggggcctgtccgcgtgcgtgcgcgccgccgcgccatgcgtgcgcgccgccgcgccatgcgtgccgccgtgcacgtctcggccatgccgccgtcctcgccgccacctccggcccccgtccgcgtgcgtgcgcgccgccgcgttgtgtgtgccgccgtcctcgccgccgtgcgcgtctcggccctgccgccgtcctcgccaccgcctccggcccccggccgcgtgcgtgcacgccgctgtcctcgatgccgcctccgaccccccatcctcgccgctgtgtgcgtgagggagagagtgagagcgagagagagagagacgacagagtgagtgagagtgagagtgagagtgagagtgagagagtgggtcccacatttttttaatgaatagaatgttgactggactgccacgcgtacgccacgtagaccaaaaccaccgtggattgggtcgaggggggtaattcgtctggtttgcattgttgagggtgaggaatgtccggttttgtggttcaggggggtaattcggccgaccgcgatagttcgagggggtaattcgtactttttcctttttatttattaaagggtggatagtctatgtctcacttaaggctcagcttggttcttatgtttcaatctgctcttcttagtcctttaagtttttgttttaattcaaactcatccttagacctacttaggaagccagataactaaatattatcaacatgtctcgattaaatgatccttttacccctcgttcatatatatagaaaataaaaaggcttactatcaatacggtgtaactgtatgatgaaaactcctatagatctgactatcataaatacatctaataattatatgatgctattttttttaaagagtaaagtgcacggacggtccataaacttatattggtgtgtcacctaggttcttgaactctcaaaatgcatttttgggtctctcaacttgtctcgggtgtcatataagtccaaacgggctctaaaccgctccgtgtgctgatgtggcatgccatggtggtgcctacgtgtcagtagaacccaacccatatgtcagtcacatatagaaaaaaaattaataacatatttttctcctctctttttcatttatttttcaaaattaaaaacttccttttctcctcaatctcccctcttttaaaattttattttttatatgtgagtgacatgtggatcccacagacacataagcgttagcgtggcatgccacgtcatctcacgaagtgggttagaactcgtttggagctatatgatacccgagacaaactgagggacctaaaaatgcaatttgaaagttcagggacttaagtgacacacctgcataagtttagggaccgctggtgcacttcactcaatttgcacacaatgatttttttttctataagtaatgcaaagtaatttatattctacgaaagtaattatgtatatgatactatagttgttaaagctcaaccctttgtatgagcaggttaaggttgaaataacgggaagcgttttattcatttttattctcttttgtagagtatgtaataatgtaaattaagggtaaaaggatatttttctaatacaaccaatgactaggatcagccatttggcacaccaagtggtccaaatgatgatttagggcctgttttaaactacattttggattggttaaatcctcgattttcgttagtcacttaatatgaaaactttttatatagaaattattttttaaaaatcaagtaaatctagtttttaagtttataataattaatactcctgtacgcctgatcatccaaattatgttacttgttttcttttctgtacgcctgatcatccaaaacacaaaccaccttgaaacgtacgcagccctaagctaaaaacaaatatttaaaggatatgtgtggatacaataaaaagataaaaccgatcaaattaagtttactagattagttattcacccttcattcttcattaaactttgataatgtaagagctattggtagtcaaatcaacatcattacgaagtaaggatagctcaattagttaggttttttttaaaaaaaatcaacctatcctgatttaaatcgtagatttgatatgagtgctcgtatttatggttaatttttttagtggtacctgttgataaataggatgtgtgtatttatagggacgagtatgcgaacgtgtgtttagaaaaattaaaacatcatcgaccaatagtgttgggcaaactctaggccagcagtatggtggtggtgaccggtgcgcggcaatgcacccgtctctactcccccacttggccccttttatgggcgtgggccctacgcgtgtgcgcacgaggaggtgaggtgagacttagagagagagagatagaagggactcctctgctctgctctcctctcctatatccatccataatccattcctccccgccgtggccgtcaccgtcgcccctcgccggaggacgacgacgagacgaacaccaagagactgttccaccatacgcaatcattacacagacgtggggactatactatactatactcctatttaggtgcggatcaacactataatcatcggtgtttaactttcggtaaaacctatagcaaaattgtttatctatatactataacatcatgttctaagcataattagcatattatgacacctataaacacgttatgacaccaacaaaccaattttctgatccaccactgctcctatactcctatactatactggagtattactaccccttcctcctcgtgtactttgcacttgccaattccattccattattatataatcctcccctccaaacccatgcccct

SEQ ID NO: 68121 - DNA, 25912 bp, Oryza sativa
caatagcgtcatctattaaaaaatggagggagtatatagcaacaaaagtcccgagcgactccctccatttcatattataagtcactttgacttttttctagtcaaacttttttaggtttgagtcgtttgaccaagtttatagaaaaatttagcgacatctataacaccaaattagtttcattaaatgtaacagaaaatatattttgataatatgtttgttttgggttaaaaatgttgctacgtttttctataaacttggtcaaactttaaacattttgactaaagaaaaaatcaaagcgacttataatatgaaacggaggtagaaattcattgaaggtaataagagtgacacaagttcacaaacatacctgtggctccaacaattttccctttgagttactataagtgcatttctgagccaaatcttcagatataaggcctgtcccgtcagtatgtatcaaccgctccccatctctaaaaacttctttgccatgttcatcctgagatattacaataaaaaggtgttacattccagaagcaagaccaaatattggagaggatggagaattaccaagcaaggctcatcatcaatgagtttgacaagaacttctgataaatcaacatccaatgtgatagttttggagactatcaaagcaaacctgcaacgttacaacagaagacatgaggtttaatgtaacagaacactcacatgcaagaggtgaaagcagagtccaacagttagttttcttctattaagtgggcccaatagttcgatagcaacaataatgaaaatgaacaataaggtaggcaatggacttgtggaaatacaagcttatctcccagtttaagaaatttcaatccttctaaaatgcacatccttctattttagagaaaattccttatatgccactgaattttcactgttttccttaaatgccataaaaatgagctattcctttctatgccatcgaaataaatttcagtgtcatcttctggcatccacgtcaccatggcactattaagaagagaaataatgccagtattgtcaaaagaatgacaaaatttgcccttggctccctcgtctctatccccactactgtcttccctaaatccacaatatttcccattggtattctccctttgcccaagcaccagcgtcttcccagcccgtcattggcacgtttctccacatgctaccagcatcatcctccctgcaccagcaccccctgctccagtcagcggcagagcggtggggtcccactcccatcatcccaatgccaggcactgttgtcctctgcatgcccattgcccccacagccgcctcccaatgcccattgcacagagacagcattgttgcccctcatgcaccggcgtgatcgtcatcctgcgcacatacaggccatgataattaatcatggtatgctgctccaaatctgaaatatggtatagcccttctgtcctaagatccttgtctcaccgccgccaccgtggatgaggccaacaccaaacaacacaaggaacctcttggcaccagaagctcagctcctccatttcctaggtccagctgatggaattaatgccatggctcagccagaggagtgtatccatatattgctggatgctagaaaagagggaaataaatcatgcccattaaccttaaccttggtttatcgatgctgcctacactacttgcagatacttttgttgagcggagctaatgcagttatacagaaaagcggaccttcaaaatgatcttttttttttgacagaggaaaatgaatccaggagagagaagggtacataaggtgaagaagaaaggcagatctcctgaaaaaaaaaggaaaggaggagagaagggagaagggtgattttgtacttttccttggcaactgaatatcatggtgatgtactgatgtggatagcataagagagcatggaaattctattcgatggctcaccattaatacaatggttaaaaggtagagcttctctacctttcgcgtcaaaaagaataactaattttcgatggcatataaagaaaccggtgaacttcccatggcatataaggagtattttataagaacacatgttgctatcatggtagcaaaaccattttctgcaactaagctcgacatcacccagtaattgcacccatgctgcatagattaactgatattattcaaaagtcaaggaaaaacctgagcatatatttcgccaaggtgagaacagtacggatgtgcatgaataggtcacgagcctgaccaatcgttctgccagagagtatgtaaggttcatccatgttccacccagactcagtgcgaacaaagtagcatctgacagatgaagtacatttcttgttttcttcttctctattctcttctttcattttattctctttcccgccgtccttgtaaactaaaaaaggcacattaatcaatgcagatccaatcatgaaacagtgacaaattaggaaccatgaaacataatggggacacttggtaacaatacaagagtttacaactcagaaaatggcactagtttctcagcaacaaattgacctgttggcaacctcatactggttactggatattgctttctaatttgcatataattacagtactattactagtaatccatttttttccgacaattctaaaaaaagcatgtgtgtcatccccatgccagttaacatgacccaaatcaccctaagttcatgtcttcaaaaaatctgttaccattgtttgtatgaagacattagagaactttgaccctaatggcatatcataaattgcagtaaccatctctacattatgtgtattcatcagcctaccactcgtattaaatccaaatagatccagcattgcaacaaaaggtaacttacggaaaaatcgatagcagcgcaaacccaaaacaataccctcttcagcaaccttatggtagtgttccaaataggtagacaaatcagtctcagtgtctgaagatatctccataaattttactacaaggacgttatcatcaccaagaactttctgaagatgagtcctcctattctcaatatatggtccctgcacccagccaatgttaaaaatataacgatggcaccttaagttccttacaaaataaattatcacagagtgcagcatttgttgattttggcgccttgacctttattgcaattagtctttatattagaacttccagaaaaatcttaggcagcttaagaaggatgcatgggtgatatacacctttatgtgaggggtagattcgcaaacagtcaacagcaatgaacatgaacattacacaatcatgactggtagataggagaacatcaaatagtaggccatctaaaaatatcatggttaaacaatgagcacgtataaaagtatcaaaagcaccacacaccttgaaaattttgacaactgtaccccctcttatctcaacattacaatggtagacttttgacatacctggaccagaatcaaggttctgcaagcattacatggagaataatttcatcaggctcaagttataacttataatagaggaaaaggaacaaatagtggaaaacagaaaaataaaatgttagcataatattctcataaggaaattgtgaatgaaaaacatgcacaattgtattgctagaaagatgtaaaagatataatggttgtggataacatgtcagccagcccagacttatcgtaggaaatgaattgtgacgtcccagcattctgaagaactggccactcaaaacctgggtacaaaaggtagtttttgttccatccatcatggtatgcagtgtcatatgattgtaatcaagtacccatttcaatttttttttgtagttattaagtaaaccaagtcgacatttaagttaggaggtacaagtcagaagtacatctagcaaacctggacactagaatcataatgaagaaagggtgatatctggaaggcatcagaagctgagagccaatgtgcactagagtaagcatgtattatgttatctacgcacatacaaaattcaaggacaatgacttgcgtaggtggttccatttacaatgatcatgatccaatatgaaaagggatcatcatgtttgatcatttttagagacctttagtgaaaattattaagagtactggtgttgcaataacctttgctctatctgaagatgatatattatcgtgaccaaatgtgctccagattcgtgactcaaattgagccatggacattgacttcaaggatctgatactgtccacggagaggacatcttctatcttactactttttggtgtagataatggaggctttactcctttcttattcctgtaacaaaaagagaaaatggtgtattagcaacagcataacacagataaaagccatattagccttagaaaatagtccatgttctgctataaaaacatctttgttctttattatgtaaaaagcataaaccgaagagaatctaaccaggaaagataagcaaaaatcataaatatcttcctgaactccaactctcccagcgctagcatctgagggctcactacctccctcaacacattggtcgtgtcaggacagattgctggaggaatttgcggcatcacccaaatgggacatggaggacttcctgaggggccagccatattctcgacacatcttgatagatcccgcacagggctcggggtggaaactctttctggagtagaaacgatcggctggatggggctgtcaatctccatatgtctctgcagcccagatggcatgcggtggccagggctaccaacctgcatcataacatcattaggcaaagcatgagccattggttgggtaggaaagttaatctgcacagccacctggttggacgcaggagaaaccattccacgggaaggcgtataaccttcaacgcagttctggttctgcagcagcacagaagatattcgaccatatgggctcccaactgctgggttagcaaggtccggaaccacacgagcaatatgtccgacagaaccgccattgtcatgcaaacggagcggcatctgttggttgggactcccaacctccaccatgtcgttgggtgtttgagcatccatttgaacctcattgtagtacagtggagtggatatagattcctctgtgtaaccacaagacttattagtaagaagtacttcacaatttaggatatgtataacagctacaaagaccttagaaagaaacaacatgcaaaccaaatcaaccataccaaatgggcgaaatgcaaaggtaaaaagaaaaaaaaatagaaaaatgccatcatactaagctgaaccaacgaggctaaaatcaaccggttaccaaaaccacgacttaagggtggcaaaattaaggagaaaaaaaatacgatcgacaagcattgaattcgaaaactgagcgtcaccattacagaatgttgctccctatcacaacttggcaagattctccaaatcgagagcaggaatcgatagcccaactaaaaacaaaaacaaaaaaaggaagatactcccttccgcctacgaaaagtgcattagcattaaacaggggcgtaggcgcaacaaaaaaaaaagagctgaaaaaatctcccaaacagtgcgggttttgcagccaaaaaaacacgctaaaacgcactgccataggaagcacaaacgcagctaatcctcctctgcgaccatccattaagattaaaattcaaaaagggttttcctcacaaaaaaaaaacgaaatgggcggtgaacaaaatattggcctcgcatgagaaaaaaagagtcggtgaacaaaaaatgccaagcagcaaaccccctcaccttcgcggcaggggccggagatgcatgcggcgctgtgggcggtggggatgccccgcgcgttgcgcttcatcctctcctggttcgccatgtgcctgatgaagccggagagcgtacggacctggcgcgcctccccaatcgcccggagcacccgcgccgccgccggctcgccgagctccgcgagctgccgccgcgcctccgcgcaggcgagctggcccagcctcgcctccagccgctccagctccgcgccgaccgccgccgggagcgccggctcgcgcatttggttcccaccgccgtggggattcatggttgagagggtttagggtttaaggcggccacacacacccacccacgccgcgccgcgcctctccgcggcggtggagatcgaacgaggaatcgatcggtttggaggtttggagcgaggaaatttggaaaaggaggagaaggcgcgagcggggtcacgctggggggccaggaggaggaggaggtggtggggggggcccacatggcagtgggtgtgggaggtggattgattgtggggggtgactgggaggcgaggtactcaactgtgactactccctggcacggccacgtgtcgcgcttcggagggcggtgccgaatgtgggacccaggtaccagagagtggaggattgattccttttggttgcttggactggagtatggagtacacttccggcctccctgtgctagtgcgcttctgcggcagaatcggcagatgcagtgacgcgtcaaaagttactagctagccatctcatccgaagttccaaactatagcatccaaagcccttgtgtaggccatgtttttcaaactttttcaaacttagaacttttcatcacattacatcatatccaaaactttcctacacacataaactctaaccttttttttccaaactaccaacttttccaaacttctccctaatttcagaaactaaacacagccttagttccaaactttttttttcaaactttcaacttttacatcacatcaaaactttcatacacataaattttcaacttttttatcatattattccaatttcgaccaaacttctaattttagtttgaacttatctctgtagtggtagtaggaggggtagtactcctagtagtaatgaaaaaaaaaagtaaatttcaaaaaaactacaaccgtaacaaaagtaacattagtaatatatatttcaatttattgtaacgttaatatatgaaaaattatcacaaaactgtaatttttacgtggtatgcaacaataaaatatgtaggtgacaacagtatgcttgtgacatgtaaaaattacaattttatgataaattttcacgctattgttgtaacaaaccgataattttctcactatagttgtcattttctgaaaattactctaatgaaaacaaccaaggatacccgtttgaccgggagttttgtttttgcaatttaaatggcatataaaacaagatatgctatatcgtatgattaataaaatattaattattacaattaaaaatatgtatttgaatttttaaaaactatacaaatttctttaagaaaatgtacattttagcactttaaaaaccgcgctcgtagtaaaaaagaagttgtaaaagctaacaaaactacggaactaatagtctagcagtactagttatttataaccaatctaataactcacctatatataatagtttttttttcaaaatacaggacacagaaaagcataaacaaaaagaaaaggatagaattacatgtgtaaaacagttgtttcgaaaacatacggagggaatagcgacgggattcttatcaaggttgacaccaataatattgacacagtgaccttatacctcaacgtcaatgagattcgctttgagcccacgatctatttctgcaattagtttttagtgattttcacctggagccaccttctattaccaatgttttgctttaaaccatcctttaaccaatgttttactttagattggatacaaatctttgtgccagtttggaccatcctcagctcttttatccatctacacaattatcatatgacaaaaaatggctatttttttcaattttttaggtctttttgaaaacttatttcacgaatagacccttaaaacttatttcgaaaataaacccttttttagaaccaacatcattagcgacgtgatcccatatgaccaccaattacaatggcatcatcccactagcctctccatagaaactaagctagttatgcaaagggtgcaacgtcaatatcattgatgtcgaggacatatgtgaaatatttttttttcaaaaaaagacttatttgtaataaaagaatatttataaataggtcatcggccagtgtcattgacaccgtgggcttatttgtaattttttattggaaacatgtcgttttcttatattttttattagaaatatgccattttcttatctggacagagagtctatctaaaatgcattgtattaggaaatgtctcatccaattttagattattatattttgagacggaagaagtaatccagatacattgtactccctccatctcataatataaggtatggtcaaatttgacacagtcttcaaaactaatgttatatactacaaggtttattgtaacaaaattataaccatctcaaagtaaatttaaatgtcaatacaatgatattaattttagcaaataaaatttaattttatattataataattgttggtcaaatgtttttaaagttgaatcttggaacgtgcgcatgccttatattatgggatagagggagtaataggaaatgtctcacctggtcctagattcttatattttgggacggttcttatatttcgtaacagagggagtaatccagatacattaaggctgagttctttccccaagttcccaactcatctcaatcgttttccacgcgcacgcttttcaaactactaaacggtccgtgttttgcaaaaagtttctatacgaaagtttctttaaaaaaatcatattaatattttttttaattttttataactagcacttaattaatcatgctttattctatcgctttgttttgcgtgcggatgggagggggttctcaacccctccaaaagaacacagtctaaacgttccatttatagattcttatattttgaaacgaaaggagtaacattttaagtaattctgtatggataagccagaaaaacatataaaccgtagtgctgtgtttagttcctaaaattaggaagaaatttagaaaaaagttagtaatttagaaaaaaaaataaaagtttacatgtgtagaaaaattttggatataatgtgatatgatggaaagttgaaagtttaacggaagtttggtgtgccctaggcatggccttataatagacgtccgatccttccgtagttgggtactgaaaactttgaaaaccctaaaagcaggcagcacacgcataccctattgccctggacgggagtaggcacgcattcccaggattcgtgacagcttctgctgttgtgcggagcccgaaagttgtgctgcacatgtcactcaatataggacttgtttagttataaattttttcttcaaactttcaacttttccatcacaacaaaactttcctacacgtaaacttctaacgttttcgtcacatcgttctaatttcaaccaaactttcaattttagcatgaactaaatacacctatactcccaattactcctactccactctacttgctctaggggtgtgtttagttcacgctaaaattaaaagtttggttgaaattaaaacgatgtgatgaaaaagttaaaaatttatgtgtagaaaaattttgatgtgatgaaaaaattaaaagtttaaagaaaaagtttgtaactaaacaagatatctcactataccaaatcgctgccagtattgcaaaaggagatagaaagaagtactcctagggtgtgtttggttcaattttttgtttggtttgcatgatatggcgatccaatttcttttgtgttggaggatatagcatggatggaaaaagacaaaagttagtgagactcatttgtcatatatatatttttttatcaaaatataatcatccgagatcttgttttaaagatttaattgtaacaaatataatggtgtaatcaaatcataaattagataaacggtttaggagaaaaaatcatttggagcttgcttaacagaaaatcaaaccaaccacgaccaatcagaacaagacacatcacccagaccaaaactggatggcttcatccagcaaaatcagccggatacactcatccagcatattgagggaatattccctattctgggccgccccatccaccctgccatccaaccaaacaccacagaaaatcgggcagctatctcccatccaggctcatccacccaaccaaatacacccctaatgttcaaggaaaacctggattactggagcatttgctactgcggcaattaataaaccattgatctgaatgtgttaagccatacagccgcactgacagaaatttgttaaccacgtttagatcagataagtagtagtactccactacttaccagttaccactaagcaagctacagcgatgaagtgtcatagcagtccacaagaataaatagtcggaaatcagattatcattagataagagagcaaaatcaacagtcatgcctaccgcatatttgggtgcggtaatcagctcacctcctcaagcttactactcctactcaataaggtccatctcttttttttttctctccaaaatttaccaagtctaaaacctaatctcacggtacagaatcactaagtttgtctatacatgtgagcaatgcagttttgttttttcttttcttttacatattgaataatttatgcacaataaatcagtaatggaaatggttctgcactcattatacaaaaacaaaattagtctttcatcatattaacgttagctttggttagttaggatagttagtttatatttttgaaggctacgagtaagttaaagtttgcacttcaaaatccccccattatcttgtcacaaaaccggttgttcatattattagatcttaatcttacaaaggaccagctcgggaaaatgcacttcacgacactgatcttccatagcatatggagcctaaataaagattttttgcccatttttcctgcaaatagatttatcagatttatttgttatgtggagttcaaacaaggcacaagaagaaggtatagtcacctttacatgctggccaggaaaagcagatgttctcagtgtctcctgtgtttcatcgttaggctttcttctaggtatgctcaagatcaaagccacctggtcacatgtggctgctgttgcagttatgcgataaccactatcccagcgttgatggattccttcactcggatataagaaatcaagttctactacctacaaaagagatatgcgagataataaaatctcaagacttttacatattcaattgatagtcagtgtagcttgctgctaaaatgaattcaattttacaaggctcttggacactccaaacgtacctgatgtgtgaaaccagcgttccgggacataaccacagcccatcggcttcctgctgtggccaaggcagtgacatagaacccctccttccactttttgtttatccatttgaagggaaatgaatcacttactttgtaggattgctgtgcatatggcgttcctgagaagcattcaagtcagttcttggcttcttgctcataataaataccaacagtaaacattacaagacacccaagtgtttgcgctgtgaatggcttctcactacacatattaacggtggtactttctgaatactttgatgcatcaacatttaacaaatttcacctcaacagtaaacattacaggatacccaagtgtttgcgctgtgaatggcttctcactacacatattaacggtggtactttctgaatactttgatgcatcaacatttaacaaatttcacctcatccagtattatcttggtcaaggtaacaatattaagtggtatgtttatccaaatgttgtctagcagtttatagtgatttcatcatagctaggggcaaaagattgacagcctcatcggttgcccatatttcctaataagccaaaatgatttattagaaaataaaaattaatttataggtaaaaaattgtatatgtgttcttagcaacttaaaagccaatattaaaaaaactatgttcaaaatatcttaaaattaacttcaaaattaagtttgaaaattcaaattttggcttttgctttggcttattaggccaaccaatgaaaccttgattttatatattaaacccatgtcatgtactaatgttatcaactatatgctgcttagcatagtgttgatttaccccaaagagaacatttgtttgagaatttttctttattaaaatcaaatatttatcatggttttgattaatatccagttcttttagtattcgattacgtgtttcagtacacatttgatgagtttactgtagttcttctctgagatgaatcgttgcgcttgttacataatgatcctggcaccgaacatgcaaattcaggactaaaggcatcaaaatgaaactgtatacctgttgacatgatcaccaccgagcttccattatttgaaccagccaaagaagtaatatagtaatttctctcccactgctccattatccattcctatcaaagcgcacagttaaagttgtgattatacatttatctcagtgttctaaaagtcagctccaggcgccggttagccgccgcgattaggcattagatggtgcattaagaggctgaactaacttgggtggtgtttccttgctattttagtgttatatagtcttgtttttatgcaatatgcttgctaatttcttggatttgactagttagcctaacctaggcgccccccagccgccggactagtgcctggcaccttgttgtcccaaaatataggcaattctagagttcttcagggggttaaggagaggtgaaattaaaacagggatggttgtgattggttgagatgaggaagtagatggagaaattaaataagagatggcggtgattagttgagatgatggaatgggtgaagtagcaacattttgagacaaattttgaatgcaagaagttactatattttgggacggagggagtagaaaacaataccatgagatggcaattaggatagagctgagtatgcttgattagtaaccaaccacagataggaaaaaaaatacatactcaatagtaggatgacacgcaattatttaccttgtgaagaaagtaatgggagagttcatgtacttgggcggtaaaaccagtgccagcatccataattaaagcccacagatctgaacaggatgaaactgaacttataaacaaaccatcttcatttcctttttgaatatgtggtgctaatctatcatctgctacattgtagtggtatctgaaaaataaatgtggtcagacaatagagtattattttactgctaccaagcagattactgtgccatacctctgtttcattggccgacgggcattgtacacactaatccactgggtcgctggcattcccattctaatctttttcttaggttgctcctcatcttcagccgctgtgaggcggcctctcttctgaccaacctgatatacaagctggcagcaatccaacaaagcattatgcaggtagcccgctattacataaagaaataaggaattatttaatatgtcactagattttgccagttaactattttaccaccaaaatacatttgatattgaatatgtcactgtctctaaagaccaatctgatcatgtggtcttaatggcaggacattgactatgttttagtctatgcaggtcatactcgttatttggtgtttcatattacagaaagctaggacaggaagttcaaaggcaggttcacaattgagttgtttcatagtgggacatagatttccttcactaaaacctaaaagcacaaggttggcattgaactaattggaattcttgggaaataatattagttataacactagtgatgactctcaagcccaaggatagaatcaggtaactttaattatttactagtgctttgaattttgatccgagaaatagggaattggaactgagattcctacacgatcattttttctgacagatgatacagacgcagattaaaatggttgaaggaataatgtaccttctgggcaccatcggtgtttaatggtcttccatctggatttggaccaacaatgccatcaaaaagagcaatgcactttgcatagtttggctcttcgtcgaacttcaagttcacaacatactcaacaaattgacgaaatggtggtggaccaatgccacataaagattctggagaggttgccatctttttcttgcaaacaagaaaacctttattctctccctaagttcattcatgaattacaaaacgaaattagtgcatgtagcaacaaaaaagtcataaaatcaatcaaaattaacctggaatccttgccaaggcaggcggccacggagaaggaaaataagtgtgtatgcaagggattcaaggtcatctctcctgcatccagttcttcccaagtgggcatgcacactagcataacgaacagtacccctgtttacagtagcagacaaacaggaagagcgcatcaataaagtaatgtgcaaaatgataggcatcgtaataaactttctattcaaacctaaagatatcaggtctctggtcatattcaacatgctttcctgtaccagcatctttccatttagtagctgcattggaacaaaacaagttcataaggaagcaacataaataattacatgacaacaaattgacacaatataaagataaaagttgattaagaattacctagtccaagatcaacaagaaaaagtttcttcccttcaggggtatctggaggaccaagcaaaaagttctcaggtttcacatcaccatggacgtacctgtcataaacaaaatttattagctaaaacttcagagacgccatgtgaaacactcttacggaacatctgaagagcaggtcgagttaccctttagcatgcatcttctctagtatggagatggcctctatacctatacaagcaaccatctcaacagacatcctgtaaaagaaggccacaaattaaaaaattgaaaaggctgcattgaactgtcaagattaattaggaagagtcaaaagatgcccacgagtgggaattgttattccaaacatcccacaggctcggtcccaacatatccataacctgcatgaaaaatgtgtatggttagaaaaaacgtagttgataattcttaagagaaaaagaaaccaatcaaaccataaaccggaaagcaaaaaaaaaaaaaaatctagttcatgctccattaccatgatgtaaaacccgccctgctttcctttgtagtgtacccgtgggacaccatgatttccactaagagtactgcaagagaaggtttatcataagtaatcaatgtaaacgtatccaaataatttggtattcacaaagaaaaacttacacagtagagagccagaagaagaaatacttacttgtagacttgccattcatagggagctccatagctgcaacctttgctggttcgatgttcgaattttagcgcaacctgacagaaatgaacatgagtactgacgcaagtacgaatagtctcagttccaactacttcaatcattcaaggagatacactgacctctaatgcatttgcaccagaatttctgttaccatgagtaggagaggaaatacgccggccaacgtatacttgtccaaatcctccctttccaagcttcctctcaagcttatacgttggtgaatttccgatttgtacctggtccaagcacacaaccgcccaaaataaatatatggttatgataacatgatgtaaaatcctataaacatgtgaaaaaggagacaggtcagctattccatgcgtaataaaatgatacaaaatttcatcatcagaacagccattgcaacatttctgatcttttgtgagctaaacaggtttcaagcagtcaactctgagtgcaggtgacatgaggcaccttcattcttgcaacaaatcctgtataatgactaatcctgctttgatctaatggaaagctaccattatcctaaagaatgcctatacagtagcatctacaatatggctcaacatagtgcgcaataaaattaaggcactttagattctcccgttcctaggcagatcttttatctgcatgatggtagctaatcctaacagaccgatgctcaatcaaatctccgcttggaatttaacacaaacactcagcatgtgaattcaacaaatgttaggaataaaacaggaacagagaatacatgaaacagtaacaacactcagctaaccaattgaatttcgtatacatggcagaaatgaacataattaagcaaccgacaagatctacgttcagtaaaaacacacaccaaacaccagaaatggtatattcatggcacactaattataagtgccatcaaatgctagagattaactagatggagtctagaactcaagatgttagctatctcatcagttttctgcttgaaatgcacaataagcttctggtcaacatcacccgtactgatgctatcctagatttacacaataagcattcttcattcacatttagtcaaaagttctaatttagttccacacaattctctacaaaatcagttctgtgcagctgctatttgtaatcaatacatctgctatcctccccttctcttgtcaccagttggatcagagttaattgaaagtaagctaagaatccagaacaactagtagttattttgccacaagcgtaaaactccaccatcccatcccgcgtgtacagtttgcatagatcaatcagttcatctacaccagcggcagcgtctattcaatcaatagaaccctaaaccaaaaaaacaaaacgccccctaaaaaaaaatcgacagccatatctaggtcacgcagcgggggagccaaggggggatagataatccgcgattaccgtctccgggagcggcgcggggctcccgtcgtcgccggcgccccccttgtcggacccttccatccccttccgctcctcctcccgctgcttcccctccggctgcctcgcgtccgctgggcccgtcggcggcggcggcggctgctgctgcttccgctttccacggcctcggcgcgctggcatgcttcagcggcgcacgcccatcggctcgccgggggatcgaggcgatcggccgcgctggggctagggcttggcctccgcgccggcggcgacgggtggggggtgagccggcggcggtgacgacgacgagacgggaggagggggagattgcgaggtagggcgcgtggtgaaaaaaatcctggtaccacagccgtgttgtgtagtaagtggggattacgccgccgactcgagcttacgtactgtgtagaatacgccttctctcgaacacatgcggatcataccacactggcgtgtagttgtaagtatgatggcttcagaagttcagattcgtcctatcaaaaaaggaaaaaaaataaaaagaagttcagattcgtttcaagaaagatcatatactactcgtcatgtttgggttagcttgtatccatgtggggattttgtttcttacatctcttgccactaaagattatactcatattccttcgagaaagattatattcctacttgagttcttttttcgaaggaccaaaaatcttttgtgactcatcattttaatctctagtatactgcatcattggtttcatattataacccttggccctgttcctttctccaacaaaagtcggataaaattttaaatactcgtgtcacatttttcaaaccgctaaatgatatgtttcatgcgaaatctttatatacgaaatttgctttaaaatatcatattaatctatttttcaagtttgtaataattaaaactcaattaactatacattaatatcaccttattttacgaaaaaaaacttaatcttcatcttcatgagaaaataacaccaccctagtactttgattattttcctattgaagcccttttatgttctaatattttttaaaaaaacaatttaacaacatctacaataccaaattaatttcattatatgtaacattaaatgtattttgataggatgtttgttttgtattgaaaacaatttgatcaaagttataaaagtttaactaacaggaagttaaagcgatttataatataaaccgaaggagtatgtactacagtggcgaattggatcgacttcaataaccaaggtatcatctacatttgggagaaaacaaaatttagtttactcgcatgctcaattgttgtgaaatatcgcgaaaagaaaaaatctttatgaactagagtcccgctccggtgcttttctacttagagtagaaattaatccgaaccgttgatcgtatttaatcatatggttgagatcgagttctactcccaccaaattttatgggagtagaaatgtggagggatatatttgtccaaaggtaataattcgcgtagggtattatcgtaatttgtttttatctaactcttcaccctctctctctatcctatcctaatcgatgccattctcctccatccccgcctccgtcggtgtccatctccttcgccgcctccgtcgccggtccttctccctctccacctccgtcgcctccagcgccatcggcatctccttcccctccagcaccgtcgcctcccccggcctcaccgccttctccgccccctccatcgccgtccgtatcccccgccgtcgccgccttgtccgcctcctctttcaccgtccgtctcctccgcccgcgtcgccttcttcggccccctctgtcgccgtccgcctcccccgccctcgccgcctcctttgacgccattctgggcctcccgttcacctctatcgtcgcctccgtcgcccgtccatctccctcgccgcgttcatcgcctccagcgccctcgcggccctctgccccatccaccttctctacctccagcgacctgtggcggctgcggcgtacgtgctcggcgcctcggcaagggcggcggatccacgatgtgctgcttgtatggcagtccggcggaggagaggctgatgatgcaacgtcgccctcatcttgatgttgccgttgattgttcatcccatctcttcggctgctactggttcgagaacaggtaacgtcctgtcccattttctcccatcacttcctgataaatgatacagtaatgttgtaggatcactattagatcctccaaaagtagcagcctgacgcgagcaaaattcagttttaacaccaagtagtacttcataagcacaacctgctagatttctactgaggttgttgtcccaactatacaaatttgaaatgtgtctgacaaatgttatcaaatcaccacatagataattcttctgtgaccattagcgagagatgatttccgcttgtgcttcattctattttagttgatgagcagccgacaacggtttaaatggttatgattttgcttcagtaaaattctagtactaattctggagttctctatacttcgtaaattacacacagatcgatttttatttgattcgttgcttgtagaaatagttccactccctgtgctacatcacataagtcaaatttcagaagatactactagtttatagtggttacggccagcatggaacagttaaggtccataattttgtaaggctctgcagatcattttattttggaggctttccaatgtgtataattttcttttcattttttcagccatgcagtggagctccaatggtgagtttgcctttcattgtcttgttggagattgcacgttggaattactggcaaaagtcatgcttcttgcattcaagagttgtatcctgttctgcgagtatgatctagcagcatggtatggggctgatattttataaaggacaacgaccaatgtctgaattgatatatatatatatatatatatatatatatatatatatatattgtactcgccataatttaatgtctatcacagaagcagtaatatactcccttgcgatatatcccacgtggttttctttggtagacagtgttcgtgttttaaaacaaatgaataggcaaagatgatatatatttgcacttgggagttgccgtggatggttactgcaagatgctttaattttgtccatgtcgcgaggggtcaatcccagtaccacaccacttctttttttcaatcatctaacataactgcaactatcttttttatcttcacctaacagaaattaatctgcaatcaccacggttaatatatcctgaaacttggcttgatagagctttattttttgctaattacacccctgacctccacatttacatgcatatcacttaagaagtatataatcatctgaacaaagtctctgatacaacaaaataaaaggctgaagaaacgtcagtggtccatccccaaccttcaattgtgttgatgcttcttacatgctccctctcatagctccggcttgaggattacttcacaagttgcaaacatgttcaggaaagtgaacaattctgtgatacaagtgaatctgacagtcgcggctgctttaaaatctcatctcataatgaaaatattctagcagttaaagaatatatatcatgatgatttatgagaatgcttgtggacatacatggacaaattagtaattaacactataagttagtaactatatggaactgctccctaaaaaaacaactcaggaactgagtttctaattcagaaatgttccctcagataaaaactcaggaactgtgtcaacgatcctaaaattgtgagtattttcttttcaaacaatacttttagatttttagaaatataccataacagaaattaacagtcaaaatagtattttatacatactcaagttcagagattcagttgaattgtattttattcaaataatattataatagctagcacattacatcttcagaattaatatatactccaatatattgcatccagcccgaatcaaaattcagcatccatccatatcaaagtcacatccgataaatcgaattggaacttgtatacaacgctatacatgcaatctagtagcaatagcattagcatgttcctcttcttgtgcggttcgtttcaaaaaagcaggttcctcttcttatcaacaacgaagaaatcaaattcgattgagagcaaacgcacaagtaccatgataatcgaaaataaatactagctgttagcttgttcagtgggaggaggagatcaacgcggatgtgaacgcggtcgtcagggccgaagaaatcggcatggccgtggtcgatagggaggagatcggtgcagtgcagatgcgcgtggtcgccagcaacggaggttggcacggccgtggtggctagacagggatcagcgacatcgacggcgggaataccaggggtggaggatggcaggataatcgaggtcaccgacggggagataaaacggcggcggcaggatgaacgccggctgatcgaaatgggcgccaccaccggaatcgagctgtgcaggaacggacggcggatggatgcggcgagacggtcggagcaatacgagacttaaaagaaaaggaaaacacaaatacccaaattacccttaagcacataattagtaagtactaatatacccttccaaacagatggttcagatcatttctactggtagtagaatactacgagtagaaagcaccgtagtcaagctcaatgaactaacgttcaaagttataagactgtccgggtaaccaacaaaaacagtttggggaacctgactgcccatgctcctccccttcgtgcaaataccggctcactctttgaaggatctttggttttacagtacagtacagttttaccataagtaatgcaaatgctactaagatagttagctgtagctacctgtggaactccaaggtagttcaggtgagggctccaataaaaatcatcaaataagtgagaactcatgaaaatcatatttaaaagtcttataaatttatgaaaaaaaatttaaagataaatataccaaatcttaagtccaaactcaactttatttgagaaaaacaaaaaagacaaatttcagatgaatagtgttatattactattcgagtaaaatgcgttgcaggtactacaacttgcaaggtgggtacaatttagtcacccatcttgtaatttgctcaaataaatcactcaacttgtttggaggtgcaaatataataaaaaacgtgtcacgcgtattatttttgccaaggtggacgatacgatggcagacgtgacgatgagttggcgaaagtaatacagttttgtagaaaaacccttctactatattactctttgctaatttaattggtctatttagatatgttatgcccgtgtgctaagccatgatcgtaggtttttttgttggcgtgcgcacgggataggacggcgccagatctagcgagtcgcggtgatagcctgcgtggctgcgtatgaatccatcatcggcgaaattatcaacgctagccacgagcgctcctatttaatccatgaatatgatgtcaaattaccacattgaagagtgcatataaaaattggttttagcacaaggaacaaaccgctttatttcccaatataaagacaaacatatatccttgtacatcaggcaagattcagtactggcagcaaatcacgtattgaagatttggagtatcaaacaaacatatgtactcaaacgaaaaattgaaacaatataagggctaatttgcatctttgttccttgcatacaaggtgaacctgtcatgctgacgtggcgtccaccttggtacaaataatattgcacctctaaacaagttgagtgactttttttttagataatggaagttgagtgacttatttgagcaaattacaagatgggtgactaaattgcacacaccttgcaagttgtggtacctgcaacgcattttactcttactattcactcaaaagttatctcttttttccctctataatagagttgagtctaaacttaaaatttagtgagaatgtatttcatacttgcatctatctacagtattcttctcatgaatttatacactttttaggtctagtctcatgggttttcacttatctaatagtcttcattggatatgtcgccgttctgattagctcacatcaacttctcctttctgcaaagctaaaaaaaaagggacctatcaagtcttgattataactttgtacagcaacctgtggcggtgcgtacgatgatcacatcatcgcgattcactcatctttttccgtatagccatattccttggatgttgtcacgatagcacgagtgacaaaacaaactcggcaaaaaaaaaaaaagttcccattttagttcaccatcgatttcgaccgtggattttcttcgtgggtcatgacacacatcataaaaaaagaaaagaaaaagaaaaagatgaggtcgtatgcgtaatgcgttcactaatcactcgtcgaaatcaatggctagtggtaacaggctaacagatagtgccggccgctatctgaaaagattatagaagaaaagctttagcttaatgctaagcgtgtgactggccggaccggaggaatgacaggtttttgggctggttgggctcaaagtttagaagaaaagggtcgcgtcatgggccaagtcagcagcccggcccacctgcagccgaagcaaaagcaaagccagctgccgagctgcgtcgtaaaggcgaaagcgaggcaccagctaacccctctctgccttttggttttgtgtttttttcaccttttgcatgcgtttttgcctgcctttttccacatgctttggagcttggaaggcgcgcgccttcgcgctagtggcaacgtaaaaactattgcaacggagacgctcccacattggcctcgtgccaggttagccggacggtcgtagaaccaccacatccacaggtctgtcaacgagttttctctttcttaaaaaaaaaatcataatgtctgcatactcactgaaaaaatcaccaccgacgacgttcgacagatatatcacctactacttaaaaaaacaattatctataatgtttcatacataaatctggatgaattggcttgacgataagaaacctagggttaagctacgctcacttcggatgtcaacgatttttctaacgcaaaatagagggagaaaatcaccagaaaataaagtgtcgccggatttgctcgatttcctcgtgctcttgcctctccttcctgcgcccttggcgtgtcaaagcagccggtcactcaggacgatgggcgcacgcgcacggtgtgccaactgccaaagccaaagcagcagcaaaagcattatcaaaagcgcacgagcccgcgccaaataggcgccctgcatgagcaaacgtgcatatggttgatttctacgtgaattgagtgaatattagtggagaacgtttgatttgattaacaagcgaggatgggttttaattgcgatggtgttatgataaagttgtaggtgtatgactctactcagatcaaatattgttctttataaattttggccgtatagtactctgagtgtatccataaataatgagaagaagaacttatattcttttttctccttcagcccgtacgcagagtgccagggctatccatggccatgtgccacctgatcaaccgcacaactttcccctcccaaaaaaaaaaaaagaaaatagaggccccaacattcttatatttcaatacaagccactaatttccaatatattattatcctattaattttatttgttcaaaagttcctctcacgttgatgtactgatttgcctagaacatatttatattttctgggtccaatagatgttcgataataatcatggcatctaatttatagcaactacatgaacaagcgttctagtactaaatattccatttttcgcttggtaaagaaaatcaaataactacattaaaaagcacttaattttcttacttaaggaaggcgttgctaccatttacgtaatattttttcatggacaatttactatcctttttattgatactttttaaacataaaatcttgttttatgtttcatattagggtctgaaattgctaggtacggtcccgcccttattatcttcttcctcttcctcccctttcctctctttccttctctatatggggatcaacgggcaaagagcttaatctgcccgtgtgtacaagtaccatggcagagatatttgtcacgatatcttccatctgttcacccatgagattgtacggtccacctgtcaatcaatatacgggaataaagctaatccctccattccataaaaaaaccaacccagtactaaataggattttccctttttaataatttgctatcctattgttgacagttttcagaggtgaaaattttcgaattttaaaccatccaatatgctttgagatttgtgttgtggaggaaaatggaaaaaaaaatcagatgctcacggcaaggatcaaacccgaggcctgcagcttgcatgctcgttcaactaaccagttgctccatcgatattttcagaaatcacttatattgtagttacgtagtagtagttagtacaatgtaactacatagttacaattgaaagttttcattttaaaaactatcgaatgttgtatagctactcctattttttaatataaacgaattcggataggctataaaacatcgtatttaatactagattggttttcggtggtactaaaaaagtaagtaggggacagcgagtggggatgtggagtacgtacgacacggtacgtgcaggcgtgcagcaagacaaggcgaggagacacactcacactcacagacacacgcgggaaaagcgaagcgaagtctgtctgctggggcaattatagaaggattagcgcgagctgcccggccgaatactaatcggagggagtatgagagcaggtacaataagctaattcagcagggatcatccaaatcctagctggaagggagagaatgaa

SEQ ID NO: 68122 - DNA, 44274 bp, Oryza sativa
  unsure (1)..(44274): unsure at all n locations
gccgccgtcccgaggcgttcggctctgactgacgggcatgggtgtgcatgcatggtgcaggcacgggagcgcggtgttcaggtcgcacctgttcgggtcggcgacggtggtgacggcggacgcggaggtgagccggttcgtgctgcagagcgacgcgcgggcgttcgtgccgtggtacccgcggtcgctgacggagctgatgggcaagtcctccatcctcctcatcaacggcgcgctccagcgacgcgtccacggcctcgtcggcgccttcttcaagtcctcccacctcaagtcccagctcaccgccgacatgcgccgccgcctctcccccgccctctcctccttccccgactcctccctcctccacgtccagcacctcgccaagtcggtacgtcctccttcttctccctctccggcgagctcctcgacgagatagagtgggtggatgaattggaggaggagcagagtgggtgggcgtgggcgagcgccggcgtgcgtgcacacgtgcgcgcccgtgtcaccacatggaagtaacttacacaaggccgggaaagggaaggcccaaaaggagtgggcccaatcacacacactctctctctctctctctctctctctctctcatctcatattctgactctagagagagagagagtggctcacctccatgtgggccccaccccatcggagtagagttaccactaccagcagccgaaaatccacgttcctgttcgccaccagagcgtgtgtttgtgcactcgtaaatgtttattttttctctgcgtattcctctggaagagatgcaaatacagtcttgaacatttgtaatttttagagatgaggatggaacgaaatgtaattgcaagaaatggtgatgaaatgcaaatgcaggtggtgttcgaaatcctggtgaggggcctgatcgggctggaggcaggggaggagatgcagcagctgaagcagcaattccaggaatttattgtcggcctcatgtccctccccattaagctgcctggcactaggctctacagatcactccaggtactctctctctctctctctccctctcatctaagttctctttctctctctacctgtagtactccatgtaaacctgcactgcaccacacattgatctctactactctcttctgtcagccactctgtctctcctttatgtctgatgttgctcagccctactccatgcagcatcagcagcagcatgatcagtgtctcagctgccatcaccattaacctctcttaatatgttctctctgtttcacaatcttggattaaatgtatacaattgcactcgatccattgcacatttttgacacattattgtgtgtgtggtcatcaggccaagaagaagatggcgaggctgatacagaggatcatccgggagaagagggcaaggagggccgccgcctcgccgccgcgggacgccatcgacgtgctcatcggagacggcagcgatgagctcaccgacgagctcatctccgacaacatgatcgacctcatgatccccgccgaggactccgtcccggtgctcatcacgctcgccgtcaagttcctcagcgagtgccctctcgccctgcaccaactggaagtaagcctgtatacctgaaacctctcttacaacacagtaagctcttaattggatcaatacctgcatataattagatgctagagatgaatcctgaacagaaaagaaaaataaaaccataccctaggaagtaattaaggatcctctgttgctgggcatgggcagtcagcaaaaagggtccagaactgaaaagagttggattttctttcttttttgtctgaaaggaacatgatcaactattcattttgtcagagccatgtgttgtgcatgatatactactatcactattgtctactacacacaatggcagaggatctgtgtccccaaacaaaaactagatcataaaaagcctacgaataagggagagatacgtaggtgggcagaagggatcagcagcatataaagggttgtgccaaccttggtccatccctttcttgttggcatcttagagctatcattattatttgttatctaatgtgccatctgaaaagaaatactactactacttgtgtttggaccaatctttgcaagatgacgtgcgttgcatcattgtcaatgtcaggtcgggtacatacatatcattagaacagagtcgccttctcacaaaagaaaaggcttactatcatgatgtatcatctacttacatatcattagtttgtgctattatgcgttttttttttctaaccggctataaacgcatgtgcaaggaatagtttttttggttgaagtatggagggttttttatcaactggggaaaaaagaaggttacataatttggctatttattctatggagattagaaggcagcagtaatatttcctagctagcatgtcctattacaccagtagcattgtgtcatatgctagattccatttacatcactacagtgctaagaaattactcgcgtgtcgactgtgtttctgttttgatgccatgtgagcaataaactcattgaaacctctgcatgtctaccactgttagagaacatgcatatcgcggctgaagataaaatccaccgtcagtaattacttgttgtaacaatgatgaataataacaccaatcacattctaatgctaccaggaggagaacatacagctcaagaggcgaaaaaccgacatgggtgagaccttgcaatggacagactacatgtcattgtcattcacacaacatgtaagtatagttcattaacactgtaacataaatttctatagctcaaaatctactggccccgtgtggtttttttcccatgaccccatgcgatttggaaaattggagtgtaggtgataacagagacgctgcggttgggcaacatcatcggtgggatcatgcgcaaggcggtgcgcgacgtcgaggtgaaggggcacctcatccccaaggggtggtgcgtgtttgtgtacttccggtcagtccacctcgatgatacgctctacgatgagccctacaagttcaacccatggaggtggaaggtaagaaagagccccacatttggtagagatgttcatccaattgctacccctttaggcaacaccagcataataaggatttgatgagtgcggttttggtgggactcctaacatgtgggcttacttctatatcagtaatctcatgatggatttgacattgccttgtactaacacttagtattgcagaaaataacagagattccctcaaagttgcattagtgattgatatatacacctaggcagaagtcaattgaatctcccaaaataactggatttggtagttctttgaactggtaaattcagacaacataagcttaagctgtccaggaaaggaatacacaccctttttttccctctattgtgtactttgtgtaagctctgaaaatgatatgcaaataattaatctaggcaaatgatggtgctgtactactgttgaggcatcctatcattatgatttgatttgggaagtctaataatgtgctaattggtcaagaaatcaatcaatctcaacaggagaaggacatgagcaatggcagcttcactccttttggtggtgggcagaggctgtgcccaggcctggatctggccaggctggaagcttccatcttccttcaccacttggtcaccagcttcaggtatggatcaccacatctcaatcttggccattcttagtgcagccattgattccaactccttagctttgtttcatgatcacttggcaacaatagcttttttttctttctagataatggaatacaaactacaacttttgcataattttccatgatcgctcggcaccgatagcatttttttctagataaaagaataaaaatcacgacctctacatcatataatgaatggaataaaaatcacggcctttgcatcatataatgcacgcaaccgggcaccaatggcatgcatctcatgtagtcatgtccctatcatttggccatgccctcttcgcatgcacattcatgttcctagtaataactaatctctgtagaacaatagaagagcggaacagtagatgaattatgcgttgattgacagaataattgtgggggggtatatagatcgggtacgtacatgaggatttgaagatcaagccgaatctttccagagataaaaaaaaaagaaaaaaattatgtcagataataactggtcctaatacgtcactagggatagcatcacgaggctttctcccatgcttatacctcctctgttatcatcttccttgagggagtgatcttactgtgcttaaggaggtatctaaagcggtggtgaagccagcgacatcgtcgagcccggataactaatagtgttttgtagtgatcaatccatttttacacgcgtcaacggtgattggtagtggagacgccgacagcgaagcctagacggtcgttcgacctggagccgtctccacctctgatcgaaagatatagtatggtattttcgcctctcacactgggagatacaactttcggcctacaaaatcaacttctggttttaaatctaagatatagattatttctagattcaagcttagaaattgttttttttaagagacagagatagtaccaaattctatttctataattttcttaaatacagtaaattatttcttctcgcgaggaggattacactgcgtaggaacactaggtcatttttcatgtgaaagaaaaaaatggaagctacgaggaagacaaataatttcggcgcgcggggcgaaaaagaagaagatcaaggaagatacccaaggtgggaggtcggtccagcctctattgcgaatagagcggggtgttgttccgcgcgtggggccacacgtgcgcgcacatgcggcgcatatccatcccttcccccccacacccacatgtgtgcatgcatgcggactacgccgctgtacgcgtgcgtggcttacggcgcccgctgctacagctacagcgcccgcacgtgtcagctaccacgccacgccctgcatgcccaccgccgctgcacctccccttgagacgtggtcgctgggcggtggtgggtctcacatgtcagtacgtctttcgtcaaaaaaaaaattcaactttaatttgtttttttcatggtctcacaaccatgtagcttaccaatgcaaacagactaatctaaaaaaaaaaaaataagcttagctataatgcacgcttcgattaagcaatgttacgatgcgtgtgcttagctcaggatagtgcctatattgacacgaaaatatactacatccatataaaaaaatataagcattttttactataaatttatatatttattcatatttatagctaaaaatacttatattttgggtcggagcgagtatcatattttgattaccagtcgtccatcagctatggagtctgtatagggctacgtcctacgttcgggaggtagaaaatatggtgatttattttatttttttgcggggaaatatggtgatttattaatatatgattaattaagtattagttaaaaacttaaagaataggttaatataaatttaaaaataatttttatataaaaaatcgtattgtttagtagtttagaaaatgtgccggatcgggttgagttgggaaaggaggcgggaagaagcgtggtgtagtaattggcgaagggggtaagaagggggagaccggagacatgggtgtgatggttaggcagccggaatgggctctctatcgactcgaacagttggatgagatgagacgagatgggtgacatgcgtgcgtgcatgcatactttgtgccttgtccggtccgtgactgaactgaatcccaggaacgcgaatataatactgtagcacgcacgcacgcacgcacgcatccagctgatctagccggccgagatgtgccactttgaccggtcgtcagacacgctgcatcaatgtaggagcacgtgccagggtatggtcgctgcatgcctgcctgcaaacaatactatactcctcccataaacaaatcaaactccaacaagagaatccgacttgctagaaaaacatcatatcactttaaacaatggagattggagagtccatcagtccaatgtgtttttctgtcttctttgaccatcttccaattccccattatgcttgtgctgacctctatctaattgatcctaagagaagcgttttgcaacatcttgtaaaaaagcaaatcacataatattactcgtgctttatgtagctaagctacattggatcaggatcctctgcagtcaaagtcacgtgactttgtcactgacattgtgggtccgataatcattgggtccacatgtcttacaaagacaatccggctacatcatcatgccagtttccgtaataaattgaccagtaatttagtactatggactttagaacctggcacatgcatagcacagattcatgcatgcgtgcactgcatctgcacgcatttgcattggttgcacaagcagctagctggcctacatataacatattactgtgttatgcgagcaactggccactgtccacatgaagccagtaaatcaactatcaacattgatagtagtaaagctcttgttcagagttgcaggcatataggtgctccctgcatggtttgctcaaacttaagatagatgatactacattctaaaaatgcaagtatttctggtatgtatctggacaagatggttaggactctagctataacatagaaaatgcttatattagaatacacttcattcgtctcaaaatataaggtattttgatcggatatcgatcccatccggttaaataccttaagtagggagtggcagtggcatcaccatcgatcatgtgttattgataaatgattatgattatgagatctcttatctacaatctctttctgaataatcgacctgctgatccatccattgcatgcatggttgttgcctgacaaggacattgaaatggactgctaattgctgccatggatgcaggtgggtggcggaggaggaccacatcgtcaacttccccaccgtgcggctcaagcggggcatgcccatcagggtcaccgccaaggaggacgacgactagccactagccaccactactactataccgatcaccatactcaactagtagaggagatccatcagatgcatgcatggatcgatgcagatcggtcggtcgagtacgagtagcccacacgagtcgacacatgcatgcaacaagccaagttgcacacaccaagatgcacatatatatcatctatatgtcgatctatactgctacctacctatatatatatatatatatatatatatatatatatatatatatatatatatatatatatatatatcacacgtgtactagtactactctagcaagggatatgatcaggaggggcaagctctgagcaatggtccctgcaagatggccagttgctctagccattgatagaggtgcttacgtatggtgtaattatacaggaagggtaggccagcattagctaggaggcagctttgttaatttagccaacatgtattgatgtataagctactgatcgattaattaacagtactactattgtagaactactgctcattggcctttgatttgatgctggtgctcatactatattagtggtgaccactcatactatagtagggttaatatgtgtacatggaggcattggtccacaaggagcaagtgaaatgaatcaatgggcacaggaaaagggaccctatgcaagcagcaagctgataggactttgaccactgagaagctgggggcctggggcagtgtggtgcagctgcggctgcatgcatctgctttgctttggagtgggggaaggaagagaagaagagataagcatatagggcctagagagagaaatccagcatggaacatactgcactgtagtatacatacgaatacaggacaggagaaagagagaatggactggtgaattgagtttcccttgatgtagcccagctttttgtgtgatcttttctgcaaggttcagctgcagacttgcagggggggtaaaagccactggatccttttgggagatatgccttcatcataaggctgatggttaaggcaccacacaacaaatgaagagcaacctaggggaaccaaactcaggttgccaaacataaaacgtcgtggctaatgattcgtctcaagagtcaagatcagatcagctgccctacttgtttgtttccctttcttgagctagattttcccggctttggaacatttataccactgaacatgtatcaccgcctttgtcttcctcgtgtcagatgctattggaaccctcatcttctctcacgaggatgatggtaagcatgatagctcgatgtcctacggcacgaaaatatgggtgacccaagatcaaatagcggcagcacaacgatctaacataatatctggactggacctcccttctgcagttccttccaaggtatgcccagtagagaggctaatgagcccagcttttggggagcaagggaggcaggcacgcacacacgcttgccctgccctgccttttcaattaactctcatgtggcctaatggtccaattaccatgggctccttactttcattaactctcctgtggcataatggtccaattaccatggacaagcctcctccgtttatttctttctttcctctggcccacccgcatgtgtgcatgcttgccaccgtgcttttctaaactaaagttgcataggatctccctcttttttggaaaccactacatttccaaaaccgcggccatacatatcaacagatgattacagaaaacatgctaatatatgcagcagcaagctcaactacacaagctttaaacacccctctcttattagcattattgaattcttaccatattgccaagctgtacggtttgcagctacagctcttggaccaccagagaagccctcctagcgaaccaaatgcatccccagatttattgtagctctgcttcaagacggtcctgcaacagaatagtacaatcgcaacaaaaaaataataataataataatacggctcaacgtgaccaccacagaaccaaaagaacatcgaaatatcaagctgcaaaattttagcatagttactggttaatacacacaaataatacatcaggtcatgtgaactaaggcatgtacatgaaccaacagatggactcaataacatcaaagcagataagatgcttaaagtccaaatcagtccactagctagacacaaaaattcaatgatttgttcatagccatgattttaagccccaaaaaactacccaccagaaaagcctgaatagtagtgatgtcatgaaacatagaatgaaaactagcagattttgcaaaaagtagttaaggcgcaaacagaatgcaaactgtggacctacattcaaaacagatagccaattggcactaagagttacggattgatgtacctatggtgataagattcatacaaattgtggatgttaacaaagtattcatggaccacactgcagcaaaagggtctctcttcatagaaacaaaattcaggtttctggttatcatcatatcatgccaaataactccaaatgacagatgtattagatttgcaacagcagcaaggaccacaaatccattgttctggcagatccttgtttaccatattatcttggattggtacagtaaaaagctggtaagaagctgaaggccgtactagcaaagatgtggatatatcaatagcagccactacagagggaaccacacgccctacagggccagaaatttcagactgcaatttcactccaggacattgacttatgatgcacagcacaactgactatgggacaaagttcctaaacccccagtcccagcgcacagagatgtttctcaaatactgtaaataactgcaggaatagtatagatacatatgaagagcatcctatgttcgggagagagcaaaaattaaactgtcttcataccagccgcaccgcatggccacaccagacagcctacagttattgtcacatggcgatcatgagctgttggtttggctttcagaactcagaaggcaagaaaaatcatactgtccaagaaagccatttcagttgatcaccacacagcagagaaccaaaaggaagtgtaaattgggaaaaggagaagatatgcagagtaggcatatattgtacaatgctaaacaaaatagtagtgaaattatgccatcagtgttcaggcaatcaaaccaaattgcatgaaaccaaggattcatcaatgtctggtcaaaatcggtaccacaaatatgattaaatgatggtctaattaactatctttctaaatggaaatcaaaagggcttcatattaacattaatggatccaaagtatgagtcggcacactgaaaaaaatatgatagagaaaccgttctaataactgtaagcaaaatattatatgccaatgccacagtttgagctattgacacagtggatgagaaggacccagtcatatctcataaaaggggcatggtgtttaagttatataaatctacctttaccgatcattagttaaaagattcagtgagccagaaatacacatagccatccacaaagaaaggccaaacattgctctctgcaataacaacatatgaaaatcagctccatgaccggccacctccataccctctatatctatcacggtggcctgcaaagatgtgacaatagtcagtcacattcagaattttcaaattcttaggcagcactataggtgaaaagaaagtaggcagaaatcagaatctgtaaacttgcttctacaataatttgaaaatagttagataaacagagagcttgcctgaagaagggggtggtgcaccacgacccatattagctaattcagggctgaccttttgtccagcttcttctagtatgttgatcagatccttggcaaatctggcattagcagcagtgaaaaacgtgtaagctgttccttttgctccagctctgccagttcgaccaatgcgatgaacataatcctccaatgatcccggaaagtcatagttaatgacatatttaacatccttaacatctgtttccagatataagtggcattagtttacagaaataaatataattcatcgatctgggaggatttttgtatacctaagcctcgagcagccacatcagtcgctgtcatgatagggcttttccctgatttaaattcagaaagaacccaatccctctcagcttggcttttgtcaccatggatagacagagcaggccaaccatccatccgaagctgtctagtgatttgatcacatcccttcttcgtgtccataaatattaatatccggctgccatccattatatcctccagtagattaaccaaccttaacatcaaagaatttcatcatcaatgcattctgaatgaatcatttcagtgtgtaatgaagagaaaaggtcacgcggatcctacttattgtacttctgactctcggataatatctccacatgttgagaaatggcatgattagctttcaactcctcagaaccaattatgacctgcagcacaaaaaaagcaattgagttcacatgaagcagataccgtagtctgccataaattcatctgcaaaatgatgcattggcaaaaataaccaccttgtatgggtcgaaaagaaagttccttgctagctgttcaacttcctttggccaagtagcactccaatataatgtttggcgatctggacgaatctgaaaaggcagatggtaatcccttaacactatgtaaaacaatgttggtatgttgtaggcacggttcatggaggaaaactctgcctatggctgggcagtgttggctgctagggatgagaggactaggttgatgcaacaaacttggggagagattataggttgatcttcatctgattgattactaatggatacatgctaccctttcattctgttgacagtgtataagtaaaagcatgtaacatgtagcaagcataattattagaaaattgttgagaatggaataatagattcagaagaagaggcatacctgagaaacaattttcttaatctgaggttcnnnnnnnnnnnnnnnnnnnnnnnnnnnnnnnnntaaaacaaggtaagtgaccctccgcaaatttgtatgatgtgattctatcatatcaatcagtcttcctggcgtggctataacaatttcaacgcctggatgcaaacagtgacaaattaaactaaatatactacacaggatgaatgtatcatttaagctatagatcaataggatgtccttttgaacagtgtcatttcattattgaccaactgaatgtccttcaaacattgttcatgacttcatgcgtgcagtacaaaagattccttctggttgttgaacttcctagcataagaaagaaagagaacctttttgaagatcgcgaacttgaggaccttttggaacaccaccatatatgcaagtactttttatttttgatgacgcaccaaacttagttgcctcttgctgtatctgcacagcaagttcacgtgtaggggctaacaccagaacaattggaccatcgccaggtgctttaataacacacggaaaaatgttagtagattaccacaaaagaagtccagaatgtatccaagaaaatcggttaagaaacataagcaacatttcgcacctagaatcggctgagcattaacatgaacaatggcaggtaaaaggtaagcaagtgttttccctgatcctgtttcagcaatgccaataagatcacgtcccctcagtgccattggccaaccttgagactggataggagtaggttctacaaacccagcttttgtaatttcttgcaaaacatattctgcacaatggaagttaagtatcttggatcaggaaatatagaatgtaagatgtccaagattaaaaaagagcaaaataataaagaatgtagttcagaaggtaaaggggctcataaattatcaatggctcaagtccaagaatgcaagcagaataatctttgaagagcacaacagatcttaaatgaataacaagtgacatattcatatcctttcctcctgatgaatgaattggctgatgaagtgatgataatgggatttaatgagaggaccaacaaatcctaatcggagttcaaagaaaaccaaatgatactttcaccatttagtgttcagcacttgagctggttgcacatgttatcgctgttggctgtttttctttggaaaaatcattttacaactgttaatcatggcctaactccagtttccaaccctcaacttcgaatagttcaccttttgaccattgactattagaaccacctactgtttaacctttggcctcattctagagtggttctgcagttacatgtcactaatgtgacaatgtggctcaaggttgaaatagttttgagtatttacagccaaaacaaattccgccaaagcagaaattgtggtgtgaaataactgttatgatacttcaattctttgatgattcaatgtagtttacaacacaaccagctaacgaaacaaatagacctatacattcccctcctgaagcacgtccatctaaattccaattcctcctggagcacgttcatctaaattgcatacatagtactatagtaagtgcaggacaagggtagcagtagcacgcagcaaacgaaacctgggaatccgacatcgcggaactcgcgcactggcttgggcacgtcgcggccctccacggtgatctcccggcggcgccggtaggcctccacctcctcctccgtcatgccggccacggagggggactccacgtagaagttcttctcgaaccgcggcagcccatccaggtcagcggccgcggccgcggagtccgccttgctcgtcggggcgaacgccctcgtcccgcccccgaacgccccttcgctgcaaccaaaccccaacccaacccaacgagcaatcagaacccccaacacttagggcttagggtttagaaatcaaaaccacggtggtggagcggttacctgcggcggtcgcggtacgagccggggtccgcggcgcggccgtcgaagcggctcatggcggcggcggcggtcgccggcgacgagagggaggcggggggtgcggctagggtttagggcggggcgcacgtggccggagagtttggtgggttctagaagaagaagcgaagcaaacggaggacgcgaatcgaatttggaggatttggatttggagggcatttcagtggcggcgagttcaagcggaggggaaaagtgtggggagaactgatggagcctatgacgtcgaaaacgtactctgaaaaagcacaaaacccaccagaaaaacgtaatactccctgtgtcttggtgttttttttttcaaaatattgttttcttcgcttcttaaaacggctcaagatggggaaaacgaacttttgattgagccgcggtcgattttaattaaatttagacctagataaatggtttatgggtttcttcatcttccttctttaattatttttcagccttttgactttggactgataacagtagaattgaaaaactacgaattacccccccaactatcatgatcgaccgaattaccccccgaaccataaaaccggacattttttaatcccaactatgcaaaccggacgaattacccccctcgacccaattcgcggtggttttagtaaacgtgggagtacagtcagcaattcttttaatataaaatcagtgggcccacctgtcagttcgccacccctctatctctctatccccaatcccccccctctctctcttctccctcccctcaccagctcaccagcatggcagcattgagaatggcgacggaggagtggagggcgatgctcgggcgctggcggtggcgcgcggaggcggaggttgctcggacgccgatggcgcactcgtgcaaccagcaacgaaggcggaagcgaaggcgagtagcggcacgcacggggcggccatggcggagaggcgatcataccacctgtcatacctcctcccccctctctctctcaggcataaagctcgcacagcggtcggcgtgtgggcgccggtggcgcgcgtcagacgggcagtcggcgtgcgggcggtggtggagtgcggggaggacgcggcagcggcgggcggcgtcgaggagggtgttggaggacgagggcggcaggacagcggtaggggcggatggagcttgggggcggcgggcggtggcggaggccgctcagggcatcgaggacagcggcggacagcagtggaacgacggcgagcgagggaggtaggacggcggcgaggacagatgtagcttggggtggtaggatggcgacgggcgatggtggaggccgctcggggcgtcgaggacggcgaggctgaggcagctcggggatgggcggcggaccgcggactcactgccggagcccgatgttgtgtccctcctggcatccctcacccgccctattaagcagaagaggggaacaacgctgcaagcggtggcagtggagtgggggcggcgacgaggggacaggggaggaggagctcatcctcggccaccgacggggtgcgccgcgagctatgtcactgcccccattatgcccgctctcccgacggtgccacacatagagagagagggggggaggaggagggaagccgcgccgagggggtgactgctcgtcgtggccgcatccgccgacgctgcctcctcgttccccgtccctgccgccaccgccgctctgtgtcccccgcctgccaccgacccgtgagagagagaagagagagagaggaagagtgagacagagagtgagagagaagagagaggaagagtgaaagaggagtatgacaggtgggtcccacacatttttataaatagaatattgactggactgccacatattatggattgggtcgatggggtaatttatccggtattgaaagcatagggtaaacgatgtctgattttcgggtttagaggggtaattcggtcgaccgtgatagttcccggtgtgtgtggggtgaggggggggggttggttaatttgtacttttcccgtacatttttatcctagttcgtttttaccaatcatgtgtttcgacttactagacgtaaccgtgatggccaccgacgttgatgacatctatgggcgcaaatgcatcatgcaccttcttacaggagatgatgttgatgttcctttcttcaccttgctgccttgagagttgagaccacaaaaatactttccggctatggtctctcagtttgtacctatgtctcgtgaatggcagacgaaacataacatttcatgcacaaatattctattttgctttcccttctcgtcatcgttgaagcatgctaagagtgatctactgttgttatgggtggggagaaaaaccttgcataccgtggaccgtgcgaagctggtgaatataaataggctctgtttatttcacaaaacaaaaattctcacgctgtcatattgaatgtttagatacatgcataaaatattaaatatagataaaaaaaacaattacacagattgtgtgtaaattgcgaggcaaatcttttaagccttattgcgccatgatttgacaatgtggtgctacattaaacatttgctaatgacagattaattaggcttaataaattcgtctcgcagtttcctggtggaatctgtaatttattttgttattagactacgtttaatacttcaaatatatatccgtatatccgatgtgacaaccaaacctaaaaattttccccaactaaacaagtcctgattagcaaacaaccttcttttacatcaccgtccgtacgttgcctccactcctccgaattgtgtccaagttgaaattttcacatgcaagtacctcaagggtgtttcagatatatttccttgtattccctctcttcaccaaacaaaatgaacaaaatagtaataactgtatccagtagcaaatatttaacttttgataacatctttcacgatgttctataactaaaaccacgaagtcacaatgtcaataaaaaatatcttattggaaaaaaaaccgttttgacaacaaacacacatgaaaacacttgaacaaactttgactgagatcttataagcatttctcacgataaccaatgggttcaaatcttttcgccatcatacgttgcaccggttactcttacaaataataaaacatcctcatctctgctattataaaaaattgaagatatttttatcggtacttttgatacatcatccgtgtttaataggtttttaagttcaatcgtttttagaaatacaaatccatctttgagtcggtttttaattttgttcgtttttaaaaatacagaaggagtcgtataagaaatctctttaaaaaatttacatgctaacttgagacgatcggacccctaattgcggcttatgattttgtaaaaagaatatccaagcgaatttccacgataaatttcaccttagctaaaccgtataataataataagattaaaatagtcttcacccgttgcaacgcacgggtatttttctggttgtataataaacttatcatgacagtaaattaaagattggagagaacttagctaatatggtggtggactcagacgtgggtgggtatgaagtgatcaagagtttatgctaggcctttcggcagccaaatacatagtgaaagtaagagcaggtataataacaggctataagtcggctgtaaatatattttaagaagataaataaggagagagaaaagcagcgggctatagatttgtagccatatgtagcacggactccaagacacagtgtgtgtataacaggtgagaccaggtgttaattgtgtagtatgtaactattgtatgaatgagttattagattggctatagatgaattggagctagtagttagctataatattaaacttgctctaagagtgtgttcgctagttcccaaccagaaccctccgcacgaaaaacggagcaatccattagcacgtgattaattaagtattagctaacttttttttttcaaaaaatggattaatttgatttttaagcaactttcatatagaaatattttacaaaaaatgcattgtttagcagtttgaaaagcgtgcgcgcggaaaacgagtgagaggggttgagaaaaagggcatccgaacacaccctaaggtagccccactctctcctaaacaccccctaaataaggtagcatgtgcttttacatcgaggcctcatagcggtccacccctgagactgagtctcaatctacccccggtcgtgggtacacgatgatcccatctgctagggtataaatttggtgctcatagacaatgtactattgatgtttttagataatagaagcattgttgtgctcagttaattaggaaaaaaagattcatacctggaatactcttagcctctgtataacttggacgcatgtaaccaagcatacacccacatgctagcttttataacaaaggaaagtatagaaaaaaatactaagtaccatcaatccacgtaatatactctcacctagcgaaagtgaacataattcaaatggttagtttttttaacctgttcatgagtatatctaggttttaagttctagaattagcacgtgtactcgtatttacgtctaattatttaatactgatgacatatctgttgacagtgaaacgcgtatattgaccaattcaacctcaagacatgcttataaagataggatgtgtcaaacgctgaaatgaacccaaccaaagtggatgaacgttcactaaacaaaacacatcacacgtcacgttcaatcaaactcatctacaggctgcaaccaacgaagaccgagtttagttctaaactttttcttcaaactttcaagttttacatcatatcaaaacttttctacacataaacttttaacttttccgtcacatcatttcaattttaaccaaattttcaattttagcgtgaactaaacacacccaaagtaaagccctatatcggtctcttcattctccacctcgatagccgccgagatcgatactttgggtctatttggagagctaaaatcacgagaagcggctggttggttgtcagctttataaaaatctagaaaactagaatttttagtttttaacttccaattcattctatagtctgtacaactataacttttattaagatttaaaaatctggataaaaaattagactgtttaagatatattgattcaagagactaggatgtatttagttcatactaaaattggaagtttgattgaaattgtgacgatgtgacggaaaagttggaaatttgtgtgtatagagttttgatgtgaaaagttttctttaaactaccaactttttcatcatttcaatcaaacttctaaattttagcgtgaactaaaagacatctcagacctagtagctaacagaaacgaaacagatcctttgatgtttcatccttatccgtagaataccttccattgcagctccaccactagaaagtctagactctagagtagctcgaaacaccgaagcaagcgaaagagcatcgccgtgccgcgcggagcttttaaaacgccgcaacttccttccttccttcctctcctcccacgcttcccacttcgatttcccaaccgcactccagcgagagaaaataaaattttaaaaggaaaaagaaaaaaaaaagatatatcagctcccgcctggggatgacgacgagctctcgccggcgatggactcaccgccgcaccaactagcactcatcgtcctcctcgtcgtagccctcgcggcgctcttcctcgccctgctgcgcggtcgctgccgctgtcgcgagggcgaggctcatcagctgcccgagcaggcggaggccggcgcgggggtggcggagggggaggagggcgggagggagaggaggaagcggcggaaggcgaggaggcggcagcggaagggcgccggggacgacgacgcggcgggcggcgagggggacgaggcgctgcagctgcagctgctgcggcggcggccgcggttcccgctcgcctcggtggccggcgcgctgcagcggcggatcaccgcgcggtacgacgacctcgcgcgggccagccaggcccactccctcaccatccatcaggtcagcagtgcgccgcgtctctgattccatatcacaaatgtcgcttcagatgcaaggattttgtgcattgcgattactcgaattagggatgtataaagatgtgactccagtagcatgcttgacttatatatatatacaactgggtgccgttcattgtttgtttgtttgttttgctaattgctttcatttcagactttcaagatagaatcagacttaggttttgatattatggatttaatgatgttggttggtacattttcactagtgcggcaagtattaaatcaatggttttgctgactctacatgcggcaagtttgtttaggacagaaataaaaaaactacactagtgttattcacactgacagcaatatatcttcagggttacagtgtcactgttacctgctgaaaaagaacccaaactagagcagtggtagacttctattttgctgtgttggtaaaactagataaatgcatatatgactttggcactatgcagtactcaggccacatgacagtggtttggcaaaacctcattttatttcgtagtttttacgtaggcagagggccatttcctgtgaagtataaattgcacggcgtggtttcatctggtaggtctgcgtcctcttttgctttcttgggtggcacataaactggaatagattagcacaaaggctgagcgaatgttttgtttgttttgctcgtcaattcttggtgcaactttctaactttattggtgtcattggctgttaaagtgttcacttgccttgaaaatttttagaaaggaaataaatctcaaagttgaagattgaacaacgaactattcaccatattcaccacacgcccttctgtaattcatactgaattcatttactacgtgtatgattcatgagatgtgtgacacaccacctatgtattttagtagtagaagtgctgttccatgctccacaaccccgggtcattgacccaatcgacacacattcatggtaactgtgcacggcatatctaatcagaactgaagcttttaatgaaggaaagcaagcaaaagccattttcttttttagaaagcaccaaatcctctaccattgactcaaacaagtgccaagcaaacggagtcatcttaacccctcccccccaccgcccaccgcccaccgcccacccacctccgcacccacgtggccacgccctcctaggaacaaataaacaaaaacaaaataatcgaaatagatctagatatagcttgtgtgaccggctcctacggccctaccattgagggttcgcctccgatcttctgccggaacccatagccatgaggacttcccttgttcgtttcttccttactatcctcgccaacacgtttctccattccccctaccagcactcctcacctcctgaatcatcccaatgttcgacgccgcttggtagcgagagtggaggaaagaggaggcgggggaggagggggaagcagaagggcttgggtgaggtggtgtctgttcacgagaaaaaggaggcaaaaacatcacctttccccctcctgctgttgtgccgtgcaacgagacggcggatcacagaggtgtatgatgagatgtaccaaattgttcgtgctaaaaggaatgatactggcaaggttagtaatattttcttgtatttgtgatacagctagatctggtggatttatttaacagtcggattttagtttgagttgggaggttggtctgttttgagtatatgcaagaacaagaataggaaattttggtgaatgtgtgaagtgttcaccaccaaattattcatcgcctgtagtttttgtgcaattcaagcaggtgctatcagaatttgcgtttctaaccagtgattcagtgaaattaaggtgccagtgtttccaactttctatttttcgcagatgaaccttgattttctattaaggtgccaattatttaaagaattccatttttatgcatcttatgggggaattttgctacctagctagagttaactactccttacagcctcactaacttggtatggatccaatgtatgatccatgtcataaaaagatcactcttagaagttagacccttgtctttacccaattaagtagtatggagtttctattgtgcttgtttcagtaaaaaaatgattcgtaaagaggaatcaaagtgtcgagtggagctcactaatgaaagggagacctaactgtaagttcataagtgttttttcttgcttttatggacataatcttctttattcatcactttgctggataatgatatgttgagcacgtactccctccggttccataattcttgacgttttggacaatgacacggtctccaaagtatatcgttgactttgttttcctattataatatatatacaataaataaatgcatgtttacttttcttatactttgaaagacaaatctatatatgttgttttagttcctttaaactaaatatttttgaagttattgataatcaaagttacaaaagtttgacctcaaccttgtccaaaacttcaaaaattatggaaccggagggagtagtatcttagctgcttgctctgttcctgggttgatcacaatattttggaccatataatctgattaaatggccacttcttcagtgattagattccttggtctgtgtgctctacattttaaccaactatataccagaaataggaatcctgtttgtcaaccgcctttttgtagtagtgttaagactccagaattttgtttcgagttaagagtgaagccaccaactcaaaggacaacacacaattcatatgttctgttatgctgcctcaaccaggtaatatgggcttgagacaacgttgagctgctcaaaagaaaccaaagcttcttttgttcagcgactatttgtttcttttggcttttagttttctacattctgtaacagcctctacgaattagattctaccctgtaatgttgaagtgtatcatgatttatatagcttttaactttttttttcaggttcacgagttcattaactgtttggtagatgcaagaaatgaactgctgcacaagtatgttgctatttgcatgaaatttagcttcagacatccattactccaaataatgtgttatgcctattaggtcggagatggttcaaagaagctgcagaataaagaaggccttactatccaacccttgtagtcgcagggctaacagttatgaccgcctctgcgaacaggtgatgcatttgacaaaaacaaatttcgtaccaacacgactaagtgatacatttgcgaccagaagatctattcatgcaaatctttgctaacaacatcttttgatgtctcttttatatactgacgtctcgggtattggcataggtgcataaattggaagccgagcacaaaaggctaaagaaggatgcggatatctacaactatattcaagagcagcttcagatgtcagagtcatacaaactggtaaacttttactatgttcttattaaaagcaactctgccctgttatattgaaatatgaaggttgtgataacaatgccatttaccttggcagttgattgagcttagtgcgttggtggagaaggccgaacgtgaggatgcccttgccaccgaggccgcagagatgacattcgaggagctgctggctcaggagaagagcgacgccgccttctggcagcgtcacaggaagctgacctcaatcttacccaagtagagtttgataactgaccgcgcgatttcaccatcgtcaatagtagcccgaacccgtaaccagaatttgttcctggtggagcttttaatgttgctagttgcaaccgtggtgtaatgcgcttgccaagctcttgggcgcctgaaagtccagagtccttgaccataaaacctgagagattcaggtggttggctgacgaccagcaaatgctctcatatatcctatctggtacttcggccatgaagatttcttgcctgtggatgccctgatggaattgagctttcttcaatgcagaaacaactgggaccgagccatttatgccacagcctgcactgatgggtgaattggtgatggcttgctgcttgcttcggatttcttgtttctcttttgaggaatggcttgagaaattcagaggcagtagaaggctactaggctagcagtatcatccatggtgcattgctgttcatctttgttcatcttccatctctgcatatagatcatcgagcattccgaagacatcctcagctccggtgagattcggcggcgcgctcccggcggcgaaggcgaccaccttgttgtccacttcaatccagctctgccccggattcttcctcaatccggcctccttcgtcatcaccctcaccttcttggactcgtcccacatgccacacatggcgtacaggttggtgatcagcatgtggttgccggtgctctggtcctcggattgcaggacattggcaatggtggcctcggccatggctgcatcaccatgaatcctgcaggaattcagcaatgctccccacacgcacaggtcaggtctcaccggcatcgtctcgacgagctccgacgcgtcccggagcaagccggcgcggccgaggaggtagaccatgcatgtgtagtgctccatggatggggagatcttgtgcgctctcaccatgcgatcgaacaggcggcggccctccgtgacacgcccggcgtggccgcacgccgacaggacggcgacgaaggtgacgccgtcgggctcaaccgtagctccggccatgtcggtgaacagagcgagggcttcgtcgcacaggccgtgcatgccgtagccggccagcatcgagttccatgagatcaggtccctcgtcttcattccatcgaacaccttccgtgcgccggagaccttcccgcacttcgcgtacatgttgatgagcccattctcgaccagcgagtgcctatctagctcggctttcatggcgtggccatggagctctcgacccagccgtaacgccagtaggtcgacgcaagcggagaggacggtcgccatggtcaccacgttcggcgagagccattgctgctgcattcgccggaacagctccagtgcgcggtcagtgtcgccggacgacgcgaacccgccgatgaccgcgctccagctgaccacattgggcgcgaccgtgccgccgatctgctccatctgggcgagcacgtccaacgccttgtcgcacagccgagccgcggcgtagctggtgatcagggtgttccatgtcacggtgttcttcgccgtcgcgtccctgaaagctttcttggcgtcgtccatctctccgagcttgccgtacatgcagatcaacgagttggtgacgaacaggtagccatgcatgaggcccttcacgacgccgcagccgtgtatcgccttccctttggccaatgcaaggtcgccggcgtaagggcacgccgagagcgccacggccatggactcggcgttcccctcgcagccgctcctttgcatttcaccgaacagctgaaggacatccgcgtgcttcccgctccgcgcgtgcgccgagagcagcgccgtccacgtcacggcgtcgggacgcgcccctgcggcggccatgcgcgcgaacgcgtccctcgccgcgtcggggtcgcagccgctggagtaggcggagatgagcgcgttccagtggaaggtcgtcctccccggcggcattgcgtcgaacacgcggcgtgcgtcggcggcgcggccgagcctggagtaggcggcgaggatctggccggcgacgtcgtgctgcgcgtggaggccgaggtgaagggcgtgggcgtggacggcggaggcgacgcgcggggaggcggcggcgcggagggcgagggggagcgtgtaggagttcggcagcgccggggagagcgcgcgcatgcggcggtagagcgcgagggcgaggtccccgcgggaacggccgaggtgggcgcggaggaggcgattccatgggacggcgctggtggtcggagggtggtgatggtggatcggttggtcgccggcggcggtggagagatggcgcgcgccgcgaggccgatggctgggacgagaggtagagccgcgagcgcgaaggagacagcgcatctgggagtgggtcccacttgccagtaaaagcaaaagttatgaactccggattatattataaatcgattgacttttttatttatcaaacttttttttaagtttaatcaaatttgtaaaaaaaatatattaatcaatacaaatatatcaaaatatatttaatattaaatttaatgaaactaatttaattttatagatgttgctatttttttctacaaacttgatcaaacatgagaaactttaacaacggaaaaaaaatcaaacgacttctaatataaactgaggaatggatggctgaattgaattcagggcaaaaattagcactgcaatctcgccgttaagtacctttttttttaccctcaaaagttaacaaaacacgtacaattctgggttgcttcacaaattacaacatgaacatacaaagtcagggaggggcacatcaatctggaacacatcagggtgtaggagagaatggaaaccaagggaaaaaaaaaaacaaggataaggtagatgagttagctgtgaagaaagtttttgtcagctgcatcggtggccgtcttctgaacattcagaactttgagatgatccctgaccagcagaggatgtcatgagtctctgcggagatgtagaatagaaccaagattagcatgaggcatataacttgcattttgcacaaacgatttcacaggcatagtgtactaaagagatgcttcaggatatgcatactatttactggaagtgtagagcgatcatgtccttgagttgctagacctatcataatatggaaaaaggttgagcagaactattctatggaacagccgttcaaaaaatgtacctgacgatcttaacatttctgaaggacagcatcacagtaagaatcaaggtaaccatcgcgaagcaaaggtgctccaaggaatggccgctgatgaagtaccggttcacactgtatacctttctgtcagcaaggccttcaaatcttgcaagaaggtaaaaacctgcaccaagatgccaatcaaacaacagttttcgttcaagcttttttttgtagaaagagtttctgctaacataaccttactacataagatgttaacggttacctgtggcaagaaaccaaaatcttgagtgtgtatattttggaggaaacaagaatagcattgcaggaattgcaatgcaaggagcggaattcaaaactacccataaccgcatatcatcaagaaccctgaaatcatcgagaacagagcaagaggactcattttattatctgatatactgacatcaacaatggaacacgctataggtgctggggcactattacctttcacatgcgctgctcaccagtatgagagataagagtgatagcaaacaagataacccagccctttcatcaactctttcaattaccaatatagacaacattgaagaagctgatatcatcatctgcgttcatagcatccagtgaacattcatatcgaggaaaaggatagatacatattcattaatagcattggttatgcacgataacatgatagtcagattggctgcctagcacagtagtatggaaactcagacacatccttttttttctctttttgcctatggttaatacttcgatgatattaaggacattcaagtaggtgaactgcattttttgaacatgaactacttaatacagttttttctcccaatggactcgaagcataaaatgacaacatatcaaaaaaaattccaagtccagaaaccatggaaaacaccacgaaataagtaaacagtagatggggaaattacagaaagatgagatatttagataccggcaacctgtcccaaattaagcggtcatcatctggtttgaggtgatagtaagccgagccaaatgctgctgctacattcccagcatagaagaggaaccatcccaaggcctcccatctcaagctgcacaattccacagtaaaaacaaaatattaaacaccagatcttacctgctgatctgtttttctgttaaataaggatagcaaaataggaatatctctttaagcatcatgccctcaataccagcctagttgtacaataagcagtatttcaagaaacatgaagatcacacacttgttaaataaaatttcaacatcaaatttaaagatttgagtacacggtttggtggaacaccctagctcaaattccattatatacccactctataatatagcaagattacagattattaaagcaattagatgaataagcatgtaatagctacaggcccaggcaaagttatactagcatagcagcaaaaatattatttcactggtcaccaacattacagtccatctttctctcagacagaagcagtttattagagccaggggagttcataaccaccctttcactttggtggtaactgtaaataagttcataaccaggggagtagtaaaatgagcagttatgaaacaattaggcacaagctggcctcctctctctaggttttcgagcataatcagggtaaattgacctcctatataattttgttcaagctcgtggtactcgattctcgaatactttaattacagctcttccctcgctgcaaatcacgaaacaatgtaacttcacgcacttctttataatcctttaggcgagacatttcaccgaacagcagccgagcaagggcaaagggcggagcgcgcacctgatgccgaagcacccactgccacagaggcagaggacgagcccgggcacgcccgccaggaggagcgggtaggcggtgagcacgttgagcgtgttggggacgccgaggaggttgcgcatgtcggcgaagaggtggagcgcgggggagtggcggagccgcggcgtggccaccaggagcagcgccgaggcgaggacggcccccccggcgagcgcgcggcgccggtgctcccggcggagcgccgcggccgcgaggtggccgaggccgaggccgagggcggcgcggccgccgccgccgcggtgggggtggtcggcggcggcgagatgcatgtggccagggggagtgctcagtggagcagaagaatgcggtgaattttttctggtgttgggccgccttgcggttgtgggcctgcttttcttggggattcttttttagccaggtcccttccattcatcggccatacaaattagtccctgggattcttttcaagttcggatgagtttatagaaaaatttagaaatatctagagcattaaattagttttatctagtagtattgaatatattttgataatatgtttggtttgtgttaaaagtgctaatatacatttttataaaatttggtcaaacttaaataagtgacttataatatgaaatggagagggaattgtatctttttaatcatcgaccaaataatatttttttaagaaatattgaatttcatgatcttaggattatacagatttgttgtccatctcggattgatatcttcttctccaactttggtgagctcaaccaactattttaaatatatatggcaccattggtttttctctaaattttggccaatgatattattcaaataaataaataaattgaataaaattactaatagatcatcataattaatttaaacgtgacttgtacctcaagtgtatttgcacaattatctataaaaagccaaattaagaaaaccaacgatgtcatatatgtatctaaaattggaaatgttgcatttcatatataggacatttggaagagcggtagagtctgagaaacaagttgcgaggtgtgtgcagtaaaagtctaacaattttggtagtttggagaagtgggagactctcttgaagcagatgtagctacttaaaaactcttctttgcacaacttttccaacttcactatattttctgcacgcacgtttcacaaacagttaaacatcgtgtttttcataaattgtttctctagaaaagctgttttaaaaatcatattaatttcccttttcaagtttttttagcaaattttattaactaataatgcgctaataagagatctcgttttattccatgtggaggagattaattagttcccaacacaaggaaatgaaacagcctatatggtaatgggcatgaggcatagggcaagaggtgtgttcatggcgtaccataatatgtttagggggtgtttagatccaccccaaaattttacaccatatcacatcgaacgtttgaacacctgcatgaagtattaaatataggctaaaaaataactaattgcatagattacgactaatttgcgagacgaatcttttaagcctaattgctccatgatttgacaatgtagtgctacagtaaacattgctaatgacgaattaattaggcttaataaattcatctcgcggtttactaacagattctgtaattggtttttttattagtgcccgaacaccacatgcgacacccagccctatataatatccgatgtaacatgccaaaactttacacccctagatctaaacacccccttagagaaatctaagattctcaaaaaacaagcaatttactagtgagaaacggccaaaatatttctctaatatatatatttctccaatttagattcgcaattgccgagtatcaactgccgagaaacggccaaaatatctctaatagcattaatatttcatatgctatattgtttcaaaaaaattatttcatatgcgatatacttggagtcagggcaaattttactttggcgtaccacatctgctatataagttggggtgatcatttggcgttcaaatatgggaagttgggcggcgtcgcggcggtgaccgaaaatggaatgctcatgcaaccgcactgcccggctgcagatctccggttagatacgcagtactagtacttgtcacattgctatcccaatctttttcttaaaaattcagatcaccaggtactagcttactactccagtgatactaaccactactactcctggagactataataaacatatatatatatatatatttagatttattctctatcaatcgccttaatttgaatcaattatgtgcacatgttgtacaattaattcacgtacgcatcgaccgacgccggccgttaatttgtttcagttaattaaagctatcagctaagttattatgtgagtgcatatatatagtggtttcttgtcatgcgcagacagatcgagtgttccttgtgcaaacagaaagctactcgatcatatttcggtcctcaaattaattaccaattaattaattgataattaatcaagtcgttgttggaactaaacacagattggccagctcaaaagcaaccaacaatgtcgttgttatccatgtgatatatcgatgatgatgtgaatctccggtgtcgttagccgtcgtcgtcaattgtctttctgatgattggcttacatcgatcgatcgagctctgcaaggtatcaggaaaaggccagagtttctttccccagattcgcctgaagatatcctttgcttcgatctccctctttctccatcgatcttgactcgtgatcacgtacgcctttctgggatctcgtgtctcttgtttccatatggatcgatcgatcgatcttacgtcaattctggcttgatacacagtacgtgctggatgtggaagatctgtaagaaaagcgggtagatagctaggtatatactgtatatactccccctgtctcataaaaaacgaatttagatcggatgtgatacgtccagtactatagatctgcatagatatgtatattcaaattatttatagtgctagaaacgtcacattcggtactagatagttttttatgggatggaaggagtaaatatatatactgaagctgcagacgtcaaaccaaatgtgtacgttttttcttcgtgattatcttgcaagatcttcgtaccagatcctgatttaatcgcatatatcttatacggtgactagaaagtactacagcctcgatctttcggagtaaacgattgatactgtatttgtttacacataaagcaaacagctaaagctaacagatttagccgaaacagatcccaaacagtatcatacaaaataaagctagataggtctatatacctatataggtcatgatcctacatcagccaggaaaatgtcctgaattgatgcagtttaatacaaggactgagctactaggtgtatgtatgtgattaatttaaatggatatcataaaatttgatacgatagagtacgatgatacaagctcttacataaacacgtaaatctaaattcgaccaaaaataacaaatgctaattgcactgcagatgtttagcgatgtactacggctagctgatttaacttttttttcctagttgtaaaccgaatttagtttatggacttattttatcatcttaatcgataataactaattttatatttttttaacatacttatttaagtctcctgtaaatatcttaggtataaaataaagtaacttttgtccatatatatatactcctacacagttatgcatgcagtactgttcctttcagcggtagtaccatcggagatctggctcggatctagcttgtacacccaacatcgagcactaataattcaggataggtgacaagtcgtcactctcacagtacagattgctactgctgctgcatgtcgcacaaaatctcttcacgtcacaaatctctccacgtcttcatgacgtgaagagattttcaacgttggattttccatctgtactacgtacagcgctgtacgtacgtgcacgtagacgtacgggccccgttgtcacgtactccctccgtaaaaaaaaacttaatctaagagaaaaatgtaacccctacatcttctcccggtataaatttaaacatatggttgtctagattcgttatattaggaggtgccacattcgattcaagattgaatttcttttggactgatcgagtatgtgataattattagtataagctgacttcccttttcgtgagaaatactgtatgagaatggactttggagcatctagatctctctcccccaaaacaaaactctctcacacacacatatacatatacatatacatatacatatacatatacatatacacacacacatatatacatatatatatatatatgaatgaatttagatatacaagtattctagaagtaaatttttttttcttggacgtaaggagggatatcttactagcattcatatgcatggaaaaatattgcaaacttataatacatataactaagattaatttagtttacacccacaagacgacgatagatatgcatcatgatgcattcaagcatgccgtacgtttgagatcgacatgcatatgaaggcatccatgcatgcatgcaaattggctggtagtacactagtagtacgtagtactgtactatatatttacatacatgacctaattaattaattaaaaaccaacttcttctaatcatacatgcggccacacacacgtacttatcacctattagttggcatgcatgcatcacagtactactttgcctctccttttagtaggcaaacacactacttaattatctcgcactacatatatactactactccattatttatattagcttgactagagcattgtccattgatcgatctccctgtcaagcttaattagctgcagtgtgctataacgtatgcacagtacacccatatgtgtatgcatacatacgtatatatacgtgtatatatacgcatgtagatatgcatttgcatacatgtgtcatttcatgcgagtggtgacgtgaaaatcccctggccacgggacaggatggcctttggatcatacttgctcttccgctgcacgaatcttggccagagattggcaccgaagtgccgcttctgccactctgcctggctgccgtagtaaggcaggtactgcttgtaggctatcccggccacctcgcagaaacccaagatctcgtcgttctgctcctccagcctccccacgtcgccggccgccgccgccgaccgcaggatccccaccgtgtagaacacctcgtcaccgtcgtcgtcggtgatcactgccgacatgttactgtcccacctgaaacatatccaggtgtgtgtatgtttagttaccaccatatatgttaaaattaaggaaagtctattcatccttcaagagaacggacattgtttttcatgtcgtaaaagaaccataaaaatactctggaaatatataatataccacttcataaatatgtacgtttaaattcaagtagcatactagcataagtaaataaataacttagtacacactatttgcagtcaaatttgtttttttactacttgtgcaagttgagtttaagattacaatgtttatatagtgatatataatatatttatgtatcatattaattttttatttaaacattttaataagttttcagacgacacgcacaatatgaggggtcgtcattttgaacgaaaaaatccaccccgtaaaaattatatacatgtgtatatgtagtaaagctttttattattattattacttgttgcggttcatggggtagatgaggacggggcccatggcgggggtgcggctgaggatgccgtggaagacgccgtcggcgaaggcgaggacgccggagcgggggaggaacaggttcagccatgggtgcggcacgtcccagagccccgcggcgcggagcttgagctcgccgtcgtggacgcggtccaggaacccggcgtacgccacgtcctgcgcgaacacgaacccgcgctcgtgccgcagctcgcgacgcagcacatccatcctctgcaaataaaatcaagcaaagaaattaaagcatatatgttggtaaaattcatcaaattctttgcagagagatcaccgaaatttgatcgagttattaattttgccagcactagcagcgtggatggacaggtggcgacgtgacgtcatgcaaggataaagtgaggcagtactttgtccacatgtgtgtgtgacgtgtcacgtgtgggcatgcaggatcttctcggatcacatagcaaaagctatagctaggaaatgcaaactgtatatgcatggaataactagctagctatctatatagagccaacatagttggtcggtcgtgttgcaaaagatgggggctcatgcatgcatatgcatgtgtgtgctaaagctggctagctagggttataaccatacaagctgatgcatgcactgtatctagtggcgcacagatctttggctggcctgtcatccatgagagatccatcatatccatcggtttccagcttctagcctagctagatacatgtaactatgatcaaaagctagctagctagcacatactatgtgatgtgtcaatggccacatgatgcatgcatggatggtaggtccaagctggcgatgctgatttctttctggcaaagctctaattcctcagtcccgtaataaggcagcgttcgtttggacgacattgagggagaaagcacctcgttttccgcaagtacgctttccaaactattaaacggtgtgttttttgtaaaaattttatataggaaagttgctttaaaaaatcatattaatccatttttgaaatttaaaatagttaatactcaattaatcatgagctaatggctcacctcgttttgcgtatcttcccaatctcctcaatccccttctcctcaaacacaccagtttatattttgctcattccatttattctaaaataagtttatttttaaaataatcattgcatcggagtttgtgaaaatagagaataaccgaaatttgtagtactttctattggtatgtgtgagatggatgaaaagtgaacttattttgggatggaggtagtacatggtattactagtatatgtccatgtctaaattcattgtattagggtatgtcccatccaattttaaattcttatattttaggaccgatgagtagtagttttgtgcagaacaacagatatgtgcgtagacatacactaatctagtctagctacatgctcaaaattgatactccctcactttaaaaaataaagtatttttatatgcatttgtctagatgcatataattagaaatgcttatattttaaaattgagggagtatatatatgaaccctctttggtcaagatgaaaatgtgatgtttaagtcaacttttagtaactttgaacatcaatatgtatatcttcataaacttttgattggttatatgattttccttaaaaatatacttttacaataccataattttattacctttatttttttttaaaaaaatataatacaaaaatacctgttaaagttgtgcgttctgaagactgtaacagtgtttaaaaagacaagtttttccttgatgtgctacaaatactgttaatgatataattcgtcctggtagctactacctacactagcacgcatgcttttcactgttttggacgaaaaagttttcaccataagtagctaaaagaatatgtcacgatcagacgatgcatatattttatacacctgtttaagcttagtgagagcgactaacctaatactccatatactagcttactaagttgctactatagtatctaatctttgtctctccgggaactaaggaagataaaaaaaaattaacacagaatcgaataattatttaattacttccagttaggtgtgtgatagcgagaggtgcatcgcgtggcagacaaaagtggtaggccaagtacgacgatgtcgacggcgcaagagacttcaatttcatgcaccgttagggtctgtttggtttccacggacttattccaagtccatgtcacaccagatgtttgaatactaatttggagtattaaacatacactaattataaaacatattccatatcttggactaattcacgagacgaatcttttgagtctaattatgtcatgattttgacaatgtgatgctacaataaacttttataattatagattaattaggcttaaaaaattcgtctcgcggattagctctcatttatgaaattagtttttttattagtctatatttaatactccaaattagcgtccaaacatccgatgtgacatgggctaaaaagttttagccccatctagaacaccccttaattgcatgcgtgcgtaagcgtaagccccaggtggcgccaaaagtttttgcagcttagttgttcccgccatcatcacgaggtgggacccgctctggtcggctcagcgcagagcaagctagtagctagctagtataccttgtcaacgtcggcggcggacggcccggcggcgccgccgaagtagatggcgccctcgaggaaatacagcacgccgccggcctccttggcgagcgcggcgacgcgggcctcgtcggcgtcggagaagaaggatgaggaggaggaggaggacggcgaaggcggctgcggctgcgtgcgccaggtctcgaccaggccctggttcaggtggaccgagccctcgacgtagtccatcagcccgcccaccgcgccggcgccgccggcgcgatcgacggcgatgaggcgctcctggtcggccgtcatcgccgccgccgtcgtgtacacgaaccgcacccaccgcgccctcgccggcgccggcgcgagcgggatgcgcgcccgcgtgatgacgccgaactgccccagcccgcccagcaccgcgtcgaacaggtccggcgccttctccttcgagcacgtcaccatctccccgacacctgcagatacatgtatacgtcaaaacacctataccttaattacctcgatcatggcggcgcgtgtcttagtagatgtgatggatctacgtaccggtgatgacgtcgagctctagcacgttggaaatctgggggccatggcggaaggcctggccgctgatgccggcgttggacagcgtgccgccgacggtgaggtggaggtagtctgtccacgacaccggcgtgagcccgtgcgccatggacgcgcgcagcacgtccacccacagctgctcgccgccggcgtcgacgtaccgcccctccactgacacggcgaggcgccgcgcgccgccgccctgcaggcggccgagcgacgccatgtcgacgacgacgccgtcgggcgcggaggcctggccgtgcaccgagtggccacacccccgcgcggacaccgcgaacggcgccgggcgtgcgcacgacgcgcgcagcagcgcggcgatgtcggcggggcgcgacgggtagagcacggcggcggcggcggcgagccgaggcgccccgacgccggcgacggagaggttgccaaagtcggcggaggcgcgcgcggtgcccgcctcgtcggcgcggatgagcggcgcgatgccgaggtcgccgaggtcgtcgaggaaggaggcggacgaagccgacggcggccatggcggcggcgccgtggccttgacgaagcagttgagcatgaggagcactgccatcctgacctgctcttgcttcattatcaatcaatcaatcgatcggtttgtgtgtgtcagtgtgtgtgtgaatttgtgtgttcttgcaccattgtagaagggacaaggtggcctataaataagcagattcttgtgtagtttgtgtgctgacgatggaaggcagctgatagatagctagatagacagtagagctgtggtgaccgagacttgaggctctctgagatctgtgtgacaaggactgaaagatttggtttggtttggtttgtcgttttggagattaggggagagtctttttaaaggctaattaagggtgatatatatccttctagaatctagattacatggtgttgcatgcataccatggtttgtgagaggtaattaaagtcgatataattaaacacgtaaaagaattaatacaagtgggaatataataggtcacatatatacatacactaccggaatccagaattctgggcggccattaatttgtactccacaagggagttgtatgcaggcagttcggccggtaacacatttgaaccctcgagggatatcctattatgtattcgaaaaccattcatgaaaaattctcaaaagaatttaccactcgacaaaatttagtcaaaaaaaaaactaacttgggcctaatggctagcagcacggttagtatagccaccctaggtttgattccttccttctccatttttttttatattcagtccaaactagctagaccacacatccaaaaataaattaaaaaagttgagacaaattcagcatataaaccctatactattaacacattgagatgaaagagcattagacaaacaacccgttaattttacaaggacaaatatataagtgaaccagtaaacttaaaatggaagataaagaaatttcacatcccccgcatagaacgctaggtatgttcagccaattagttcacctaattagctttctcaaattaattagttattaggttctaggtataatatttttaggataaattttaaatagtagaaacacatcctttttgagacggatgcaatagtcgtcgttagcccttgcatccctaccatgcaatcgatccggccatagagaatcccataagaggatgagtggtatagagagattgcacgtctatgctgcatagtgtgccattacctatagcttctcgttcaccctgaagtgcagtgcctgcgataactaatcttcactattataaacattaaaaatatttttttatctaatattttggtaccttgctcgagtccatactgatttttcatccatcggccctggcccgattgtttcggtgctgtgtgtctttgtttccactcctaatcagtgtgcgttgtgagttcaagtgcacgcgttgcgcgattcagtcacgacgtccccatatctcctgctgtttccaggactcgacatatgtgcactttggcacatctcctagatggaccgaggaaaaacagaaaagacgatacgtagagccttattatacatacggaactggtcgaatattggtcaagacatgcttatgtgatgcattagcgatcaaatattaattcgtggataatttttttttatattttttcgtgccgacttaaaagctcttgcttaaaaataagctacgataaaaggaaaatcaaaatcaactccgaaaattaaatttgaaaatcagctatatttgttttggaaggggttagatcatgaaaatcaaaccgtgatcatctaaatgctaatgcaatattagttttccctttgaaatgcacggatcttttttccagtgcaaagaagaaaacaaattggtacgagagatgacattttgccttgcctcccattgtatcgcgtcgcgtcgcatgcaagagctgccaaaacgaaacattgtacgattatatatactccctccgtcgctaaatatttggcgctgttgacttttaactatatgtttgaccgttcgttttatccaaaaactttggtgaaatatgtaaaactatatgtatatataaaagtatatttaacaatgaatcaaatgataggaaaagaatcaataattacttaaatttcttaaataagacgaacggttaaacatattttaaaaaagtcaccggcgtcaaatatttaggtactagtattatatttgcgtggcgatgggagctactccatccgtttcaaaatatttgacaccgttgactttttagcacatgtttgaccgtttgtcttattcaaaaaatttgtgaaatatgtaaaactatatgtgtacatgaaagtatatttaacaataaatcaaatgatatgaaaagaataaataattacttaaattttttgaataagacgaatggtcaaacacatactaaaaagtcaacggtgtcaaatattttgaaacgggggaatatattggtcggccaaaacctagtacgtgcgtgcacacagcgaggcggattcgtagcgaagcatatgcatgcagcgcaccgacatgtagatctttgattctttggtcgatcgtttgtcgtcgtgcagggcaggtggcgctgtcgtggccgttgatcgatcgtggtgacagccaaacgcacgttcgatcgatccacggatccatgattttatttgccgctggcctgcgcgcggctgcagacgtacggccaccggccggccacctgatcgcgctctcgctctatagctctcgtacgcgacgcgcgcgggtaaccagccgcgtgtgcttgcacgtactcgatcgtatacgttgcatccagctgtccgcatgcattgcagccaggagagccgaggagtgtcgctgctggaggttctcgtacagaaactttttttttaataaaaaaaaacacaccgtttagcagtttaaaaaatatgcgagcgaaaaacgagaggagaaagttgggaaccagccgtgccgaacacacccaaagcttgtccttaacccttgtttatttccctcctctcttatgaatacatgccactctatacatttagttctttctttctaaaatatatataagaacctatagtatcggatggaacactttagtttttattactacgacacatttttgtgaccgactctggaatatatataactttaaactgatcaaattaaacggttcaaaactttgttgctaagttgattttttataattttaatttaaactgattaaattaagtgcatggttgagaactttgtttataagaattttatatgtagcagtgctcatccgagaaatataacctatcattatctaatcagtattacagatcttaaccaattaccttttcttacagcagaagagatgcacgtagatgagtgaatcatatatatacaagtcgcaatcaaagtaatggatccaatcaaggtgaaaagacgaggtgtggccgccgtggaaattctgaattaggagatatattgcttaacacagtattatatataattagttgaagatcgtatcctaattaagtcatgaatgaatgaatctctatagctacggtggtcgaccgtcaatggtcattcctcgacgtactaattaacaaatgaatatattcgattgtgtacgtgctagatcgatcgatgatacgcaattatttatgcttctttgtccaacatgactcatttcacatcctgcccgaatcttgtcgccttgacaattttggcacatgtacgtacagtggcgtcttgatctttatcttagtggcctctctacagatagatatcgatccagctgagaacttgtcaggttttatcgaggaccaagttgccctgccatgtgtatagtgtttgcggatggacagcttttacggtatgcagtccaaatatatcacataaatatacaaattgtatatttttcttattacacgaaagatgtgaacacatgtgggagttggtttcattcctttcccaatcaacctcactcgttttcatgcgtacgcatttttaaactgctaaacggtatgttaaattttatttacaaaaattgcttttaaaaattatattaatattttttttaaaaaatataacacttaattagtcatgcactaaacatcactttgttttgtgtgctaggagtgaaggttcccaacccttgcccccgaacttagtctaaagttctattaaaagtgcacctcctactatgtgcatgtgtatcataagggagtgtctaaattctagctacctgaaactaaattttctatcatttttttcatgcatgataatccaatatggttctcatatcactccctattatttattcatttaaataaaatcccttcttagtataaacaggttgaacaaaaaattggtaacatatatacaaagatttacaaaattacatgaaataaaaataaagtaaaaacatatataacaacaaaattgctgttaaaacggagtaaaattgcacatatatctaaatattctaggtgtccagcgcttgaaatcaaccaaataccatgtatgtgtcatctaactaaccctacattcatgcatgtgttgaaataatatgaaagttttttctgtttacgcgcactatatccgtgtgttgtgacggagataagaatttaagatcacaagttgaagaatggaaagcaataaaaaaatacaagagtggcggaattggtgcagagcatactgtcaccctccaattccaactcccccttttgaaacataatttttatatatttcgcacacatcatctcgatcagatttgcagaaacatatggtgcccagcatatctaaagcaagagatgcagatgacgtcaacaaaccgttcaatttgatgagatttgttcgtataagatcttcacgaggatcctgaataatcctgatgcaggcgtagacttaattacatatagcatccagtgagtttactcgcggcaaaaggtgaaatttgcgatctccaaaaggaaacaatactatatcaaaccagaatataaattaggacaagcagttcggttcgatcagtttgtcactgtcacacacgcactacatgcattttttaatacgatttcacgcaggacacattatacgatatgcatcaatcttcaggatggcgatagtacacattttacagctatatatttcagatcacaagcttttacacgtgtcacatacacaacatactccctcgatctatcccaggaaaaatagaaaaaaaatcaatttttagatttgaatctggatattgcctactccaggtcctaaaataaaccattcttatacgggatgttaccagggtttcccaaaccgccggggccggggttactgtgccccggtggtaagcacgtttaatgtgcgataactgtggaaaaccgtactgacggagcgtggggctcctcaccgggagaccgcgcaggtccccctttaccggttcggccgggggcgctaagtgaggttcttcgccctcgatctgaggaacgtcagcgagagaggaagtgcacaagacacgggcgacgtagacaggttcgggccgctgagaagcgtaacaccctactcctgtgttctggtggatctgtgtgtgaaggaatacagagagccggagagcgagagagagttcaggctctagaacccattccccagagtcccaacccctcttcctctttttctcctcttttttctccctcttttctccttttttcctctcctaggcctgggcctcctttttatcggg

SEQ ID NO: 68123 - DNA, 31157 bp, Oryza sativa
atcgaatcccggccatctcgggcgcgggcgcgagcgggacagagaggggagtgggcgcggggaacgcggcgcacgcgcgggcgtggtcgacgtggcctggaggaggcggaggcgtggacgcggcggcggtttcgggcgcggcggttgctggcgcggcttcggccggaggtgggggaaggacccgacaggtgggccccacctgtcggcgaccccgggagaggagggcggcgggcggcctggctgggcctcggcctgcggccggcccaacagggagggggggaggaaggagagaatgggccggcggcccattcgaaaaaaagaggaaaaagggaggaaaaagaaaaagaaaaaggaaaaaggattttccctggaattaaaatattgcttgctcaattttaattggttaaaattatttctagagctctgaaaatttcactaaaaatcctgttaatgaatttcgacatgtagaactcaagaaaaattccacatgtcaaatccgattattatttgcattactttcttagggttttttcttgatttgcacctgtattttcttgggggtcgtttataaattaaatttttggcttgggaggagaacttcggggtgtgacagtcagacacgaagtctgttgcagtccccatcaagtaccgatcctcactgatccatgcatgccaacacatgatctcagaggatcttgagaatgtagattggggtgttgatatcatgtgatatatttcacacacaatgccaacgacagtatagctggcgagtcatgtggaagtcgtctctgaacctgatccgaaacatggtacagattctgctgtagatgatcgttcaaaggaaggtgatccatatgtatcagtcatcgtgaccccatcgcatctccccaaagatacgatcgattcggagctttgtaagatggagaagccaccgtatacctatccatgtaactaacgtgagacttcattttcgtagacaaattcatgctacctccgttttttcatatatgatattgttgattttctaacaaccgttagaccatttgttttattcaaagtttttgtgcaaatataaaaaatttcaagttatgcttaaagaacatttaacgataaatcaagtcacaataaaacaaataataattacataaaatttttgaataagataaatgatcaaattaaaaaaatcaacgacgccatatattaaaaaacagaggaagtacgcactatcatgccaatagatatcttttatggatgagcttttatgtagcaggttaaggatctaggctcagttaggctctattcgggagcgagggttgggaaccctgtaaccctaactccccggcacacaaaacgaagcagtgttttagtgcgtgattaattaagttttagctatttttttaaaaaatggattaatatgatttttttaagcaactttcgtatagaaactttttgcaaaaaacgcaccgtttagcagtttaaaaagcgtgcgcgcggaaaacgaagatgaggagttgagaacttgtactaacaaacggagccttagtcgagggatgcataaatctagaccacccaagttttaagttctaattgagataaatttgggtgcatgccctttaattttagggtaagtcgagacatgtgatcgaagcaacaaaaaataatttgagtttttttagtcatgcccaatactccctcaattctaaatcaactttctaacgaatttagaaatatgttatatgcaaattcctatatgaaagttaatttattataggacggatggagtaacttataaccgagatatgagatcgaggcaacggaaaatagttttagaagtcaaatatgacaaagaaaaacttaaaatttaagcttgaggaaaatttgggtactgcatatagatcatatggctgcacatgtctttcccagctctccttgattcgttgttgtccaaacactgtactggtcgcgggcgtatctccatgtgaatctcgcgaggcagatgcatgtcgagcagtcgaggtaaaatagctagctaggtgacgtccctgtccatcaggagcacgtcacggctgtcgttagctaaatctagctggattgtattgctagctcactctttgtcactcagcttgcccgtctttgtctaacctggctaaggccctgtctagattccaacttttttcctcaaacttctaacattttcgtcacatcgaacttttctgcacatacaaacttttaacttttccgtcacatcgtttcaaattctttagacttttaattttggtgtggaactaaacgcagcctaaagttgactcgctagtacttgtaccacatgtgtcgcgcgcgtgcaaactcatcagtgcaattgcaagtgcaaatggcatgtgatttcgtcgtcgtctcgcaccggattggagagggaaagatcttgccaagatcgctgggagatctgtagggcgctctctctctctctctctctgtgtcagggagatcagagatcttgtgacggctcagggtgtcgttaattatatgctataggccacggcgacttgaccgcggccaaggctgactaattagcatgctgtaaatcgtcttgaaaacgaaaggtagttaattagcacgttaatcgtcttgagaagggaagatcgagtcgggcctgcgtgtgctcgtgtgattctttgacggtgttggccggaagaaatcgtcttcacaacgaggatttttttttactttgtagtccttttttgaaaacttaatttataaatatatacctaaaaaaaacttaatcttgaaatggaccttttttttatgacgctaatatcattggcgccgtggttcaacatgacattgcgccgtccctctttaccccttcttagaagctaagacaccgatacaaaggggtggatcagcaccaatgtcattgacaccaaggatttatttgtaataaaaatatttataaatagatctttggtacaagtgaaaaattcctggcttcaatctacctactgattcctgaaagagaaaaaaactccttttaaatcctatacgttccagtcaggattttaaacaactctagttcccaacagagataacctcgtaccatacagaatccatgctgtccattttgcacaccaacagtgatgcatacttgtgcccattgtcacactggacactgcgcttacagataatcactagttcactacagcaggttcacttgaagcagccatgccggtataaacatggcccataataatttttctagtagtactttgtcccacatgttcatgagaagtgctaaatcaccagcttaaaaagtctgctcctaacattactgctacagtacacacatacttgatacaatagatagttaatttggtggtagtagtccataaacacgacactctacctgcgatgatccttcttgatgatcttgcgaagaagtggaagcgagcagagcgcggtgtcaccctcgttcttgagcgcgtagaagtggcacagcgcgcggccggcgaccttccaggcgaagccacacctgctggcgtcgttgctccaccgtgctttctcatacacaatctggtagatcacgcaggcttccgagaacacgtcgtcggggtccctctgtgtctgctcgaattcagatgcatcgtagagcatctgcagcaggttcaagggttcgttaggttaaaacgaaaacggcgagccgccaatttcattgaatagagaagaataaaaccgtacagaaaacaaacatgtacaaacatagggccacagcccgactaagggctaattaccgcgccacccaggcggcgagatagggttcgttaggttaaaaagctagctgtaattaattcgaccattgaaaacgctgttactcaggaaatttggatggatactcacatgcttgtacttctcgtagagttcttggaacttcatgttcctttcttctttatctaccattgcgcgatagagcattgtactgtcagtcaagtactcctcgtagcggtgttgccagaggtgcctggctgctggaggtgcttctctttccatgaaacatgggagcaatgataccccttattattgtaaaaaggaaaagagggaaaaaagtaaggcatactgttagagagaacattcatattatagtactattctcatcaaacatatgaaaccaatttaattgaaaccgtgttctatgccaaaatcatgtctagtgcttctgcagaatggtaactaacctctgcttctctcattgaacaattttgacatctctccctcccattcattttgttttgaaactaggtggaccatatgagtaaaaaattaacggttgagtgcataagtagatagtcttctccataattaaaaacagcagatgattttttttgtaactttttaatacaattttagaaataaatctttccacaacttatttctaggtctgaataagtgtaaactattataatttaagattatccttatgtgcgtaggtaactaattagaatagatgtaattgttcatcatcacttctataaataaattaatatatataaacatgaaactataatggtttattaattactatttccaattaattgactgccttacaattaatcattttttcatgcaatgaatgcaaaccgtttttttttaaaaaatggcatagaccctttccatgataccacatatgtatatactgagaacaacatcacattttctcaatatgcttgccatttggcaataccttaactactgcaagctcagctcataagttatagcctatgtgctacaagcagaacaaataatgtatgtcatctccctactgcagataaaactataaaagaactgaaaaaaggaacctaaataaaacagacaacataccgattggttgaacattacaagatcgcagagattctacatcttctgctttatcatagatttgtccaagtatggatgatgaatggtacgaaaaactgcggcccatgaagtgggggtattgttttaccatcagatcacttggaatattgacctgttgggacagcacataaactgttgaagtgcaatatgcattcccatgtaatgaactttggtcttacaaagcatcaaatataaaataataaagatacacctgcacatttcatctattatctttatcttgtagccctacttgatctcactgcttcatacgttaaacgtattcctgtcaccatgcaactattccaaccaccatggtgccctggacaccgggtagctggtccatttctaacttatattgaactatgttaattacaacattatccaataatcagcttattactatgtactggacacccactgcagctatccgtataaaatattggcagtttatgaatcattgtaatgaatcacgagttgttcagataactacacttggttcatccgttcatgaatcattgtaataaggattcagtactgtgtaaaagcatttgaaactgaagaatgtgtaagcccaagattggaactaaccttgttcccagtcttcggagcatccaaagccaaataatacaggtcaactaactttagcatcttttcctctattagtttcttttcaatttcgtcaagtgaatctgtcaatagtcggtccatatatgctaaccagctatcagctgccgtaccaagtgcaaaactgaaaggagaaaagaactccaaaatcatgttagattgtataaaaccaataaaggttgcatatattgaaatactacaggaggtcaccaaaactagatttttaaaaatgtactgatcaggttcatataaaaagaaattcaagcacttctagaatattgaattcaatcaagtgctgaactcctcaataaattgcctactaaaaactaaatgagattcatgctgctaagttttctttatagtgaaatggttctagttaccattccaaaaaggaaggctggtgacaattattactgtgcatcagaaaaatcaagcttggtattaatacctgggagtaaatcttgttttcaagaactcatgaaatagcagcctttcaagtttggattcattacaatcctgaggtttcttttgcttggtcttttttggtttaatagcttgtacccacggttcagaaggtttgaagtgttctaataactgaaaagaacattttcaggatcagtcagcaataattctttcaaaagttaaagacagaatgtgctgttattatatcagtaccttattatgcaagaattataatttaaagatacagtgaaacaacaatgccaaatttactaatgaatcatgcacagcaaatctgtaatcagtccaagaactagcaagcataattaaaacggataggtcaatattccaacacttttggccactgaacttgggcttcattagcgattggccacctgaaaccattctacattcgggccaagtttaaaaggtgaaaagtgaatggcttcgatagtctaaatttaggaaaagggtccactttttaggtctgaagatcagggttgtaaaatggacactttcctcattaaacatgaaggcatgcaatattatttagtttggtaaccaaattaacccctcatgtctaactggcatcccaaccaagccaacaccttccagctatccacttggcggtgtttatcctctatgaaaccttgcccataacacatgtttggcaaaaggtccaattttgcccttaaggtttaacaagggccacttttcttacaaagaagagagtgtttccaagaagactacatggatagactcaataaatatagaccatagttaaaatagcatcacggccatatggatggaacaactacactatgaacgagggtggaaccaagcaaaacttcactacggattttaatgagaatgaaagataatcaagcacaaaggcacaataaggcaaaatgtcaattagaaattaacaaacctttgggttttttgagacccaataaatgtcaccgtcaaaatcactgttggccatctcatcagccaaagaccgcggcccagaaatagggaagagtatagcatatttagcatatcccacatactccttttctagatccctaatatatgttgctttcaagacatgtatatcaccaaaatgtaacccaggatgtttataaacaagaacatctccagaaaactggccattttcactgttgaacagcagataaagctaataagtaaagaacaaaccagaatgcgatcaaacataagtgatacagtaccaaccaatggatgcaaggaagaaatatgacaaagaacattagttcttaacattgacaaattcaaaaccttttaataatccataatatcttctatttgagattttttttctatttattaaaaacagtcacacagatttcctgatgtctaaaagactacatgttcaagttagtctaaatttgggaaaatgaacttaaaaatgcaattgaagtcctgaagccccaaatacccagatgtatttagtatcataagttactagtctaaacattttctttagccgctgtttaccaacgaacttcacaattgcaatcaaaatcattgccagcaatatataattgtttgaatacaaaaatgcgttctcattgctaaaaggaaattgcaaaaactccatctcaccttgttaaagtgcaaaatttatggtgctaatcagcaagaacttggaagaaagcatggcaattttggtgcatttctactaaacaaaattacaagacattaaagcagttccagtggtgtccatgctggatagtggatattcctatgctatatggtgactggtgaatagtaaactgaggatcactgatacatataaaaaccgctgaaaggatatgcagatgcaaaaggggtaattctgtaactaacagtatcacgcagacttcattaggtctgagtgttccggtagggtctgtagtatccattagataatagcactcatcaattggtatctttccttgcttgattccttttctttcctgttgagccatgaaatccagcctatgttgcaaatatgactcttctagaggaattccagaaagaatcatacgtgctgacattgaatcttccatgtcagcatagctgaatgcaactgtaagaacaacatgagaataatagtccagatcaaacataaacaggtgactgaaaaacataaataaaatggaaatcttatgacaacatgtaaattgcactgaatgcaacaaatgtattttgaacttacttctcagtgcatcttcataatcgtaacatgcattctcagccccttcaattgcactttgcagaagctccaaaaagtactcttctggaactcctccatagcaaagtaatgttatcaagaaccttgatgttaatgtccttctgggtcgattgctgagcaaaaaaaaaaaaaaccatagtactgattgtgaacaaaaatataattgattaattgctgccaataaaaagcttaaacagtggaggaaaaatgtaaagtcctcaacatgctttaccaccctcccctcaaaaaacatgctttaccacccctatctcatcaacctaatcagccccaaccatgaagaacgacatgtgacagcacttggaaccccttaagtaccaccaaccgatgaatgaaatgcaccggacgtctgggctttcatacacaaacaaactcatcccaaaaaaacatgaactattaagcaaaggaaagtaatcccatttatagtacaaaacatgtgtttttgttctgatttccatgctatgccacctcatagaatcagtagcagttaaatgggaaaaagatatcaagtactcccttcctcgggggaactgtgcaaatgatcgtgacaaattcaggaaagagaatggcaaccttgacacaaaaatcaatctatcagccgcaaagtttcaaacagttcattctgctgaaagggaatctcaaaagagagatagaaagctagaattcactgaattttttactatttgtttaacctagcatagtatagattttacattgaattatttttggaatgcccggttatccatgaaccatgcacccatttcttttttttttaccttttgcaccttttcatggccattaatattgtgtccagggttcacctctccgatatggaccaatcccaacccctggcagtacaacagctttcaccaaatttcgctcgaatttactgtttcaaatttgaacttctcaaaaaccattcaaaagtttgctcaaaatctactttcgtcccatgccaaaacctcaatattatgtgaaccctggttggatctctaaggcgatgcacagggggaccagaagggtgggatgcaccggaaaaatatctaaacaaaattaactgttacttttactgcgctggtagaaagccagagcacaaaaaccagagcttaagtactaaaatgtattagtaaccaaggatgctctacatataaaaatagatgtaacaactaacaatgcaactcagatttttggtaccttgtagagactatttcaaaggaattcacggactgaacaccagataaacttttcttggcatttcgtgcagagactatttccgatgagttgacagaccggacaccagataattctggatgagtttctatttttaccattgatggtcggatgagtatagttgcaggaggaagctgcaacagaaagagatctattcttattcttacaaaatacacttgaatgctagggatagtagctaagataagatagcaaaagaaaattatctgtacacaaaattgtgtaaaaattgaatagattgaaaaagacagtgcatgatgtacaacaagaggatatctgaaaagatgacaacaccagcattgaacaaaatgaattaatgatcaacaattattagaaaacagtgaccttgtatgagataacatgtctatcctgaaagtatataaatcatgcaatgatattctgaatattgcttgaatttacacaatcatatagtattagttaaattgccagatccgtaatagaagatccgattgtattgctatcaggatacaaggaaggcacgattgcatagatgcttaagaaactatgaatcaaaattgggaacaagaggtgataacacaagagcaaacaaataacacaaaactaccaaatttcaatgtataagtaatatcatgtcaaaaactcagtacatacccgcctgtcaactaggactgttccctttacagcagatccattatagaacagacggaactgcataagaagaggctaggaaaatagaatagacaagaacagcaaactcattagttgaaaacacagcaaagtcagaaaagagtagatcggaacaacaaggcaatagttaatacagtacatgttcagcggtgagagatcgatgcctcttcaaactgttaggcctcatcactgtttcactttcatcacaagttgcaatgccctgaacaaggcataataaaaaaaaaagtatatcagctagctacaagcatggaccaaaacatcaccattaagtttgagaagcatgattgtccagaaaggaaaacataactaaaatataacataatagggtggtgatgtcatgtataacacacagtaacggaacttaatgttggttgatgttgattactggattttcgaattctgagtcagtagcaacaacttttcagtccacccttactcaatgcagtggacagtaggaaaaattcctaccaggcaattgttacagcagtgggcaggccattgcagttacttagcactttagcaggtaccaaattaggaataagtcaaataaagtactccctccgtcccaaaatataacaacttttagcccttaaggtttgtcccaaaatataacaacttcttcaccaacattctcttcttaaccaatcacaaccctccaccattcaattttctcacctacctccacttcttaaccaatcacaaccttctatttaattttacctactttcttaatacccatgtccaaccctaaaaattgtagagaatagaatagatgtctcaccaatgtgggggaggtgatctctcatatatatagctgaattacaatgaatgctagtgctgagatacaatcaatactagtgagttacataagaccaaaggtctagaagagtaactatctaggagagtaaaggtctaggagataaacaggcaaacagcctatagattaataaataatcctaataaaaatccttatattctgggacggagggagtaggagattatctcctaacaaggaggtttgttatattagagatcgagagagagagagagaggattggtttaatatttgatattagttccatggaaataaatctctatctctaagccaaaacaggatcagtaaattcctagtgagtgatgaaatgaatcaacaccagtacaaggtaaattaatataagaggtattttggttaggaacaggaaagaaagtcacacagcagtaaactggtattgcaatacaatgtgccaacaattaactgttcgcccatgaaggacaccaagtatggccgtatatatccggttggatttagaggccgggtaaaaaatacccttctctaaaaaaatggacaccaagtatcaatttaattaataagaaggataagacttaaattcgagctttagaggacccaaacttgggtggtgagggtgtacatccacacctcctaccaactaagctcgattcctggtctgcttttctctgcccacatgtttgaaactttatctaaaaatttgtaattatgttgcatagtatctttatgagcaactccacaaattctgctttctgcacattcatgagatgtgtttgtcaaactttattgttggtttgcatctgttcacattataaacaatcaagtaatccgaatttgcttattagtatgtaataacgccttcacaaaaccataaccatcaggggaacacaaacatagaatgtctgaaaggttaatgtatatattttagataatggacttttcattaatccggcctctatatccatcaaggaaatacacagccacaacatacgcgagttcttggagtccaacccacacgcagaggaaaacacataaacacacaaaaaaagaagcttgaagacttagcttaagggaacagaagtcttagattattcattcaaggtgtatggagtgaggataaagcgcacctgtggtttcaaaaattttcccttgaagatactcgtggggcaattgagagccaaatccacagatacaaggccagtcccatcagtatggatcaacggctcctgatctttgtgaacaacattgccatgtctgtcctgaaatgttacaataaagaaaaatgtgattccagaagcaaaaacaagtattggagaggagggaattaccatgcaaggttcatctttaatccgtctgacataaactgctgatagatcagcatcccatgtgatagttttggagagtatcaaagcaaaccttgttacaacagaaaacacaggtttcgtaagtaagagaacaatcacatgcaagcacgctcaagttgagtccaataattgtgtttttctatttagaaagcctaatagttcgatagcagcaataatgaaatgtacatggaaattgaaaatgtaggcaatggacttctggaaaaacaagcttatcttctgactaaataaatcccagcccttctatgcatctccttttgtatctaaaaacgatacgctgctatcatggtagcaaaaccagaattaccagtaaggcagtaactaagcttgacatcgaccagtacatatgcccacattgcatcaatttaattagttgacactactaaacaaagtcataaggaaaaacctggccatatattttgccaaggtgggggcagaacttatgtgcatgaatagttcacgggcctgaccaactgttctcccagagagtatataaggttcatccatgttccacccagactcagtgcgaacaaagtagcacatgacaggtgaagtgcatttgtttttgtcttctatcttctcttgtttcaatttctcctctttccctccatccttgtaaactgaaaggtacatcgatcaatgtaaatccaacaaaaaagcaaccaggaagcatgatgggagcacttggtaactaggatacaacttgtaaagtagaattggtgtctcttagtcaaattgacacgttcagactcttaatggatattgcttccaatttgtgtataactacagtcaatctattttttccagacaccttgcggggaaaacacatctatgccatctcacgcagccacgcaggaatgactggatggacctgttcacacaaccaaataaacccaagtgtgtcttcgaaaatccatgaccattgtttctctgaagccattagagaactttgaccctagtggtgttacatcataaattgcagtaattatgtattacatgcattctccagtctactacttggtaataaattcaaatagattcaatgatgcaagaaaaggaaacttaccgaaaaatcgatatcggcgcaaacccaaaacaataccatcttcagcaaccttatggtaatgttcacaatatgtagagaagtcagtcttggtgtctgacagtttccccataaactttactacaaggacattatcatcaccaacaactttctgtagatgagtccttgtattctcgatatatggtccctacattcagttaaataaggttacaaatttagcattggcacctgaagttccttaaaaaaatatcatgagtacggcatttgttgatatgggtgccttaatttttgttggcattggtcttcatactactactattaaaatcttatttgttggcattggtcttcatactactactattaaaatcttaggtggcctgcaaaggatgcatatgggtgatgtgcacctttatgtgcaagctagataggcaaacagtctgaacagcaatgaacaaattgaacactatacaatcacgattagtagatggtagaacatcaactagtaggccaactaaaaatatcgttattaaacaacgaacatcaataaacgctatcaaaaggctccacaaaccttgaaaattttgactacagtatcccctcttatcgcaacattacaatgatagacttttgtcatgcctggatctgaatcaaggttctgcaacaattaaaatggaggaatggagaatgatttcatcaggctcatgttataatatactatcagaggaaaagaaacagatagcagaaattagaaaaatgaaatgtcagtataatattctcatgatgttattgatagatcttgatgctcaagaatgttccaagttctagggaactgatgaacttacaagaactaggtatcattagcagacagtgtttctaataaggaacttttgaacaagaaaatatgcataagtgcatccctagaagattgtaaaagcatgatgcgttgcagaaaacttattacaggaaatggtttgtgatgttccagcttgctgatgaaccggccacagaaaatcacggtccaaaaggtggttttgctgcatttatcatggaatgccttgctagatgattggtaccgtttctatttgtttttgtagttctgaagtaaattaactcgaaatggaagtcaggaactacaagtcagtagtaccacctgtatggttctgctttcaacagaagcaggcttcttttcagcctttagtcttaaaaaaaagtcaaaagtgcatgtaacatacctagacactaacatcaaaatgaagaaaacatgatacttttaagatattagaagctcagatcagaatgtacaacagagtaagcatgcattatgtcctcgatgcacaagtaaattcaaggagaatgaacatgcataggtgcaaattatatatatttacttatggctccgtttagaattatccaagttctactatgaaatgggatcatcatctttgatcatttttagagatcgtcaatgaaatacaggaaatagaagtactgccattgaaataacctttgctctatccgaagctgcaatatacttgtggccaaatgttctccagatttgtgactcaaattgcgccatggacagaaacttcaaggatctaatatagtccacagacagaacattctctatcttttcactgaaacataaaagagaaaggtgtattagcaacagcaaaacacagacaaaagtcatctgacttaggaaataatgaatgttcaggtacaaaagcagtttttttttgttctccgttctatagaaaagcacaaaaatgaagagaaactaacctggcaaggtaagcaaaaaccataaatatttttctgaaccctaactcttccagcgctagcatctgaggactcgctgcctccctcaatgcattgtctgttgtatggcaagtcgttgtagggttttgcggcatcgccgtaatggggctcggcggacttactgaggggccagccatattctcaatgagtcttgaaatatcctgaacagagctcggggtggaaactcttcttggagtagaaatcatcggctggatggggctgtcaatctctatatagttctgcaggccagatggcatgcaacggcatggactaccaacttgcatcataacatcattaggcaccgcaggagccattgctcgggcaggactgtcaatctacagagccatttggttcaacccaggagaaaccattgcctgggtaggagtcccaacttcaatgcagccttgattctgcgacacagaagatgtatggccacatggactctcaactgtcagctgagcaagctgtggaaccaaacgagcaatttgtctgacagaaccaccattgccatgtaaatggaacggcatctgttggttgggactcccaacctctaccatcccatggtttgagagactagtagccatttcattgctggggctttgatcgtacatctgaacctcgttgtcgaacagttgcgtgtatactgattcctctgtataacagaagcctcgttagtctaacaagcattacagataaatcagatgattaaataactactcctctgtttcatattataagtagttacgatttttttcagtcaaactacttaagtttgacgaaatttatagatggcaacatctacaacatcaaattagtttcattgaacatattttaataatacgtttgttttgtattgaaaatattacttatttttttaataaacttggtcagaagtttgaaaaaagtcacaacttataatatgaaacgaaacggagtgaatactacacttcacaatttggaaaaaaaatgtaacagctacagatctacaacaatctgagcaaagacattagaaagaaacaacatccaagcgaaatgcatatgtaactgcaaaactaaaggggaaacaccatcataataacctgaaccaacgaaggcaaaaccagcaaaatcccaaaaccacgacctcaaccttaaggatggtaaatcaagaacgtgaacgactcatcgacaagcatgaaaaccgaaaaactcggaaggattctcctccaaaatgagaccagaaactgaaagcgcaaacagaaaaatggactgaaaatacaaaagcaaaagagaaatccccttacatagtgtatgaccttgtgattacgagcaagcgcgtgactaccagacgaaacattccccaaatattgtgttactgtatgcgctttgcaatgaaaaaaaaaagaaagaacaagaaaaaaaaacacacacacacacaaccagaggaagcagaacgaagagctatccttccactgcatccagtgccactaaacagcaaaaaaaaaaaacgtgtttttccctcacaaattggtgcaagcaaccctagttaacgagaatggcatcgcaacccaactccagaaaagaaagaaagaaagaaaccgaaaatgtcacgcggcgaactaaaagaaagccctgaccttcccgggaagggccggagatgaacgcgggggcgctgagggcggtggggacgccccgcgcgtcgcgcctcgtgatcgcggcctcccgcttcgccaggtacttgatgaagccggggagcgtccgcacccgccgcgactccgcgaccgcgcgcagcacccgcgccgccccggcctcgccgagcaccgcgaggtggcgccgcgcctccgcgccggcgagctgccgcagcctcccctccagccgctccagctccgcggccaccgccgccgggagctcggccggctcccgcgcctccgcggagccgatggggttgtacatgacgagggttcgggggcttctagcccggcccccccgcgcctctcggcggcggcggcgaggagagccgaggaggaggaggaggcgatcacgttggcgttcgcgttggggcgcgcgatggagggaggaggttgggaaatttgggaggaagacgcgcggaggtgttgaaatggcggtgggtgttccacatggcagtgggaggtggattgtcgattgtgggccatgcggggtgtggggcggggcccaaggaggagtaattcgggtagcttgctcggcaccctacccttcctctgtgcttgactgcggctgtggttgacacggtgcttgtgtgttgtgctgcggtagaatcggtacggggggattgaggattcggattccatttccactgtgtcatacatcgactcatcgaatttaatgttgtgtttagttccgtgtaaagtttggattttggttataattcgagttaatgtagctgaaaagttgtgtgtatgatatgttgatgtgatgaaaaatgcctgaagtttggatctaaactttggatctaaacatagcctaaggtggtgtttggatccgaactttggatctaaacaaagcctaaggtggggtttggatccaggaacttaactttagtctctatatttagacactaatttagaatattaaatatagactacttataaaactaattatataaatgaaagctaatttgtgagataaattttttaagcctaattaatccataattagagaatgtttactatagcatcacataggctaatgctcaatagattcgtctcgtaaattagtccaagattatggataggttttattaatagtctacgtttaatatttataattagtgtccaaacatccgatgtgatagggacttaaaagttttagtcccatctagacagggtctaaggctatgtttagatccaacctttggattcaaacttccaactttttccatcacatcaacctatcatacacatacaacttttcagtcacatcgtaccaatttcaatccaaacttctaactttgaaaggaactaaacacagcctaaagataaagaaggcatagcatgactggggctgtgttagttccctttaaacttgcaattttttcctcatttggagatatatataatagagtattaaatatgtaaaaaaaccaattatacagtttgcatgtaaattgcgagataaattttttagtctaattacgacatgattttacaacgtggtgctgcagtaaagattaaccaaggaggagtagcttgctcggcaccctatccttcctctgtgctcgtgtgttgtgctgccgtagaatcggtacgggggattcggattccatttccactgtgtcatgcatcgactcatcgatggcataggattaagtagctcccaccgtcccaaaatactctatctatcccactctaaatgcaaaatactctatctatcctactctaaatgcaactatgagttttttatccgattttgatcatttgtattattttaaaaaatttataatcagaccctgtttatgatcggtttagatgggctaaaactttttaatccctgtcacatcggatgtttagacgttaatttggagtattaaacatagactaataaaaaactaatttcataaatgatagctaatttgcgagacgaattttttaaacctaattaatccataattatcaaaagtttattgtagcatcacattgtcaaatcatggcgtaattaggctcaaaagattcgtctcgcgaattagtccaaggttatggaatgggttttgtaattagtctatgttttatactctaaattagtatccaaacatccgatgtaaataagtccctgtttcacaatcccccttagattctaatttttttttgaaacttctaacttttccgtcacgtcgaactttcctacaggttagttcccaactttttcttcaaacttccaacttttccatcacatcaattagtacacacaaacttccaacgtttccgtcagatcgttccaatttcaatcaaacttctaattttagcgtgaactaaacacacaaacttttaacttttccatcacatcgttccaatttcttcaaacttccaatttcggcttgaaactaaacacaacctcggttcggtattttttgctgttatgagatgataaaatatgaacggtactttactcgtgaaaaaacgaatctacgactggacgcgatatattctagtataatgaatctagacagagatatgtccagattcgtagtgctataatatgttatatccaatactaggttgagtttttatgggacggatggagtatgtttttaaattttttttcaattttttttaaacaagacagatatccgtgttcaacatttaaccgtatgtcttatttaaaaatttattaaaaataaaaaaaatagtcacgtatataatattattcatgctttatcatctaacaataataaaaatactaaccgtagaaaaaatttcaaataagacgaacggtcaaacgttgaatatggacagtataaaactgcattttgttgaccgagtaaaaaggagtacgcaaggattctttaaaaataaagcagcatatccccgagtatagtttcaaaatatactacccatcctaaaatactactaatatctttaggattcaaattttgttttgaaatcttttcaaaaagaaattgtttcagtatattatcactttgaagtgctagttgccccatcatgcatttcgtttcaaaagttttctcattttaccctcaataaccatttaacttccggtcatgtattattcaataaaaggtattataatatttttttattaaaatcaaatcctgatgtctaaatttatttttagaattcaaatttttatagaacggaggaaatatatattcctgtgagatggcggatagtagcggaaaagggttaaggcatcagaatgtagtctaaaactagttcataagtaataaaatattccattcagccacctaaccacattatggaactagtccatagcaagaaaatagcaaaagccacacataagtatatgggctgcccatatagaataaaatatgttattttctctctctactcctaatactagttgctatctatatacattgtgaagataacaataattatagtccatatatgtgggtcctatctacatggactacttttgctatggcaaaagtagtccatagagatgggacccacgtatatgaactttaattattataacctacacaagtatatggatagcaaatagtattggtaggagaaaagagatagagacaaatgatatattttattctctatggacagcccatatacttatgagtagtttttgttatttctttcctatagttccacaatgttgctaggtggctgaattaaatattatattgcttatggaccacttttggagtacattgtggatacctcttagggcaagtactatgatagatgtggttgctacctccaaatttatttatggcattcaccaataaattaagatgcaagatatacaataagtcacctataatacacaaatatcaatgcctttagtactctcacattcttcttagagtttgtgtggaggctacctcttgatttaggggtggttcatcatctctcctcacttctctccttcatcttatcacctaatcctatgtgttatttttagagacagcacatgaagcactatagcacttgcccttagggcctagtactagcagagaggagggcgggggcatgccatgtcatgtcatcctggcgtggcgtggcgtggcgtggtgtggtgaacttgccagaaagcagaaagcagagagtgcactgattccttcacaaatctggcgactccaccagtctagagaggagtagactagtagtaggagtagtaggcatgctgctgccctgccatggaacagacatgagcagcgccgcgccgcgccacaccaccccacacccactgataccgaaagatatcgtgatcagatccagtgcagttgattcagggctgtttggataaattttagtccaatagaatgtttagcactaattaaaaatattaaatataaactaatgataaaacctagtactccataatcctgggctacatgtgctaattatatattatttaggattaaaaaatttatctcgtgaattagctctcatttatataattagttttattattagtctacatttaataattcgaattaatgttcaaaaatttcagtacctagatccaaacaccacctcagcaccacatgatgagaaatcaatgactcatatcaatgcatatcactgtagtaaaaatattacttttatacatcatatagtaacgaatgtgaatcgttagatcaaaatatggatggctcagattgcttgcagtttttattgtgcagttatactcatcaatccataaggaagtgtttggcaaatgtcaaagggaaatgatttccacccatttttaaatcctaaccattcattcacccttttccatttaatcctaaacttttattcatttctcaatctcaatcccaatgccatcctccattttccattatccaaacgcaccctaaaagtatgatagtagggcagaattaacagtcatacgaaaccgtatatttgggtgccgtaatctgtaatcagctcacatcctcaagcgacaagcttatacccaataaagtccctctcttctttttccaaaaagggaaaaaaaagaaatcagttaatctaaactctcacggtatacatgcattttttttcttttatcttctacaaattaaaagttgtctatacatgagtttttcccttttatctttaacaaattgaataagacttggccaacgggcaaagtgtcccaactgggacgaattcattcgggagaacggcagaagaagtgtgcaatctgctgaacaagtggatcgtggacaacggcacggtagaagccaagccgctacagtgagcgaaattggaacatccattccctccgctgtagcaaagattgaagatacagcacgaatcagcatgcatctacacactacggtatcagctttgatatgctgcagttcatcagatgattcggtgttagaacatgtgccatcacatataaaacacaaccaccaatattaaagtcgtttccactctgaatatgcaagctcttgatatttcatttagacttcacatgtcagtcatgcaagctctgaatgtgcatttgttcagtgatacatgatgcatgcatgcatgctgaaatgattccagagctaacgtagcaatctttagcttgactgcttgtgttcacttcaagcagccatgttaataggcccatcagcttagttataaagtctgtcctgacattttcctactaaaccatcagcttaagaagtccttattagtccgctcctgctcctatattgctgttacaatactacatacgccaaacttcatacaaattaactatccctaaatgcgatgctacttcacttgcggtacttcttggtaaatctgaagttgcggagaagttggagcgagcaaaccacagcgttaccctcattcttgaccgtgtagaaatggcacaatgcacggccggcaactttccaagcgaagccacatctggcgacgttgttggcagaccgtgctttctcatacgcgatctggtagattgcacaggcctcggagaacacgtcgtcgaggtccctcggtgtctcttcaaattcagatgcaccgtagagcaactgaatgttggcaagagcgattgggtcagaactctgaagctgttttccaaccattaggaaaaaaaaagctggtattcaaaagaatacaggacactcacatgcttgtacttttcatagagttcctgaaactttatcttcttttcttcttcatccgcctcttcggcatagagaagtgaactatcagccaagtactcgttatagcggtgttgccagagttgcttgattgctggaggcacgtctctctccgcgaaacatgggagcgatgatataccttattatcaaaaacaaaagagaaaaggaatgtcatgttacagagaacattcataaagtacttgtctcatcaaatatatgaaacctgcttgtgacaccacatcacaattcacatcaaccgtgttctgtgccaaaatcatgagttgttctaaatgttgcgaagcacaccacatcggatggcatggccaaaattttttgcagcgtttgtttttgaaagttaaatagaaaaaaaaagtgatgacatacagcataccatgggttatacacagacaacttattagaatagatgtaattgttctccattaattttacatataaattatacgaatatgatcctatagtctcacaaaactgacctagagtcctaaactctttccatgataacacatactccctccgtttcacaatgtaaaactttctagcattaccaatatactccctctgtcccataatataagggattttgagtttttgtttgtattgtttgaccactcatcttattcaaaaaatttatgcaaatataaaaaacgaaaagttgtgcttaaagtactttggataataaagtaagtcccaaaaaaataaataataattccaaatttttttaataaaatgagtggtcaaacagtgcaagcaaaaactcaaaatcccttatattatgggacggagggagtacatatagatgctaatgaatctaaacacatacacatgtctagattcattagcatctaaatgaatgtggacaatgctagaaagtcttacattgtgaaatggaggaaatatatatttattaatatcaacatcctcattgccaccttaactgctgcaagctcaagctaagttgtagcctactatgtgctacaggtagaatagagagaatgtgtggagtatccctactacagataaacaaattgaaaaaagaagggagctaaataaagacaacttactggttggttgaacattatcagatcgcagcggttttggatcacctgctttatcatagatttttccaagtatggacgacgaatggtacgaaggactgcggtccatgaagtgggggtattgttttaccattagatcacgtggaatattgacctgtcgggattggtgggcaaagcttaaattgttaaagcacaatatgcattcaataccctcacattacaaagcttcaaataactaaagatgcaattgcacatttcattttgtatcttgtaattttacttaatctgactgcttcatatgtcaaatgcattcatgtggccatgcatctgtacatataaaaagtaatatataagaaccaaatatgaaataccaacgagttattcccataactaagcatggtacatccattcttaaatcacgctaatataccgagagttaacacatatggttaaaagttcacacaaccacaatcaagacgcaactaatggaacaaagaatcatcatgttatggtatattaatttaataaaagagtgacttcataactatgtacatcaagaccagtgtagtgtatccacagcagatagcaacattcaggtgcatatgactgattttgctataattttgtagtacttactaccagaatagaatataatagcaactaataaccttcacacgcactacccaatagcatatatggattgaattggataggctgacttgtcagcacattcctcagtatgatttcataagtagttcagttcatatgttgacatgtatataagaatagtccaattgatttcactccaaacttaatcaaggtgttattaactaattattactacaaggtcttggttcaatttgtttccttctttccggtgtttatcaaaataccagatgaaagcataagttaataaggatttcagttccatgtaaaagcatttgcaacaaacattgtgtaagcccaagattgaagttaaccttgttccccatctttggagcatccaaagccaaataataaaggtcaactaacttgagcatctttttctcaattagtttcttttcactttcgtcaagtgaaacagttaatagccgatccatatatactaaccagttagtagctgccgtagcacgcgcataactgaaaggagaaaaaagaaatccaaactcatgttagatcgtacaaaacttataaggttgtatatattaaaaagctacagaaaattgtcaccaacattagatatttaaaaatgtactaatcggattcatacaaaaagatacccaagcacttgtagttataaaaatattgaattcggtcaagggatcatcattggcgcatgggaggacatccattgaagtattgaacacctcaataagttgtatatactagaagttaaatgaggtaaatttctttacagtagagaaatggtttcctaatgaaaaatatacattagaaaaactgagcttggtattaatacctaggtgcaaatcttgttttcaagaactcatgaaatagcactctttcaagctcggattcattaaaatcctcgggtcccttttgcttggtcccatttggtgtaatagctggaacccatggtttcgaaggtttaaaatgttctaacagctgaaaagaccatttttattatcagagcagcaataatctttgaaaagctcaaaagagagaatgtgctgttatatatcaaaaccatatacatgcaagaataataagcaaacatatagtgaaacaatgcaaagacacaatgaaacagcgatgcacaattttgcaacaaaaagcaaacatggcataactaaaaaaacagctaccctaggaccctatctaccttaagatggctatggatccacccaaatgggcgttcaaagctattataagaaaagcagaggatttctttggaaaggacaggataaagcaactgtcttttgtcttgggaacatgtttgccggccaatacagtattgtggtcttgacatacataacctagaaaggcttcaaataattgattcttctagaccatgggtcagcttgcctatccaagtatctcacaagtcacaatgttcatgcgctcttctacgtagctacggaaactataattggtaatggggagaacaccaagttctggactgatatatggctgcgcaaaacattggctgaattggaccctaaccttcttgagacaattccccgaagagtaaggaagcaacgcactgtggcaaaggaattggttaataggatatgggtggctgatattaaagaactcacaattcaggttatttgtgagtatctacatatttgggacttggtggatgggataatcttgcaacaagatgttctggatgagcatagatagaagcttacaagttctacacaagtaagtcgcatacaatgcttacttatcaatcaagtttgcaacttgggagcgaatttagagaagttgggttcctccacaacataatttttccttgtgattggcagtcgacaatcgatgttcgacatcagaccgtctagccaagtgtggcttaccacacctggcctatgtcatcaagaggatgaaaccatgaagcatattcttgtctcatgtgtcttttccaggaaaagtatggaccttgatcttaaattgggattggtggatgcggcccctcagcctttcagtatcccatttttcaggatggtggtggaaggttgtcaaggagattcctaaggagcagcgtaaggggttgaactcgttgattatcgtagtagattgggagatttggaaagaccagaatgattacatgttcaatggatcaagtcctctgtaggttgtgagtccaccaccacaaccgaggctagtttgtggtgtctagctggagagcatgcgctccaagagttcctctgtaggttgcttgcctcgggcagctaggttgtccttgaaggtgtggtcgtgcgtcaccttccgtggtgtgttttttgtgggagggttttcgtaaaccctcgtttgtaacttgtaagtgtgttatacttcttcttaatgaaatggattttttttctctcctgcgtttacgagaaaatattttcccaagtggactttactggtcttaaacaccaccctgaacttcaaaaccaatcacctttcaagttcaccccaaatgcagacctgttttggcaacatgacgatgtcacccaaggccgaaccaattttaaactgacttagtaaactatttcaaaacgttctggaaacctctaaccagtacagtggacctagataaagtataactggcccttcaaaaataatgttaaaaaataaatacctacaaatttatataaatgttcgactaatttatccaagttttcaatactcccaacaaccaatcaaaaagaaaatttaagtcatttagttatcataaaaaattcaaaaaccatttatacctggtgtatattttttaacattcagaatcagaaaacacctgaatcagttctggaaaattctcaataatattatggtgtatatatagcctagaaaatttagtacgagaaaaataaagtataagcatctggaaaaaggtgtgttcaaaactaaataagccaattttcatttcactgactaaaatatactctgtttcacttgagactaactatactccaaggtgcgactaaagaatttgtccatattttttatgtcaactcactaattccaaaaattcaaaaataatttcaaccttggcccttactgccaccttaatgaatgtcatgtaaaaacaatccgattcaggctaaggtataaagtgaatgattttgatcgtccagattttgaatagtgtctacttttgaggtttgaggttaatgttgtaaaacaagccttttcctcattaaaacctaagcatactaataactgaattcttctaaaagcaaaggagctatgacatttaatatcatttggtttgggtgcagtgaccaaattagctcctcaggtttggcgaaagagccatttttcctggagttataacatcggacacttctcttataaagaacagatcatttccaagagcattactggataaatacaatcgacatagaccatgggtaaagtagcataactgctgtatgaatggaacaactacgctgtggactaggggcaactgagcaaaactctgtcagggattttgctgaccataaaagataatcaagcacaaaaacaatattaggtgcatctcccaagacgatgatttccaataaacttcacggtaaaatgtcaatcaggaattaacatacctttgggtttaatgagacccagtagatgtcaccatcaaaatcactattggccatctcatcagccaaagaccgttgtccagtagtagggaagagtatcgcatgtttagaatttcccacaaccttctctatgtcgctactatatgttgccttcaagacatgtatatcaccaggatgtaagccaggatatttatacacaagaacatctccagaaacttggccataatcactgtttaaccacatataaagcaaataagtaaagaaagacccaaaacataacaggcacgctacaaattaatacttgtatattgatgcacatttatgcaaggaatatatatagcaaagaacaaagttattatctttggcaaattcaaaccccttttcgtaatccaatatactctccccattttttaatagctgacatcattgacttttggcatgacatttgaccattcttctttttcaaaaaaattatacaagtgtcatttattttgttgcaagttgttttatcattaaaaaaactttaagcatgaattatattttcgttatttacactaaattttttaataagatgaatggtcaaacgttctatcaataatcaatgtcgtcatctattgaaaaacagtagtatctgttggtagaattttttttcctaactattaaaaacaattaaacagatcaaattactgagctaaaaaaggccatatacagatatactcaagaaattcaaaattaggttgaatgaactaaagaatggcattaaagtctcgagggtccaaatacatgacatgtatttatgatcttatgttgtcagttcaatactttctttagactccatttgctgacaaaattcacaattgcaaccaatattgttgccactattttcggatagtttgaataaaaaatacagtccggttgcgaaaagagaatacatgccaaccaatctaacctttgagttgtgattcaaaattgaggattgtaaatagtaagaaaaatggtaatgttggtgcgttacaactaaagaagactgtaagacattaaagtagttccaatgatgcccatggtggataatgatactcctatcttatgtggtaacaaaggatcactgaagcataacaaaaaaacacacactcaaacaccaagaagaagcaaaagagtatttccattactaacagtatcacgcagacttcattaggtccaagttttcctgtagggtctgcagtacccatcaaataatagcagtcatcaattggtatctttccattcttgattccttttctttccagtagagacaagaaatccagcctagattgcaagtacgactcttctagtgggattccggaaagaatcatccgtgctggcattgaatcttccatgtcagcatagttgaatgcaactgcaagaacatgagaatattagtccggatcaaacacggacaggtgactgaaaaatataaagaaaatagtaactctattacaactagtaagatgagtacaggttctacagaatgaagaagcacatatatacaaattgtacagaacacagtgcaatgcaatgagggtagttcgaactaactgttcagtgcgccagcataatcaaaacgagcattgtcagcctcttcaatcgcagtctgcagaagctccataaagaattcttctggaactcctccatagtgaagtaatgcaattaaattatttgatgtgaatgtccttcctgatcgattgctgagaaaaagaaatgatattacttactgtgaacaaaaaatagaactgactgcctgttgccaatcaaaaagctttactaccccttacacacctacctaatgagctcagctttactctccctcctgcctctacctaaccggccccaaccatgaggattagacatgtgacagcacttaaaccacagtaaggaacctccaagtctggccaccagcccacccaaaatcccaaataccacaatgatttaaatgcagagttcgttcctttggacatctgagtttcatgtaccaacaactcatccaaaaacctaaactcaaattactaagcaaaggcaagtaatcctatttatagaaaaaaaaaagtgagtttcacatctaacacatcaaacgtattttgttgttctgatttccaagttatgccacctcatagcaactgtagcagaaattgggaaaaatatatctgggtgggttgtgtggatggtcctgaaaaactctggaaaagaagaatggcaatggcaaccttgacaaaaaatcaatctatcagcatcaaattttcaaatcaaaattcattctgccgtataggaaatctggatagagagagagagagatacaattcaccatttttttaattatttttcttatatattttttgtttccgtcttaatgaaatgaagcacaattctcctgggctttagagaagagagagagagagagagatctacaattcaccaaaatttgtcctctgtgtttatcctagcacatcatggattttaagctgaaatttcgtacatgcctgattatatcatgaattgcaaagccagtgttttccttgtttgcagtttttcatggccatttgcgttgcctaaaagaggatgcactggaaatactcaaaaaaaactaacagcgaccgtaggcaaaactaacatctcaaagtttctggcttcaaccacacttacgaaagatgacacgtgatgcgtgacgtataactaaaaaaacgaaagg

SEQ ID NO: 68124 - DNA, 1172 bp, Oryza sativa
caataaggaaaatcaagtccatcgaaaacatgtggcttagttgtaaaaatccgaagaagaaaataagactctgataccacttgtaggattgcacagcaagaactaagccaaccaggcgggagggggtgtgaatggttgtagtgccccaaaaccaaaaacttttaacgcaattaaaagttaccctcaaatcgatggagatcggtctgaccgcatatcttgcaccggtctgaccgcgcctgtgccgttggtctgaccggtgtagatcggtcggtctgaccgagtcgcgtctcctcctcctgtcgtcaccgctgccggtccaaccgcagttgtgccgttggtctgaccggtgcgttgccgctggtgtgactgccgtgcactcgccgatgtgaccgccaaaaccccgagcaagcacaaattgaagatctctcaaagtagatcgaactttattacttctattcatgtttacaaagtacaacactccactcgaaaatctcgactaaactcgaagccctaacttttctctaaactcaactctcacacaatcgataccgggaggcctcaccctctctatttatacccgaggtagggagtctaaatccatgaacccaacttgtacaaaaagttctaatcccctaggaaaccttcccgtacaagaaataaactttacaaacttcaatcataaaaaatttggactcctttcaaattcgactccgtatctcatacacacgacatctccattgtatggcatatggaatcttcaccaacactgcattgatctttagcataagcatcccgcatgatatcctgatcgtccaaacgtcatcttctcctaagttgactcccaatccatcaccggcaacactctcccgagacatcaagactcacatacacatgaatcaaccaagaaattatatccgagcaaaagttctctccaacttgactcaacattagcacacaacagtattacgagaagccataaatatgaattaatcacaaatatccaaagaaacaaccagaaaccgaaaccgacacagtgttggtcagtcaaaccgtcgggccagccggtctgaccggctgcacctgcccggtctagccagaccacacagttagcaacatcttgtccatcatctaaaaaccacacatctccaaaaccactttgtcgaatgtctcca

SEQ ID NO: 68125 - DNA, 15866 bp, Oryza sativa
caagcaaacaactacaacattaacaaatgctaatgtcaatttaatgaatgaaagttatagccactgactagtaaacaacatcaggtttttccttctaatacaaggcagaactagtatactcaggcaactaaatgaatcataaacattcaaaaatgcccgatggagtggcgtgaagaaggataaaatcgccagaagactatctgtgcagctaatcatgtgcagaaatagctcagtacgttctatgaaaacataccgctaaaatttccatgtcgagaactggaaaagtcatttcttgtcaacgccccctgtattatacttgcatctttgccttcctgcacaaatatgtgtgtaatacgtaaaattcctgcaggaaaagagagcagagtaacctttcaaggagagtaactttgcagagttagaaaacaagtcccaaagaagatctatgtattgatcagcagcattttaagaactaataagaatatcaagataaatttccacgggcataagaggtttttgttagctgccgattccattccaagttaggcatgtgaaggtttgcactggtcctaaaaatagggcatccaataattaacgcatgcagttccttacctcaaaatggtgcctacaggatccaaacaagcttagctggtcctcgtagcacagcttcagttgtttgcgaaagctggagaactccgtaagcacaatctgctcacactcttgtataagactttcattcagtccctcttgctgcatccgattccgaagcctggcagtcgagaccgaaacatcgctttgcacaaaagttatccttccgctgagtgatcttagcgaataaaaactcctcgccaagatcaaggcctcgatccaggcaacacggtcttcttttgaatctgtcttcaaatgaagtgtctttgtgggggaaaatatgtagaatctcctatcatccgacttgctctcccgaaatgctgacaactacaacataatgtccagttagctttgctatgggagaccttgcacatgaaaatgcagagtgaactttccaacatgtaacgctatccatcagaaataaaatagagcacacacacgcagactaccatccatcgtgttaatcaacagtcaagctaaatgcttattgcagaccaagacaaataaaaataaagatccaaagaccattagtttggcattccaggaagaaaggcatgtgaatcacttccactcccttcaactttaattaaagggtgagggggaaaaggcaagcaaaaggtacatcacatctaacatcaaaatatggagagaaaaaacaacgacaacaaagatttcaagaaaaccaagaaaatacaatcaagatggtgaccactaccttggaccaagcaagtgaagtgggcaagtagagcagttcttggagatccacaaggcccctcctgattcactctaacttacacacaggtcctctatttcaacccctaacccccttactatcttgctctagtatatgtgaccactggaagcaaagcaattgtacatcctttaattgttggggacccatgagcaatggccttgaaaagactcagtgctagtacgactactgcgagttcaacagctagtaaaagacttgtggaaaagcaaccctctccctctggagcagtacaaatcaataatgcaataaaattcaaaaattaaaaaaaaaacattcgctgagcatattctgtaaccacccggatttgttcaacttaatgcacagtattaaccatgcttcattaaggattaattgtgtcacagttggaattaattatatcatctacatttttttaatacgacagcgagggacggataaacttcactgtcttcatcgttctttagagttgccacagaaccctgccatttgtaagaaattctacaggagagcttgaaattttggctaaatccactaaaagttgagggatttttgtgcaaaagatgtgtctggttgtgtgatagagaaaggtgcggccctttttttttttttgggaaatctcgtatcaggaagagaaaaataggaatcatttttgttcatttgtaccttaacctgatactgctaaatttaggcattgttctgtggcattggaccacgaatgagatgattggtcaatcaaaacctcaggtgtttaactgctccaatatgcccccccccccccattcatgtcatgaacaaagcagaaattaattcggaaattttgttccattccaagaacacacaccaagatcatgttgaacaaaataatcgtccaaatgacaaacaaaaaagggaaaaaaaacttcaagaattcgtgaggacaaaagaacatcacgtcatttcgatccagcaaaatgtgacgcaatctcccaactaaccattgcatagtaacgagatttcgacagagaatcttccagtctctttcgccaacgcaaacgaaggaacaattcacacactaacacaatgcaaaatgtgattgatgcttgatcgattcagattcggaaagaggaagaaagagaaaattcctcgcagacacagattcgcaaaccgagaaatgttggggcaaaaaaaaaaaaaaacatgatctgcgagatcgcaggagaggattgggttaccttgaggcagacgacgccgacgggcttgtccggacggcgcgcgccgccgatcctggcggaggcgccgccgatcagcctgacctcgccgccgccgccgccgccgccatcctcgtcggcggcagcggaggcgtccctacgaatcttggagtaggagagcaccccgtcgtggagcgagaaccaccgctcccgccacccgcggccgtagttggtccacttgtggagcaccccggccaccgccaccgccgcgccgcccgcctcgggctccggcgtcggcggcgcgtccggcgccggcagcgccgccgcggagaggcagcagaggccgtggtggttcaggtggtggtggacgcctccgcctccgccgccgctctgcgtcatccgcctccttgattcgacggcggcgacgagaacgaaaaaataaaaagaaaaagagaaaaaaataatgggaaaaaaatggatttcttttttctttttttgggttcgcgaagaggagcgaagcgaagggaagaggagacgcgagttggctttatttagcagcggttggttgctatttatgtgtgggccccacctccctcgcctattttatgccccctccattttttttcttataagtcgcaaaaaagcttggaggagggttgtttttttctttcccaaactttaatttggccatttcttgagttaatttgtatgttttccacggatttttctcctttttgtcctaaatgcatccaagcaactggctttttttcttcacctttcttctagatgtaatcttgtctacgaaatacggattatgtttcagttattataaatatggtttatctctcaacagtttcggcgcataactataataacgacagcgctacgacgatttaactaccgatggctttgtcagataatcataacataagacaaagccaaaagcatatctttttatatgaactaaaattgtgcaagaaatttcattattaaggtttaagttaaaacattatgttactatccatctaaatgaaaaaaaaaagaataggcaagctaatagattgagtggtcgactgaggtttttataaggttgtgctagcacatataattccttattcatttaatggtataaaacatattcatcgacagtaacacatccgtgataattctgtgaatctcaagatatatagatcggtctagtctttggaggtgtttatagaagtaggatatatgcatgtttatatgagcggttgtgttttacattgttttatatatatatatatatatatatatatatatatatatatatatatatatatatatatatatatatataataacttagttttatactagaacacaagataagctaattaaaacaagaaagaaataattataattaaggaggggagagagacgttaagcaaggacatggatactgtttaccagatgtaggggagcacaggatgtcatagggatcaggagtggttcacgtgctatgactagatttagtgggccttaatgcatagttaatagtgtaccagctagtggaggtgagtgcaacatccacctctcaacaaactccatcacataatctagaccttaattaacctttggaaccccttaggtttactctatgtgtgcaagacaagataggtaactggaaattaataatgttagaaattactgggagtaccttcaagtttacacaaaagatataaatgatgttgcatatcttatgcatatctatactactttaaaattaacaatataccaccactatcctttatcactaacatttgagcccctcaatatcgataaaatttttgtgctccctaattcatcccttttccatgacaatacacgggcaaactagttagtatatgaagtatgttccggtggcactataggtttatcaaaatatgccagcttttggctatgaaggtatttgacatgatttacaactaaaaattattatattttgggacgagacgacatgtgtttaggtgtattggcaggcatgccgtgtgtgaatgtattgatgacatcgtgagagagaagaagaaaaagtaactcttgggagaagattgctaaaccataccagtgtaaaaccgtgtatttttagcttcaaatccaagagcacggacagataacaagtgatgtaaaagttgatcaaggttgtgcatacacttataaaaagcacatgagctgcacatgatgacatgaacatatatatgcatagaaaatttcacaactcatgctagctccataattcttgcttaggtactatctccttttgtcccttctgttggacatttccacttcaatttggaaggtctataaaaaaaatgatgcaaatgtttatagcaatgccatgaattttactcagattatatatatacacaacaaattgaccatggatgccattctttttagaaccgttccaaaattaaagggacatatacaggaaagtcggagtcatggatgcatggattgatacaaatgagaaataataaacccatattcttagaatcttaatagcattttcaggtatagttatttttcctagaaatccaaatattaacttttgaagggccctagtacagaaattgctatagagcaacaaattaatacaagtcactttctaagcaatgtttgcttacaagataaactttctcgtcatccattaatttttttttaaaaaaaactactagtataatttatatattgacaattataattggtcaaaatcacggtgtgggggcccactcaacgttggcacgtgtgcttgtcccggtgtggcccgcgtgaccaaccagcctctcttctaggcttacgtggcagcacatatcgttgtcttcccaaccgacccgtcactgacaggtggcccaacaccatgggtcccacatggcatatgttaaaatataatttgtgagggataaaatgcctaaggctacacagattttccatttacaatgttattataatttcatacaactgaagttcatcaacttttctaaaagaaaacaatttacgacactttgttgtatgatattcacccttattttagaccgaatcatattcacttttttttgtactccctctgctccatattattataattaaggtgtcctagtttttgtcttaaagttacttttttctaacaaagactaaatttatagaaacatgcaccaacttctacaacatcaatttagttttattaaatcatcgtgaaatatgtctcagtagtgtatttatttgatattgttgatgttaaatatttctctatcctaaccaaagttagagaacttttaagttaggacaaaactaaaacacctaaaatatacaaggaagagatattataatggtaaattgactatttgagaaatatcttttgtatgtcaataaaaacttacaccctcttaaagagaatacaaacatatttgtctacattgcgagtccaagactaaacataaaaaataacacaaacgcatgatacaatcaatttctaacacataaaattcatgatacaagattatatcatcacacattttcatataatagatagagaaaacgatttgccacttttctttatctcattgaagtatgttaaggagacgtactcattaatgtgtgcatactacctagggaatgcgctcgtagtgatgtgtggtgtgttctctatgtaatcaagaaaaagaaagacaagcgtgaggtatatatattaagaaggcacactcgaggatatgtgttaaggaaatgcattcactgatatatatgtgtggtgtgcgtgcgtaatgccatgtgttcatacatgtgtcttccaagcactcgactaaaaccaaaataaattatgaggtcaaaagcgaggtgagcatagcaatattacaaatcccatggctggcgatgtgccacgtagcttaatatcttgttgatctgtggcccccacgcttggacgagaaaacccaacatcgccaggcgcacccaacttgttgtcactttggttctttctttttgcaaggaatgcaatggaaaaccagcctatccccaatctagcactgtacttacatgcagtagtggcaggttgattgccaatgtataaacaatgcgaaatagtgtatttcaattttagcccaatagtgtgttgattgatatcatttccgtggctagtcaaagctcatttttagctatcattttcacgactgttggtcgcgctttattgattgattctctatggcatgttcgatttttgtgatagattaatagcgtacggtgctttatttagtatgaagatatacactttctttttctttagtgaggagataatatacatattttcttaggtgttagtattaactagctagacatatgtgtataaaatggttatcaatgattgttttgtggatcagggttctctttaccacttgggaaggggttacgacatctcgacggtaagcttgattaccgtaataaatcgagaacaactgaaaaaaaataaatgtttatttcaactttttttaaaaaaaaacttagttgggttaccaggcgttatcacaagtcggattactgcggtaacaccagtaacgggtggcaagagaaacttagtgtggacagcattattgttcttgccagcataatgctttgtttataggctttcaattggagaaaaaaaatgtgactattttacatgggccttctttggattctccgagctattaaatagctctctggaatcttgttatttaggagtattaaacgtagattaccgacaaaaccgattccataacccctaggctattttgcgagacgaatctaacgaggtatattaatcccgagggctattaaatagccctccggatccaaacagggccatggacttggtatagtaaaaatgaatcattaagagcagactataagccagctgcaaacatattttaagaagataaataagaagagagaagagcagcgggctacatatttgtagccagctgtagtatggactccaagacgcagtatgtgtatgacaggtgagaccatatattaatagtgtagtgtctaactattgtatgaatgagctataagattggctatagatgaattagagctagtagttggctacactattaaacttgctctgatacggtactactgttaggcagaggtgagtggtcaagtaacgcttattttatttgttcttggatctgatcacagttgacttaatcaattaggggatggtacggatagctgctaatgtagctttgttaaaaaggaattaagtagacttaggttcacatgtcatgaaagaaaatgactagagaagccatgtcagttttgaataattgtccttcttaagatagcctaaaattgaatccgccgctaccgtaattttcttgatcgagttcaacttcagcctcatttaattttgatttcaaaacagtagctctcttgattctatcatcatgaaaaatctatttccttgaacacggtaatttcacagaattttcatatgaattactttagcttctccataaatcctgtaaaattcctttgtaccaaaagagaccttactatttttatataatagaacgaataccagtctttgcttcaaagaaattataaccacttattagttattacaagcaaatgttcttttagcatagatcaactaaacaattccagcaaacaagaaggcaaagaataccttactggtgctaagtggtgatggttcctattagtgatgaaaacggagcggatagtttccgtctgctctggagaaaaacgaatatggatacctttcggatcggataattctcagattgttcggatacggttacgaatatgaatattttctcctagatacggatatggatatggtatcggggtttccgttgaatacggataataattcggatatccggtgaacagtgctattcgaatatccgcagaagccgtgagacatacccaatttctttataaccctatgatgttcaatatacctttttagattttaatagtagttcatctcttaacactagtacacactattaatattatttaaatttttaaaaatatttataaattatactacattttatataaaatgagctaattatatatgttgatatttgtttctattagaagttgagttggttttcgtgttccaagaaaaaaatgtttcagtagtcatgtccaatcatattcgattcttattcgtatttgtttccgtattcgagctatccatatttgttttcttattcggcaaaaaatatgaagacaaatatggtatgagcattatccgctacgtttttatccctagttcctataaatgcaaatacaaatgtattcgagaagtctcaaacaccaaactaaaacattgtttttcctcacaaccaactcaaagaagagaaaaaaaaaaaccatcaagacattgttttgcttgctttcttgctgcacaaaacataggcacaccatcattcagcagtatctttaccacttgatgcaacctgagaccctcatgattttgtttgtttcagctgttgttctctagggtttcccaaaccgctggggctggggttaccgcgccccggcggtaagcacggttaccgcacggtaaccgcaaaaaaccgtacaaaaccgtgcaaaatttatcaaaaattcaaattattttttaaatttatttgaatttaaggaggttaccgcggtatttatattaccatacccccacggtaagcccggtaaccgcggtaaccgcgcggttaccggcggtaaggtaaaccctgttattctcctattgaaaaatcaaaggaaacaaagcatatgtgagaagataggagaagagaggtaaggtaacatggggcctgagttggggggacaatgcataggtgtatgtgttgggatgatatcaatcaaatcatgtcaccttcgatcgatgcaccagatgttccctcagcatccatcacggctgcatgggccttttagacccaagtgaaacaaagaatcatacattagagcatcatcgacatgattgtgtactactccttcagtacaagcaccacatgattttccttttaggaaagtaacataccacttgatattttttttctcggttacctggatgacacatatgtagacaccactatataagggtttttacagtgtggttaataatatctcagtccgagtgagccagatcggagatttgatgccacgtcaggctctctcgttgtcctgtgaagaacacggagccaagttgagccacacgtttttatcagaatttgcaggtctggcctatagttatgccccacaccactagagaaggaagaggaagtataggtacctcgtcgccatccctgtcctccatgccaaggggaggagggcaatgaggcgctatcctcgtggagcacttgggccgagccggtgacggcaatggcatggccgcagacgaggaggaggggtgcaagctcaatgggggtggcgatggcctcgatacgtccgcaacaacagcccgacggtggccgcctcaaaccctcgtcccatttgcagtatgttgtcatcgtcttgtggatctcgcccttgtcgtcgagtggtaaagaaggggaggaggggagaggggtgccaacggggagttgaggtgctaaatggagatttttttttcagtgagcgatggagatcagggatgggtcaatggagcttgctgggctgccgccggcaacctctcgcccacctcgatctgcactgaagaagcacgtcggctcgatggggaaggcggcagggtcgaagaagctcgccgactcatcctaccgtccctgaccaatgttgttgtgcttgtcgtcaacctccactcgcgtgtcagctaagcttttcaccagtccctcacgctaaactgccgagctcgtctatgcatcggttgggagaagtggagaggggaggcatcggttggggaaggagagggatagtaatctggacaggaggcctgtctagattcgtggtactatgaaatgtctaatcagatattaggcttctatattttgggacgagagagtacatgataaatcttaactatttggtggtttagttgtttaggcatagtcattctctcttttttttttgttttagaaacagaagacaaacacatgcgctcactacacgcacactcacccctataaacgcacacacgcacaccctatctctatgagcacctctaaaagactagactgacatatgttgagattcacgaagtcaccactaaagtctcgctatcgatgaatatgtcgcctaccattgaaaaaataattagctctaaatgtgaatacccgtattaagtctaagacttaaatccaagtgggttgattcgaccacagggaacctaaccagttgagtgacgctcacttcgcattcattctcatttaattgaaacaacgctaattaatcttattttctcaccgttcttgtctatcattttctagaaaaaaaatgacatataagttacttgattattgtttcacatgaataagattcattcgcaagaactaacaaccaaccaatttcacttagctttttgttcccaaaaaaatggaacatagagatgactccaagatattatagttgcatcacactcgtttaattttaatgggttgtgtactgttattctcttggttaacacaaaaatatcgagaaccatgatatgagcagggtgtacacattactcgaattaactagttaactgaactttctgacgcgttagcatctctatgtgcttaggaccaataacataggattattacagtacacatcaacgttgttcgttaccagtaattaatcacattgcacgaataaagaggtatacgctgacgtcaccaaccgtacaaaggcatgcttgcacgcgaggcttgcaaatgatgatgaattttgtttcattgtcacgatgatcacttaactctatagtactactttaatttgagtgtttttcgtcgcaagctttaagatcaaaagccactactcatattgttgcaaaaacacactattccaatatagtattatacgaattcctgagctctcgaataagtaggttcacagtcgttttcagattttaagttgggaaaaagttgcgacgctttaacgtcaagtcgcattcatccaaattctgcctaataatttctagtcattgatcattgaccggtcaacaacaatctgctgaactggaacatgcaaatgtgcagcctgttctcaggaacatggcctgaaaaaacatctcaactaaccaatgggcaccgttgatctaacaaacattgattggagtacacaagaaagggaagcagcatatggcatcgccaaatgcaatctttggatagttttgtcactgcaagtatcaggaggaattgctacagacttttttaactccctgtcaatattgctgtctgtcacaccatactccatacatgtcccccatacatcagatttagggctcctccaagggcgaaaatacggtgtggatcatcagcctccgcgagcctccctcctggtggcatcatggaggatgtcaatgtcgacgccatcctggggaagcagcacgtaccgcaccaccgatcccctgatgaagcagtttcgcacggatagctgccagagcgaaagcttgagtcagcatgctcaaatgaattctttgtaaagtgttagtgcttgattaatgtagttcttccatatagaacagtgaacacaggtgcgttgttgtatttttaacaatagaaattaacaggtgcaagtggtaaagcaatgagagtatgaagattgtttcagcaagcaaagataacaaaaggatatgaatctttccatcactatcatgacctacaaaacacagtatataacattgatctatagctttgctttcctttgggattacttcaggcatcatgtacttgtaacaactaacaagcaatctttagtaacctatgcagtacaaaagtacacccttcatacaatatcattggatggaactgaaggccaaataaatatctaggtacggatactggttgtccctgtcaagtaatgtgcttgcctggttacaacagtatttgcactggaattaccagtgcatcttaagctcctaattctgcaccagtaaggcatgtcacgaactaggtataccactatatgatctactccccattaattcctaaattcatgtcaatgtagcccaaagtttgttctacaaacatttagacataccgccttttatcattagctggtgactacttcaggacatttactacagaaccattgattggagtcaacacaccactgtgttatggattggctaaggtaagggtctgaagaccaggggatagggcactcgccctctaatagcagcggcaggacttctccctgctgagctgaaagactcattgattagaactctaaggcttagcgctaacttcagatattaattgattatagggtatatggggtccctttatatataggaggatagacttgacatccaaggaactaatctctagtactacagaaaccaatccaatatctatctataactttctaataaacatcatctctttcctaactagatactctcctatctttatttgactattcctaaattatcatgcctaaactgctgcatgggcctggcccatgcccaaaacaacagagagtaacaagtgatctaatgaagagtaatatctactatggtttataaagatggttattattatcttccttatgcatactcttggttgtgggatactgggatcctataactgacattttgggcctcactgtatgcccaaagaagaatcagctgctgccataatttgaattttagaactttttttttggagttgattttagggtattttcaacttagtttctttttcaacattggcttttaagttgctaagaagacatataaaagtttacccacaaatcaatttttggatatagtcagctcttggccaactgacggagctcctagttactaacggagagtgttacctgatccatatccatatcgtacttcttttacttatgcaactacatgtcagacgtgcaaccattctgaattgtgatacagcattcagcactaactaaacatgtaaggatcatgctaaaggtactcctttaacagattaataaatcaacagatgacaagtacatgctatgcaaacagaagagaagaaatctgaaatcatgtagaatgaggtgattttgaatgtatccattaatctgacacagaccaatcacaagaagcatcatgatctgcaacactgaatggcatggaagatgtagcacaggcattggggctccttcagaggatagtattctgacaagcccggggttagcaccgtgcatgaaccaatatctatgtataaatccttttgaaagaaggcagtgcgaccccacctccatgaactacattttaatgaatagccccttgaagttcttcaatactactaagtcaaaatatagctacttttggttatgactctggacaagtacttgtccacattcacagccaaaagtagttacatttcaagacggaggtagtacataatagtaattacaaaaaatgttatagtcctatttgaccattttgaccttatcaaattgactgagttgccacatgtacatgtgtgttgttcaagctaatttggaatagaaaaatgtgtaaacacggtaaaaagaagtgaataattaatcaactgaaaaaccatagcaaatgcacaaacgcacatgcatattgaagtacaaaaccatgaaaacttcctaaatctatcttgaacagagaacaaagcatacagagtcaatatatctacagaagaccaccgtaaagaaccaagaaacactgtgtttgctgcagagtcaatatatctacagaagtacccatgcaaacaagcggctaattgctatccatatttcaccaggacagagacagacagatagatagataaccagagcagcatcgcatcgcatcgcataccatgtgcgggtacttgtcctggtcgacaacccgagtgttctcgagcttgatgttgaggtattggtcgacggagtggagcgtgccgcggatggccaggtcgttcttgagctccaccgtcacctccttccccacgagctccttgaagtaggagaagaacagctgcacagcaaccaaatcaacagaacaaaaaataaaaatcaacacaaactaacagaacaaaaaaaatgaagtgggaagagaagaaatcaacgagcagttgaacaaaaaaaactaaaaaaaatattctaccatactggccgcagaaccctccccgccttagctccgaagaatctgcagacgcaagaggcaggattagcacccagtggacgggatccccaaacatttttgaggggcaaataaaaacaaaacttctagtcctattattaaggtttaaggctatcaaattaagagaaaatcagcttctcccagatctagaagagaagatacagttaacgcaggcaagcaaattggacacaaaagcgggtgggttggagagagagagggagatgaatgagaaaagaggatgcggatgctcaccaagaagcagcaggacgacggcggcgagcgcctctccccctcccctggtagcgagatggagatcggcgcaggcgcaaggagcggagaggatagaccggaccgccggagatggaagcgcggcagccggatcgggaggaggcaaaaccctagaagagcgcgagaaggcggaggaggaggagttgggttgggttgggttgggtgttgggtatgagataggaccaaaccatattattatgggccgggttagggtgaaaggcccatatagctttatttattaggaaaaaagtatactctgactccctcaactatcacccgagtatgattcatgtcctccaacttccaactattaaaaccggtgcaaacaaataaacaatatccctcggtggttttggaagtggttttggctgacgtggcggtcttgaccgagtctttatccaacatggcgcttacgtggcattagaacaaaaacaaaattaaaaaatgtggcgcttacgtggcattagaataaaaacaaaaaaaatatgtgggacccatatgtcattcacacaaaaaagtgggactcactgacatgagagaccacatgtcatcctccctctccttcccttcttcctcctatctctctctctcgggactcaggagcggcggtggtggcagtggccgatggggacgaggcggaggggagcgttggtggcggtggtggcaggcatcgccagcgatg

SEQ ID NO: 68126 - DNA, 1815 bp, Oryza sativa
actcgactgcgacaaagcagattacaatcaaaatgcagcaactgcgtgatggtttctacaagctaaatctatgttcatcttaaagagttcttttcacagagagagagagagagagaacataccattctttgtcgtcgttccaacctcagcttctccgcgtttgccttctcatattcaccgttctctagatgccgctggtctggccttagccgtgaatcagtaggagggagtttgtcctttgaacatgaccaatcaattcaattaggatcattgagtcttgatatcaagtaaacaattcaaagcttgtggagtattcatgactacacacatacctgaagatcaggagacagttcgttcaatgtgatagcgaacgacgatagattgtatcgcgttggattaggagaaggtttgttcttttcccacagaagtacggcacctttcaattgatcaacgctcttgaccttggaagtatctaaattactataatacatattttcatcccattttcctatcaaaaacgaaggtttgttcccatcatcatcctctacaaagccttgtacctgtggacataaaaagtgtaagcacggtatgaagatatatccaccagaaacacttgtgttcacaagtaaaaacagtgcatagtttcttacagtagcattcagaatgaactacatggaaaaaagggccaaataaatttccacaacatagggaattttcgcatggaaaaatcactactctcattgcaagggcatttcatgctactaccatatcagcatgaaaatggactagtttcatcaaatccatatacaatcaatggactgataattctaacagcaccgatgggcagctcagagtaggaacttgcaaccttgcattgagtttgtggtttaaatttatactactataacgcattaaaataagaacatgcttgtgcaattaatgtatcagatggtacgattgaaggagaccactcagctcttcatgttataagtgacccgttgtccacactccacacatgcaatgtttgacaaggaaataagcgtaatatacagattagtcagaaggtactgtacacagaaaacatggttttctccacatatcaggctaacagtaataaaaatgacagttaaggatgacaaggaaaaaaggaggtgaaacaaaacataccaggtgaggattgcgatcaagaagcgatggctctttgaacttgagtttacatgaatactggcgattcccttttatgtgcatggttccatgatggctgcagtacagcttcccaaggatgagattatgaatagttgttgtcacctaaaatggcactagcactttagcatgagacatacacaactttgttatgaagaacataaaaatcatagattccgttcaggtatcatcctacagaccttactccattggaagatttcaccgtcatcgaattccactgtcagaacaccaatcggatcgacttgaattgactgcccccaaaacttggatttgagattgctgtcgccccagaatttccagcccttgccttcacagtggcaggcaatcagcatggggtgatgactaacctagtgatgaaaatgacgaaaagcaatgtgttgcaattaaatgcttcacactatcaagatattaaattttagttcacagatagaaaaggaggcaagtgtcatgccttgtggaacttacattaattttcagtagatatcagttttgcattatatccttcacataaaattgaaatggaagataaaatatttcctttgcacagaaaaatacaataaagagttagataaccaaccttttctgcaaaga

SEQ ID NO: 68127 - DNA, 6497 bp, Oryza sativa
cggaccttaatcataaacaactcggtcaaagtttttgaaataattaacactcaaaatctttttactttttggacggaatttatccaaatttcagacaggactatccggactgggtctaaatcataaacaactcgattaaagttttcgaaataattaccattcaaaatcgttttaatttttagacagaatttatccgcatttcaaattggattgtccggactaggtcttaatcataaacaacttggttaaaattttcaaaataattaacattcaaaatcggtttaatttttagacagaatctattcaaattttaaacaggactgttcggactaggtctaaatcataaacatcacgattaaagtttttgaaataattaacattcagaatcattttaattcgagtaaatttcacattgcaccatgtattttgaccaaagtttcacaatgggtaaggtccacaccaaccttttcacttaacaccatatacgtttgcactagttggcactttgaattgggattgagcacatcaaaagaagttgtcagagaaaagatagttaaaatcatcaattttagtgccacagtattaagatacatatctttagaaaaaaaaatagcaaatcagaaaacaatttttttcagcaaatcacactaaaataatgatgtgaacatgtttaaaagtggcacaaaatgatcaatacattggggcaaatgaataaaaataaaatagaaaatagaactagttaagtaccacacactaaaaagaaggaagaaaacataaaatgttatgccttttataattatccatgtgtaaatcatattttagacatgaagctctctcacatattctcttgtgttgatcacccctagtctaaactgaaaacttttataattatccatgtgtaaatcatattttagacatgaaactctctcacatattctcttgtgttgatcacccctagtctaagctgaaaacttatgtaaagatgtacggtgttaagtgaaaacattgatttaaccctagtccattatgaaaccttggtcaaaatatgtggcccattgtaaaatttactcctttaattcctagacggaatttatctgaaattcaaatgggactgtccgccttaatcataaacaactcggttaaagtttttgaaataatttaacatccaaaatcgtttttatttttagatgaaatttatccaaatttcaaacgagactgtccggaccgggtctaaatccaaatttcaatcaaaacactccaatccaactatgacagacataaggcaacggaagaataaaccagtatgttttttttttacaggtacttcacaattgcaattacaagtagtatacattcagccacaaaagctatgatatacacagatcgacactttcagaaccacaaacttctcttttccaatattttgcgacgccgtaaccttgttagcatgacgggtttctgctgcaccagagataatataagatgctgatttataggtgaacaaagcgagaacatataacagtgaatattcagaaatcactggaatatgcatgtagagtttttctttgtcttgccactcttctatatattctctgtccgagaagaatgtgcctcactctaccttgttctgcataagttatgacatatgatcacacattgtgctgaaaatatcatcacaagctgaaaaagtttttctttgtattgcctcaccctgccttgttctgcagaaattatgacatactaatcacacattgtgctcaaaatatcatcacaaattgataaaaacaactgacaatgaaagacatttggcgtgaacaaacaaacagaagggcccaataaataatcactctgtctgtaaatgagagaagaacaaccaaagaaacacagtacagggttgcgacatagttaccttaagacggcggcatattcagaaatcactgtaatagacatctagagcatatattgtctgtcccgagaagaatgtccctcacgctaccttgttctgcagaaattatgacatatcactcacaccttatactgaaaatatcaacagtggataaaaacaactgacaattcaaaaacacacatctccgttaacaaaagtatttgttcattaagcagaactcaaataaggcatcgctggtacactgcacactagcatggcatgcaagagaactgaactaattgcaaaatcaagagatagcacataagatcaaaataccggagagaagataaattctccatggcaatgggctttttgcctgctgctcagcggcagaggtgctgctttagtgccggccacagagggttgatgctgctatggggtcgggggacggcggctgccagcctaagcccctgagcccaatggcggaggggctgcgacacggcccggtaaaggcagtgctgcacctgccggcagaggaggcgctgcgcaatgcggaggcgagcggcggcggcggcagcgggagaggcgtcggaggctgcgagggtggtggaggcggcaagtgcgaagaggaagggggacgggtggtggaggtggcgatggagtggcacgagcggcagagacgtgggaagcgattggggccggcggcaaaatacgatcatacccctccgcacattattttctatggacaataatacccctccacatttctactaccatcaagtgtggtggtagtagaagtaaatctcaaccctttgatcaaatatgatccacggttcagattaatttctactgcaagtagagagcaccggagtggagctcatctgaaaaaggaaacgtgaaaccattatcgtacatttaattttcacccctacccaatgccatcaacgctagctcgaatctctggactttgatctgcatgaacatgcaggagaatgagactaaggaggggaggtagcagtactttgtgtctcagttggcgacctgacatctcaattttgtttcctgtgactgatagtctggcattgtaagattaactggattattgtttttatctgctggtcgcacattgctatggcgagaggatggttctatggttgcttttgcaaaaaaaaattaactggtaatggcacttgcagaattttcttttaaatgaagtgagtacttagtattcttttttttccccttgaaatggcaacggaaataaaaaggactaatgagtccttttgcttatttgtcagtgaagaagacccttatttgccacttatgtttcatgttaagttgttgacattgtaggtttacaatgaatttatttttttttaactattaatagaactgaaccaataatttttacagaaacgtgcattgcacgtgcatgattactagtcttcttaatgagagaatagagtgactagatcactgaattatactagttcactaccacgcagcaaaatactactataaagaaaataaataaagagagagagagagagagagagagagagagagatattaaccttacagtattccccaggctcctgaatattgtggagttgatgctgatgatctctacattgcgggaaatgctttttttgacatggaaaatgtagagaatctctaccttatgacctttgcagatgatgctgattgctggccttcaccaatctgagttaatcagatatttacagatatataatcacatatttgacagggataataaggctaaacttattcagttccagcatgaatgcatgatgtgcatcattcctaatctcatgtagctaacattagttgtgctgcatggcttactatttgtaggaattttttccattttctttagtcttcaagagttagaaaacatgacagtgatgttaccattttacataaggcattcaaacttacctcactgttattcctttccatgaccatcttgaaaagatgctctcaccatatgaaacagaaaaggactcagaattgacactttctctatatcttgcagttcatcattggacattggtcggtcctgttttatccaatttgttaaagccaaaaaaaaacacataggacaggtaaacaaaattctactatgaataggcaggaatttaacacaggccagcaaagtcaagaacttcagtttactgatcacagctgaattaaatgtgatatgtgaccaggaactcaggcctaaaactcaaggttgacaaaaagtcatttactattctagaaaatcacaactctattaaaatatgtgaccaggaactcaggcctaaaactcaaggttgaccaaaagtcatttactattctagaaaatcacaactctaggaatacaatattgcagctactcagtgttgggaattggctcatacaattccccaaatcgctagtacctacatgtgataagtaaaatgcacttcatcaatccttccatacagtcttgatatgtattcatgcaccgatatgtactcgagggaatgtgtatattacttgtcacctagtctggaaagcataaaaacctgtcaaaagtaacatcaggaataaatcgcattggtaaattgctcacatgttgactgttgagtgcttcctgtatacagtgatcaacatttttccttgttacaggactaaatagtgctgaatccccataaaaaaatgccagtatatatctgttgtcatcgacattcttcaccagtaatcaccacatgagcaatgccctcctctaaaatggtggaatcgtgtagtatccctcaaaatgatttctcgatcctcgatcttggagatgaccttggctgcattatgacagtctccacaaaccctgagattcttgaaaatcctcaaggtcatcccaggagcagtactaatcagaccaaaagaaatagcaagcttctcactgtgcctcattagcatctgcaccttcagagtttcatccacatcatgcaggacaaaatcaagatctggaacataacccattgccttcatcctctccgctaactggcccagtttttcatggatcaagtaaagctgagggtgcaatctgtcatttgatctaaactcatgcatcacacccttaatctctatccagctatacccaggtgttttcacaactgcattatccttcatccacctccttactctagagacatcatcccactgatttgcgccagcatagatatttgcaagttgtacataggcacctgcgctctgtggatccttttcaatcagttttccagccgcaagctcagcaaactccaagttcttataaactctacaagcagccaataaggttccatatgcagaaggatgtggttcaaagggcattgagcggatcaagtccacagctctttcaagcttaccagctctgcagagaagatccaccatgcatgagtaatgatcaacccgaggctcaattccgtacaattcctgcattccctcgaaacaccgtattccaaaatcacacaagccagtgtggatacaagcagtcaatactgccacaaaagtaatccagttgggctcaactccttcatccttcatcctttcaaataaattgatagcttccttcccatctccatgctgagcatagccagatatcatagcattccacgcaaccacatccctcgtatgcatttcaccaaacagtttgcacgcgctactcaagtccccacacttgcaatacatgctcacaagtgacgtgcccaccgtcaagttcctactcaacggaagcttcatacaccactgatgtatctgcttaccaaatccaagtgcagacaagttactgcaaccaagaagcacgctgcttaacgtcgatgcatttggctgaacattggcctccctgaccatggtcctgaacagcctcaaagcatcatccgcatgtgaattcttcacatacccagcaaccacagcattccatgaaaccaagttcctcactggcattgcctcaaagtattcgatggccttcaccacattgccgatatccatgtaccccgacaccatcgcagtccacagaacggcgtcccccttctccggcgcattcctaaaccactcctccgccgcgctcatgtctctagagcaggcgaacccggaaaccatggcgttccaggaaacggagttcctcactggcattgctaggaacacggccttggcctcctccacggccccactcttggacagccccgacaccatggtgttccaggacacgacgtccctgaccggcatcgatgcgaagagcctccgggcgccatcggcgtcgccgctggcgaagtggcacgagaggagcgtgttgtaggagacagcatccggggtcggtattcggtcgaacaggtggcgtgcgtccgcgaggcggccgagcgccctggcgtagccggcaaggaggcagttgtaggtggccgtggtcttccgtggcgtggatgcgaacgcctcctccgcgccggtgaggtcaccgcgccgcacggccgccgcgacggccacggtggagagtgagcaggtgtgggaccgggcactggccaggaatgggcagcgacataggatcatgcgtacctaaaggctgacgacattgcttgcagcg

SEQ ID NO: 68128 - DNA, 10891 bp, Oryza sativa
attcctgcagccccagtcaagtaaggcgtggcaagccaacgttaagctgttgagtcgttttaagtgtaattcggggcagaattggtaaagagagtcgtgtaaaatatcgagttcgcacattttgttgtctgattattgatttttggcgaaaccatttgatcatatgacaagatgtgtatctaccttaacttaatgattttgataaaaatcattaggggattcatcagagcccaacatttcatttccccaaacaaaaataaatgaatgaataaattctaacagaatagcccaacatttctttcttatctaattttttttggtttagctagctcgaagccgaccaagatttataaattttatacagtaccagaattcacaataaaagaatggatctatcagcattaggaggcagtggcaaggcatccaatcgcacgattcatgaactgcaactgctactgcactaaaatgtggaggaagaagataacaatcatgaagaaacccctatcaaatccacgagagggtttggccctcacgaaacgtacagctaagctagaaatcgcatcaaaatcatacggctcgaacagaaacgacaaggattggggaatccatacccctccatataattgccaaaaaaaaaaactcagattaatcgactcacccgcattacccccgcttcggcctagcctccagccgctctcgtccccttcctcctccccctccactgcgcagaccgtggccgcagcgagctcgggcaaaggcggcggagtaatcgccggcggccgccgcggcggcggagaaccagacgaggtccgcgaccagagctgcgtctctcctcagccgtccgatcaaagccttcgctgtattttgcagaaagatccttatcaatatctctaccatttccaccaagtcctcaataagatcgatagttcgataccattgatcgcaatataaatttaggatcttctctactgttggatcagaatcggacggtttgtattaattgtacagtcgatataacacataaacatcggagtaaactttactttgagccttttttgtattaccgtagtgttattttggatctctttcatcaaaattttcactttggactcccttttgttgccattttgattcactttggaccccttttggcatcttcatctctagcatactcctcaccactacatcactgctatcttactggccgagtcttgagtttaaattctgattggtacgtaattaaataaaaactacagcccatttctattccacgttcgaggcttgaggggagcctcgcgtaatggagagtgttggaatataaagtgaattgcccacctctattccacgttagaggttagagagggcctctcgtgaggcggggagtgttggaatataaagtgaattgcccacccttctccatcagcttaaataggcttgagggggcctcatgcaaaggaggcgtgaaggagtgtgttgaaatataaagtgaattgttcgcatttattctaagctagatgtttgagggggtctcacgtgaggagggatgttggaatataaagtgaattgctcacatttctctatcagcttaatctttttggttgaattggtcgatgcatgcaactcgataatagccatgcaacattttccatataatatcttttattaaattattacaggagtagctatatttatggtatcatatttttcataaaaaatagtcaaatcgtttttacactataattatattcacttacacattacaatgtacttacatatttatatatttacattataattttcaaatcttgcatgtaaatcttaaaatttatactgtaatttttctcatctctaaatctaaaccataatcacaatgggccaaacgcatagtcgagtcacatctgcacgggcaaaacaagctagcactaatctcaagcagatcaaacaccatacaaatctgagtgcaatcgagaagaaaatgtgtcgacacaataataatattttagtacaagtttgcgaagagcctgagcacgccgtagcacgcggccatggcggcccacccgccgagaagcaccctggccgccgacctcgccgggctcgcgccgccgagcgccgcgccaagcgccccgaacccggcgagggcggccgaggtggcggcgcacacggcggcgacgcgcggggcccaggggcggacgaacccgccggccagcagcggcagcagcgcgcccaccgtgaacgccagcgccgacgccgccgccgccttgaacgggctcggaagccggccgctcccctcctcctcgccgtcgccgtcgcagcgtcggcggcgttgcctccctccctgcgccgggccgccgccacctcgatgtcgtactgcgcgtacacggacacgaactccccgatggccatgctgcacgcgccggcgacgaggcccggcgacgccggagaccagcatcgccctgcccgactcgctcaccgcgccgacgccgatcatcagcgacgccacggacaccagcccgtcgttggcgcccagaaccgccgcgcggagccactgcgcgcggccggagtagtccacgccgccgccgccaaacgcctcttcatccttcaccaccatcaccgcctcgtcgtcgccgacgccgacgacatggacggccgccacctcgccgtgttcttgcttaccttctggaggaggagacgtcgccggcgacggcgacggcgaggtggacacgtgcactaccgagttcatctgcatcgccatggcgagatcgatcgagcttggagctttggaagaagagggagagagagtgtgtgaagcacacgcctagaaatgggaagcaacgatgcccatttttatagccaaaaatggaaggataactgatgatcatctgataatgctttgtgacttgacaacttagtttatttgatggacaaattaaacatagctggaatatttaattaattagggatgtatatgtatgtaactgaatgtttggactctgaagaaaccttgttgcaactgattgagatgagatgtacacacatatacaactatttttttatgccaaagtgtccataaatcatgcatacatgtacatgtatctagctagaaaaaagcctttctttatgcactaatataagtttaattgtatatttatactccatatattatcttcagggatgttaacaaacggaagccctaaaatcctgcagagcatttggcagccaaactttttacccatttttcatgcaaaaaaaaaaaacgctcaacctagatataaagctcctgatgtagatatattgtttgtggaggttttggacacttgatgtgtttatcttggaagcaaattaagattgcttgctcttaaaaaaaaagttgctattttctttgttacatcatgcccaagtacattttatcaagtacaatcagttgatgatgatatattattagcttgctaatttggtcatttacagctgatcaaaacagtgatcacacatgttctcaaagctgtagctacatggccgcacgatccatgtaatctcaggagattcggaagtgaatcacagtggccacgcagcaccttagtcgtcatcatttccatttaagaaatcagctaaatagccatatgcagagggacaagccaataaatttagtttgtgtagaaaatttatttgctgattttgaccaaacattgtgcccggatcgatggggatcatggtgattaggtatttaagtgcacacatgcagttatctctcgattggctttttcaggagatcgagaagaatcacgccaacagttgcggaagattaattaactttagccttgcgatcttgtattgaaaattcttcatcaatctgtcccattctattttatttttaagagaggaacgaccaattaatatccgtctgataaatatatcctccatccattctaaaatataataatttttagcctttaaaatttgtcccaaattaaatacaacaaattctccatcaacattcccttatcaaccaataacaaccctccatcattcaattttatcacctaccttcacttttcaaccaatcacaatcctccatcatttagttctacctattttcttaatataatactgcgtccaactctaaaactccttatatttcggatggaggtagtagataacaaagaatataggtactcaaaatattatactatctccattactaaatattcccttcgtattttaatgtatgacgccattgactttttgaccaatgtttgaccattcgttttatttaaaatttttgtgcaaatataaaaatatttatatcatacttaaagaacatttgatgatgtatcaagtcaccataaaataaataataattacataaattttttgaataagacgaatggtcaaacgttgaataaaaggtcaacgggatacggaggtagtacttgttattctcactttgtaagtccttttccgtgtggcagcgtccattgttggaaacctaactcagctcttggtggctttgatggctgcggcggtggcaaagatgtggacgaacgactgccacggtcatgtgagcaaaatcaaactggtacaatgatcatcaaacggttgattttagaatttctgtttcaattcatgatttgagttagacaagagcaacttgtatgtcgttgaagaaacaatggttatacagtcgaagaaacatgcaacttgttatctctatcgtgatcttgttataagaacttttcatactttaaatgaaattgtgattttgtaatccaccgtctttatcaagcaatttatgtaataattggatgtatccttttaaagcaaataatgaatattctattaaaaaagatacatattttaactttgatcactaatttttttttaaaaaaaataataaatacttaaaaagataccgtagtatgttacgtccttaatgtaagcactaatctttcatttattgtaatctaaatatctaaaaatattagtcatcaaagttaaaacattgatattcaatagtgataagagtttcccttaccatttgagggggttatccccctggcggtaaggcggttacccaaaaaccacgtgaaattcatccttaaatatttgaattcagaaatcagcggtttcgcggttttggcgcggttaccgccaattgtgtagcagaacagaaacagtcctaaaaaattgaaaataacacttaaatgtgtgtagaaattaaggataatttgaagaatatataggatacttgcgaacctaacttttggtgtaaaataccaaaattcgagatgaccttttctatattatggacttgaagcaattcaacatttcgtagcataataattcaacaagctcacatttgaaagtatgtgtcagaggtagcgcgatagagagagataagaggacccgggagatattttctccacttatgggccttaatgggtcggatattttgtccacctagggctcattatattatttctctttttttattttctaatgtactttccgttttgccctcaaatttgaatttatctcactcctttccaaaaaaaaaaaattctacaccatctgccacttcaaatcaagaaatatataaatggattttttttcaaaattttgaatttggacaaaattcatcaaatcctaccaccggtaatgcctactgtaccatgcggtaagcgcggttactagcggtaggggaaacctgatagtgacatgtatttgagaatttaatggacggaatgattgatgtacgttaattttatgttgaattcctgattggtactttagttaattccagactagtatagtttaaagccatatatttgacacgcgataaatttcttttattaaagggaaaagtccattttataccctctaacttttgtgcttgtctaaaatacacccctgaattacaaaactggaaataatacaccctacaactattaaaaccagacactttaaccccttaatatgtttttatggtggttttggtatgcgtggatgtcagctgtataaatgctccacgtcatcagtggttatatgggccaaagccctttcggggtttgccgtgaagtgcagcggccagcagccgcgcgcgtggcttgccggagccggcggcggcgttagctggcagaggcggtggcacggaggaggatcagctacgtactgaattgttgggttgttcttggattaattctcgattttagcttcatgtctatgagcacgatttgatcaacccaagctgaccaggttcctcttgacaaagttggcaactttagtcaaaaaaaaaagttgccaaggtaaaacaacaaaccaatgtgctgccaccattgctgccatcacggtgatccggtcgggatttctagtagagatgccgccggtgctcctccttggcaacgagacaggccatgccaaccctctgcctcactgcatcaatggagctctggtcgacggcatggccggtggcggcggtgacatagaacacaccggagattatgtcgcccttgattgacagtcgcacgccggtggaacaagcagatcgagaaagatgactggctaaggaacaaccagaacgagatggaaatagcggctggtgagcctcccgctgcgtcgtctacctaacgcgaagcccacccccaagccgagcttgaagaagatggcgttggcgccgagcccgcccctttgcccaaggagaagaggtgatcggcaatgagctcaacagagaccgctcccttcgccaagctcaggagaatacaggcggcggcgtgcttgctctccttggctaagctcagggaagcataccagagctctaagcctccgacgagttctcccggagggagaggaaggaagaagatgggccagtcctcctcctccccctcgaccacggtgtagagcctcgcccccgccgaagagagagacatctggctttggcctataaccgctgacgtagatcatttatacacctagcatatacgtgtaccaaaaccaccataaaaacaactcaaggggttaaagtgtctggttttaatagttagaggggtattatatccgattttgtaattcgggagtgtattttagacaaacacaaaatttggagggtgtaaaatagacttttccctttattaaatttcgcgtaaattgagttgattcgatttcaaataatttttttctaaaaaaatgatctacgtggcattctaaaaataccccgtgtatatatatatatatatatatatatatatatatatatatatatatatatatatatatatatatatatatatataatacattataaaaataatagatatatatgtttacataatataaaaatggtatgaagataatgatttgagattgtttgtatattgagttctaaaaatacaataaaattgtaaaatgatatattatgcttgtatgatatttaaaatactgtagataataattactagtaggtgttgatgtgcacacttacacgttgagctttagaagttagtacacatcaactatctatatctatatagatagaatgaattgtgtaaattttaattaaaccttaggtatcatgactatcatatggctctttcatttaacgatggttcatttcgataccgatcagtatcgtctgtatgggcccatatatcaatggcccgaacagcatcagctaaccatacgcccgatgacacgagtcatttggatacaatatacataggccaggttagccaaaagtaagaataaggaaagagacatgtataattatagaggaaatttacttcttagagcaaataattagtagtatcccgcaaaaaaaaaaggcagaatcgaaaaaatgggggaaaaaaagaaaagcaagtaaaatcaattaaaagtcacgcccagtgggactcgaacccacaatcgcctgattagaagtcagacgccttatccattaggccatgggcgcttctctgcgtgaaagtttctcactcttttgttattaagttatgtaattctacaatgccattgctcccctctataccatgggagtttggtggtgtttgaatcttgtgaagataaatattaagtgtttcacgtaaattaatgaggtgataataacgtgtgattaattaagttttaattattacaaacttgaaaaatggattaatctgatattttaaaacaactttcatatagaaagtttcgcacaaaacgcaccgtttagcagtttgaaaagcgtgccactttaatccaaaatttcatccatccttttatttggattcgaacggggcctttgttcgatccgctcctaaattttgcctcatcccttatatacccctaagtttttattttgatctcctctgtgctattccattagttgaccatgagttaccgttaaaatatttttaaaattgactatattacctctctctatacttatgtgagtagtttagtgccaaaaacacaattcttatatgaaaaaagatctatttgtaaagaaaagggaatataattatttgacaacaaaatttaatataaatctaaaatttttaaataaatgttaaattaacttttacaaaattcatcaaaatttgaacccgataaataaataattttggttcatgatttctagcaaaactcttatatggattttgtcaaaaaataaatttgttcaacaatttaaattttctttttcaaattttacaataaataattatgccccatttgattttatcatgaattacaatttttcacattgtgaattatgaagtagatagcacgtaagtatgagaaatggatgatatggtaattttagaaaaatctaacagtcaacttacggtcaactaacggaataaggatagaggagattaaaatgaaaactcaagggcatgtagtggatgaggcaaaatttagaggtatagaaaagattgcgaaactttcaagtgtatgtagggaattttctcttgctcttaggtccttgaaaaatgaaaacgtgcttatagtttatctgttaattgccattgctctttgtatgatgggtaaagaacatacaaatttaagatgtgatgatataactcaaaagtatggcatatcaaaataaaataatcaatagtgtgattttataaaactttatggttataatatctagatttatgtgccacgtgtcaaaattccagtggttttgtacaacttaaaccgtaatatgtgtggttcggtgaaatttactctatagttagtttttgacacaatccatttacaaaataagttttacaaaagggccaaagtaacaaaatttcagcatattcatattcacaaccgcctatacatctgaaaagagggacgctccgtactatactagaaataatctaaaccgtttattttaaaaggtagactagtaatgtactaatgtaggagtactaatatagactaggggtaattttggcaccggatgttttgtccgtcaatgggctgtacggactctgggcctgtgcagactcgtgtggaccaactaatgacgtgggcccacgtgtgtatgtgattataaaagaacgtactccgtacgtccgatcagaaaagaacgtgttgaataaaaaaaaacgtgtcaggttatgctacgctacagcgtcaagaaaactggattaaagtttttaaacacaacaaatttcggtttcaattttagaccaaatttatcatgatttcatctggtctagatcgggttgacaacggaaaaaaggaaaaatatttacgtctgcaattcattcggttagtccagagcccattaacaacaaaaacacatggtttttcatagtgcacacatagattagagcagtactagtattttagggtaaaatatgctacgtccaaaattcattcgggactattcagaccaggtcgataacaaaagcacgtggttttttttgtcgtgaacacataaattagagaactactattttatgacaaaatatgtggggctcaagaaacacccaatggtcttccggtgagctccgcaagatagtgggctaggcctgacttcgaagcctcacccattctatttatttaatattataccctttcttaatatttgtgtttttaatatgtgaagctcagtcaaaatcgttttaaccgaatttcaaccggaactgtctaaatcataaaaaaaaaatctgttacagtttttgaaataattaacatttaaaatcgttttaaattttcgatggaatttattcgaatttcaaccggaattgtcctgaccgggtctaaatcataaacaactatgttcaagtttttgaaataattaacattcaaaattgttttaaattttagatggaatttatccaaatttcaaccgggactgtccggaccttaatcataaacaactcggtcaaagtttttgaaataattaacactcaaaatctttttactttttggacggaatttatccaaatttcagacaggactatccggactgggtctaaatcataaacaactcgattaaagttttcgaaataattaccattcaaaatcgttttaatttttagacagaatttatccgcatttcaaattggattgtccggactaggtcttaatcataaacaacttggttaaaattttcaaaataattaacattcaaaatcggtttaatttttagacagaatctattcaaattttaaacaggactgttcggactaggtctaaatcataaacatcacgattaaagtttttgaaataattaacattcagaatcattttaattcgagtaaatttcacattgcaccatgtattttgaccaaagtttcacaatgggtaaggtccacaccaaccttttcacttaacaccatatacgtttgcactagttggcactttgaattgggattgagcacatcaaaagaagttgtcagagaaaagatagttaaaatca

SEQ ID NO: 68129 - DNA, 13587 bp, Oryza sativa
atgattattcattcgcaaacgttaacctttggtttgtagaaaaaataaattacaaataactaaaagcatttcatgcataatattatcgaagcatactaacatatataagtatgaaattaattaactttcgctcattcagaaaagaagaaggtagtagtcaatgccaccagctaatagaaaatggaggaaacatgaattaaatcatgttcaagaaatcgatggcacccatagctagaaaacacacaagaaatgtaagatttaaaaacgccaatggaaaaaaaatgccatgacaaaagttaggcatgccattaagcaagtgtagtttggttcatcgcaactgtggttttaccacacttttgcctactacatgtaatgtgaaggatgaaacaaaacacgatattatatactgcaagataattacgtccaatttaagaataattttgaaacacaaaaaacaaattttaggtgtttctcctgaatggaacacgtgtacggcaggcaaatttgaagtcgtctatatccattgacacgtaacgtagtcaacttcaatataaattaactggtatatatacacactttaattaaagtataaattatcgtacccatacaaatcaggtttctgtatgtctttatgtagacgtgggcaatgacaataacaggaaatggatcattctacgcagcgagaaatataccatccatccatgcatggttacacgcatatattgtgttgttccatttaaaattaattagggcatgtttagatccatttggaatgacaaaagttttggtgacaaaagttttggcattgtaaaagtactagttggtgtttagatgcatgttaaagttttaccattctagcactaaagtgagagagaaagagagtgggagtggtcccaaagcactttttggcacaatttgctactatggactagcaaatgccaaattgccaacttttgctactagtgtttagatccaaaatggcaaaaaatactacaaaatggcaaaacttttgccattttggaggatctaaacagggccttggacgctgagtgtggtagctagacactatttcctccgtttcatattataagactttttagcattgtctatattcatatatatgttaatgaatctagacatatatgtgtgcctaaatttattaacatctatatgaatgtgtgtaatactaaaaaaaatcttatagcctgaaacggagatagtaattagtttgcacacatgatctttactggatggaaattgagaatctttgaccttaggatcaccaaccaaataaatgctatcttcactccgttgaattttttcaggctgtttaatttacacacacctcataaatttagtactcgatctattattccctctgtctctgagacgtattctgttttattataggagaagattcttaccaataattactctattataatatcacttatataatatataattataatcatacgtatttttaatatgaatgtaaatataattaatttataaaaaaattagtagagtaatcattgaccaaagtcttatcctaacaaaaataaaatactccacatattttcaaacggagggagcaatagatttacagaaaaaaaatagtatccagcatattcaatattgagtatatatttgccgcaatgcaactagaaaagtaattcaaacggccatcaaccaatcattgagatcagaaacaaacataactgtgaacgactagctgaattagttaggttcttggagtagaatttgtccacctagattcaagtattttaccgatttagtataactgttcacatttacagctagttattatttcaatattagataatatgtctgttgatatttaaatatctttggtaactttcaacaatctcaaaatcaccggtctaatctctcgaagctggagctgctcatactgagcagtgtgcgcatgtgtatatatgagattctacgcgcgcatgcccgctgggattgtgctttagagaaaaagaaacaatatgaccatcaaatttactataaatgattgtttatttaagcgtacattgataccgtgttttgaaaaaaaccaatataagtaggggtgtagtggctaccccgaaacttacttataggctaaaataagccgtgaacccgcttattttaatatataagtgggttcgcggctcacccacttacacccctataaccaccaatctatcttgtgacttctcatactagcggttgcaccttccagctcacatgatgtgcatgcgaatagaatgtgccatgagttggacattttcccatcatggatcaacttctgaggtttataacgtgtgcaatgacgacgacatggacgcagaaaacgcatattttctctgttttttcaaaggggaaaagaaaatcatggatgatgaagacttgcaatgttgcgtgcatgcgcgaatgcagagaggcactactatagttcattgttgtggctatctacatagtactccctccgtattttaatgtatgacgctgttgactttcgacctacgtttgaccattcgttttattcaattttttttagtaaatataaaaatacttatgtcatgcttaaagaatatttgatgatgaatcaagtcacattaaaataaataataattacataaattttttgaataaaacgaatgatcaaacgttggaaaaaagtcaacgacttcgtacattaaaatatggaggtagtagcaaagtccactcttttgttagctacaacacgtggccagcatcgacgtagatggtgaatcctcggcctaggatcacggaccaaatttaatggtgtatctggactttgagtgattccatttgcacctgtatatttatttgttttagaacgttgtgcagtgcggtcaaaacctaaaaatgctttggtatagcacagtaaaaaatatattattatttataaataaaagacaaaggtcaaatggattgaaaaatactccctccattccataatataaggcacaaccatttttcttagatgttttataatataaggcatgcatgcaagtatgcaattaaccatgacatcttctgcattaaattattatttttaaaatcatccacttccaattattatatttattatgatgatccaaactataagatgataataattattttttagtattttagttaaagtggttgtgccttatattttggaacggagagaggatcagataataaagtagaagtacacagtaaaagaagagacaaaggtgaaaggtggatcgagagcactcgaagcgcgcgagacaattaaacgggtcgaatttgtcaccatatagtacacgtctcttctcccatcataaatactccacacagtccactacttctcctcgtcgtctccctcgccgccggccgccggcgaacccaagatttcagttcagacgagcaccagccgccgccgccgtgatgatgaagaagacatccaaggagctggactacgtgctggtgccgatggggatggcggtgatggtggcgtaccacgcgtggctcctcctccgcatccggcggcgcccggcgaccaccgtgatcggcatcaacgccatcaaccgccgcatatgggtgcgccacgtcatggaggaggcgtccgggaagcacgccgtgctggcggtgcagaccatgcgcaacagcatcatggcctccaccgtcctcgcctccgtcgccatcaccctcagctccctcgtcgccgcgctcatggccagcggcgtcgcccacggcatcttctcccccggcgccggcgacggccagggcgagatcgtcgtcggcgccggcggcgagacggcgctgtcgatcaagttcttcgccatcctcgtctgcttcctcgtcgccttcctcctcaacgtccagtccatccgctactacagccacaccggcatcctcgtcaacgtgccgctccacgcgcaccgccaccgccgccgccgaccggggctcgccgtcgactacgtgacggcgacgctcaaccgcggcagctacttctggtccctcggcgtccgcgccttctacttctcgtgccccgtcttcctctggctcttcggccccatccccatgttcgcctcctgcctcgccatggtctgcgcgctctacttcctcgacgtgtacaccgagtgggacgagaagccggaggaggaagaggagctcaacggcaatggcgatggcgacgacggcggcgccgccgcgtgccatgaacaacccaagatggccgccggcaacagggtgacgcctcagcaagacgtcgtctgaaaactgaaactctgaaggtgtttgttgcctgtgcctgcatgcaggtgatctggattcagcagctcgttgaatcaagattaataattagtttatgtactttggtataaataaaatcgccgtgcctaggattcaatatctcgttgaatcctagatttgtcgcgacaaattcgcataaaaaatgctttgaattgatgttaagtatgaatgccctacttctttcatgatgataatacttattgctttggacaaagatataatcagactctaaaaactttgactataaataacattatagaaaactatatgtgtcttaaaaagtatttcaataaaatcatatatttattaatatttctatatatattgtaacaaaaaatagtggtcaattgtctttattgtgtttttcccaaaattataagtattatcgagtctgagggagtaatttggttctacaaatggtctcagatttttaattacttcttagtaccagttaggaccttcttcgatcatgtttctacgacacaagtcagtgacttcatgaatactgtttttatagctggtagtattatatcttgtgaaaagtcaattacgttatgtcgtatataagataataggagaatatacacatgcatgttgttattttctcagaaaacaaactgaaagggaactgcaaacctcagaccatcaagttcagacttcagaaagctctatagataagtacttcatccgtttctaaatatttaaccccgttaattttttaagtacatgtttgaccgttcgtcttattaaaaaacttttatgaaacatgcaaaactacatgtatacatataagtatatttaacaatgaatcaaatgataggaaaaaaattaataattacttaatttttttaataagatgtacagttaaacatattttaaaaagtcaacggcgtcaaatatttagaaacggagggagtatattcttaatgagacgacaaaatgactaaacacacctcactaccatgcagcaattatatagtagtactactcttaaagaaatgaagggagagaaaataataccttttgtttttctggatgatgtatcctccggcatctttttttatttttttgaaaactattctccagcctcctgaatctcgtatgacattaatgatacccttctcaccttctgtactctgcaaatgatgctgaatgctagcctgcagtaatgtgaattcttcagaaatttaatttacatctagattatcgagtcaattatatagacctgtttggcatagctgctctagctccagcttctagccaaacagtttcagcttcacctaaaatgagagcggagctgggtggactggtggagtgctatcacaaaatgaactagagaggtggagctgtaactccactccaaactcaactcttggagttaaattttagagttaattggagctctaccaaatagacgcatagttattgaattcaaaatgcgcaaaaattaggataaacctgttcagttccaggcttccagcgttgcgtgatgtacatcatttgtggacctctgcagctgccattgtgcaacatgacttgcaaagtgtattacactcacaagtttgtgtgtgagtaccgaactccatcgacaaaacacaaaacatgtcaataaattgccgtgtttccttatgaacaacacatgtacggtggggaaaaaaatttaaggtgatctacatcgattggcaagttaacatggtacaaaattactggagtgctaactgatacattataataccttaattttttaagttatataaataaattgaagtggcagaactaatttgtatacgtgggcaactaattactctattccgaaatatagcatgcatatacgtacctgaatccctttctacccatccttttagaatctttcggtagatgcagagtgtggtagacgctacccacatggcgtctaacagtcgatctgaaatagccaattaatcttttgaccaaggatcacgaaccaaacaagtgatgataccaaaagaacatctcatcagagatagagaattaaagcgagagcaaacttgcatcgctctggtttgttcacagggcgcggccgtttagagtgctccttttgcgaaaataatatcagcagagatcatcagtatgacatttaaaaacttcattcattcggcgttgtaataatttcaatcatctttagttatattagttagctaggatatctggatatgtattgaatatgatcagaaaagcaactcaagcactagcacgatacccaaacaaaccatcgattagatcttgcaagaaccacagcaccatcaattcatcatccaattcgagaaataagccagacggcatattcataaacgaaaaataatttatgaataaaactttgatatactccctccgtactcgtaaaggaagtcgttttggacagcggcacggtctccaaaacataactttgacttcttgtttctataaaaaatatttattgaaaagtgatatatatatatatatatatatatatatatatatatatatatatatatatatacttttatgaaagtatttttcaagacaaatctattcatataatttttatatttttaagctcatcaattcatgatttatatttctaaggtttgacttaaacattattctaaacgactttctttactaatacagagggagtacatgtttttaatgatctaaaattaaaagctgaaaaataaactataataaaaaaaactttaaaatcaacttcaaatttaagattgataattcaaattttagccgataagtataagcatatgaaaaaagatgacaccataatagagatgtacagtttattacagcacatcgatctcacaaccgctaacttggcatgtctctgtatgtgtactctatatattgtttttttagaactactctatatattggttagctagctagcgagtaccatatctcagctgccattgccacccacttaatttgcatgcctatggagtgacagataacattacaatctgcattgtggaactttccacttttcagaattttgcatgaccgttcaaatggcatatgtaagatgatgaatctacacgcatgcaattggattctcgaatacttaactactccatttgtctcattttaagtacacttgtgagtttccgtgtccaatatatccgttatatttgaaatttatttatgattaacatttttgttattattagataataaaacataaatagtacactttatgtgtgacttatttttttaattttctttatgtttttattaaataaaacgaacggtcaaacgttggatacgaaaatccagaactgcacttaaataaaattgtgacaaagggagtacttcccaacttaactcaaattggagaataacgtgtgtaatgacgacagcaacaacattcgcgtttataaatctaattaaacagcgggctagctagccagcacaaacccctgcgcatgtggccagcaccaacgtacaaggtactttgagttttcaaacgtgggaagcacttgatcgaaagaattaatttaattaagcacgatacatatgatggtcgatcgagttctgtcaccatgtatctagacatgttttacgaccacgtacacgcttagccagggttcacactttagaatcacaccgaaatttcggtagtttcggtgtgaccgaaatttcatgatttccaaactcttttgcacgaaattatttgaaatattaacagattgtaactctggatttgaatatattttaaccaaatttaacaaaaaaattgaaaaaaaaaaccccaaatattgacagagttgctcgctggtgggcagggttagaaattccggaatggaatttccggaatttcagtcatttcggactccttatacgatattattttagccaaaatttttatcttttttactttttcgtgaagttggtaatattttgtttaaatttgaccaatatttatttaaaaaccgaaaaattaaaccctgccagtgagtcccaaattaccgaaaattcaatctggcgatcagctccccctgcatataaatactacccagtccaacgttgtccggccactaccgttgtgcatgcttgtgtcgtcaacgacggcgactagcagtagcagtagagagtggcagtgagatcagaagagatcgatccatgaagcagctggactacgtgctggtgccgatggggatggcggtgatggtggcgtaccacgcgtggctcctcctccgcatccggcggcgcccggcgaccaccgtgatcggcatcaacgccatcaaccgccgcatctgggtgcgccacgtcatggaggagccgtcggggaagcacgccgtgctggcggtgcagaccatgcgcaacagcatcatggcctccaccgtactcgcctccgtcgccatcaccctcagctccctcgtcgccgcgctcatggccagcggcgtcgcccacggcatcttcgtctcctccggccacgccgtcgtcggcggcggcgtcgccggagaggccgagctgtccgtcaagttcttcgccatcctcgtctgcttcctcctcgccttcctcctcaacgtgcagtccatccggtactacagccacaccggcctcctcgtcaacgtgccgctccacgcgcaccgccaccgccgccgccgcccggggctcgccgtcgactacgtgacggcgacgctcaaccgcggcagctacttctggtccctcggcgtccgcgccttctacttctcgtgccccgtcttcctctggctctttggacccatccccatgttcgctgcctgcctcgccatggtctgcgcgctctacttcctcgacgtctacaccgagtgggacaaggccgacgacgaggaagacgacctcgacgacgacgatgacggctgcgtccccgccaaatgctaaataaaggacggccgtcttggcgccggtagggcgacgactcagtagacggatcgagatcttctatcttaggtcagatgactttaatgtcactgacatgtgggtccataacaaagagtacctatatgttagtggctcaaagttaaagttatataacttaagtcgaaggatcttaatcctcagcagacaacatagcggtatgtgagaacaactttagtgtacagttgaactagacttgctaaaggttaacccgcatacccacagtatgcttagtgcctagtaaaaagtcatgcctcttaaaataaactaaggcactaatgcatgatttgtgctctgtttttgtgtgctgtatgcttgtgaatggtgttgctagttctttgaaaatatatattggaatagcatattaacagcacataaaacgggatggttcattaatacatgattaattaagtattaattattataaatttaaatttttatttattttttcttaaaaaaaacttatatatagaattttttttacataaaaatataccgtttagctatttggaaagcgtgctaacaaaaaaaaatgagaaaattgtaatttggaggtgaagtttaggatagtatatatgtttcccctataatcacatcctagaagtgatctcagatttttagtacattggaccttattcgatcttgttcctgttaacgaccaaatttggtaatatcatcatcggaaaagaggattagatcgaagtggagtcgaaggcggagatcgattcgagaacagagcaagaatcggctggagtccggatcggctacgatcaggatcggctgggtccaagtcagactgggtgagccgatatagccgattctgacaatatgacttggtatacaacatcgggttgagttgatatgcttcaagatgattgccgcacatggatagagtcctgagaaggcaattgtatctattaattaggatattttatataatctccttagagatatgtttcgggcaaaagtctgccgtaaagacttatggtatcttagagtttgttagggataagagtcgtatccgacatggacatagtttgtaattttcgggtataaatagaccccgaaccccatgtaatcaatgaacacacacgttcaatacaatttcggcgcatcgccacccttttgcttttattttatttcgacgagttcttactttcgggttgagctgcatcggtttcgatcttcaacaagaggtaaaacttgttatgatggcttgcgttctcgggattagtacttccatctttatgatactctaatcttgtttatgtaattcgtcgagttatcatatatcttacataatctctggcaatatcgttatctaacctacaatcggctaacatctgttggtatagagtagccgattaggttatatgtcaacgttgacttagattatataagatatctaccactctatgaaaccttcagcggcttgattgtctacatattgttcttttcatacttaatgctgcatcaattgagtttgatctattaagtcgtgcttagaataccaatctctagcctgctttctggttgccgattagagtagtatcgaagtttcaaccgatcttatctgattcaactatatttgttttatatgctttattgacacgttagatctgccctttatgtcaagatattgttgcatctaagtatattaagcttctgtttagtatattctgcttgttttaacatcttaacatagagtcgtatcggagtattagccgatacatgctagatctatctgatcggctatgctatgaacatatataatcctgttattaatatatatttcgatctaagtgatttatactgtctcggcatggcgaccgatctattccagtcacttgatttaagtatatatcgatataagaattatatattgttaatatctacagccgatcgaatagatttatttctttattatctatttgcaactgccgatcgatttacatatgacatcggctcagagataaatgatacgtcatcggcacttagccgatcggctatcgtttataggtttaaccgcggtttgtttgtctttatttcttgttgattgcaggatcaaatcaactggcacgctagcatacccgaaggcgagttttggacctgcactggagttaagcagatctcctaggcctcgtgttttacgtcaatagttccctactatatatgtgacaactgataaagtcagtgccgtcatgtgctattgctttagctagtagcctggtattatattttaaatttttatagacactagaaaaaatacccgtgcgttacaatgggtgaaggctattttaattttattgttgttatatacggtccaattaaggtattttattgctgttatacaatctagttaagataaaattcactgtgggaattcacttgaatatatatattttagaaaatcatgagctgtaattaaaagttcgatcgtcttaagttagcacgcgagtttttctaaagagaattcttatacgaatctttctatatttccaaaaaaacgaatgaacttaaaaaccgactcatgcacagatgacttactaaataccgacaaaaacatcttcaatttttataatagtagagatagagatttgcatgcttgcataattataagtcaattacgttaataaactaaaaatggaaattcaaacctcaaacaatcagctctgaacatttatctccccccataattcattcatcaaatcccacggtccagaatcatcgaatccaacgggtcgagatcgtcgcggaccctctcccctccgcacgagctcctcacgcgcgtcccccaaatccccaatcacgccgccaatgagaaccccgtcactgtcctcctcttcatcctcgccgcggcccaccgcctccgccggttcctcctcctcctccgccgccgccgccgccgccgcgcagtctcgccaccacttcgcgcagggcgcccagctcctcgcccgtgcgcgcgccgccgcagggaccaagaagcggagccccccgcgcggcgctcgccgaggccgaccgcgccatcacccgtcgacgccgccacctcacccgacccgtgctccctccccgtccccaatcccgacgaatcctccatcgcgccgccgccggcttccaccacgccccccgaccatcccccctctccccaatcccggcagctcctcccatcttgcgagtcaccgatcgcccaatgcgggtttgtcgttgcagtgatcgaaccgtcgcaccgccgccggcttccactgcgccccccagccatctctcctcctccccaatcccggcggtctccgtcacgccgccatcaagtcgtcatcgattactcgccctccgatacccatcgcgcctcctcgcccccactccgctagccaggtaagcatcgctcaatccccttcccgttccttcaataattgcaagaattcgtttactcctttgattgtgacttcttggatggtcaaccaatgattgctacttccctatgcacgtattgtattgtgcccggtaggtgttcgcttaaatgccaatgaggagagttatgttaaatgccgttgagggatggatatggatccagtgcccattaggtgttcggttaaattctgttgagggatggatggatcggttttaccattaatgttgaagcaaataagtgcataggtgaattagattcttttgctgtatataaggatattttgtgtcacttgctttggttagttgattcaataactaggtttggttagttgattcaataactaggtaagaataatcggtaggtaacttgtctaagcaaccaattgtcaaatttctcatgaagtggtccttttttttcagaatcattccggtgcagccagcgaccccaacagctcctctcgccaccaccaccaccgtcttctccctttgtccaggtatccattttgtctctcttgtcctccgttggatgtctccctgagggatcgatgcactcatatgtgatgctcctgacagatatttatataaatcgctgctgtcttctcaaattataatttaccgtttttaataatttgtactggcatatcaaattaactgctgtttttaataatttgtactgatatatcaaaatcagtgttgtttttaataatttatacgcttcatggctcataataaatcgctggtgcattgatatctaaatgtttgctcatgtgctatttacagctcaggtgaccggagagaaagagagagcgcaatgtgtctttctgggccaagcgcttccagaattcctcttccctaggcccgcacacgacacgccgggccaccgtttggcctctcgccgccggtgactggagctgagaacgagccccccccccc

SEQ ID NO: 68130 - DNA, 5501 bp, Oryza sativa
tttctcataactaatggatggctttcttttgataaccttgaatacttcttttcctgcagcttttgcttgattaaaggtctgaaggtctggtgcagcataagtaattgatctgaatccatgtggtggaaatcatgtgagtatcttttcatgaaattttcaagaaataaataatgcattggaccttcagaattacattatcacacacgtgtattatactcattttagtcggaaagtatttcagtgatatcttgaactaagagtctcacctgaaactttgctttcttttcaaattgactgcttttaacatcggaaagttaatttttgaatagaaattttggtgtaagagaatcagtcaggatgttactgtatcattacattgctccgaagaggatgctcatgatggcagctatcgtgccacctcctgttgcctttcggctggttactgcgactgccccaatccaaaccatcagtgcccatgaacagaaggtcacagcttggaacaatcccagtcctatcccttttatcactgcctccttcttacttagtttgtactgattatccatgcaccggacaaaggatctcatggcccgtttctccccaacaaaggagaaaacagtcttaatatgcgacaaagtctgctcagaaaaaggtgtagtaggattaagaatttaaatcttgtaggcaatcgtttatacttccaattaacttggcttgagctgatgtaaatgatttacctgttctacaatagatgttgcttctgagactatagcattacgagataacgatatgccattcatctgtttcgtgtatgttgctccaatgacgaggatcagaggaatgaccagaaaggagagcaatgcgacttcccagcagctggcaaatgcaattatgataccagcaaagaaagtggagaagctcgcaacgaaatgaccgagctgcagaaaattggggtcaggtgcagtagtggtgcacattggaccacagtttcacaaatattatgtgcaatgttccataaatcacgaaatccattaccttctcaccaattgcatcttgtatgacactcatgtggttggttactccggtgatgatttttgcagtggtcaagtcagtgtcgaaggccccaacctcttgattaagtactgatctcagaaatgctagccgcatgcgtgctaattgtctttcacttgagtatatccagcatgagatctctgcatgcagatgataagaggataaggtaagcatgtttttgtaagatctcctataattatcatttctgaacatatatgactacttataaaaaaatagggtaaaattaggctccaaccgtaaaaaaaacatattctctaacaataccattcatctctgacatgctattatgtttcactagtttataagtgccttttatgccattgcagatgaaacaaaaatacgagtttggcactaaatccctaatagctggacaagcgtgcttgtgaggctgtaaaaacatttatgagttttatgccctaattttatacttaatgaggtaattcatgagcaatattgcagttcaacataatttacggccctgttttctattcctatgtctatgcttattctgtttaaataactaaatttagaattctatgccagggtatttatttaaccaaatgaaaagccacatctatcatggaagataaaaggacagattgtttctgacttaccgaccattccagcaggaagagtagctgctgccatgtaccacacaaacggaaccaccttcaagcaagaagtgaaaaaaggtgtaaaaataaaaaacgatcacagatcaacatattgatattcaaaggactaaaatgagagaaaaggctaatgatgtacatggatatcatgcttttagaattgagaaaaccaccttatacaatgcatggaccatgccctcctgatcatttatgttggttccataagcatcaagtgctttcccaagaaggagatatccgacggggaatgccatgccatgaattatagatccaacagttcccagggccatgaggagccagtctaccgcatcggcgtagcaaagcagcccgaggaatggaaatggcttctcgtcggtgctggattctgacggaactgggattgtgctattactttcatccatttcataaattgagatgatgaaatagagtggtcttcatcatggactgtagacatcttttttcagtgatgatcttggtgaccccttttgcagtagagtggcactgaaaggagattcatagatggcattagtattagaggtatgcacatttcatactggtgcatgtttacgtgtagatactgacaaacatgtcttccaaaatggagtgagacaaacacaataggtactctcaaggttggaaacaaaatatttctgaactggtaaagggatcagcatattatgtcaaattgtcaatattagtggtggtgtttgcctaagctttgacactgttagttgtctttgacaaacttagctgtttgattaaacaaaacatgtgaaagctgcctagctgcttgactgaatcagtgaagctaagagaaaactgagaaatgataggagagtctgcacacttcacattatattttacattttttttgtgtggaccatcaagaaactggattatcacatgatgccacttgatttgttccttttatcttgatctaaaaaattcatctggaagccaaatcaatgtctggggatctcactttaatgatccttaaccttgaccaatcaaatgcatttctcacctccttggatgatgacttgttaattaagataaaaaagatttgatctgcagattatgttaagctgtgcttacatgaccaaggtgggtttctgggaataactgtggcataatctgagcatattctgttttagactgcaatactgcatatcatacacaaggctgtcgatgtcgtcatgtcgcatgccattgcaaccaacccggaatgcttgtttgcacctgaggaagtttgtttatgtatgttgtccaggagggagtatccaaggggaaatagtgtatcatttctgatcattgccagcatactgaacattttgcctgttagtcatacaacctgatgaaaaataacagctgcatcgatcacattgtgcatgttgccgtttgcaattgggaggcacacgggtagctggttggttctccaggtggtttttgacaatcttcgttgatgctgcaaaggtagtctccaaaagaagagccaatttggtttattcccagaattttgtgcaaaaagctcctatatttgcagtttggaagaaatttggattattatccaggctcgggaggccagtcaactggaagctacaaagaaaacgttttcttgattgaagcaccagcgtatgcatatgctacttcagttttcgtctttctgctgttgtgctcattagcaacattcatgctgttagagaaatgcaagttatgaccgcatcatccatgtcattttcactgatgggatcaggagggaatatccggaatttcagatgtcttgtgggacacagggatgactggttcaaactactgtttaaaaattttgagttcagtcttacattttggaagtttttgaggattatattgtctgccagagtactctcctcatagtgcatgtttgtcctgactttgtatccatgcagatgagagtagttgtacctatttcttgaataagtttaccgacacatcatttcttaacattttgctggttgctcctacaaaatccggttccaataagagctcagatctgtgtttgttctctgaattttgcgcaaaaagttgccgaatttgcattgcctggctttttttaggctcagtaggctggccagtcaattggaatcttcaaatgacaaagaagaagaagaaatttctccttaatttgccacatggttggaaggccaaacaaaatgatgcatcatgtctgaacattttcaagaagggagcctatttgttttcttatcagaaattttcatgaaaagctccgaaatttgcagccatctccggatgcttgtttgcacctgaagaagtttgctgatgctacttgtccaagagggagagcatacaagggaaaatgctgcattacttctgatcattgccagagaatcattcgatagtcttaagtcttaaccctgtctcatgcaaactgaacatgttgcttggtgctcgtaaaaaactgacagaaactaacgttgcatctgatcgcattgtgcaggtttccatctgcaattgggaggcacactgacacctggtcggttctccaggcgattttcgacaatctttgtcgacgctgcgaaaatggtctccaagaaaagggccaatttggtttcttctcagaattttgcgcaaaaacctcccagatttgaagctacaaaaaacatttcttgaccgagagggattttgttccatccttcgctctactaatcagatcattctcagacgtccaaagcaggatatgctacttcagttttgtttttttgttgttgttctcattaggcacgagtatgaagatacataaatgtaagttctgatcgcaccatccatgtcattttcactgatgggatcaggagagaatatccggattttcggatgatgtcttgtgggaatgcaaggatgactcgttcaaattcctttttttttaaaaaaaaaatgaatcttatgtaacatctccattgttcactcttgcattttgcacggttgacttgcctgattgaactttttggagatgacagaatgctatgtttgaaccgacatatttgttgtgaatttgtatctgtgccatcatacatgggatgaatggcgctccctttgtctcaaaatatatctacctttccagttctatattttaagacagaggtagtataaaatttgcttgttttataatgacatatcggtacgattacctatttgaatactaaggctgtgttcggtattggaggatgggaacatatccttcctgcatggaaaacggagcggttcattagcacgtgattaattaagtaatagctatttttctcaaaaatggatcaatatgattttttaagcaactttcgtatagaaactttttgcaaaaaacacaccgtttagcagtttgaaaaacgtgcgcgtggaaaacgagatggtagagttgggaactcccggttccgaacacaacctaaggtagctatgcactgggaaattaaaaaaaaaaagaagagcaaaactacgactcataaaagaatttgtgctgatgtcaactgttctgattgaatcatctgcttgcgtaggaataatcaaattcagctcatctaaccaaatatcttttttagataatggattaaaacccgacttctacactaataaggatgcacacaggcaaatctaaccaaataaacacactaaggaaacataatttagatacacctttatatattattgtacatgtacaagggtagagtgtctaactttcttagaacagaaatggagtattccttgtaatccaag

SEQ ID NO: 68131 - DNA, 6834 bp, Oryza sativa
tttagggaaactaataatgtatatttgatatatctatatattataggcggtgcaataatataagtaaagaaataacttttgagctccacatgtactattatactaaataattttgatatatctatatattaggcggtgcaataatataagtaaagaaataacttttgagctccacatgtactattatactaaataattttgatatatctatatattaggcggtgcaataatataagtaaagaaataacttatgttttcttattcaacataatatcagtaaagatataggactaaattttacaaaataattttggctacatatgaatccaggacctttctctttttttttctttggaggtgacgttagctaaactaacacctatctcgaacaggctagatctaagcgtatgcatgcattgaattgaggtatatgaagtgcatgtgcgttgactgtatatctaggtgctttgtactagtgaggattattatttattaattactactagcaattaaattaaataatactcgctgcattgtttgacttttgcatcatatccaccgtacacactgctgtacttggtcgtccatgcaccgatgcacggcacgattaccctgcaggaagaatacaaatacgactaatcctctacttgtttagaaggcttaattaaaatggcactggtcaatcatgatcaaatgcgtgtcaatgcatggttatcaaagtcaatttgttatttatcaaagtcaatctggtagccaagagaagggttaattaaatttgtccaaagtactcgtcatttacttgtataaattgtccaaagtactcttcatttacttaagaaaaaaaactcaatttgttaatctggtagccaagagaagggttaattattttcctgagatactagcttaaacacccatgttttacaaggaataggttgaatatatgtttttttccctttcttaagcttggaaatgaacaatccgcatgaattaatcactcttaattaagtgaaatccatatattaggtggtataataggagtagatggcagcaaatttatcactcaccagcatcacttaaggtttttttttaaaaaaaagaagagtatagatatgtgttgtcttctgagagatcgcatctgatactatacttttttttatcaggagaatatatgttttgtacgtgtggtgtatgcaacatgatttgtacaagtaaatgacgagtactttggacaatttaattatattccattttggccaaactaaaatctcttgtccaggatctagctaaggttgatagagcatctatattattactgtgatccaaagatattgccttatcaatcagtgtactaggaccctttcaatcaattgaagtgacgaccaaaatttgcgtgttcacatatctcatgccccttcgtattttaacagataacattatcttttaaacatattttagcaattcatcttatttaaaaaatttatacaaatatataagatataaaatcatgcttaaagtactttaagtgataaaacaattcataacaaaataaattataattatgtaaattttttgaataagataaatggttaaacgtgtgacaaaaagtcaacgacattatctattagaaactagagttagtattctatatatatattttcttttcttgtggtttaatctaaagtagagaattgatctcccgttttaattatatgatactgttgatatttgacataattttgatcatttgttctattaaaaatattcaatacattagtaaatatatatataagcttgtgcttaaaatacctttaaataataatataaatcacaacagataaattaatgcaaatgtaaataagtcgaatggttggtcggatgtagtatgtcgtaaacagcatatgggtgcatgctttttgaaaattaagaaaatcttttgcaatgcaacatattcctgttgggaatattattgctgaactgcaattctgattatgtctccttctaggaattaaggcatagcatcttcctagttccgaccatcacgtcacaatgagccaggtacgtacatgtttcgtttggaacagcgctgctaaagaggaacagttaatatcaaacattatttaataaaactaacaaaatattttaagtaatctaaataataacgataggataaatcatatcctattttaataattgtactcctattttaataatctagggctatagatttacaactaatatgtatttttttagcgtataaattttagggcgcaacacgggtgtgtgagctcagtgtggttgtgtacatgtgggtgcaacgaccagggataacatgaccatattatcctgtccgagtgtccggtcggggtgaacatagcaaccctggcctgttggctacgttcttccccttctttttcaacttatctctcgttattctcgtatgtacattttccaaactattctacggtgtgtattttaaaaaaaagttctatagaaaagttgctttaaaaatcatatgaatcaatttttcaacttttaaactaatacttaattaattatatgctaagaagtgtagttatatgtggcggagaggagggttccctaaccaacccctccttccaaacacagcttaacaacgccctgcgttcgagagtctaggttgggaactctcttgtctcgattttcacgcgcacgcttttcaaactgctatttcggtgtgtttttgtaaaaagtttctatactaaagttgtttaaaaaaatcatattgttccatttttgaaaaaaatagctaatacttaattaatcacacgctaatggatcgctccgttttccatgctggaggcaagctttccgaacccggacactggcaagcagcctaagagcttaacgaggtaaagtgctcccatgggactctgctgatgaccggtttgaccgtgtcaactaagagagactagtaatatgcccgtactaacgctacggttatattttgtaatgaaaatcaagatatactaaggtaatatgaaaaagaattattatattgttgctaattagataccaatgagaaaactcaaattgcaacttttttttgaatgtttgaaaacaatctaattccttatgcgcttaggaatacaaactaaacttattgcgtagaagtaatacaaaccaaacttcatattacaagcaaaagcatttttattattttataaactatattaatcacaggagacaaatcatacctacataccgaaagagccaaatcagtccatggtgaattaaaggcttgttcactttgatgctcaaattaaccataccaaatttgataatgctaaatttttttgcgcattttggtattaccaaattttacgtagtgttttaagagagaaagcttctagaaataccaaaatttggtaagtagcaatgtttgaagccctcagtatgtctagtttgttgttagtatttgcaacaaatcatcttacatgaggaatgtactcattataacattttagaggttttgtagtttattttttttatttaaggagacctcattcagctgtgcgaaagcaaattttttaacatgggcttgttgggcttttgacatgggctgggaaagaaaaaaaaaagaagagacagcccattaattctcacatacttattgggccttttgcgtgcgtggttgcctcactgacatgtggggcctcgtcgacgccaagctaatccgcgtctccaccgcgatgcaccgcttcgcctccgcctcctccctcccgccgccggcgccggcgacggcggcggccgcggcggcgcaggctgcggctctcaggttcggctccgccgccaccactcgtgtcccccgagcgctagccctgaccgcctccacttgcccatggcaccgccgacacctctgctcctcctcctcctcctcctcgtcggcggcggctgcggctgctacggcggcggcggtggaggaggcgcggcaggggcggaagcagctgggcgcgacgacgcagctctacgagtacctcctcgccaacgtccgcgagcacccggtgcgtgtctccctccctccgctctctgcttggttcgtctcgagcaaattttgccgccattttggggtgcggaattcgcgtcatgctctcttgccaatgtgtgcttccgttttatcccgtgctggaaaaatgcatcaggttctcaaggagcttcgtgaggagacggcggccatgagagggagccaaatgcaggtgcgtgccatggataaacttggctactcttcttagagagctcatttaccattttcccctataaaattagtcctaatctttttcaaggtaacattggtccaatgaagccacttcatacatgattacttttatttctgaaagtgcaatgatactgtttagagatgtttcggaaatcagttacaatatatacactctcagctggtttctttgtcttgttaggtttcacctgcgcaggctcagcttctagcaatgcttgcgcaaattcttggggctcaacgatgcattgaagtcggagtctatacagtatgtgatctgacctagtgtttgttactttgttttgtattataaattattcatatttccactctaggtaagtaaaaacgcaacattagaaagttattgtttcttgtcagaaccaaagcatgatggttgatcaaaatgagaaataaactccagctggttaacaatatatttgtgagaactcgtgtatctgttgttttccctggaaactataccataataagcaagcactacaacgtttgaatcctatatgcaacaagccttctggtagtactgaggcttgattcttgcatatgttttcctttcatcatcaagcagtctttcctgtctggtacaataataaattaataatccacacggtacatgttatctcaagtgctacaaattgcaatcaaaaccttgtgaattagctacttttgtagaaagccactgatttctgcaaattcaataacttcattatagcattcgtttaatctttgcacagggatattcgtcgttagctgtagcactagctcttcctgaatcaggtcgtttggttgcttgtgagagggatgaaagatgcctagaagttgccaagaaatactatcagcgctctggtgttgcacacaaggtgatcgcctctttttgcttgatgggttctggatcatgatgaatttcttgggctgatctatcacctaattccttaggttgatgtcaaacatgctttagctgcggattccctaaagttactaattgatggtggtgaggttaacaggtacagtaattttattgtggtataatccatcattgaacatcttagttggtctaacaaatcttgtctcttctaccttttctagttatgactttgcattcgttgatgcagacaagagaatgtatgaggagtattatgaacttctacttaagctagtaagattacatagaaccctttcttgcttatagcaattgtggtctgtcaactgtcatcaatgatcataacttttttataacattatagaagatttgctgcaagttttatgatcctatttataagttccatgtatgtagcaaccataacttacatgttttgattataatctgtatgttgagcattatgttttgttgtgttgcaggtaagagttggtggtttgattgtaatagacaatgtcctttggtatggtagagttgctgatccactagtgagtcttttttcccttttttagttttgacatgacatagaagctatatggtagaaagtggatcactctttcctgattttttaggaaattatctggcacatttttccttaggtgaatgatcgaaagacaattagtataaggaacttcaacaagaaacttctggaggataatcgtgtcagcatcagcatggtctctttctctcaccacctctcatatttttttatctatcgcctagatttgtcattacttgcaagtgtttactgcaaagacttagaaaattatttatatgcctgcacaagtatattgaccgttaaagcttgtgaagagaactcagtcctggcactgatgtgtagcagtaccgcagtgaagcgcaatacatatcccaagtctggaagttttatttgcctaatgttgtggcatatttgagccaggatcacatataccatgaatgtgtttagtcctatttgctatctttttaattatcaatttgctccaaaatctatataactccttttatccgaactttcttttgagcaccatgttcagttttttgtacaacttcagtgagaagaaaacagtatgatgcaagtgacaaccataatatttgttacttgattttcatgtgatatacttataccatggttccatggagacagtaccccatgccttctaattttatcacttctctgactctatttttttagttgacaatggtactatgttttcttgggagacttgcaggtgccaatcggggacgggatgacaatttgtcggaagctagtagatacctgactgaacaacatactctttctagatatggattttgggcgtgtgcctttttggcttctcgcgacattatcttcaaagggtatctatagaaggatgcaggtaatgatgttcgtggccttttgtgattctgttaagtttgggatatggaggttctgtctcggaatgagggggcaacaatactagtggcttcattcaggcggtacttgttactaattctttaagtccggggttaaatccctaagtctgaccttaattggttgtacttggcaatggatttctttctttcttgaaggcattgtctggagttcacagaatttccctaggtgaaaacctatggt

SEQ ID NO: 68132 - DNA, 13993 bp, Oryza sativa
ttaactgcatatatcggtaaatatcagtgctgttgaaaaagtttctgcaagcaaataatatatttgcaaacacatatagatgtacaaatcgtggctcaaggttagcctatttgggtcaatattatttctgcttgttgctgcacctggtgtcataatgtaacagggggttgagctcagaaacagacacaggtttaatcctaagatgcccacaacagcttattaacttgcgcatgtttctctactgaatacatgaaccgcaatggaaatcaggatatacacccatcagctaatagcctcgcccataaaaaggcgatggaggcatttcactttcaattagattaggtaaaaatgtagtaaacaacagtatacctagtgcaagaacaaccaagactaacccatgcaagctgagagttggaacctaaaatgatcatacatttatgaacgaactgtcatcaccaataatattttccctacgagcatcacaatatgcaacctggtgaacagagaggggtgtagtaactaagaaggttggcatgctcctatacaattttgttcatacaaaacatgttcgcctctcttcctttcactttgatgtagatagtggagagcacaatgcttcacaaaagatggggctcacgttccataattttggctcacatagcacttgtgctagaaccacaaaaaagagtaattaacaagggatctccatgtaccatgcactataaataagaagttaaagatgttcacagggcagtgaagataaatgtccagctaacgaagcactctacgcatcacaaaattcagttcagttgtaaagaaagaaaaaaatccacatggaatcaggggcggatccaacttgggacatgggggttcagtcaaacttttgggtgaacaaacaaaaaaacaaacaaactgttactagctagttgtattaagagaggtttaaggctctcaaattaacaaggaggaggagaagagcttcttccagatctagaagagaagctagtagggttaacgaacgcaagcgaattcaaggtcccagtggggtgggggagagagatgaatcagaaagaggctcaccaggatcccctcccctactctcctcgccagatggagatcggcagccgcgactcgtcttggcggcggcgcaaggagcggaggaggagccaacgagacgggagatttctctcttttacgcgatatactcgactactgcccaaatgggccgcccggcccggcagcgcccaggcacgaccggacctaggcccagtcaaggccccttctctttggacagtgccttataaggctgcactaagtctattttgggtccccaactatttttctttgacttatataaggctgaattgagtctatttaggctggattttccggattgaaactacaaagcggtatttttgtttgaagctatgggatcaaagtccagtgtcctcgatgcaaactttgtctgatgaattgacaacaattaatcagataatacagttgcatatgaaaattactagttatgtatgtgcgcagataaagagatacaaaaccacacatcaagtgtttattctatccatatactgtcaggtttatattggctgtgtgtgacggggcaaatatcgatcggttgtgtgtggcggggcgactgatgactagagaggtggagatattagggatggggggagagaaaagggggaaggggtgaggtgacctttggaggggtagaacagttggtgtgctagcgacgacgacggagctcgcaataggtgtagggggccgagacggtgtagaggcgataattgaccgccacgccgtgcgtggctggcgttgattagggtccgggggcaatggagtcggggaggattgaaggcggcgcgcggcggcagaggagagatgagggcaacgataaaaactatggcgagctggcgcccttgacagctcttgcggggcagaggacgtacagtgcagcggctaatagggaggggagcgctgataagcatggcggagcggtttctggcgttagcacgtgcaggagcagaattggggagaggcgcaggggtgagtggggatgtggtgcacgattgagagaggtgggattgatctcgattgttgggagctgttgagtgatgaatgaaagaacgagtgatgagtgaaaccacttgctacactatatggggaatagatagaggtagagaaatgggagaggtttatcctctctttctcaaaaaaaaaaagaaaagaaaagaaaggacccaaccgtgatcaaccactgcctcgattcccttggtcctccgagaatctcgccggcgatggctgggagttggttactgcgccgcgttctcccaccccagctggttatttatagtgcggcggcactcctccattctcctccattccctaatttgtataatggttctctttgcaaaaaatgtgctggtgaccaaactaataggagaatggttagggagtctaagattcaggaggtctcttgtggataggaaacatttggaatgggttaaacttaatcaactttgtcagtcaattgaactgactggggaggaggataaagtggtttggaaactgactaaaaatggcattttcactgttaaatatttctataaagcaatgatgattcaaaacactggctttcaattcaagaatatttgaaatttaaaatttctcctagagagaaggttttcctgtggctgatgttgaaaaattgcattttaaccaaagataacttgctgaaaaggggatgaaaagggaaggaggcaaaaaaatgaaactgtggagcatctttttaaaatgcccaatttcaagactcatttaaaacatagtgagttgtgtgtttgatttgaaaccaatccataatatacatcacttgtttgggaggtggctttaggattttcaaaaaaaaaaaaaagataaaaactttgtggtggtgggaattgcaggcagctattgtttggactatatggaagttcagaaatgctgcatgtttcaaaaaataaaagaacacaagatcctttagagctgatatatgctgtttgctcctggatcaatctttggtccattttgcagaaatcgggggacacacaagacaggcttcaacgggacgcggctttgttaaagacggtggtcactgacttctacaacacaagatttggatagaatccatatgtgatgcggatacaggggataggatgaagatttatgccttctagtggctgcagtttctgttttttttttctctgctgaatcttgttcccttttgctgtaagactgttaaagactttgtattcttatttcgttaatgaaatgggagaggtctatcctctctttctaaaaaaaagcccaaccgtggtcaaccaccgctgcgattcaaaaatttcaactcaaattttaaaattcaaaactttcaactcagaattcaaaaactttgaaatcaaattcaaaaattttcaagtcaaaatttgaaaccttcatatgaaaatccaaaacttttaacccaataattattcattttttattaaaaggctaaatgataagattagagaagggattagacgacctaagcatatacaggagtatcgctaagcgctaggattagtgcgcgcagctagcttaccgttgtggcgcgtgcgcgcgcactggcagcccccgaggtttatcctttttttaaaaaaaagacaaaaaaagagggaaaaacaaccgtggtcaaccaaccaccgccgctattccctggcgcaccgggaatctcgccggcgatggccggtagtttgttacggcgcctcactggctatttatagactacagtgcggcggcagtggcactgatcccattctgcgtcgagctgcctagctatcgatcttcgtacgtaaatacgtctccctcgtctccggcgagccaccggccgtgagagatggcgccgccgtcagccatgaacacgtcgagggcggaggagaaggccatcgacgactggctccccatcacctcctcccgcaacgccaagtggtggtactccgctttccacaacgtcaccgccatggtcggcgccggcgtcctcagcctccccttcgccatgtccgagctcggctggtacataattcattcatcatttctccttctccatttcatttcatcgtccatggatgagtgttcgattttgtttttttttgtaggggtccgggggtggcggcgatgatcatgtcgtgggtgatcacgctgtacacgctgtggcagatggtggagatgcacgagtgcgtgccggggcggcggttcgaccggtaccacgagctcgggcagcacgcgttcggggacaagctgggactgtggatcgtggtgccgcagcagctcgtcgtcgaggtcggcgtctgcatcgtctacatggtcaccggcggcaagtcgctcaagaagttccacgacctcgtcgcgccgccctccgcgccgccgatccggacctcctacttcatcgtcatcttcgggtgcctccacctcgtcctctcccagctccccaacttcaactccatcagcggcgtctccctcgccgccgccgtcatgtcgctcagctactccaccatcgcctgggccgcctcgctccaccaccacaaccacaacaatggcgctgccgccggaggtgtggactactcgctgacggaggcgacgccggcggggaggacgttcaacttcctgagcgcgctgggggacgtggcgttcgcgtacgcggggcacaacgtggtgctggagatccaggcgacgatcccgtcgacggcggagcggccgtccaaggggccgatgtggcgcggcgtcgtgctggcgtacggcgtggtggccgtatgctacctccccgtggcgttcgcgggttactacgtgttcggcaacgccgtcgacgacaacgtgctcatcacgctggagcggcccgcgtggctcatcgccgccgccaacatgttcgtcgtcgtgcacgtcgtcggcagctaccagatctacgccatgccggtgttcgacatgctcgagaccttcctcgtcaagaagctccgcttcaaacccggcatgcctctccgcctcatcgcccgatcactctacgtctgtaagtgtgctagcatgcactaacacacacacacacacacacttgattagtgatccaattaattaattaattaccccctccaaaacgggagaatttaccttttgccatcctctcaaaataccagttctcaaatgccactctcctaaaatttcatttccaaataccacctgggtccacatgtcagcctcttttcccattcaaataaaagtgacgtgggactggatggtgtgtgaggctgatatgtgggcccgggtggcatttggaaatgaaattttgagagagtggcatttgaggactgacattttgagaggatggtaaaaagtaaattatcccctccaaaagtattttctattataatacatagaaatattaataaatatatgattttattgaagtacttttttaaaactaatttacacatacggttttcatatttttaagataaatattttagaaattattaactaatttaattaataattactctctctgtcctcaattataaggcctatattttttttacacggtttttaataacatactttaactagtatcttttccatttcatgatccaaacaaatataaaattagcatcacataaaagtactttaaaatataaatctattttgaaatataaatctattttgaatttactgatataacatgcataaaatttactgatataacatgcataatatttagtatagatatagttagtataattattaataaaactactaagtttgatttttcttaaaaatagagtgtcctataatttaggaccgagcgagtagttgtcaattagtctatcatatgttgttaattaggatctaataaatcttaatttgtactaattttggagtattgaatttcgcagtgttcaccatgttcgttgccatcgcggtccctttctttggtggactgctaggcttctttggtggctttgcgtttgctccaacgacctacttcgtaataatctctaccattaatttctttattattagaaccttcattaaaaatgtatataatttaaaatctctcgtgcgtattaatctccgttttttctaactgaaatatgaacaattgttttttcagttgccatgcattatgtggctgtcgatcatgaagccaaagaggtttggcttgtcctggtgcatcaactgggtaagtagtattatccattaattatttagcatgtgcatggtcaattaactaacttgataattatcctcatctgattgttaattatatatcttgttaattttaattctttatatatttttggtgcctcagttctgcatcatcatcggcgttcttctgtcggtgttcgcaccaatcggaggtctccgctcgatcatcgtgaatgcccagagttacaagttcttctcttgagtgattaattgagagaaaaggtgttttaccgttcaattaagtgtgttcttaattaattaggggattgttttagataatgcacagagttctatttaattaattagatgaaagagaaattcgtgtgtccctatgagacatctgtgtggattgatatagtagtcgatcaaatgaaggcatattatttatttggcctttgtttgtcgatctagtactctagcgttaatttaattcgtgtcgagtttatcccaatttttgatgatgtttgtgctctattatcacgtggtgtggcattcgttttaagggtttatgattggttcaaacttcgtcctagtttttacacgatttgaacttgaaatcaattactttcaattcgactcttgcgcgagtctcactaaaaaaagttatcgagtaagaatatcgagtaagaaaaaaaaggatgttgctgtaccacgggaaagcatggcagatggcgagaaccaggtacatgaacaattaaccaaaacatcataaacatcatatgtacaaatcagcacaaagaaacttcagccacgctacaagcagttcgctgggaggaggtaaagtctcttgtacactcaagtaatatattgcagtaggagcctctccaactgtttttccgtcaaaaaaaaaacctgaggagagccgacgctgaaacaaaatttgacccaacctcacacctctgggaggagagtgccgatgctgaaacagaatttgacaaggtttaagagatcacacgatttcaaactgaggttgacgataattgcgccccattcctttggtagggtactttgccatatcagatatccattgcctcggaggccgatgaagcattcttcttcttgttctttcttttcttgtccttagggtccttcccctgcttggcggaattgctctcctttctcgcagagggtggctgtgttgacaacaggtgctgatggatcgccgcaaacgggtcgagctggaactgcggattggtcagcacagcattcagttgggcagcctcccgttgcctgaaaggagagacaaagccagtcaaaaaccataagtggaaagaaagcaaagaacgcaagtggaggggcagatgaggcaattacactaaagcttgcttcgatttgcagttcagttttgcttcggtgtgcagatttgaggcatctgtttcaggaaggaactcagagagcattgagagatcatatgctttcagtttcttctggcggctcctctgtttagatttctgcacaaagaaatttaaataatcacaacccataacactgatagtgcaaagtaaagcaagtgtaacttccagaaaactacaaatggagtagcccagctgcaataaaaagaatcagttgtaaggaaggacagtgtggagagattaaaggccaagaacagaacggagagactaaaggtctcatttcagcatctacaagtatatttactctaaaatatagatgcattaacatatgaaatgaacagaattaatgttcgcagtttgtgtctagaatatatgaaaccacaagattgtaactatatgttgggaaattcatgagtcaagagccaactggtcttggcatttgtttttccatatggagttaggcacgtatgggtttcctaggatcctagtcatcccatcacagtaggagggaatacaggagacagtggatcatcagtgcaagtacaaaaagcatattagggttccaagcaggtcccaagtacaaaatccattctcatatctgtttatggatatggtgtggttattttgctagtcttcacatgtagacaagcatttggatgacaatataatactttcttacgcagataatttttagcataccacaaatacacaggacaagagactaaacatagctagcgattgagaaaatcagacttacaaatatatacttgaccaatacatacaatttggaatttatccttgaaatatctaagcattggttgcgttatacgcccacgccactcatggagcaaaacaataacagtaaaaacaagctgcaacaacagaagctacagaaaatattcaattgcaaccaaaggtgaaaagccatacacccatagaatctgctgaagtctgattcaagctagaggcatgtagatattttttgccagggcatggcttgtttctgtttatactttacagctgtcatgtgaacaagaaacagctggtctagttcacgtatggtggacaccaacacccctagtttggatttgttcagcaggtttattagatgaacgctccataatattttttggttcaattagtgaacaaataaggccccaaataaggaggacaatatgcttaatattattgcatagtgtaattgattccccttagctaggtgttggctgtgttgagaaggattcaaaggttatggtcatcaaggccatgttaaaaacagagaatagctcctgatttctttgctaaactttttgtggcttgtgctagtgatgcattacattataccagggttacaaacatgacaaaaaccagtgagtagtaaccagtgcttggttttcttgcaatagccatacccgctatagtgaactggaacctagacaagcaatttttcgtctcgtgctattagaggaactttttgttcaaataagttttgccagaaagtgcctggttctgctcagtactggatgggttggatgtgcagagcacattccttaagaggtaaattccacctagcaagagactagctgaagagtgcacccacactatttaaaaacccagtcttgcagaaattatttactattagtatccgggaggtcctatttctttcttagctacaacctacaaatgccacacagaggttaattggggaactgtgcacagtaatcagtcatgaagcatagatatttcagttctgagtgtaacctaaaaaatatgggattacgaattgagatctagcatgcaaaactggtgtattaagtcaatagaaacagaaacgacaggacatgatactaggtagttcgaattgtcaaaaatccattttttgggcaagatagtattcaatgtttgtgtacgaggaacacacaaatttgcaatgctgaagagaattaaagaacactataataataaacgagagggtctataagcaccttgcagatagtctttgtagcatttagggaggttactgcatctttcacttctgagaaacaaaaacaaaaataaatcaattatactataaaccacagtaaacaaaaaaacatgctattccgcaaaatatagtcaacgactcaaggtagacaagaaaaaggtaggaaaatgaaacagagtccagctagcagtaagcccaatcataaatcgtaatctatcaatgtttcgactttcgagtgcagtaccacaaactaagctactatctactttacaatatacatgttctgtaaacacaagtaatctacaaaataaaaggtatactaaaaaggctacaactatttatagaaaacaaaagaggttttattatcacaaaacactaaaaacaacaagcatggaacatgaacgaagaagtatttttattcatggataagatatttccaagctttcactattcaagaaaaaaaaaagcattgccccttttacagacatattaattttcttggaataaactaataattagttgtccttctttacaaaaatgaataacaagcatttcagaatagcagtgaagtaaaacataacaagccaataccaccatcctctggtcttttgaatcaatctctatacattaatcaacatttgccttatacactccctccatccaaaatataaggcctatcagtttttttacatgttctccaacattgtattttggaaattaaattatcttacaacatattatcagcaattacaaaggtaccgttgtatacgaaataccacatgcatgacattaaacatatacattgttagttcaattactagccaaagattgcaaatgttgatttttcctggaataagggagtacagccaaaaaataatggaaaggcacacctacttgtgtagaagctgagcttcttctcaagcttctgtttggacttcagttcatgcttcttaggtgacccagtcctgaaagcaggggcggatccaacttgggacatggtggttcagttgaacccccaaactattcggtgaacaaacaaacaaacaaacaaaatgttactagctagttgtattaagagaggtttaaggctctcaaattaataaggaggaggagaagagcttcttccagatctagaagagaagctagtagggttaacgaacgcaagcaaattccaggtcccggtgagagatgaatcggaaagagggctcaccaggatcccctcccctgccctccccttttgtgctcggcagatggagatcggcgcgccctgccctgtgtgttggcggcggcgcaaaggagcggaggaggagacaacgagagagagagacggccgagttctcttttcttttacgcgatacgagacgccagggcccaggccctatccgaggtggggggggcccgctgtgccgtgcccacaggctgcattcacgggccagtctatgcacaataagactctggctatgccagccgatccaaaggcacgatagtccatcgtgcttttctacaaaataagtctttttccgtctcttatctctttgggttgtgtcatatatgatggaataagtctatttatgtccttctctttggacagtgccttataaggcagaattaaccccaactatttttctttgaccatgccgtgctgggcagccccaccatgccaaggcattggcccaagcacggcccaattattgggccaagctggcacgagcccgacaataattgtgtcgttccatgcttggaccaggccaaatggtcgggctgtcgggcctcggccttatggccatctatagtctactccaactttatcttaatatttttactattttaaaactagttaatagtatttctttatgatgactggtgacccacatatcatcaaaaattaacaaacacagttagcgattgtgtcgacaacaaatttctcagaccactagcaaccactaactgatactccatgcaccgtcatcaccgctctttctcctgagccaccatcgttcctcctctttgcctttaccgtcatcaccgacatttctttttctcctccactatcgttatgcacactattgttatggttgcattgaggtcggggatgtcgggcgtgaagggactgggaggcaggagttgacctaacaaaaagcgaagacgctatatccgtgctccttcttgctatacctagcagttatcaaacggagggaaaaagaaaatggagagagagagatagtgtgcggagtgattgctgagtcatcagacttggagatggatataatagggtggtccaaattgaaatgtaaagttagctattgtgtaaaagaaaagaatggttaaatgatgacataatatgaaaacttttaagaatatttaagaatacatagtatggactgtaatttactccctctgtaaaaaaaggaatctagagatatgacatagtgtagtatagcaaatctggacataggcatgtatagattcgttttacttggatatgtcacatccagtactaggttggctttttttattggacagagagagtattttttttctctagcacaattaaagatgagttgtccattagctgaaagtagggatatgatctaaaatgtatcggatggttgaaaataaatgaaaaccaatggttgatatgttttttctcacaactttttaaataaaatacatctaatctaacctaatggtctaaattatcgggtccaccgatttgagtgaaaattgacggtgagattaggcattgccacgtggtggtctaggagcgtttgtagatgtgccacgtggaggcttgagagcgtttgtaggaagtttaatggacctttagtatataactaggaaggtagcccacgcgatgcgcgagcatgtattagagattatgtttgaaaaaaaattaaaatgatagaatatcaaccagatgacacttgccatttcaaaaatactgtttatccataacttatcctcatcagtgttgcttttataatttgtccaatctatttgttagcttttaaaatatataatatttaatacattcctataaacaattatctaacaatatgtagaaaagagttagatttaatttgtatggaaacatgtagtgttctgtcttgtttaataaaatgtttaggggctttcttttttttagcaaatcctaaataacattattgttaatgaatatgttttatttgtaccaccaagctagtcctcctatttggttcaattgacacaatttgttatatatatatatttacatataaatttctaagtagaccacccttccctgatatatgcgtgatctatagtatcgtttattttaaaaaagaaaatacctagtcaatatgagttagaacattctagtttaacaattaaaaaataacttcttaaccaactgtaaagctaactttgtgtggcttatatatgcaataatatgcggaggaactcataatgtcatgaaagccagtaatatctaagcacttaaaagatgttatggccatgtaacatgcaatagttgttccaattttagtgaaaagtaggaaacaatgttccttttatatttcttgtttaattttatacaactcttattttaagttcaaaatataggtgttatggatctttaaattgttggtttaattatgaatagagcaattagattagaaaccagatgtgtggataaaaaattgtgtatgttttaatattattgattatttctccttttagtttgagagctataaaaatatcgaggaagggcagaggggaaagtgcgagccgaaggggactagtagtgttgtgtttgtgcgcatgtgaggaggagggcaaagttttctgtgtgtgtgttgggggggtggttctttttttataaatgatttaagtgaaaatcgatgatctattgttttgtttctaaaattttcaaatatttttttttctaattattaagatgtaacacctagcggcttaagattttcattaaaagtagatgtaatggttgaaaataatggatctacatatttaactcgaaacatgtggtcaactgtttttttcctataatttctaatattttatttttaaatttaagatgtaatatgtgacatatgtgatactgttagtgctctatagataatgtacgagatttaagatgatatagtaattattatcaattttttatttttctatttttttgtttggttgacacacgtaggtgtctacaaatgatgtactatttacagcgaaatatgggtaatatggatcttgaattatttatttatttataaataaaacaatagttcaaccgaacttgaaaaccagatataacttaaaagatagtcatttagttttctaattgctgtgtgtttatgtattaagtttttaattagttaaaatt

SEQ ID NO: 68133 - DNA, 2023 bp, Oryza sativa
aatgctttattgattgattaagatgtatcttttttttcttttcataaatatatttatatgtatacactacaaatttaataatattattttgacttattataatgtcggattgagaggagtattttttgggaattaggttcatttagttttttcatcatatatatagtttaattactgttaagttatatacagtgataaaatctatatcactctttttttccataattttattattttttgaattggacacaaaggtcagaaaatataaccaaaagttacatattttattcatagttgaattatagtgaatgtgggcccttaaaagtaaaataatataaagaatgtagtccgtgcataggtaagatataaatcaggttcgacattgaaatcgaagcagattctgcaaagagatggattcgaagaacagagtatgcatcggctgcgaaagcatcggctggagtctgcatcagctgagatggatcggatagaaaacagccgatagaggtggtgcaacccgattccgacggtgatggcttcaaggatgtttctagaatcaatcaacgtgcttaacaaggattgccacgatggagataaagctcttagaaaggcaattctatctattaattaggatatcttacgtaaattccttagagatatgtttgggtaaaagtctaccgtaaaaacttatggtatcttagagtttgttaaagataagagtcgtgttcggcaaggacatattttgtatctcgggtataaatatgacccggacccatgtaatcaaacaacaacagttcaatacaatctcagcgcatcgccaccctttttactttcgttctatttcgatgagttcttactttcgggttgagctgcatcgattcgatcttcaactagaggtaaacttgtcacttgtcatggcggattgcgttctcgggattagtgcttccatctttatgacactctaatcctgtttatgtaattcgtcgagttatcatatgcacgttgcaatctctgttagttgtgttatataacttgttatcggttgtttctcattgttaggaagtgaccgatagggttatgtttcgttattaagttagattatatcgtgtatctatcatctcttagatgttttcatcatcttgcttagatcttatacttatctttatgcttaatgttgcatcagttgagttcgatctattaagtaatacctataattgtaatatctggcttgttttatgatcatcgagagagatagcatcggggtttcagtcgatcttatctgatttagctactttgtatctcatatgcttgattgacatgctagatctgccctttatgctaagatcttatagcattaaggtatattaggcattttgttcgatatattctgcttgttttaatatcttaatatagagtggtatcggagtattagccgatacatgctagatctatctgatcggctatgctataaatgtctatataatcagtactttaatgtatatttcgacttaagtgatttatactgtctcggcatggcgaccgatctatcctaatcacttagtttaaatatacatcgaatgatcgattatatgtcgttaatatctatagccaattgagtagatttagttttactttatttatacacaactgccgatcgattccaatatgacatcggcatcggctcgaagataaatgatatgccatcggcaactagccgatcggctatcgtatatggatttaaccgtggttttcttgtctttctttcttgttgattacaggatcaaatcaactagcacgctcacgaacctaaaagcaagattttggacctgcactgaagttaagtagatcttctaggccagtgtgtgtttttcacatcaacagttgtgaagtcatcccttctttcttccagctgcgcgcttttcaaactgttaaacggtatggtttttacaaaaaaatatatatatatatacaaaagttgctttagaaaatatattaatctatttttttaaaaaaagataatattaaa

SEQ ID NO: 68134 - DNA, 1024 bp, Oryza sativa
taattatagtgaaatttggtcttcaaccgtgaatttggtcataaacaatctaaagacatccatggattaaaaaaacaattatatgatttagatgtcgtagttacttgattttttaacaaataaagtatgaaaataggataaagaattaatggaaaatagaacagggaatcgaaggaagggagggagtaagtacataatgctcggtggggccgggtttaggagatgatttttaaaaaaaaaaattataatagttgtaaataatgggtccaccgaattgaatgaaaatcgacggttattttttaaagtgcaatgtgacggcttagaagcgtttataggatgccacgtgatgacttacgagcgtttgtagaaagtttaatggacttttagtatagatatatgatttttcaataaactacctcttattctaaactgctcatttcaattttattttattttcttattacacaacaaatgcacacgcaaactacatcactacacatagtcacatacttaggcaaatgtgcccctaacacatgcttaaaaagacataaacagaaatcagcagcatatctctgatcttattaaaaagacattagatttgaactctgatgggtaaaatcatgctgacccaccgagaaatccgaagtctgaaaaacagaaattcaccaaaagatgaaacggaaagaaggcacgtgaatccatgttgaaaattttacttgcgtatgaaatactgaatggggaaatgcatgaatgggtgacagcaattcgatttctgtgtccacattagacacccagaggaaagcattatttttgtttaatttaaagtacttgacaacgaaattgttaagaaatatatatatatgatctcatccatccgatggaataggcattgcggttgccatgcctcccgttaccacaaccggcagagaagggaataaggctaccatgccccttctctccttcggcacttcttgacaactggcgcgatggttcgcgctcctgtggttctgaccgtatccccttg

SEQ ID NO: 68135 - DNA, 7044 bp, Oryza sativa
cgagcgacgacgacggctccagatccgcgcgccgccggcttccctcctcgccgcttccgccggccacttcctctcctcccctccgtccgctgccgtcggcgcccgtggtgaggccggcggcggcgccccatggttttttttattttcctgagatgattttcacagccgggctgtggcccgcctgcgaaaatggtctattttcccagtcgagatggtagcggcggtcctctcctccgcctgcgaaaatggttttggaccgcctggaaaaatcttttttctagtagtgctaatctactgctgcatggacggtggagcccgggcaactgcccgtggtggccaggtcctggctccgccaacataacacaagctttttttttttcttttttcgcgatcgatcacacatgaaaattgaaaaggcagaattatgcatttttcatattagttttgttaacgtaaatctatgcaatttgatccctgttgccagctatttctgaaaggattccatggttataatcatgaaaatgatcctgcactggtccatactttttttctttggtctcaatcctgcacaatagtttctttacagagttttcctcctgacaaaagaaaatgatatataaaactggcacaatttattgacatttgcatcataattggttagtgccctaatggcaagtgttctactcaagggactgtcctgagtattaacttaagaaactctgaagttgccatcgattgcaactgttcatagtgaccacattcttaagttaatacatcatgagtttgttatatttctttccacttctctatatgtataaaaaaaatagtgttctctgaccatgcttttttgcgattatctgacaatatataaacaatgtaatgttttctgaagacatttgtatctctgtatccctctcccccatcctttttgttctgtggggtggatggatgggcctatcaaaaggttgttccattatcatttgaatgcacctataataagaactaacaattggcaaacaacagttttccttcagaactagggactgttgtttcaatccaaaaatagtcatagttttactgccatgtctcttatagcttttgctgctgtgcgactagcccatcatgatgatctgacttacaatgcttgtgtctcttgctcttgatctccttctatcagtcactctaggtgcagctaatttctgttcgtctcctgacatttctagggatgcaagatatcgaagatcgatggaaattgctgccgcctacaaggtgcaagaaatcatcacatccggcatttaagtgtgtgaaagactggttctgatttttttttttgctttgttgtgtttcttctctgtgccatagctagaagctagactgaaaacaactatggtatttttaggcttttttatcttagtgaattcatgtaaaaatatttagttatggttctatccagtttttgatggttgttcttgaagggtactagttactatttttagcaggagtgccataggagctaatttagctaaacttgttgcatcggttaataacaccatcgaatatttcatttgccaaccttttgtagacctgaattttgaaaaccaattagaaagtagacacgggctataatgagcgcctcttggcgcgctaattttttaagtatatcagtgcattcacatagtactcgatttttttaaataaatgttttgattcgtgcatgaatcactgttttgcagccataccacaagctgacttaaaaattgcaaattgctgaaaggtacaatcgtataagaaacaaaatgattttcacatcacttcgcaaactacattttttccctacaaccaccggaactcaatatagttcctacgcagcttcatcattcataacagaacaactagcaagttcaattcaatttaaagagatcgaatggtgattcacactctaaagcaaacttagactaaaaattaatagtatctttaaagattaaccttaagggtaaaaaaatctgcaatccctgcaaacaataatgcttgcttcaatatggtatacttagtcatatacatggacattctccaataaaacattttgttttttttgacgcaaataataaaacattttgtaatctacagctcataactcaaaccatattgaccatctcatgaaaagtcacattacacatcacaaattaattccagccacaacttttagttcatgtgctcacctattggatttgcatgaaaggggcagggctgagtagcaaattgacgcacagtaacagcagatgcagatccagtagagtgaagggagcaggattttagtgggaatcaactttcgtaactgtggcatttggggagttcatataattctaaactaacatggtaggttgtctgtagctcatatacaaataatctgcacccaaaccagtgccaaaatatacgaacaaatgcagaaattcgcttaggcaatactgcaaacaccttaagtgcgcaaaaaactgaagtaaatttaaacgatgtaaatggagaggaatgaacctgcagatgtcacagtgttcagtgcagatgtcgatggtggcaccgcgatgggcagaaggcgggcgggccgcagggcgctcgacggcggcgagtctctcccacgagctaggtcaccgggcggcgctacggcgcatcgatgggcaatgccgcagcgggcgacggtcggccgtcgacaaaatgcctccaaatgctgtacatcctgtagtgtctgaggatggtaggtgggtttggccaccaaccaggcaaaaccacacaattcccccatccttggccttgcgcttgcgcattagggtgagccaaaaagaaattaaaaaaaaaaacaactgaggtttctttccctcaacacataaatacccgacaatgccctagccgctcgacgttcataccgcagcatagagcacacgcttggtgtcgcggcggcggattgatggcagggaagacggatatcatccgcgatatcatcggcggctgggtggtggacgagacgtgcgtatatatttttgtctactactacattccctgattacagaattttctgtgttggagttagttttcttcttcttcttcttcttcttcttcttcttcttccaggtttggttttgctcttgtgattgatgggatttccgaggtacatcggtttccggtttccgagtaatcgctctactattttaggtcgactacgatcttggggataattacattgcttccttttttcttgatgatagagggtctatgtgaatgctgctatactatgaatatgattaacgtggacaacggctgatggatttgattcgatgcgagcggccgttgacatgtgggccccactccaacaatgactaaggttgctcattttggcccaggtcatcgtgaggcccattaagcccatctgcccacgttgtgatgcccagatgccctagttgcaaccgccgccgccgccatctctgcggcggtgtccggattcttcttcttcttcttcttccctcgtcatccgggaacgcggcgaggaggcggcctggctacaggacgtcttcttcttccctctcgtcttccccctcttctccaaccttctcttcacgggccaaaaaaaatctttggtaattggtacggtccgccatgcgggcggtccttgtcgagctcggaagacggcatgagtgctgtaatattggttggattcagttatgaaattaagtagtactgaataatgagattcgggttggatcaaatttattcgaacgggatcggttttgttcttttgtttttggaaagaaccgaatagtttctttttaactatttcctcattttaaagaacggtattatgcgattcaaatcaaatctacgcaagtcaaaatttcaacaaccagttgcgtcaacatgctttttgtctggttaaaagaactgaaagtacgtactatgctttttctctgctttgatgtgtgatcttagtccttttgttcctttcttgttattctctgaatttctcctgtccgtattctaaattggaaaattgcattgatcatgagcagtttgcgttgtgtgtcacaaaatcatgaggattcaattaattacttgttcatgagggtggtgtatatgccattgtgatttagctttctgaggattcaattaatctctcatttaggggataagaggatagattctgaaaatatataagatggcacctggatgtcattgtgatttagcttttaattaatctctcatttaggggataagtggatagattctggaaatatataagatgacaccttgatgtcattgtgaagctttaacattttttttaaggtatttagcttttacttcgatctgaatttctaaacccaccatttttttcgtttgtgttcaaccagagatgcggcattggctggacttcgtgtggcagagcgtgcctattggaaggaatttgtggacagagtattgaaagataccagcagcattgatataactgcgtcaaatatagctgttcccacaaggctacctgtcgagctgcaagtcctgatcaaggttatgatccaccagattcttaacactcagcctggagcaatccctccactagcatttcattggtgttgcaatcagcttcttcagcatttggtgaattcagtaagaacccaaggacagccaactgttgaaccaaatgtacatggacatcaacgttgcaggggtgcaggttggtcatcggggattcccgaacgattggccgatcgaaatgtttcagaagatggaggtattggaggagttgattcgaggaggaacattagagagatgaatggtaaaattaaagagacaaatgcaagtcgtgagtcaccccgaatcctcaagcctactggtgagccaaacccatccactggtggcatacggattcagaataatcggcaagagcaacctgcagaaatgaccattttccatccatggaaaaacattactgatagaacatcagcttatgagctaagccatattgacaacttggttaatcatgaagatgatgagacaaagaggcagaaagaacagagtgttcacatcactctgttgtatgagatcaacctcatcaacgaagagcttttcgataccgtgatcagtatcaccggtcacaaacatggtgggacagtgatcaatttcagctacaatgcagtgtctctttgcaaagacatggagctaccatttgcagcatacggaaccgtctctctcaagccgggaagcttatttgtcccagctgattatcctcgaagctccccggtgtacgaagatggtgatgaacagcaccagggaatgtacagcgtgatttcaggcatggttgacaaggtgttccagcgtgccctgcgtaaactcccggtgccaatgtcgatcaggaacatggcccggcagtggggcatctccgtgcgaacggtcaccaacggtggaggaacgttcagctccgggtatggccagtggaagagttgcaccgatgagtttgcaagtccatagtccatggatagacccatgaagttttgcaggaacaagtgatatgaagaataatgctgatctgctgttttgctgtagggcagatgcagaatccagtgtgagtgttgtgagagaatatttatatttttgttatgcattaagaggctgtgtggatcatctgtttttgattaaaccggttttgcttaaaaaatatttcttactacggttgtgaattgtgatatttatctgtttggactgtgtaattggaatgagcgaatttgctagtaaaacatgttttctgaaaactggttcgtatcttttaagatccaaacaaccacttagagtttttattggcaaatactttggtcgttaatcttgcacgtgcaggcttatgcaattattgtgcaacagttcatttcatacttcatactccgggcaagtagtatgaactgaaatgttgcaacgggcttatgcaagtagtatatatatgttcgtctgaaaatttttcacaggaattgaactgttttagttcgatgcaacaagatggaagtctgcaatgcatccgggtctgacattttatttgccacattctgcttgacacatggagttcctcatacagatgttcttcggctgcgtctgacaaagtttagcaaactgaaaagtgaacttatgcctatttagaagcgcacatatctcaaacaaattttgtgggcctcatcgtttgccctatatagaatcaactactactgccaaagtttaatttttaaaacttaattttgaagctttttcattgaaatttttagaattaccttttaagtcgttaaaaacatagagtatataaaagtttttacctataatttttagtccctccggacaacattattttttgtgaacaggctgtacggcgtattctcagtatatagtttttaagcagaagtttcagtctgatttctccatgaacctgcaagaaagaaaaatgcggaagtactgtccttaaccatggaatcctttcagaaataactggcaacagggatcaacttgcatagatttacgttaacaaaactaatatgaaaaatgcataattcttctatttccaagaggtaaagtgtttcattttaattttcatgtgtgatcgatcgaaaaaaaaaaagaagcttgtgttatgttggtggagccaggacctggccaccatggcagttgcccgggctccaccgtccatgcagcagtagattaggatttaattactgtgattactgaccttgcagccacatggagtacataaatacaatgcttaagcaaaggcaaagtgctataatcattgtgtattttggtgaaacataattgaatcatatggtaaaacattttggtgtagcgtttgaaacgtcaagtttcaattgttgaaacatccacgcagggacagatccagaacaaaaaatggggggagggggctcaattacactgcttctttaacctccagttatataggaacctttagtttattattcatggtgaaaaaactaaaggggtactccgggggtatccatagatcttgggggtgta

SEQ ID NO: 68136 - DNA, 4889 bp, Oryza sativa
ttttaagtattttaattccttctcagcctatacacttagctcttatatggattactaataaagtctagggctccaaggttcaaatatcgatcctttttttccttttacttctattccttcattgttgttgtcctgacgtttcatggtcttatattttgggaagatttgcctgtggctctgaatgactgccctgttggaatgagctaaccggggcaaattatcaatacatcattattggtcccatgcttcaaagtacaatactccggaaaaataattattcattagccttgcttggtaactttttgaagctgtttgttaactctataatgtaatatttaattcattgttataagtaaattatcttatattatcagaatatgctgcgtcatctaaaaataataggccctagcttagctagggcattggaaaaacactgctccttgcatcataaaatagttcaaactttatcccaaataaagcaacccagtattataaaatgtgacttttaccactaaatcaaccatattaattatcccaagaagaggcaaccatgcattattcttttacctctctccctaatagccacttattatattttgggacagagggagtataaaataaccttacattattattatttttgaacatttgtttactaactaattaatcccaaagtccatacaaacaatatatgtttctaataggctttaataatccttaatttgtgagaacagtggtggactagatgacgataagataggtggctcgtaataaagagtaagaaaaaaagtaactatttcatcatagcacttaaccacctaaacttttttttttctcattttacacctcgaaccccctagcagtattttttattctctctatctaagtcaattttgctctggaaatttggtagaacatagatgcgttcacaatttaggtttcaacatttttttttaaaaaagaattatcactgtttacttaggttgaaagcacataaaacagattcaaacatcaaaattaagttcaagcaaaaatcggttgaaaaaaatttgaaaatacttttgaacttcgttaatggtgccatctatggcttctaacaaatttcagcttaaaatactgcttgtaaattttagcttaaaatacaacttgtatgacgggtaagaaaatgtatatgttattaagcactaaagtgaaacatttttaacggtttaggggtaaactaccaatctaacttcactttttcaagtttgcatttgatcctatttttcaaaattgacgttgttgtttggccgtgtttccattacacattaaggttttgtcttaaaaaaaagcatgcatttattagccaaaagtaccaaaatgcccatgagtacacaacaatcctatctctaactttcttctcatcccctttcatatcaggaggctggcgtagtggacgggcggggaacgagggagcgacgtcacctgcatgtggagggagaagagggcggcggcacacgtggagggagtaggggcgacgacgatgtgtgtgaagggagaagcagcaatgaactggtcaggagaaggagggagcgacgtcaccggcgcgcggagatagaaggggcggcgctcgtgcgaagggagcagcggtggtgacactgcgcacagagggagcaaattaaggtggtggcgtgcggaggaagcagatgcacatatcatacgtgtatatgtgtgtgtgagtgtattttatatatacgcatacttttgatgtataaaaaatgtaaacacgtatgcaaagtttgtatatttagagattcaaaaagtttatataagtatgtatataaaatttagacagatgggctgaactgatctcgcgggctgggctgaaaaaagaaaacccaagacggaaagtggacgcgcgcggtctggcgtcacctgggccgaaatggaaaacgcggggtggtggtcgcgcggctagctgcaaattagctatctcgcccaccacgaccagctctgcaatgtaaccacagctatcgtctgccctagagagagttgagaccacgctgcctagtaggttgactccgccgcctcgaccagcaacgctgccgccatttgcacacgctagctcgacctcttgctctgttgtcgtcgttctcgcttccgatggcggctgcaggcggcggatcgttgctggatcagtcgaggcacgccatgcgcagctgggtactcaagaatatgtgagtagtatttctctaataatccctcatccaattatgtgaattacttttgctgcttctgcagctttttttcccgctgttcttgtgatgaattttgttgttgcataattattggtttctttccagtttcttgattaattccttcgaattgttccatgctagctccacgccctatactagaagattctcctactacttagagcggagtatctgtttttgcgttgcctacaaatcgatcgatttgccttgattttgggttaattttcgttactttttcttgattgaggatttacatctactacttttgaaaggatttttatcactaaacggctaagattagatatattttgctcgccaggagggtagttaagagctatagccaacaagcttgtgctcgttgatttagagctgccagcaagagctaattgatcaaaagctcaagatcgagcgaggcttttgaaacttggaacgcaagatgtagatcacatacctcagctggtaacgtcacccaaaatgattaacgcgtcagcctcattgctgcaaacaaattaaaccagcagaaattaatcaagcttgtgctcgtggacggccggatcgcagtgaagcaggaacgcttcgatcggacggtgcatgttgcggcatagctagcaagctcgcgcgatcggtgggatgagaagaacgcgtagtaggttaccaaacactacggctttctagttttatacatataataatgattctctctcggctgcatcgtcttagtactagctattttcttctttcctctccttcctatgcataataaaaaaaaaactgttatgcctatgaatattactggcatgtgatcagtaggtgggggcttttcataaaagtttagcaaggacagagatttattataattaatgctatactactatgtgtgttaacataatcgtaaaatttgtgatgctatgtgtactgtagaacgcgcgctaaaagaatatgaaagctgaattagatatgtggtttgacttggaaaaagaaccagaatcggtgtttggcttggctcttggaaaaagccatgtcaaacattcatgcagctaaattgaactgctcttgactgaactgttaaagttgcatgatttatgttgcggtacaagggtgcgagagaggtttgattctcattgattgtaatgttcaatttatataaggggatacggtcggtaccgcaggggcgcaaacagtggctgagctaggaaattttcaaaccagggcaaactacttagctaaattgaactgctcttgattgattattaatgtttagctaggaaaaagctcggagtatctagtatttgctaaaatatttctaactttaatcctttcaaaataataaaaattcaatggtgtatttgatggcgagcctgggcggctgcccgtgcaagcctggtggtggccccgcttctgggtgcaaagtgcaatccatcgtgccagttgtcaagaagtgccgaaggagagaaggggcgtggccgcctcatttccttctctaccggttgtggtaatggggggcatggccaaccgcaatgcctattccatcggatggatgagatcatacatatatatttctcaacaatttcgttgtcaactactttaaattaaacaaaaataatgctttcctccgggtgtctaatgtggacacagaaatcaaattgctgtcacccatccatgcctttcccgttcagtatttcataagcaagtaaaattttcaacatggactcacgtgccttctttccgtttcatcttttggtgaatttctgtttttcagacttcggatttatcggcggatcagtacacatagccgcagtttaagatagatggtgatggtgaagttgtatgtgtatgactttacccattagagttcaaatctaatgtccatgaatactatgcaaatgcaggtcgacttttagcatggttatagtaagatcagaaatataccgctgatttccgtttatgtcttttaagcgtgtgttagaggcacattcgtctaagtgtgtagtgatgtagtttgcatgtgcattgttgtgtaataataaaataaaataaaattgaaatgagcagtttagaataagaggtagtttattgaaaaatcatatacttttaatcgcagaaaaacatatttttttagaagtgtcaaataaatactccatccgtcctaaaataactcaacctaggatagaaacctaggataggatgtccgtatccacgtacatccggacattcccatcccatccccttctcctctcatcttgtttctcaagctacaattaatggtggatcctagcgggcgcgctctctctctctgggtcatgaatcttctgatagaattcctaccattgcagcttttcttaggctatgatgcgttacaccggtgagttgtacatggctcacctccattccataatgtgcttttatgcaccagcgtaaaatattggttgctcattgggatatcgacatatcgtgcttcgtttaggctgtgttcgatgcaggagttcccaactctccctctcattttccgcgcatacgtttttcaaactactaaacggtgtgtgtttttttgaaaaagtttatatacgaaagttgcttaaaaaaatcatattgatccatttttgaaaaagagctaatacttaattaatcacgcgc

SEQ ID NO: 68137 - DNA, 4789 bp, Oryza sativa
atgtcggtatccacgtacatcgggacattcccatcccatcccctcctcctctcatcttgtttctcaagctacaattaatggtggatcctagcgggcgcgctctctctctctgggtcatgaatcttctgataaaattcctaccattgcagcttttcttaggctatgatgcgttacaccggtgagttgtacatggctcacctccattccataatgtgcttttatgcaccagcgtaaaatattggttgctcattgggatatcgacatatcgtgcttcgtttaggctgtgttcgatgcaggagttcccaactctccctctcattttccgcgcatacgtttttcaaactactaaacggtgtgtgtttttttgaaaaagtttatatacgaaagttgcttaaaaaaatcatattgatccatttttgaaaaagagctaatacttaattaatcacgcgctaatagaacgctctgttttccgtgtgtgggttatgggttcccaacacccaccactgaacacaacctaaatgttccctactacataaaagcacgtacagaccggcactataggtgccgtggaagtgctaaaactggcacctatagatctttttcacctctgcaagctgaaaacacaaaaaaaaccgataccaatatatagttgctagataattaaagaaccgacacttataatatattataggtgcgtataaaaactgagcagagctaagctgttggtccttatcctcttgaggcagataaggggaggaggactcggtctctccccggtctcctctctctcccggctctctctcgctctcctctctctggctctctctctatctatcgatctctctctttgtcgcttaaagtcaacaaatagttgcatcaaaagctttaattttgtctgctttgatgtatgatctcagtcctttacttccttctggattgcttcagtacttcctttgaaattggaaaattgcattgagcgtgtgtggtgatacattctgtgtgtaacaaaatcacgtgtttatgaggaatcatttaattacttgttcatcaggcaggtatagacatagtaggaacaggttctggaaacatataacatgacactaggtaggatctcattgtggcatcaattttttttgtcgacatttatctgaatttctgaaccctattctttttgttcaatcagagagaaattggcaggacattatggtgcagagttcaactctttgcgggcatttgaggacagggtattcaatgagaccagcagcattgatgattatatttctaaaatatcaacgaagatggctattttggagcgaccgcagtcttcttcaggtatgcagcatcaagggcagatgggaaatcaaacgaggctgcctactacagttatgcaagaacagccacagccacagcagcagccgcatttgatgtcaaataatcatcaccaaacacatggaggatggcagagcaatgttgcaagggtacagatgatcactggtgttggagaagtgaattggagggaggaaatgtttcagaagatcagcgttttaaagaactctttcttttccgagcttacggattttgaccgtttacttcacaattgccaaaaaacagaagaacagttgcagtcactacctaaaaagcaagctgaccaatacaagcggataacaaagctcaaggatgcggttaggagtgctctggatttattgcagctccagaagagcagcatcgatgaaggcatgaaggtgaaattctgcaagtacgaaagctccatacatagcctactcagattctacagggaaacaaaagctaaaattaatgagatgaatgcaaatcgtcataacaatcagcaagagcaacctgcaggcctgccgaggcaaagaattactgacagaactccatcgtcagctcgtcggcaaaaccgcaatgacaacgtgataggccaatcagaggataaattgcgatgcagggttgaatcagttgtagccaagaagaagcccatcgaccgcctaatcaacgctctgcggcacagtgtagaggatgaccgtacggacgtcaagaggcagaaaacacggcatgttaacagtgccctggcgaacgagatcgacgccatgaacgccaagctgatcgataccgtggttagaatcgccggtgagaaagatggtgggacagagattgaattcagctacactgcagtgtctcttgcactagacatgaagcagctatttgcagcatatgggacgtctcctgtcaagccggtgaaactattcgtccctgctgattaccctcgaagttctccggtggtctcgaacaacaacgatgatggagatgaacagcggcgaggaatgttcggcgagatctcgggcatggtcagtgcggcttttcactgcgcgctgcgtgagctcccgccgtccatgtcagtcaagcagatggcctcggagtggaattcctgcgtgcagatgatcatgaagaaatttgcgatacggcacggtggaggaacgttcagctccaggcatggccagtggatggattgcaccgttgaatgatttagtaccgtgaggtaccgatacctcgagatactttttgttgtaccgaagcaaatctcttaattattacatgaggatgaagtgatacggagaaccgtatttgatctgttgtattgctgctggagggtacatgcataatccgctctgtgtatcatttgttttgattaagctggtattgcttttgatatttctctgtctggattttgtaattggaacaagcaaaatcgcttgtaggacatgtatttctgaaaatggtaactatctatctttgaagagcccaacaaagcatttagagttttattggcaaacaataggttgagctcgcaggcttatgcaatggtggccaaacagttcaattcctaccatatatttccttctgaaacttttaccggaactgaactgttttagctgaaagcaacaacatgggacgtctgcaatgcagacaatcaactaatcaactaattaagcgaattttgcatgtgttcaaaataccggaaagattttgtgaggagtatgaacagatggtgagaaatttttggtagggacatgataaaggagaacggaaggtacactcgattggttgggaaaagttaatgagtcccaaactattccgaggacttggttttcgggacattagatgctttaaccaagccttactagcaacgcaggcatggagactgttcgataatccagataatttatgtgcttgggtgctaaaggtgaagtactatccaaatggatcactaattgacacggccttcccttcaagttcatcgccgacttggaagggcatcgagtatggactagagttgttgaagaaagacttgatatggatagttggagatgggcaccaaattaaaatctagaggagtcaatgggttgcacatagggaaaacccagtgattctgtagaagaaggcctggaatcgtctcacgtatgtacatgagctcatgttgccggaaaccaaaacgtggaatcagcctttaatcagacatgtgtcacgcccagaaattcactagtaatttccgaactaatttgtgcattaaatcctcgtccaggaatcagccaaggtacacaaactgacaatttaatatacagattcatcaaattaactaaaacgataaatacttacttaagaggcacttagttctcaccatgaagaaaactgcagcggaaaataaaatctagcgaagctccggctccactcccacaggcagctcaactggggtatgagccaaacgtcttctccttctgaatcctttttcttcaactgaggtttgatggttattgcaaggtgagcatatgacatactcagcaagccacacaacaaatatgcaagtgcacaaggataccaaagaatggtataatatagggcttatttgcaaaagcagcatttagcaaacttttgagaattgtaaaacagtagagcaattaatcatcaatattaatcaacactgtacaacacacccatgctgcacaggcccaaccatcctgaacaaccatacccggctgtacagatctatctccaaaccaggaatgtaccattccaaaccaggagctaatcaaattattatcagttatagcatcttttattatggtgagaagtgtgagactaatcacgaaagacattgttagacccgcccataactgcgggcacggctattcgaatagttttactctggccagaggtgtaccactgtacccacaagacacagccccacgacatgtcaccatgcgcctcaataccaccacggtacctcggaaaggagctgtgacagtacccctcgcacaacacaatccaccacagtgcaccgttcctggatcataatcacccccttataaacaaggtatggactccccagcgacccccgtgggcttatctccgccacttctcagtctagtgctccgcaatgaaccatgctatataaaaggtaaagccgttgcccatactggcttgtggttggcacggttaatgtttcacaaccgaaactcatgaaccggtccttaattgtcatgagcacgaccatcaaaaccatgtgctcacaacccaccattatcaagttttagttgacaatttaattaattaaccaatcacgattgaccatcgtgagcttccattaaatatccataagtgatagtgaagcatgatttatcccattaatgagctaatgtttctaagcacggctaagcgggtataaataacatctagctgaaccaatccaatatataaggtccatgctagtcaa

SEQ ID NO: 68138 - DNA, 10023 bp, Oryza sativa
tgtgacagtacccctcgcacaacacaatccaccacagtgcaccgttcttggatcataatcacccccttataaacaaggtatggactccccagcgacccccgtgggcttatctccgccacttctcagtctagtgctccgcaatgaaccatgctatataaaaggtaaagccgttgcccccatactggcttgtggttggcacggttaatgtttcacaaccgaaactcatgaaccggtccttaattgtcatgagcacgaccatcaaaaccatgtgctcacaacccaccattatcaagttttagttgacaatttaattaattaaccaatcacgattgaccatcgtgagcttccattaaatatccataagtgatagtgaagcatgatttatcccattaatgagctaatgtttctaagcacggctaagcaactataaataacatctagctgaaccaatccaatatataaggtccatgctagtcaaattataacccataggaaaataaagtcatctttggccataattaaatgggaaaggctcaccacccaatgacattcgaaaacaatgcataagttgaaataaatcaatagctttaaacaggttcaacatgctcaaagggttgtttgggggatctgtgtgacttgccttacaaacaagcgtcttcaattcgtcttcaggaacttctccaacgaacgaacgatcctccgaaacaacgggaagtctaaacctaaaacgcaaaacaaggaaaaacactaataaaaaccaaatgaacagtacaattaaagttcataagggtagagtttgaatttagatgaattatgagacttgaacgacctcattccgagttcgtatgaattagatatgaattttacaagatttaattccaattaaacctattaaagaaaagactattccaaattgattaaacaatttacaaatgatttatagctgagacagaagattaaaacatcctccggaaaaagattagatcatatttagtagatgacatatattaaaaaggaataatatgtcattgaaaagagatgacaaatttatattaattttggatggtcaagatggcgctgatgccagcgatgacatggctgccatgcaggatcgacgaccgcaagcacgggaacggcagttaccagcgaaccacggtacaaagatgcaaacgaagggcaccgggagagagaggagatcaaggcgacccttaccaccacttacgcgaccacagacggcgagggagatggcaggcgacgaggcggcgaccttgggttgacgatggcgacggctttccggcgacgagaggcagcaaccgaagggcggacggtcttcacctcggtcctgcgatcccgagggtggtgacggtgagtgaaggcggcgatggacggcgacgaacggcgcggctgaagatggaacagatcggcttcacggtgacgacgggcttcccggggtcttcgacgatggggaagtggaggccggtcttcttctcctcgcaaactcaacggcggcagcggcgaccgaaggcgacgaccacagcgacggcgcggggctgctggagcggcggccggaggtggagagagaaggcgagcgcggggagagcgattccggcgagattcggcgcaagggaacgggtggccggggtagctctcacccttgcgaaacccaaggaggctacggcgcatgtcggggtcgaccgagaaggcggcgcgacgcggctggagggtcaccggcgtcggcggcggctagggcaaggcggcggcggcgctacaagcgacggctcggcttgggacttgaggcaaacggaagaggaggccgaggggatgctatttatagccggaagagggagagatcggctcgggaacggatggaatcggcgacggattaggtagggttcgccggaaaaaggaaggatttgatccgcgaaattggaaagaatttccatataaacttttggggatttcttgggggaaatgaagaggagattgagaggattccattcccacaactaatttggaaataggagcaacggagaggacgaatttgatggggaggcggcgctgtacacgggcacggcagggaggatatcggccggctggaggttaggggcgacactgtagcagagggggacaaaacagacttatttccgggcttcatttcctcggcccgattgaaggaggaaggcaaatagaacttcgtcagagagaggaagagaagatgcaggctcgggttgggccggcggaagagagaggaaggaagggaatgggccggattcggcccgagacaaagaagtggattttgattgactttttaatttaaataattgctgaaatgatgtttcatttattaaaaatacttataatgctcaaataattccgggaaaaatccagaaaatatttggacactaaaaatatttaataaagttttatctatatcaatttaatgttcaaaattttcatatattttattcaaacacttactttaattattaaataaattctaaaaattcctttttttacaacaatttataatatagcgattttcagggtgtgacatagtccaggaaaatgatgcatccgaaattctgaagatcaaaatacctggaagggagatgtcggactttccagcatggcatcttgagaagacaggaattttcactgtcaggagcgcctataggttagcatggaatcaatcagggaaggctcgtgtggaatcttcatctagcacggcgacaaatggtgaaaggaagctttggaagaatatatggcaaacaaatgctcaaccaaaagtgagaatttttgcatggaagctagccaggacagattgcccacttggggaaataagggcctgtttaattcgcgaaaagaaaatttttgggtgtcacatcagacgtttgaccggatatcggaaggggttttcggacacgaataaaaaaactaatttcataactcgcgtggaaatcacaagacgaatcttttgagcctaattaattcgtcattagcacatgtgggttgctatagcacttatggcaaatcatgggctaattagactcaaaagattcgtctcgcgatttcccccctaactgtgcaattagttttttaaaaaatctatatttaatgcttcatgcatgtatccaaagattcgatgtgatgtttttgggaaaaactttttgggaaccaggattcttgtggttccggggaatccagctacaggagaaccaggaacggggagctctcccctgccctaagagaaagagaaagatagaacagagtggcatatgcccgatctgcgggatggctgaagagaacgggtttcatgtacggtggagtgcactctagctagaggtttacgggaggcaatgagaacacattggctattgccggttgaaacgagttttgcatatacagggccggactggctgttagtgctgctggatagttcgcagtgttcagaaaaggcacatgttatgtatttactctggagagtttggcacctgcgaaacaacatgatccatggcaaaggaagtgcatcaattgctgatttggtcagtttcttggttagctatgaaggccaactgttgccaatccgacaacaagaagatgaccacaaaggaaagggccctatatacatggaaccgaaccagatatctctctctacaagtatcagcaaactgactgacaaatggtgtccaccgccggagcgcttcgctaaactgaatgttgacgcaggttatagggaagaaaccggggatgctagtgtcgggtttatatttagagattgcaggggtttggtgctattggcggcccaaagaaccctgcatcaatgtggctcagctgtctaggcattggcgctagcatatatcttgagggactcagagcggcgactgacttgattcacatgcccattgtgttggagatggacaatgcataaattgttagggatttaataagaaaggaacagctgaaatcggcctgggcgacgacaattgaagatattaaaggagtgatgcaaagtgcaagtgcacaagataaagagagaagcaaatagggtagcacatgttttagcacaaatggctgtcttgagggactcagagcggcgactgacttgattcacatgcccattgtgttggagatggacaatgcagaaattgttagagatttaataagagaggaacagctgaaatcggcctgggcgacgacgattgaagagattaaaggagtgatgcaaagtgcaagacttgattcatatgcccattgtgttggagatggacaatgcagaaattgttagagatttagtaagacaggaacagctgaaatcggcctgggcgacgatgattgaagagattaaatgagtgatgcaaagtgcaagtacacaagataaagagagaagcaaatagggtagcacatgttttagcacaaatgacaatgagttgtaggtcctacgcggagtggaggttgtgtgctcccgcaagaattctagacttattaaatcaggagtgtaatcccttatttaagcattaataaagctctctttaccctcatttttttttgcatgtgctagaatcgatcgcagaatgaatacgaaaatgcgtgtgccatattccgttctactccagttgggttgaggccatggcttgcgtacatggtggatttgtgggcttctcgttctgggccagaggaaacgagggacccaacataagaatataacaggctgtgggctcgtgggctcaattttaatacttcccagctagcattcgacaccgtttttggatttttagttttccaaatttatttctgtttgttttaatactttgtcaagcaatcaagttataataataaaatataatgatttttttttaaaaaaacagtcaagataggtttgtacttacacttagctcttatatggtttattaactaattgagtgaaatatagtttgggccatttttatggttgaagattcactttggacctccttttaaggtaacattttcactttgcaccattttaaggccctgtttagagtctaacttttttttccaaacttctaacttttccgtcacatcgaactttcctaaacacacaaacttccaacttttccgtcacatcatttcaatttcttcaaactttcaattttggcgtggaactaaacacatcctaactctattttcttttagccacatacaacttcgtctctggtaaagaagtagattgaacacaagtgtgagagattgccagcatgtggatgtaagtgcgcttgaggctgttgatgtgcttgagaaaagagttgttgtggttcaaactgtaataaaggtagatttatctagtccgaagtaaaaatattagataaagatagttcaacgtaaaacattggcaataaaagttagtccgatccaaaccacagttttaggcatttgatttcaagcttcaaattgtgctcgaatttttttatagttttttatggattttttttgagaaagagagcgtaagctccccatttcattaacaaaatgcaaattaccacatgttcagtacagagttcagaaaactaaaaagaaagaaaaacttgaaatatataatatataacatttcattaactaaagttcagagttttttatggaatatataatatattatgagtccctaatatggatttgacaccaacctctttaaatttagttttaattttcttcattcattgtcacgacgttccaaggtcttatttaatctggaagaagtggaaaatttggctcgtcgatcgtagctcaaaataaccatggttagcattcgaatacgactacaaaataaacatgacatacttttcaaaaaaaataaattgtgaagcccatacactagaacaggatcgcttatctgtgacgggctgaaagcatcatcactatcgggtaaggcccccgtcaatgggcaaaggtcactgatgtgaggaaaaatctcaatcgggcaaaagcccgtcacggatggatgttatctcaatcgggccgaaaacaaagcccgtcacagatgagtatgaccagtcaaaccagcgtagtaagaagcctgtcacggatgactaatctcaatcgggcacaccactaagcccgtgacggatgagtagtcatctccatcgggcatttagccagagcccgtcactgataggtttgacgccacgtgttgagtcaaactagtcccggttcggacgacttatctctatcgggtgtattctaaaagcccgtcacggatgactaatctctaacgggctggactctatagcccgtcacgggatgagttatctctttcgggcattagctaaatgcccgtcagggatgagtttagaaccaaaaaaaaaataaaatttgtctttttggctagcctcagacctttgctagccatgcccgctgcaaaaatgacagaagcatatatatatacatagtcccattcccagcaaccccattcccagcatcaattcacatattccatcacagccatttcatatagacccattaccagcatcacatcagccaattcacattcatattccatcacagcacagtcaattcacaaaatcaagcacatatacattcacatccacaacccattcacatatatgtcattcacatccatttttctctccaaaccgccgacatgcatcaaaacctgcaaaaataagttataaattggaacaattttatatgtaactagaaatgcaagtatatacagagacgagctacctaggactttactctaaagaatataattgtattacaaagaatatttacaaaaatcaaatgtttgtcgcatatgcattgcaaatgttctgccattctgagacgagctacctaggacttcactctaaacatccctttcggtgacaagatatcatctagtatgaattgtgctatctcctctctaatgatttcgaagttgatttctggaatccttgaaataaattcctgcatgttcggcgccaagttagtctacatacttgtaaatttgtcgtcctatgtgtatataaacaattgaattacacaccttagggtcgagcaatgtcaccttgtctgcgaagctcctcatgttatggcagacatggaacccacactggttgctaacttgttgacatattgggaagtctttcttgtgaccgagtttgggatgcccatccttatgcctcccgcctcttgccacgtattggtcccatgcctcgttcaaggaagattcgatggccgaccaatcgtatatttctggcttgatattggagttaaggtagtgtaccaaactccacttcggcgttattaccagaagaatccaatgtcgcctgcgaaattattaaattgccagttacatactacagttgtacgcgttgagtatttgagtataagtacggtacacgcttactgttgattgtaggcgcacataatgaagtccttgtcttgacgggcaaataagcagtccttgatataggtcaccatgtttgctcgatcatttttcagcgttgtcacgttgacgacagctggatcgagtaaggcaatatggggtgctttacgatggacatgcttccaggttaacctacaagcaagacatgagtcagggtaagcgtaatttatggacagtcgctaccatatcgcgtaccaagaaatacttacaaggagtagcacttaaggaggttggtgtcgatcgctcgcaccctatagaggtcccatagatctttgaagtctacggcgatgaaggcagtaggcccgaggaacggctgaccatcgtgctggcccaacatggaggtctctctattcttcctccttgcattggacttctccctgtagtacctgtgcaactccttgcatgcagggcccatcttgaataaggcatcgtctccgaccaatggcatgcccaatgtgaattctgctggaggctttggaggagctactggtgccttgccaagatcaagcttctttggggctaatggcacctttatttttcctctccccgttccagcagcttttctgcgtgtgtcaagcttgggtggagaagatttcgccctcttgctccttttcgcagaaggggggaggtgcggcctgctgtcaacctccataccgtcgtcccaaaaatcagtatcatactgtaattggagatcttcatctctttgttcaacggcaggagggagagatacaacagtttgatggggatgcgtcggcggcggacgagaacttggcgctggccttggagttatattgatctcaatgttgtgcttgggccattgaataaaggtcccacgtgcagccccaagggtcagaatctcgtcattaggtgggtgtgggatagtgtagccaacccaatcgggcttcactaagtccacctgaactttggcattgccggcttgctgctgcgccccatgcactcgggtctccggggtaggcttgaaagcttgaccctctgcggcaggaattgcaaatcctggtgtcaccctaacgactagggtacacgatgtgggttcctgcgatagattcattagtgtccttagtatatgttgcaatgtattgtggtgctaatataatatatgcgttcctgcgatagattcattagtgtccttagtatatgttgcaatgtattgtggtgctaatataatatatgcgttattaagttgtttttaccgttatgtggtccaccgcggcggggccttcaggctgttctgtcggagcctcagttgatgcgcagctgctacgcctctgcgtggggctcacttgtactatgggaccgggagtggcatcggtcgacctatccctgatgcgtgcctccatccgagcctccatatctaacagctcggcagtgagctcttctctaagctcttctttaagctcctcccgaagttgggccttaatgcgtgcagctttctgtgccttggaaagcttgtgcttcttgtactgccacgcgtattggaaaaacccaaacttccatggaacattggagccaatgcccttagtttgtccacggtgttcttcatttcccaacgctttcgtgcggatgtcatcctcgcgtttttgtgagcatacctcttgggaggcctgtctctcagcattcagttcgacctggggtacagttaggacgcgttagacgaagaacaagatacaacataatgaaacttattctatgtgttcaatttacgattttctggtacaccgcttgatcttcgggatttggaaacgaaagagttccgtcactattcttcttcacccttgcccttgcccagttccttgcccgctggaccgggatatcagcaagcacttgcggggtgttagattccgctgcagcttcatcctcgttgtcccattctgcctgtttccccgtgtagcctccggtgccaagccggtgcgggtgaaggttccttgcctgcagatcacggtaggtctggcttttttctcgagactctttcgtttatttggcggcatggaactcatcccacacgggttgggtgatgaatgggtatttcccaaatggttctggctgggcggggttgaggacgtactccgtgtccagcgttgtcttgaaatttttccaacaattccccatcttgcggatagcctgccgcttcagtcctgcctcggcctctgtagggtatcagaagctttccttgaactacctccaggcctcttctttttcttcttgagggaccagatcgatgtggtccttcagaatagtgaagttccgcctccctaggactccgcatatcgtagggaactttttgacagctttcgtcggagccgtcggatatccaacatcgtccacctctgttatggtgtagacttccttagtaatcttattatgggtcctaggattctggctcgatgtagtcccagtagtggtcatcgacatcggttcgccttgctgcgacatgtcctatgtcactgttgtacgggagaaagtactttttaaacacaaaattgcatctatacacattctcttatggtttgatatacctctatctcctacctgcgttcgcctcgtcgatggaaccatagcatccatggtcaatagggccggag

SEQ ID NO: 68139 - DNA, 3783 bp, Oryza sativa
tgacatgatgttgaggttgtgtcttgtgggtacagtggtacacctctgatcagagtaaaactattcgaatagccgagcccgcggttatgggcgggtctaacaatgtctttcgtgattagtttcacacttctcaccataataaaagatgctataactggcaataatttgtttagctcctggtttggaatggtgtattcctggtttggagatagaactgtgcagccgggatggttgttcagaacgattgggcctatgcaacagggtatgttgtatagcgttggattaatattgtttaattactacttaactattttattaaattctgaaatgtttgtaaatgccatttatgcaaatgaaaccatactatgccatcctttgttatcctgtgcacttgcatatttgctgcgtggcttgctgagtatgtcatatactcaccttgcaatcattcatcagaggaggagttctacagtgatgctgagggtgtggaggattaggtgtagccctggtcaagctgcctgtggagtggagtcgtttgcgccgtttattttaattttccgctgcttagatttttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaagttggtatcagagcccccttgaccctaggttatgccaaatggttacctatagaagccctctaaaaatattggaaaagtagaacttatctcctctctttctcttttaattaaaccaaactaatggcacatgcagtttatatttgtttttattgttctcacttaaaatttatttactattcctgtgctgttagtactgtacatctattaccgtgctaatggcccatttaccatcaagagttttataacaatgcttgatttaattttgctgcaatgagctaagcttagtataatgattttataacctgttattcaaaagtgcaaagtttgtgaacatgtttctgactgcttcatcttatcatgcaagcttggtttatttaccttttactttgattttctaactctattcaaattaatccaaaaacttgtgctattaattggataattgacttaactccctcctgtcacttgtctttagatgccgcgctacaagcctgagtacttgttcggtactgaaggatttgtccaggagttgcgtacgatgtccttcctcatagggtttggaattgcccctttgtatgcccagatcccgcatgatcgtgatgaagaaaaatgcggagtcaaagtcaccttgaatagcaaccgtgaagatattccatcagtgatgttcgaggctggaggaggaagctacattcatgcttgtcaggaggtggcaaggatcgccataggagaactccgggaaagctataatgatcggttggccgacaccgagtaccgctaccatcctcgtcaaccccagggaagtgattgtggcagctactttgaaccggctgggatcgagaacgacgctaccacaaggcatttggttgagatgctatgggctatggatgaaacccgcgctgagattgtaatagccgctcaagatcgtgaagaccggaatagggggaagatctgcaagctagaagacaaggtggatcatttggagaaggagctagccgcgttgaagggagaagcaccaccgcagaaggccagagtccgtctaccgcaaggaagagagctctattcgtccctcgctatcagttggcaccaaaggttcgtctggtggaaaaagaagctaccccagcggatcctccggttgtcaatgtaagtgatgatgaaaaggaatccaaacgtacccattccaagatcggtgggggccaactcaagatgatggggacgtgccgaacgagccttcaatcaactccgatgcccagaagacctagaccgttttgctagtcgttgccttagaacgttgtgttagtttgcttgtttaagtttggttgtgtgtgtgggttctgcgtgcgtttacatcattggtgggatgtaaatgcatgtctttatttgcttttgagtgttaggaagttggtgagttagatggtgagagagtcttcagctttgtaataatgaaactcagttaagatcaataaaagttaagttaattaatttaattatctgtcctaagtagttctcccctgtttctcttcttgtgctcctgtctatgtcagatggtgctcactcgcagcaacgggaacggccccaacagcaacaataacaacaataacaacagcgccgagaatcccacactcgctcaagtcttggcccaacaggcacagttgatgaacatgatgatgcagcaactccagaaccagcagaaccagggaaataaccaccatgcacctccctagaacaagctggcagagtttcttcgcgtgaggccacctgttttctctagcactactaatcccgtcgaagctggtgattggttgcacgccatagagaagaagttggatctgctccagtgcacagaccaggagaaggtctccttcgcatcacaccagctgcatggccctgcttcggaatggtgggatcacttccgcctcaacaggactacccctgaacctatctcttggcttgaattcaacgctgctttccggaagacgcatataccctcgggagtggtgtctctcaagaagaaggaattcaggtcactcacacaaggttcccgcactgtcaccgagtatctgcacgagttcaatcgtctggctcgttatgctccggaagaggtgcgcactgatgaagagcgtcaggagaggttcttaaaaggacttaatgatgaactttcctacccacttatgactggagattatcatgatttccagaagttagtggataaagctattcgccaggaggacaaatacaaccgcatggagcagaagaaacgccggattgctcatttcaaggcacagcaggggaatagtcaaaggccacgccttactttgggaccccagtccatgccacagggaggttcttcgtctgttgttcgtccgcagcgatagttcttcaacaacaatgctggcaacaacatccgcaatcaagctccacgccctgttgcatctccaacacagcaacagcctgccaagagggagcaaggcagtaagcccggggtgtgcttcaactgtggagacccaggacattacgctgacaagtgtccgaagccccgccgcgtgaaggtcgtccctgcccagaacaacccctccgcacccgcagccaaggctcgtgtcaaccatgttgctgctgcagaagctcaaggtgctccagatgtgattttgggtacattccctgttaactcagttcctgcaaccgtgctttttgattctggtgctatgcattcatttttatccatgagttttgcgggaaatcaagggatggaggtaaaggaacttagacgtcctttgatggttagtactccgagtaaccaagcactctcctcacaacgtagcccctctgtcagaatagagatccaaggtgtacctttcctggccaaccttattctgttagaatccaaagaccttgatgtcatcctagggatggactggttagccagatataaaggtgtgatagattgtgctaatagaaaagtaactctcaccagtaatgatggtcgagttgtaactgttcatgcattatcttctgagtctataaggtcacgtctgaaccaattga

SEQ ID NO: 68140 - DNA, 4583 bp, Oryza sativa
tcggcggcgtggaaggcaaggcggtcggtgaagaggtagacgcccaacacgggggcataaagcccagccgtgcaggcggatacaccagtcggcggcgcagaaggcaagccggtcggtgaagacgtagacgcccaacaacggcggcataaaggccagccgtgcaggcggaaacaccagtcggcggcggacgaggcggccggttggtgaagacgtagacgcccaacaacggtggcataaaggccagccgtgcaggcggaaacaccagtcggcggcggggaaggcaaacgggtcggtgaagacgtagacgcccaacagcggcggcataaaggccagccgtgcaggcggaaacaccagtcggcggcggcgaaggcaagccggtcggtgaagacgtagacgcccaacaacggcggcataaaggccagccgtgcaggcggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaaatcaagtattttaaaatatttataaatatgtatttctcctcttgtcaattttgatttccccgagcagatgattcattacgtttaaacgctctgtccgactagtcatagcccccaagcaccgggagtcggcctaggcacttcccagacatgcatatgagtgacatgagttcgccattaatggaacaaagtttcacggattagaatttactactcaggtacttttgcaattattaagagcaaaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaaggaatcaagataaatattatgaaaattgtttaaaaaatacgatataacatctatagcccccgactcactagtcaacggcgaaccagttgatgtagtgaggcaaaggaaaagacaaaatatcatataaagaataaaataaatgatgacttagctttgtaatattccccttggtgatggcatggacgcccatgaacggtggtgtgaccgaccaaccgtataggcgatgacaccagtcggcggcgacgaaggcaggccggcggtgaagtcgtagacgcccaacagcggcggcataataggccagccgtgtaggcggaggcaccactcggcggcgacggaggtaggccggcggtgaagacgtagacgcccatgaacggtggtgtgatagaccagccgtataggcgatgacaccagtcggcggcgacggaggcaggccggcgatgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagtggtcgacggaaaggaagtgaaaactcccaaagcgaaagcgaagtcggcgactcatgaaattgattccatcgcgctcgttgataggaaactcgacgcaacccctacctggcgcgccaactgtcgaaacatgatttcggcaataataaaagggggtagcatacgagacctaaaagtggatggatgcagagacaaaggatttagacaggttcaggccctctcaatgagaggtaataccctactcctgtttggggatttgaatccgccgggtgtgtattgatctgacgatcaggttgtctctcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccaagtcatgatctgttacatattccatacatataagttatcccctataactagtcggataaccatgccgtgtgggtatggggtacccataatctccacaaaatgtatgctaccctagcttgcaagcctgtgaggcaaattgcaagccaattgtttgatcagcttatcaagcctgtaattgtaaagaaatgataataatattgtctgttgttcaccaatcaagagaatgatcaatctcctcatagatgaacgtggtttgtccttttgtttaggggaaaagtataactgtcttattgatacataactggagatggccacaggagaatcacgagaataagcgcaagaaatagtatcgtatagtccatatggcatgtatgcaggtttgatcatagtactcgtttacagaataatgtaggcactgtttttgcaagtgcggttcactagattaaatttagttttgaggataaatcgaaaataccttttcatggcacccaaacgaagccttgaatcaatgggcaaccttttcaacttgggtctgcgtggcaggccaaattggaaccttctgtattgtaccatcattttttacagtgtgcatctccttcgtttttttttaccatagtgtccatctccttcgttcttaagcacaataatattatcacaagcaatctttcccccgtgaattatcgcaagagtttatttatagttgtacccctttaaagaaatcatgatattgtaaccttaagaacgaaacttcctgataatgaggtgaataggcacgagctcgtgtgattgttccttgtatcaccagtttagtatccactatggagacaccattgtcacccttttttaccccatttcaactacaaacctattcgaataaaatgggtaatatagagatttgatgcatcaatttcattggactaacctgtttccacaaattttgtaaacgcggtaatcacaaggatatgtttggttttcaatacaatttcactctgcgtgatagattgtaaaaaatgggcgtcctggttaggtatttgtcgcgcccggaaaaagtgtctttttctgaacgctagtgtattaatccccgtcccagaaaaagccgggtacaccacacaaacatgatacaaaagacacatctttattatatcgttaatatttacattatttcaaaggcacttcaggcctgacaataaaaaataaacaacagcggactagcgggcctacggctccatcttcacaggcgctcaaatggggtataagccaggactccccacctaggacttcttctccaaagtttttcttagtgaaggggggaaagatagagcaagaatgagtacaaccacagtactcagcaagtcacaccggtagatgtattattaatgcaagggggtacaaggggtaataatatagggtttaagttttgcagtaaacaacatttaaaagtcacttagttgctcaaagctattttgtaaagacgatcctagagctacacagtattattaatcaaggacgtgaacccacacgaacttgccttaactcaaggcctacgatgattcagactgaactggcaacccgacctgggtcccagctcgtcccaagccaacccaggacaaccattccacattttagttgttaagcaaattttaagaattaaaccactaacttgggtacattgctaggcttgcctataaccgagggcgcagctattcgaatagattattgtcgcgtcccaaatcgactctaaaattcatcctcgaaattgtgcaaagaataattaaaattcatgtgaaagcctccaacaattaaaatgtgcaaagataaaagtcaaatgaggcttggaggatttttgtatatttcctaaaagcctaaaatgtgtaaataaattttagtggaattttcagagcacaaataataattgaaaagaaataaacaaagttaaaagggttttataaaaagaaaaatcctaaaaagtcttctttcccccccttctttcttgggccggctcggcctagtccctccctctctctctctcttcccccgcggcccatcggcctcccccgcgcgcgcgccgctgacaggcgggcccgcccgccactctcgctgacgggtggggcccacctgtcatcgccttcctcccgccgcgcccgccgccgcgcccgtgccctagcgccgccgccgccgcggattccgccgcatcccgccgtccccgcacgcattaaagagggggaaatcactccccgtgattccctctcccgtttccccctcttttccctctctctctccctcggattcgtccgatttgaatcccgcgagtttcgcaggcttcttcaatggagccgagatctccgcggccgattcct

SEQ ID NO: 68141 - DNA, 2795 bp, Oryza sativa
ccttgattaataatattgtttagttctaggatcgcgtttacaaaatagccctgagcaactaaatgtctttaaatgctgtttactgcaaccctaaccctttatattataattcccttgtactcccttgcatttattctgcatttgtgggtgtgtcttgttgagtacggtggttgtactcagtcttgctcaatttttcccaagtccagaagaggagctccttgaagatgaaggttttggtgtctagctcgtgcctgccgtcaagcgcctgtggtcgtcgccctagtcttccgctgcttcttcgtttgtctttgtgtgttgggccttcgctgcccatgtaataattctatttacgcttccgcttgttaaactctgaattgtatcaacttttggtgtaccttgcctcctgggacaaggattaatgcacgcacgtcaggaacgcccgttgggttatttccggtcgtgacaagttggtatcagagccacccttgaccctaggacgagccgtagatcccaagccttagcgatattttcaaaataaaaatctttggttatttgtgaaaattgtctagtctctctctgtcttgctgcttcatttatcgccaaaatctgatcttttaaatgttgtttctctttttgtttttgtttgtagatggccggcacagtcacccgtcgtggtttggatatgactggcttcgttttggagctgcgaggcatgtgcgtggtcttggggtatccacatggagtggactaccaggccaggccacttccggatcaggagggtgaggatgcagagcctcacgctggttgggaggtcactgcagtgatcctctctggctctcctgagcggacttcgctggcagtcaccgcgggtggagactccttccccgccgcttgccagaacgccgctctcctcgccatcggcacccttcaccagcgctacccggacgagttgcagcactcgccctaccgctactaccctcgtcgcggaggagcccgcgactacgccaccttccgagatgctagctcggaggatgacgctaccgttgtgcacctggcacgcatggtggaggcgtacgacgcggctcgtatcgacttccatcagatggtgcgccgcgggatggttgagaacaacatgaagatcctggggctgcggcaggagaacctgcagctcaagaaggacctcgacgcgttggaggcgcagctgcatcagctcaaggtcgcccagggtgaggatagccgccccaagcgtcgccgcgtctgccgcagccagaagatcaccgcccgcaagagcacctccaggcctgagcttgttcgtcagtccctggcgtggacttgcttcgtcgagacccctcgtgccgagcctgcgcccgtggttcctcagtgtcgcgaccgggaaaatttccttttcccgaacgctagtgtattaatccccgtcccaggaaaagccggggtacaccacacaaacatgataaaaaaggcacatctttattatatcgataatatttacattattacaaaggcgcttaaggcctgacaaacaaaaaataaacagcagcggactagcgggcctacggctccatcttcacaggcgctcaactggggtataagccaggactccacctaagacttcttctccaaagcttctcttactgaagaggggaaagattgagcaagaatgagtacaaccacagtactcagcaagccacaccggagatgcacaattaatgcaaagggggtacaaggagtaataatataggggttaagttttgcagaaaacagcatttaaaagtcacttagttgcccaaagccattttaaaaagacgatcctaaagctacacagtattattaatcaaggccgtgaacccacacgaacctgccttaacccaaggcctacgatgattcagaccgaactggcaacccgaccctgggtcccagctcgtcccaagccaacccatgccaaccattccacattttagttgttgagcaaattttaagaattaaaacacctgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaatcccacctacggccggaacctccgggacaggcaggcaggactgagcccctagcagcagggcaccaaccctgtgccatgacatctcgactaccgggccgcagctcgtgtagccttcatttgccctggagaatgtccatcgacccccgacttcatccacctccatccgtgtacttttgtttataaccagactgagccacaaactaagccttacccactagacatgtggaagtacggtagtgctttgcaacagaggcccgagcttaatccttagagtggccggggtgctacttcccacaactggcatgcacccaacaaacatgttttaggggttttgaaagaggaagagaggtgtatgtccaattccaccataaaccaacaattccatagtgtccaaatgatatgagaattcccaaagtctaaaattataaaaccacctaatgttgcctaattaatcagcgaagcatctacctaaattcatactagtggaaccatgaatagagtacccactagttgggggggttttgtttatcctagggtgaacaaggtaataataacaatagcaacaattataagggccttaaca

SEQ ID NO: 68142 - DNA, 6210 bp, Oryza sativa
ctgtggttgtactcattattgttcaatccttcccttttcaagtaagagaagcttggtaaaagaagtcttaggtggagtcctggcttataccccagttgagcgcctgtgaagatggagccgtaggctcgctagtccgctgctgtttattttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttataaataaaactatttgcgaaagttccttttttctccttcccctaatgctatttgcaaaaggtttactcccttcttccttcttcggatttcaactagtactagatggtcagctttgcgaagaagaagatgtcgccaattgtttgccgaagctccggaagaccgcagggtccgctagcgaagtgtaggaagcagtgaagccagctgtgaaggagtgaagatcttggagaacccgtcgcagaacctaagccatcctgtagggtagtgttgttagtcgtgtgttccttgcttgtgtgtgtagcgcgtggtttgcatcggtgggttgtgatgtaaccatgctaggttgtttgcttaatcaacttgcggaataagcaaaacaaacaacacatcaacaagaagagttagttcctttaaggtcctatccttagtttctaacctgtctctcccctttgttttccctctctccctctccaaacctgtcacgtcctgataaattcatcccgaaataaaaatcattctctaaaaggaataatagaattaattaaaattcgaaaagaaattggcaaaccttaaaatacgtacaagaaaaattcaaatgtgacccggagaatttttgttaaattctccttggtctaaaaggagccctcaaattttagtggaattttcagagcacaaataataattgaaaagaaataaacaaagttgaaaaggtttataaaaagaaaaaaccctaaaagaagtcctcttttccccccccttccttcttgggccggctcggcccagtccctctctctctctcttcccccgcggcccatcggtctcccccgcgcgcgcgcgctgctgacaggcgggcccgcccgccactctcgccgacgggtggggcccacctgtcatctccctcctcgcgccgcgcccgccgccgccgcccgtgccctagcgccgccgccgccgcggattccgccgcatcccgccgtccccgcgcgcattaaagagaggggaattactccccgcgtttccctctcccgattccccctcttttccctctctctctccctcggattcgtccggattcatcccgcgaagttcgccggcgtcttcaatggcgcccgagatctccgcgcgcggtttcctctctccccggccgcgctctccccctcccgttgctataaaatcgtccctcgtgcttcgctcttccgtttccgccgctcgccgctcgctctcgccgtcggtttcgtgcccgcgccgtgctcctctctctccgccgtcgccgccgagctccgtttcgccgccgtcgtcgctccggtcctcctcccgactcggcgccacctccatcggcttcgccgagtggttgccgaccccgtccgccgctccgcttcgcccgccgaccgccggagcaccgtcgacatcggcatcccgaaccgcgccgccgcttttctccactccggccgtcgtttccgccgtcctcgttgtcccggggtgagccgtggaccgtccctctcgcttccctctcctctccgctctctcgggcgccgctccgccgcgccggtggtcgccggcggtgaccatcggggcgcgggcgcgccgctcccgtcggccgtgccggcgaggccgccttcgggcgcgccccgcggctgccaggtgggcccggccgtcagccgcccgcgcccgcgggtgcggctgacgcgtgggacccacggcgccgaccgccgccagccgcgtgctcccggtccaccgtggaccgagaggctgacgcgtgggccccacttcccgtggacccggtccgcgcgccccctctcccggctgacgcaataaatggaatttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgttcctgctgttatgtggagtttagtagtgtaaaaagccttttcttttccgttggtcgtgtagacgctgcagcttcggaagatccgctcttcgtggaagttgaagccggcgtttgggaaagcgagcaaggcaagtcacatcacccttgagcatattgaatcccagtttataaaattattttgatttaaattattgcattatcgctttgtttaaattcccgcgttatcactgttttatttagccatgcctatttacctttgttatgacattattattgctattgttattattaccttgttcaccctagaataaacaaaactccaactagtgggtactctattcgtggttccactagtataaatttaggtagatgcttcgctgaataattaggcaaccttaggtggttttataactttagactttgggaattctcatatcatttggacactatggaattgttggattatggtggaattggacatacacctctctttctctttcaaaacccctaaaacctgttttcggtggggtttgggtgcatgccagttatgggaagtagcaccccggccactataaggattaagctcgggcctctgttgcaaagcactaccgtacttccacatgtctaatgggtaaggcttagtttgtggctcagcctagtcataaacaaaagtacacggattggagatggatgaagtcgggcgtcgatggacattctccagggcaaatgaaggctacacgagctgcggcccggtagtcgagatgtcatacggcagagggttggtgccctgctgctaggggctcagttctgcctgcctgtcccgggtatcccggccgtaggtgggattgggtcggtactcttgtctaaggctaggatgggttggaaactatgtcacatctttacgacgggttccaaggccatggaatgcggagtaaagatgtgtcttgtgggtaaagatgtacacctctgatcagagtaaatctattcgaatagccgagccctcggatatgggcaagccgagcaatgtacccaagtcagtgttataattcttaaaatttgctcaacaactaaaatatggaatggttggcctgggttggcttgggacgagttggaacccaggtcgggttgccagttcggtccgaatcatcgtaggccttgggttaaggcaggttcgtgagggttcacggccttgtttaataatattgtgtagctctaggatcgtctttataaaataactttgggcaactaagtgacttttaaatgctgtttactgcaaaacctaacccctatattattatctccttgtacccccttgcattaatcatgcatctgccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgtttgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaaatggataaaacctaaggacatattttataaataaaactatttgtgaaagttccttttttctccttcccctaatgctatttgcaaaatgtttactccgttcttccttcttcggattttcaactagtactagatggtcaggtcagtgaagaagaggacatcgtcagttgtttgccgaagctccagaagactgcaggatctgctagtgaagtggaggaagcagtgaagccagctgtgaagcaggagtgaagatcttggagaacccgtcgcagaacctaagccaccctctagggtagagtcgttagtcgtgtgtttccttgtttgtgtgtgtagcgcgtggtttgcatcagtggggtgtgatgtaaccatgctaggttgtttgcttaatcaacttgcagaataagcctaacatacatcataacagcaaaagacttagatctgttaaggtcctatccttagtttctaatctgtctctcccctttgttttccctctctccctctccaaacctttgcaacagatggctgacaatgagaaaggcaataaggtcagaagtcaggacattggtacctcaagctcccgagtgaatgaagcaccagacaccagttgtgtggcagtggtccaacacctgattaaccagaacaaattgcttatagagatactacagcagcatcggatgccaattttgaacccgagtcagatgcaacctcaagtgcagttggaggcagtccaagcactcacaccacaagtcagcgcaccgccaacatcccagaaggcccctcatgccatgccacatgttgacccaaaagaagcaagtatcatctgttttatgtgtgatgagcaagggcactacgcaaggaactgtcctcagcagaaaagaaaagcaccaatgcgaaccgaagatgaagtccgtaagatgatcattaccagcacagaatggcctccaccaggaatgacaaaacatcagagaagaaattccttccgaggtgcacaacagttgacagagcatcttttagctaatggaggtagagtgtctgatagtgaagattcagatcaagtctcctcagatgatgaaggtgcgaagcctccccaaggttttaaccagaataaaatagaacttaaggcatgctctcgttgtggagaaatcggtcatgttgccagctcgtgtgcctctacatgcgttcattgtgaggaagaccatccacccgacaggtgtccaacgagtaggatcacttgtttcctttgtgaaggaactgatcatgtaccaaaagattgtcaattcagttttctgctgacgaagaagatggccaaccaacccgccagttccaacggagagaagcatcaaggaaacacaaatcctcgccaagattccagtttcagcctaactccagtgccaggacagaggaatcgaaatgagaaaagaaaatgccgagtccgggaagacatctgttgcttcaattgtcaaggaatgggtcatttcgccgacaagtgcccaaaaccgagaaacgtagctgccggcacgtcagtccacgcaactccctgcaatcagaagcttgctcctcaacgaattgtcatccatgcatcccgaagcagtcctatagcccgcgttgcaacaactccaattccaatgagtgcactaccacaaggtgtcaatgctcaatttcagccccagccaccagctgacaagacagaggccagtatctgcgttgtacctttggaagttccaatacagcagctgagaaatcaagtacaagatgaagaacccgagtgtaagaaagttattgtttgttacaactgcagtgaagaagggcattactccaaaaactgtccccaaccaaggcaaaatcgacctccacattaccgccaatttacacgaagcagacattccaatcgtattgtggtcactggagcaaacgccgtacccgtaaggcctcgtgttaatcagaacccatagcagaaacaatgcaccaatgctcctcctgctgcacctgactcggcaataaatcttagcaaccattctctgcatcgacagcctcagcaaagaattgttgtagatggaagaagttgtgtctctccccgacctactccaggcctagccaagggcaatcaacctccggagggcgataccaagcagaagaccgtcatccgcttcaaccagcaatcagaagg

SEQ ID NO: 68143 - DNA, 524 bp, Oryza sativa
cacatgacatcggcttgaaataaatgatatgtcatcagcacctagccgatcggctatcatttataggattaattgcggtttctttgttctatctcttgttgattgcaggatcaaatcaactggcacactcatacatccgaaggcgagctttggacctgcactggagttaagcagatctcccaggcctcgtgttttatatcaacagttgtctgcaggtttctccctccaccctccgaattccttctgctggttttgaatttctatgggctttctcttctgcatttgaaccccaattccattgctttccttagcgtctttgtgcatctttgcgaggcctacattggggtagagccctttcttgatctgttccgcttttactacgagttgcgctggatggaatccaatagggtatccggttgcgtcgggttccgacttcgtgatggcatgaagtcgcattatgtccccttccaatgtccctcttctcgcaacaaatggcggaacaggtggttttaccttgaaatcaa

SEQ ID NO: 68144 - DNA, 591 bp, Oryza sativa
gggcgtgtcacatcctcgcgtgtgtaaggttgtcgcgccctgaactcgatctgcgtgatatcttggatcagggggcggcaagcgacacgcgtaaggaggtgatgaaaaaagtcagtgacctgggggagtctgtcctccccctttttaaagagtaggacttcttgtattttttataatttgcaaatcttgaactctggttgctttcgggcgtatgattaccatccttgttcagtgttgatttcgaaagtttttcttgtcgattgtagagatgctggtacgaggatgttcagcagcgcgggtagcccgagtcactagcgataattccggtacttgagtttgaaccacgcgtctcacatgacgtcgaggaccaaactcttgatgtggaggtcgagatggggacaaccacctcaagtgagtagcctttttaacccgtgttgggttagtggtttccaggttgtcttagtggtcgttatgtttagcagatctcgaggatgcccttgcaacccaagatcgtcgtatccaatattagaagacaaaatttgaagtggcggaactctcgagaaccatgctagccgtgaagaaagagcaagt

SEQ ID NO: 68145 - DNA, 896 bp, Oryza sativa
gctaaaattgacaaaaatggttcctaaacttcctatcgtccgttcgacaagaagcccaaatcccaaacgctttaactaggcgggtctcaccgaatctttatctactcaccaaacaccatcaacacatatatttctccaccacacactccaatcttatcccatctctcccttatctctctccactacaacactacctcatcacgagcagcgacagggctcttgtcctcgacggctatctccttagcttactcaagggcagcttggtcagcctcggcttcctcaacgacaacgtggcataacatcagcggtcacttgttcccaacagctacgcgatgagcttgaacttggcttccacaatgatccatgctttcatcaagtgtggcgccgcataattgcagcatactagtgtcgagttcggcgacagtcagtcactggagaggagaaataagtactttagactgtttttttttatgtttcagccaatatgtttttgatgttcctttgtattggatcaaaatcttgcagtgaggttttttgtattgtttcatattctgtccttgaagagtgagattcgtggatgtttcaaacgctacactaaaatgttttaccatatgattcaattatgtttcaccaaaatacacaatgattatagcactttgcctttgcttaagcattggagtatttatgtactccctaccattgcatgtggctgcaaggtcagtaatcacagtaacctactctactagaaaatgcatttttcccgacgtggaggtcttattttcacagtcggacatgactcttggagccaaatgaccgtctaaaaaaaatataaatcggcatgacgttcgctgtccgcctgcaaaaatctattttcgcacgcgcctctttttcacagg

SEQ ID NO: 68146 - DNA, 3440 bp, Oryza sativa
agccgaattcacctgaaaacctcttgtacgtcctccattagctgttccgacagctgtgtgcaccatgtttacaggaaaaggattaccatcaaccttcatcggcctcttggaatcatcaaatttgatcttgcctccttcaatggctactagaatttgttgcctgaagacttgtaatcattagtagaatgagacccagagttatgccacttgcaataccttcttttgcctaattcctcggccgatggaatcgtatgaccagcggggagttgaatctgcttctctcagagcaacagatcaaaaatcttgttagccttggttatatcaaagtcatacctctcctcttttctagaattctttaccccctagcatggtataacctttttacttcttacccattcagctgcagctatttcacagtcatcatcatcattatccgatccatatatgtaaggacaaacatgattaacccttttagggttctttctggcttctgcagacctctgctcgtgcagggttaccttttgtataagatgtgacaagctatcaaagtcctcagatgagaatatttccctgatcggagcaatcataccctgaaaagccaaaacggctaactgggcatcagtcaaattcaaactatagcacttattccccatctctctgaacctttggatatactcatgcataggttcatcatgcctttgcttgattgctgttaaatcggacaatttcatctcatgaaccccactgtagaaatagctgtgaaattgcttctccaaatcggcccaagtgttgattgatccatatggcacagaagaaaaccaagtaaaagccgatccagacaaggacaaccggaacaacctaactctcaaggcatccacagccgatgcttcaccacattgagctaaaaatcggctaatgtgctcataagttgacacaccatcttgccctgagaattttgaaaaatctagaactttgaacctattaggaagaggaactctctcaaaccactcagggtaaggttgccgatacaagtttccagcatctttcggcttaagcccgaactgttccctcatcacatcggtaatcacatcagcccacggtcgttgctgagttgctccttgcgactgttgttgcttgggctcgaattgattgtactgaagaacaaactgagattgagtgggcccccctgctgatattgagcttgcggcgaaggaggttgatattggtaattcaaattgcccccctgataattctggtagttcggctgaatattacgcaccgagtgttcaggaacaatctgaggtaccaccgtctggtccggctgcacatgatgaactaaatgctctgggacaacctgatttagagcatgttgtcctagctgattgttaggtgttgcaaacccagccgatgcattcattaacccttgctgatgaatcggttgaataacctgttgcgttaatggcatttgctgaatcgactgcaaaacctgccgtcttggtggcgtctgttgaattggttgcacaacctgttggattgggggtgtttgctaagctggttgcacaaactgctgccttggcggtgtttgctgaatcggctgctgctggactagaacaacaataggttgaggtggtaagaacatggccgcaacctgatcttgcgtagccgattcacatcctgccccctatgctgtggttgttctctcatcaacaaccgaggactaactagttggcctggtgccgacgtagacgcagcaagtgcgggagccgataccggtgccgtcggctgagctgatggcgcattgggaggaactgtttaaacagatggctgagtattggtgatcagaggccgataatctggaaagacacctccttgcaaataaactgggcctgtagcctgatattcagccattgaaccatcaaccattgatttcatcatgtttgacaaggtattgactaacaccccagactgattgatcaaagcattgtgcacggcatagtcaacccgatcttggaagttattgaaaagctcatgtgctgcattgccattctgactaagatttccaccttgtaatccttgggaattatcaccttgagaaccaagaccttgaacttcttgaaaaccatcgccttgatttccttgagaaccatttgcaacaccttgatcacctggctgagccataccatctggagcctgttttagttcaccatctttggaagaacctgtcccaggaacatccgcaaccaccattaatttatacttctgaaccaacgttcccttgcgggtctgtgtaaatgaactcaaaaattggttctttgcttgctgcatcattgcttcaagatccttatgctgttcaggtgtcaatttatccagagtgatgggcataatgttgctctcatcaacctcagacagacccaacttaaggatcttagctttgacagaatcaggttctctagccgaggacggtgacggtggcggtttctcggccatgaggaaaactgctgttgtgactctgacttctaatcagtcctatcaggcatgccaaaagcgtattgacagaaaacacgaggcctgggagatctgcttaactccagtgcaggtccaaaactcgccttcggatgtatgagcatgccagttgatttgatcctacaatcaacaagaaataaagacaaagaaaccgtggttaaatccataaatgatagtcgatcggctaagtgccgatgacatatcatttacctttgggccgatgtcatatgtacatcgatcgatagccataaatgaataaaaaggaactaaatctactcaatcggctgtagatattaacaatatataatccttatgtcgatatatacttaaatcaagtgattgggatagatcggtcgccatggggagacagtataaatcacttagatcgatataatctaagccaacgtcgctatttaacctaatcggccgccttgtgttaacagatgttagccgattgtaggttagatgacgatattatcaaagattatataagatatatgataactcgatgaattacataaacaagattagagtataataaagatgcaagcactaatcccgagaacgcaagccgccataacaagtcttacctcttgttgaagatcgaaaccgatgcagctcaacccaaaagcaagaactcatcgaaacaaaacaaaagtaaaagggtggcgatgcgccgagattgtattgatagtgtgtgttaataattacatagggctcggggtctatttatacccaagaattacaagatatgtccaaatcggacacgactattatctctaacaatctctaagataccataagtctttacgacagacttttacccacatttatctctaaagaatttacataaaatatcctaattaatagatacaattgccttctcagaactcaatccatgcgcggcaatcatattg

SEQ ID NO: 68147 - DNA, 9131 bp, Oryza sativa
catcagttaacatggtttttaccttgccagccgaattcgagatcaaacaaaccgatgttgacaaagtagaagaagaatcggctaagttggttctatcaccagaacaagcaatctttgagaagcctgaggggacagaaaatcggcatgctaaaccattgtatataaatggctatgtcaatgggaagccgatgtctaagatgatgatcgatggtggggctgcagtaaatttgatgccttaagctacgttctagaagttgggcagaaacgctgaagatctcatcaagacaaacatggtgctcaaagactttggtggcaatccatcggaaaccaagggtgttctaaatgttgagctgacagtcggcagcacaaccatccctactaccttttttgtcatcgatcggaagggttcttacaacttgttgcttggtagggattggattcatgccaattgttgtactccttcaaccatgcatcaatgcttgattcaatggtaaggcaacaagatttagatcgtgccaaccgacaggtcagtcaatgttgccagtgccaatttagctctttgggagatggatggtcttgattgcttatctggaaaagtttgggatggagattttctaaaatagtccgattctgatatacagccaattgaagatggagaacccaattgaagatggagaacccaggctattattttgaaggcgttgtggagggttcaaacgtctacaccaaggatacagtagatgatctcgatgacaaacaaggtcaaggtttaatgtcggccgatgatttcgaagaaatagatataggtccaagcgatcggccaaggccgacatttattagtaagaatttatctccagagtttagaaccaagctgatagagctctagaaagaatttagagattgcttcgcttgggagtattatgagatgccaggacttagccgatcgattgtcgaacatcgactacctatcaaactaggggttagaccgcaccagcagcctccgagaagatgcaaagccgatatgctcgaacctgtgaaggcggagattaagcgtttatatgatgctggttttattcgtccttgccgatatgctgagtgggtttctagcatagttcatgttatcaagaagaacggcaatgtgagggtgtgcattgattttagagatttgaataaagctaccccaaaggacgagtatccaatgccagtagccgatcagttggttgatgctgcttcaggacataagatattgagttttatggatggaaatgtgggatataatcagatctttatggctaaggaagatatttataagacggcttttagatgtcctggtgcaatcggcttatttgaatgggtagtaatgacttttggattaaaaagtgctggagccacatatcaaagggccatgaactatatttatcatgatctgatcggctggttggtcgaagtctatattgatgatgtggttattaagtctaaggaaatagcgaaccacatagccaatttgagaaaagtttttgagagaactaggaaaaatatggcttgaagatgaatccgataaagtgtgctcttggcgtatcggctggccagttcttgggatttcttgttcatgagaggggaattgaaataactcaaagaagtgtcaatgcgatcaagaagattaagcctacagagaacaagacaaaattgcaggagatgatcggcaagattaattttgttagaaggtttatttctaatttgtccggaaggttagagccttttacaccgttgttgagattgaaggccgatcaacagtttacttgggggacagagcagcagaaagctttagataatattaaggaatatctaatgatttagcccaaggggcatcgggatataagccgatgatcaaagatgttaagattgaagttgctgccataacagccgatgattggagatatgatgtccatcagtatttacagaatctgtctcaatcggcttcttggaagttaagatataaagcgttgaagtatactttgttagataatgagctttattatcggacgattgatggggtgttgctcaaatgttttagtgccgatcaggctaaacttgcaatcggtgaagttcatgaagggatatgtgccactcatcaatcggctcataaaatgaagtggttgcttcgacgtgctggatatttttggccgacgatgctggaggattgtttcagatattacaagggatgtcaagattgtcagaaatttggggcgatctagagagcaccggcgtcggctatgaatcctattattaaaccatggccatttcgaggttggggaattgatatgatcggcatgattaatccaccgtcaagtaaagggcataagtttatattggtggcgaccgattattttaccaagtggatagaggcgattcctttgaagaaggttgattctggggatgctatacaatttgttcaagaacatataatctatcgatttggtattcctcaaaccattacaaccgatcaaggttcaatcttcgtgtccgatgagtttgttcagtttgccgatagcatgggtatcaaattgttgaattcttcaccatattatacacaagctaatgggcaggccgaggcatctagcaaaagcatgatcaagttgattaagaagggaaaatttctgattatcctcggcattggcatactcgtttagccgaagcattgtggtcttatcggatggcttgtcatggatcgattcaagttcctccttataagcttgtttatgggcatgcggctgtattaccatgggaagttaaaatcggttcgagaagaatagaattgcaagatggtttgacagccgatgagtattataaccttatggccgatgagagggaggacttagttcagtcgcgtttgcgagcccttgcaaaagttaccaaagataaggaacgagttgctcgacactataacaagcaagtggtacccaagactttttcggaaggtgaacttgtatggaagttgattttgccgattggaactcgggataacaaattcggcaaatggtcaccgaattgggaacgaccgttccaaatctataaggttgtgtctaagggggcatatatgttgcaagggcttcatggcgaagtctatggacgagcgctcaatggtaagtacttgcagaaatattacccaagtgtttgggttaatgcatgatcggttagtgttgccgatacatgatagccgatgggtttgcatcgccttgggatgggcgatattgttatatcgcccttagttgtttttatgttgtaatcagttgaggtttgccgatttacaatggccgatattgttatatcgcccttagttgtttttatgttataatcgggcccttagttgtttttatgttgtaatcggttgaggtttgccgatttacaatggccgatattgttatatcgcccttagttgtttttatgttataatcgggcccttagttgtttttatgttgtaatcggttgaggtttgccgatttacaatggccgatattgttatatcgtccttagttgtttttatgttgtaatcggttgtggtttgccgatatacaatggcggatattgctatatcgccctaagttttaaactataattaaatcaatgcttttgacattgtaaaattaggggggcacatatatacaccagttacaaattttgacaatttttgagcaaatttggaagttatattaatcggcacaaaggattatcaagataaacatcagtagtatcttagccgattacaaaaatttctaaggtctattacacagaaagttaccgagacaaatagcgctggatagccgatatagctctttgcctaatttgttctacttcttcgatggcttgggcatcttgagcatcggttccagggatgacttttaaagacttggttagatcagcaacattttttatagccgattttagtcttgctttctgcttttcaacagattttgggagatcggctagctttttatgttccatgtccagattggcactgcattcttgaagttgtgccaggagctcaatctttcgagcttcaagccgatcaatattagacttgatcggaccttcagataactgatcaagcttggccttctcttcatgaacaagctgccgattggcctaaattgtggcctcgatgtctttgcgctcccgacgctcgactagtctcagcttggccttctccagcttgaattgatgctgctcgagatagacagctggagttaggacatcggctagctcatctgggatcagagcttgaatctcatgtagccgagtcctaattgagccacaatcaaccactaagctgtctaacgatgatgcctctagccgatgagagatatcttcaagaattttcttcacatcatcggataagggggctaaagctttgcttgtggtatcctcttctccttcatcaagatagtctctaatgtcaaaagagaaaagatcggctaagacatgcaataatgatttaaagagaagttagaggtcaaatagacatagccgatctgggtattttgtgtcaaagaaaagcttaccaggatagcaggagcagtcggttggacttcttcttcaacatggtgaatccctacagctgatggagtctggtcacttgatgactgttgtacaggagaaggaggaggagactgtaaaagagacaagtgttagacaaaatcggctgagatcaactaatgaaagaattaagatgtcattatagccgatttcttcttcacagcagtcttctttttctacaactacaaaatctgtgagtaatcggccataaagtaaaatgattgcaaaaaggatcaaagagagctgcttactcttgaaaagtgagctggagcaaaaggagttggaggggtctgcttgggtgaagccgatggtgttctttctgtgtcgcttactttggctgcggcttggtcaacgtcttcttcaatttcctcttcatccagagcttgttcaatggatggatctagggcaggcagatcatcagatggcttagttatctttgtcttggttttcttctttggagctggggctgaagtatctacagccgatgatctggtttttcttttcttgccggcatcggctggttctctgatgagcccttgaagaagagctgaagtcttgggggcatcatagccgatgacaggaggagatggtccacctccatttggaattaatcccgaggcatattcaatgttcctgccactgttactttggcgaggaggagagaactctgttgtctgcaggtcgaaaggaaagttagtcaaggttagtcggctaagcaactattcaaatgaaattgagtaaattaagacatacctgagggacaacatctggaaagagatctgtcatatacatagaggccgattgatggaatagatgcagtttccattcactccaccatctgtcgaatgctctgctcctgaaggttaccagctctatattatcaatgctgcctagagggggtccttggaggttaagcagccgatccatcattaaggttgacgaaatttcccctcagcactggatcttatcttcaaagaataagccgattgggagttggcccattccaaactgcctggcagaacttattggatgataaaattcataggagacttagatgtttcttccttgatgaatgccgacaggaaggatacatggactgattgcagctgaagaaatttctctgggtttctgatatctttcattgttgatgtcttcgaatatgaagtccaatggattttctagaagtgttgaatcttcatagaggaaccaaacttgagtatgtttttggaaaccctcataaaaattgcagaaccagtctttaagcagctcggccgatagctttgcttctgcatcggttggtatggaggcatattctccgtaagatgtgcatctccgatgagtacgttcttctccatcattgtctacaatcggctccagtcttggaaattcagcttctgttacagatggccaattgacaaacttcatgactaccaaattcagccaggactgcaatagccatcatggtccacctgctccgactactgagccgacagctaacttagccgatgcattgtttagcatttggtacaagtagccgagaagtatttttcttaaaggaaattgtttctttgcttctaaggcttcggctacaaactgccaattggttgtagggccacagcttgatccacaaaagaggaatttctctagccacattagcaagaaagccacatgttctcgaggggtgacggaaccctggcccatgtatgctgctacatagcctgaccagccgcctatgctcttggtcttgaagtcgtattggttcttcgtgttcaagctcatagagttagccgataaggtgacatccagacccgtgatcatgatgatatctatgagagttggggtcatcggcccttggttgaacaagaaggcgttgatggtgttggaccagaaataagaggcagttgccattaggggctcatccttagctgagttggctatggtgagatcgagtgcttggccgattccaatctcgtcccaatgaactcttttgctagccgacatgctcttgaaccatgtgatccaacttttctcgggtcgagttttctcgagggatggccaggatttaaggtgtttttccagtgacctagatctgggttggccaatctaaaaggaatcctattggtttcaccaataaagaactctgtgggatcagggttgccgactgggccgagaaagtagtagttttcatgcgataggctgggaattgcaactaggttggagagatgctacaaatccaaagtaatcgagaaagggaaagcaatataaggcgagagaaaatcgatctgatgctaagaaaggggatctagccgaccgggacttacctcagtgtactcgccgacggcgtggcagacgggctggcggaggacgacatcgccgcaggcgtagatctagccggagatgaagccgcctggggatcgctttgtgcgtcagagaaatcgccggagaggaagagaacaaaattggcttcggtggtgaaaacggaagtaatggggtaaagattttccagggcggcggttagtatttaaagcactgaggataacggtcagaaaatggcagagtgcgaaacttactcgaagtcgatacgcggcaaatccgaaacattaccaaatatcccggacttggggggcatgtgttaacgaccaaatttggtaatatcaatatcggatatgaagattaaatcgaagcggaaccgaagataaggattgtcgcggaaacagagtaagaatcggctggagtccggatcggctacgactgggatcggctaagtccgagtctgactgggttaagtgatacagccgattccgacaatacgacttgtgtacgacatcgggtttgagttgataagcttcaagatgattgccgcgcatggatagagtcctaagaaggcaattgtatctattaattaggatattttatgtaaattctttagagataaatgtgggcaaaagtctgccgcaaagacttatggtatcttagagtttgttagagataatagtcgtgtccgatatggacatatcttgtaattcttgggtataaatagaccccgagccctatgtaattattaacacacacgttcaatacaatctcggcgcatcgccacccttttacttttgttttgtttcgacgagttcttgctttcgggttgagctgcatcggtttcgatcttcaacaacaggtaagacttgttatggcggttttatgatactctaatcttgtttatgtaattcgtcgagttatcatatatcttatataatctttgataatatcgtcatctaacctacaatcggctaacatctgttaacacaaggcggccgattagattaaatagcgacgttggcttagattatataagatatctatcactttatgaaacatccagtggcttgattgtctagatattgttcttcttttcatactcaatgctgcatcagttgagtttgatctattaagtcgtgcttagaatttcaatctctagcctgccttctggttgccgattagggtagtatcggagtttcagtcgaccttacctgatttaactaccttatcttatatgcttgattgatatgttgaatctgccctttatattaagatcttgctgcatttaagtatattaggcttctgtttggtatatcctatttgctttaatatcttaatacagagtggtatcggagtattagccgatacatgctagatctatctgatcggctatgctatgaacatatataatcttgttgttaatatatatttcgatctaagtgatttatactgtctcggcatggcgaccgatctatcccaatcacttgatttaagtatatatcgacataaggattatatattattaatatctacagccgatcgagtagatttagttcctttttattcatttatggttgtcgatcgatgtatatatgacatcggcccaaaggtaaatgatatgtcatcggcacttagccgatcggctatcatttatggatttaaccacggtttctttgtctttgtttcttgttgattgcaggatcaaatcaactggcacgctcatacatctgaaggcgagttttggacctgcactggagttaaccagatctcccaggcctcgtgttttctgtcaacaacgcttagtattcatctagaaatcataaacatgatttatccacaaatatctacagaaaacaacctgaaaccgaaatcgacacatattcggccgatcagaccgcgggctgaccggtctgaccgcgcaacacacgccggtctgatcggcaaccacagttcgctctaactggtccaaactgacagcagtccctatttatcatctgaaaatcaaccttctccaaaaccacttcaccaataatctaaaaatatcaaaacaataatctcaaatgataattgttcatcacaaaataataagagtaaagtccatcaccggtccctaaacttgtaccgctgtgtcatcccggtcccgaaactcgcaaatcgactgttcaggtcctcaaacttgttcaactgtgtcatcccgatccttaaacttttagatcactcgt

SEQ ID NO: 68148 - DNA, 19670 bp, Oryza sativa
tacccccctggcattaatcatgcatctgccggtggggcttgctgagtactggggttgtactcattcttgctctatctttctccccccttcagtaagagaagctttggagaagaagtcttaggtggagtcttggcttataccccagttgagcgcctgtgaagatggagccgtaggcccgctagtccgctgctgtttatttttgattgtcaggccttaagtgcctttgtaataatgtaaatattatcgatgtaataaagatgtgtcttttatatcatgtttgtatggtgtaccccggcttttcctgggacggggattaatacactagcgttcgggaaaaggcaattttcccggtcgcgacaagctggtatcagagccatctcgactgtaggataagccaagtggataaaacctaaggacatattttataaatgaaactatttgcgaaagtccctttttcctcctttcccctgtgctatttgcaaaatgtttattctcttttcttcctccttcggattttccactagtactagatggttagttttgcaaagaagaagatgtcgtcaattgtctgtcgaagctccagaagactgttggatccgtcagcgcagcaaaggaagcagtgaagccagatgtgtagcaagagtgaagatcttggagaacccgtcgcagaacctaagccaccctctaaggtagagtcgttagttgtgtgtttccttgcttgtgtgtgtagcgcgtggtttgcatcggtggggtgtgatgtaaccatgctaggttgtttgcttaatcaacttgcagaataagtgaaacaaacagcacatcaacaaaaagagttagttcctttaaggtcctgtccctagttctggtctattctttcctggcttgtttcctctctcacctcaatccctgtaacagatgtttaacagagaaaaaggaaagaatgtcagcgggtatgcctccagtaactcaagttttcaattcaatccaccactggcctcaagagagttaaccagggcacacccttggtccattccaagcatgctgcttagttcacagctaccattagttggaagtcaagaccaaaatcagtatgtgtttgatcgagcgtttgccacccaggtcaatgagcttccaatgccagaagaggatgtccccttttgtcacgattgtagagagcaaggacactatgccctgaattgtccatgggtatatgtcaaagaagccccttcctttggtttagcagggcagacatcgctaaaccagcctcctcgcaccaagtcaagtttgcagcctagtgtgcaaagtgaagagcccaatggagacaatccattgaatcctagaaaatgctttcctcctagcctttcgcaccacgtggggtcacgtactaagcaagccaaaggcaagaagagtaagaatcagaagagaaaagcaccgatgcgaactgaagaagaagtacgtaagatgactattaccagcaccgaatggcctccagcagggataactattcctagacgtcaaagaggaaataccttccgaggtgcacgacagttgacccagcacctcctaagccatggtggcagagtatctgatagtgaagggtcagatcaagtctcctcggattatgaagatgagtccccccgacatctcggcgaggaagagatggaatcaaaagcatgcccccgttgtggagaaattggacacgttgctagcatgtgtttcacactttgccctcattgtgaggaagaccatccaccaggtgaatgtcccacccgcaaggtcacatgttttctatgcgaaggtacaaaccatgtgcccaaggattgccaactcagtgtgttgttgaccaagaccgcagaaatccaacgaacaaccctacgattgtctcatcagctagtcagctccaacagcaacctcgacgatatcatccacagcaccaatgctcctcctgctgcacctgactctgcaataaatcatagcaataataccttcagcaccaaccattctctgcaccgacagcctcagcaaagaattgtcgtcgatggaagaagttgtttctctccccgacctactccaggccgagcgaagggcaatcaacctcaggagggcgataccaagcagaagaccgtcatctgcttcaaacagcaatcagaaggaagcttctcctgtgaatgatagcaatatgcagtcctatcacatcatcacagaaccaatcaaggatgcagtcactagaacaatgccagctatgtagccatgtttgtgattttcagttcgctacttatcactgtaatcgggagtttgcagcaatcatgtaataaataaatatattcatgattataaacaatgagttcgttatgtttatggaagattcatgttgaggatgcaatgtaccaatgctaagcacctttccttttaggcaatgcttagtattcatgtaatgaggaagaaatgtgtaatacagacaagttctatgaggattcttttggaagatgcggatatgtgattatgtgtataattgcttactgataaaggagacctagggtctcattccagaggaactatgttctaacctcgagttaataaccaacctgatgatggaaaagaaaatcaagcgattaaccaaagagacatttgtttggacaagagtttcagatgtgtctttttcggatgtcagggttgaatgtgtaaaggaatactttgaatgctaaataatgacaacatgaagggaatagtgggaagtaaactgaatgtaaagaaagtgaatccgagttgcctgttcgtgggaactattcccagttatgaaccaagtgaaatgttcgaagatagtctatagaggtcagattaaaatcgcatctaacaacaaagcttcagtttggcaggaaaacgatcagacaataacaagttcagcagtaaagtcatttaggaagatgtcaaagcatgtcaagtgggataagttggttcttttgagaaacgtaattcaaaggcaaaagttatcgacccttgcatcgaatagcagaagtagctagcacccggagagcaggaaagttaatatgaggcagttggtggcaagttagaagtaaatgacaagcatgatattcttatgatgacaaacatgatatcctagtaatgacaaagctgatgtcgacgcatgtcacgaaggtggtaacttgtatgagtttgacgccaaagatatgaatgataagaagttctagaactgaagccccatcctcaaccaccgcagcctagtctgagtcagttaaaggtgcaaccagggacaagtcgggtgaagagaagattccatctgcaacaggagatcgagccaagcagtccagagtggagaagtttagttagataagtttgttatagaagatgaagcggaagaagtcagacaagaagagaagaccgcccaacctatcttcttgctagcctcctcgaatctcggggacgagattcttgtaaggggggtggatttgtcacgtcctgataaattcatcccgaattaaaaatcattcgctaaaaggaataatagaattaattaaaattcgaaaagaaattggcaaacactaaaatgcgtacaagaaaaattcgaatgtggcccggggaattttttgttaaattctccttggtctaaaaggagccctcaaattttacttgaatttttagagcaccggaaataattattaagcaacaaaaacaattatcaaagtttattaaaaagaaaaatctaaaaataatcctccttttcttttgggccaattttggcccaaagacctccctctctcccctcggcccgcggccaaagtctccctttcctccctctttttctctccctctccttctctccctccttctcttgggctcccctttccctcggcccagcttcctcctccctctctctcccgggctgcctctttcccccccccctcccctcccggcctgcccggcccaggccgcctccccctcctctcctcatgggccgcctctcggcccaagctgagccgcccctccctctcacgcacgtgcgttgcacgagcgctgagcgcgccccgcgtggggcccacgcgcaggccgccgtcgccttcttcctccagccgccgcccggcttctctctcccccgtgcgaaccctagctcgctccctcctccaaatccgcttgattcacttggttaattccaaaattgattagggggtttcaatccccattgattcctcttcaaatgcccccaaattcccccttgattcgtgccttcaatccccgggaacggacgcgccaagtccggccgccttccattgccgccggccgtggttcccgccgccgttcccgctcctcccgtggccggctctctcccccatcctataaaatgggatcctcatcccccgttctctcgttttagccccctcccgagcctccccgtggtccctagccacctccccaccgtcgccctctctctcccacgctgccggccgcctccagccgcctgggccgcctcgaccgtgcgccggccggccgcgccgtcgcctcctccagcgtcgccgctacctcctccaccccggcctgccctccgtttcgcgcggtgatcgccggaggcgcgttcccgccgtcgcccttctcttttctccgcgccggccgcctccagccgcctctcccgcctcgcccgtgcgccgtccggccgcgccgtcttctccctcggcctcgcagccaccccctctccctcggtcagccctccgtttcgcggggaaagcaccggagacgcgttctcgccggcaaaacagtggcgttgccgccactgttccacctccggccgccactgtcgcgtttcccgtgcgccagccgacgtcgccaccacctccctcggcgttgctgcatcgccctctcctccggctgctcctcggtttcgccggaacaccgccgtcacgcgtgccgcctttccctcggtctcgtcggcacccactccggcagcccctttcgccgtgccagtgcgccggccgacgtcgccgtctccacctccggcatcgcagcggcaaggacgccctcggcctcgcctccccttcgaccgaaccccgccggtgttcgtcgtcgtcgtcatcgtcccgtcggttgcccggctcgtcgtctcgcggcgccgcctccgtcgtcggcatcgcagcggcgtggtccgcgtcgtccccgtctccgtgcagctgccgccggctgccctcatcgcctcctcgccggccccggtcgtcgtcgtcgtcgtcctctcgtcgttcccggtcgttgtggcgttcgtccctccgtcgagccgttctcgtccgccgcccgcgtttcccctagtgtgctgcagccccgtcatcgtcttcgtcctcggctccgcgtcgtcaagcctcgtgccggccacgtctcgccttcgtccaaggatcgccgccgaagccgtcccctcgccgttcgtctccgttgtgcccgtctgtctccgccgcgcccgttcgtcgttgtcgtccccgcgcctcgtcgcgtggtggtaaggatccctctccctcgctgccccgtcctcgtcctttcggtgtcccccgtacccgttgtgcggtcgtcgaccccggtacccgtgtaccggtgtcggtagtcgttcacgtgtgcgggtggtgaccgtgtagtgtccgtgttagtgtgcccgctcggtagccgcgtggtttccacgtgtgcaggtcgtgtggtgtttagtggagtccgtttgtcggccactcgcctcggttgacacacggggtctgcttccgtcgacccggggaccgcctctgtgtactcggtctaccgcggtcctttaggttgacatgtggggtccgcatgtcaacggcgcagccttcctgtcctttccaggctagcgcttacacatgttttataattgcaaagcttaattataataatccgcaaatctccatataacagcattaaacctcggatgatcatatcttggtcatacgaactctgaatcgacccgttcaagtctcctaatgtttgttataacctaaagaaccctgtgctttctttttatgtattgttattgcttctttataggcttgtagctttgcttgtgtgcttcgcgtagctttcgtcgttccggaggttcccgaagcgtggttcgcggtcgtcgccgaaggttcggaagtccgttctctctgagcaaggcaagtcacatcatccttgagcatattgaatcccagtttataaaattattttgatttaaattaatgcattatcgccttatttaaattcccgcgttatcactgttttatttagccatgcctatttacctttgttatgaccttattattgttgctattgttattattaccttgttcaccctaggataaacaaaacccccccaactagtgggtactctattcatggttccactagtatgaatttaggtagatgcttcgctgattaattaggcaacattaggtggttttataattttagactttgggaattctcatatcatttggacactatggaattgttggtttatggtggaattggacatacacctctcttcctctttcaaaacccctaaaacatgttttcggtggggtttgggtgcatgccagttgtgggaagtagcaccccggccactctaaggattaagctcgggcctctgttgcaaagcactaccgtacttccacatgtctagtgggtaaggcttagtttgtggctcagtctggttataaacaaaagtacacggatggaggtggatgaagtcgggggtcgatggacattctccagggcaaatgaaggctacacgagctgtggcccggtagtcgagatgtcatggcacagggttggtgccctgctgctaggggctcagtcctgcctgcctgtcccggaggttccggccgtaggtgggattgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgtgggttcacggccttgattaataatactgtgtagctttaggatcgtctttttaaaatggctttgggcaactaagtgacttttaaatgctgttttctgcaaaacttaacccctatattattactccttgtaccccccttgcattaatcatgcatctgccggtgtggcttgctgagtactgtggttgtactcattcttgctctatctttctccccccttcagtaagagaagctttggagaagaagtcttaggtggagtcttggcttataccccagttgagcgcctgtgaagatggagccgtaggcccgctagtccgctgctgtttatttttgattgtcaggccttaagtgcctttgtaataatgtaaatattatcgatgtaataaagatgtgtcttttatatcatgtttgtatggtgtaccccggcttttcctgggacggggattaatacactagcgttcgggaaaaggcaattttcccggtcgcgacattgccgacgctctaagtcgaaagagccattgcaacaatcttaacgtccgtggcattccgcccgagcttaaccaacagatggaagccctgaacctaagcatagttggtcgtggattcttggctgcgttggaagccaagcctaccttgctcgatcaaatccgcgaggctcagaagaatgatccgaacatgcatggactcctcaagaatatgaaacagggtaaagccgctggtttcacggaggatgaacacggaaccctatggaacggaaagcgggtatgcgttccagataacagagaacttaaacagctgatacttcaggaagctcatgaaagtccttattccattcacccgggcagtacaaagatgtacttagacttgaaggagaaatactggtgggttagcatgaagcgggaaattgcagagtatgtggccctatgtgatgtgtgccagcgtgtcaaggcagagcaccaacgaccggccggacttctccaacctctccaagtaccagaatggaaatgggatgaaattgggatggatttcatcaccgggcttccaaaaacccaaggcggatatgattctatatgggtagttgtggatcgattaaccaaggtggcttgattcattcctgtgaagaccacctatggagggaacaaactagcggagctctacttcgctaggatcgtgagtctccatggcgttcccaagaaaatcgtatctgataggggaagccaattcacctctcacttttggaagaagctccaagaagagcttggtacccgactaaatttcagcaccgcctatcacccgcagacagatggacagaccgagcgtctaaaccagatcctagaagatatgcttcgcgcatgtgtactagatttcgggaagacttgggataagagtctcccctatgccgagttctcctacaataacagctatcaagccagcatacaaatggcaccttatgaagcgttgtacgggcgcaaatgccggacaccgctattgtgggatcaagtcggagaaagccaagtgttcgggactgatatcctgagagaagctgaagctaaagtcagaatcattcgggataatttaaaggtggcacagtctcggcagaaaagttatgcagataaccgtcgccgtgatctggagttcgcagtggatgactttgtgtatctgcgggtcacgccattgcgaggtgtgcacaggtttcagacaaaagggaagcttgcacctcggtatgtgggtcctttccgtatcaatgctcggcgcggagaagtcgcttaccagttggagctgcccgcctccttgggcaacgtgcatgatgtgttccatgtgtcgcaactcaagaaatgtcttcgagtgccatccgaacaggccgactcagagcagattgaagttcgcgaagacttgacttatgtggagaggccagtgaaaatcctggacaccatggagcgcaggaccaggaaccgggtaatccgtttttgcaaggtccagtggagcaaccatgccgaagaagaagctacttgggagcgcgaagacgagctgaaggcagcccatcccgatctcttcgccagttcttccgaatctcggggtcgagattccgtttaaggggggtaggtttgtcgcgtcccaaatcgactctaaaattcatcctcgaaattgtgcaaagaataattaaaattcatgtgaaagcctccaacaattaaaatgtgcaaagataaaagtcaaatgaggcttggaggatttttgtatatttcctaaaagcctaaaatgtgtaaataaattttagtggaattttcagagcacaaataataattgaaaagaaataaacaaagttaaaagggttttataaaaagaaaaatcctaaaaagtcttctttcccccccttctttcttgggccggctcggcccagtccctccctctctctctctcttcccccgcggcccatcggcctcccccgcgcgcgcgccgctgacaggcgggcccgcccgccactctcgctgacgggtggggcccacctgtcatcgccttcctcccgccgcgcccgccgccgcgcccgtgccctagcgccgccgccgccgcggattccgccgcatcccgccatccccgcacgcattaaagagggggaaatcactccccgtgattccctctcccgtttccccctcttttccctctctctctccctcggattcgtccgatttgaatcccgcgagtttcgccggcttcttcaatggagccgagatctccgcggccgattcctccttctccggccgcgctttccccctctcggcgctataaaatcgtcccccgtgcttcgctcttccgtttccgccgctcgccgctcgctctcgccgtcggattcgtgctcgcgccgtcctcctctctctccaccgtcaccgccaagctccggttcgccgccgtcgtcgctccggacttcctcccgtctcggcgccacctccatcggcttcgccgcgtttccgtcgaccccgtccgcccctccgcttcgctcgccgatcgccggaacgccgtcgtcatcgccgtcccgaaccgcgccgccgccgtcctccgcttcggccgccgtttccgtcgtcgttgtagtcccggggtgagccgaagaccgtcctttcgcttccctctcctctccgctctctcgggcgccgctccgccgcgccggtggtcgacggcggtgaccatcggggcgcggtcgtgccgcctcccgtcggccgtgccggcgaggccgccttcgggcgcgccctcgcggctgccaagtgggcccggccgtcagccgcccgcgcccgcgggcgcggctgacgcgcgggacccacggcgccgaccgccgccagccgcgtgctcccggtccaccgtggaccgagaggctgacgcgtgggccccacttcccgtggacccggtccgcgcgccccctctcccggctgacgcaataaatggaatttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgctgttatgtggagttatttagtgtttaagccttttcttttccgttggtcgtgtagacgctgcagcttcggaagatccgctcttcgtggaagttgaagccgacgtttgggaagacgagcaaggcaagacacatcatcttgatcatattgaatcccagtttataaaattatgttgatttaaattattgcattatcgctttatttaaattcccgcgttatcactgttttatttagccatgcctatttacctttgttatgaccatattattattgttattgttattattattaccttgttcaccctagagcaaacaaaaccccaactagtggacactctactcatagtaccactagtataattttaggtagatgcttcgcaatctaattaggtaaccttaggtggttttataactatagactttgggaaatattcatatcacctggacactctggaattgttggtttattgtggaattggcttcacaccgctctctctattcaaaagtccccaaaatggttttaggctgggctcggggtgcatggtttggatggtagcacctcggccgtttaaggaccggtcttcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcaaatagcacagggttggtgccctgctgctaggggctcagttccgtctgcctgtcccgggggttccggccgtaggcgggattgggtcggtactcttgtctatggctaggatgggttggaaactatgtcacgtcttccgtctgtataccgtggtggtatgtggcacgtggttacacgtgagaaagacgtgtcttgtgggtaaagatgtacacctctgatcagagtataacctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtacgccttgggttaaggcaggttcgtgtgggttcacggccttgattaataatattgtttagttctaggatcgcgtttacaaaatagccctgagcaactaaatgtctttaaatgctgtttactgcaaccctaaccctttatattataattcccttgtactcccttgcatttattctgcatttgtgggtgtgtcttgttgagtacggtggttgtactcagtcttgctcaatttttcccaagtccagaagaggagctccttgaagatgaaggttttggtgtctagctcgtgcctgccgtcaagcgcctgtggtcgtcgccctagtcttccgctgcttcttcgtttgtctttgtgtgttgggccttcgctgcccatgtaataattctatttacgcttccgcttgttaaactctgaattgtatcaacttttggtgtaccttgcctcctgggataaggattaatgcacgcacgtcaggaacgcccgttgggttatttccggtcgtgacaattatactctaatcagaggtgtacatctgtacccacaagacacatctttactccgcattccaaggccttggaacccgtcgtaaacatgtgacataacccttcacccatcctagcagtgaacaaaagtaccgatccaaccctgcctacggccggtttcccgggacaagcaggccaggattgagcccctagcaataggatctagaccgggtgcgccacacacataggggtgagaccacccgcgtactagtcgagtgccatggcatctcgactaacggacaccggcccttgtagccttcatttgcctagacatctcgattaccgagccgcagctcgcgtagccttcatttgccttagagatatccatcgtcgcaacgacttcatctatctctatccgtgtccttttgttcaggactagactgagcaccgagttaagccttacccattagacatgtggttagtacggtagtgctttggaacagaggcgcgagcttaatccttatagtacctgaggtatgactaacaaaacaaaaccacgcacctcgagcccagcgtaaaaccgtttggggggttttgaatagagggggaggtgtgtgtccaattccaacataagccaatcattccatactatccaaatgatatgagaattcccaaagtctaaagttataaaaccaccttgtcggtgatatgggaccgggggtatcgtgaccagaggcttgaggcagacacaatcgcccacgcggcctggcaccttcggggacgtcgggcccgagggtgaggtgtctgccctcctcctgatttcccccgagggggggtcgggttactcctgccccggccccgaggaccgaggcaccccgaccccttgaggaagtttgcgccgcatatatgggataggtgaacacagcagtgctcacctaaccgcatttattgtagtctggtcaagcgtgtcacgctgcatgcagtgcagtgcagcgcgttcctttatccggtcacagaccggtcagatcacgggttaggtggcgactggcggtctgacgcacgccttgccccgtcccgtcaagacgaaagcctctaggcacttgtctcaagccggagctagcgtgttatctcttagagatggcacgttagccctggttagatttataccaggcttcatcccaaccattacatgcaagatgttacatgaagaagggcaaacatgcacgttgctaagctgacgcatggtagacaaggatgactgatctgtgaccggtctgacgctggtcgcgtcatccacagacagccataatcccacgtcgcacctgtttccggcggaagtgggggtaggtacgggtcgtcccgtcagaagggcactcggacagcaaccgtaccgatctccgtccatttatgaagagaagaacagtccagtttaaaaagggaaaggtgcatgtggtatccccttgagatataaaaggaggaccttgcccacctagaagggggacttttggctgattgatacttggtaacttgttcatacacagatccacaaaaacacaggagtagggtattacgcttcccagcggcccgaacctgtatacgtcgccgtgtctcgcgtttcttgctggcgagcgatctttccacatacagagagagcttgggatttcaccctaagcccccggccgaaccggcaaaggggggcctgcgcggtctcccggtgaggagccacgagctccgtcacacctaatgttgcctaattaatcagcgaagcatatacctaaattcatactagtggaaccatgaatagagtatgtactagttggggttttattttcctagggtgaacatggtgataataaacaatagcaatgataaggctataacaaggattaataggaagtgctaaataaaacagtgataacgcgggaatttaaataaagcggtaatgcaataatttaaatcaaaataattttataaactgggattcaatatgctcaatgatgatgcgacttgccttgctcagagagaacggtcttccaaaccttcggcgacgaccgcgaaccacgcttcgggaacctccggaacaacagaagctacgcgaagcacacaagcaaagctacaagcctaaaaagaagcaataacgatacataaaaagaaaagcacagggttctttaggttataacaaaaattaagagatttgaacggctcgattcggagttcgtatgaccaagatatgatcatccgaagtttaatgctgttacatggagatttacggattattgtaattaggttttataactataaaatatgtgtaagcgctagcctagaaaagacaggaaggctgcgcttgttgacatgcagaccccacatgtcaacctaaaggaccacggtagaccgagtacacagagatggtccacgggtcgacggaagcggaccccgtgtgtcaaccgaggcgagtggccgacaaacggactccactagacaccacgcgggctgcacacgtggaaaccacgcggctaatgtaacgccccgattttcgttcgggattaaaaatcattaaataatgcattttctggaaattaaataaaattaaagcaatttaatcaagtgaaataatgagtaaattaaaaatttccattaaaaatcatggccgagaatattttgtaatattctttgcaccttaatatattctctgaattttcccgtgaatttttggagctcaataagtaattataataatacaaagttcattaactcaatttaaataaatagaaaacaaattaaaatcccctctttgtctttgggccgtgttcggcccaactccctcccttccccttctctcctccggcccggccgcccttctcccctctccttttgggccgctcggcccgctcggctcccctccctccctcaagttcattcctcctccctccagccgacaggtgggcccgaggcccatttgtcaggccctcctgctaccttcggtgtcacgcctggaatttctatccaaaattccaaacgcttacatgtgtgtgaaccctcgtccaggaatcagccgaggcacacaataacaaattgataatagagtacaattattactctaattaataagcgaataaaatgtcgttacagaggtagatagttcctctcaatcaataaaaatctaagcagcggaaaattaaaataaacggcacaaacgactctactccacaggcagcttgaccagggctacacctaatcctccataccatcagcatcactgtagaactcctcctctgatgaatgattgcaaggtgagtatatgacatactcagcaagccacgcagcaaatatgcaagtgcacaggataacaaaggatgacatagtatggtttcatttgcataaatggcatttacaaacatttcagaatttaataaaatagttaagtagtaattaaacaatattaatccaacgctatacaacataccctgttgcataggcccaatcgttctgaacaaccatcccggctgcacagttctatctccaaaccaggaatacaccattccaaaccaggagctaaacaaattattgccagttatagcatcttttattatggtgagaagtgtgaaactaatcacgaaagacattgttagacccgcccataaccgcgggctcggctattcgaatagttttactctgatcagaggtgtaccactgtacccacaagacacaacctcaacatcatgtcaaccatgcgtcgcgatacttgacaagtacccgaatagagattgtgacaataccctctatataatacaattcaaagcagtgcaccgttcccggatcataatcacccccttataaacaaggtatggactccccagcgacccccgtgggcttatctccgccacttcacagtctggtgctctactatgaaccatactatactgaaagtaaagccgttgcccacgttggcttgtggttggcacgataaatgtttcacaaccgaaaatcgtgaaccggtccttaattgtcatgagcacaaccatcaaaaccatatgctcacaacccaccattatcatattttagttgtcaaattaattaattaaccaatcatgattaaccatcatgagctatcattaagccatcattaaataatagtgaatcataaattatcccattagtgagctaatgtttctaagcatggctaagcaattatacctaacatctagctgaacaattatataaagctcaactagtcaaattatactaacccaaggtatcaaagaataaagtaatcaagtacaaaagggccataacaaagaataggttaattccacccaatgacattcgaaaatagatgcaatagttgaatagaaacaatagctttaaataggatcaacatgctcaaagggttgtttgagatctgtgtgacttgccttactggccttggaactcttcaaattcttctccagcgaaaacggactctccggaaacgtcggaatctaaacagaaaagagcaaaaacaccaaaacagcacataaacaagcatgaacagtacatgtggatatttttagagacttgaaccaactaaatccgagctaagatgaattagttatgaattttcaaagattaaaccggattaaagcatttatatagattttaattgaattatgacgcaataatgaattatttttgaaaaggaaaaggggtttattgcgtcagcggctagggtttgcggtggaccgggtgcacggcggcggttcacgggtttggacggccgagatcgatcctatctacaacggacggccgagatcgaccggtccacggccgggccacgggagacgatgacgatgacgtcagcggtgacgtcaccaccggcggcggctcaggcttgcatgctcgccggcgaacgacggcgcgacgacgcgaacggagaacctcagcacgtagagagcaacgcggcgaactcaccggtgaccaaaacggcggcggaagatcaacggacggcgacggcgtcgaggaaaaggcggcggcgaccttcggcttgacgacggcgacggtgctacggtgacctacggcgacgacggaggggtggacgaggacggcgacgacttggcgaccacgatggcgacctccccgagcgacggcgacgactgaagcgacggcggcgcacggctggagcggcggcgacgacggcggcgcgagctacacggtgctagggcgctacggacgacgagaggcgaaggcgagggtggcggcgggtagaggaggacctgggggtgcttttaaaggggttgaaaggcggcggcgaaggcccacggcggctggcgacggcgatggaatggttagggttcggggagagagacgaatccgattcgagatcgaatccacggatttccaaaccgaaatagatgatgattccaaaagagaaaaggtagaggggatcccgaagatcatttcccctctattgatttcaccggaaacggaaaggcgcggccaaatttggaaggagacggcggcggcgcggcgctagggtttcgggcggcggccagccagaggaagacgacgagtccgatccgcttccctcaggatatcagtcccgaaaacctgacgatctcctgtctgatcccacaaaagtggagtgcggcatttccgaccatacagtgcttcgtacggagccatctgaagactagcttgataactgttgttgtacgagaattccgcgtaaggcaaattcttatcccaacttccaccgaaatctaaagcacaagctctcaacatgtcttccagtatctgatttaccctttcggtctgtccatctgtctgcggatgttatgcagtactgaaattcaacttggaacccatctcttcttgaagtttcttccaaaactttgaagtaaactggcttcctcgattagatacgatcttcttagggacgccatgcaaacacacaatccttgccatgtacaattcctccaaacgactcccagaataagtggtcctcaccagaatgaaatgagccactttggttagtctgtcgactatcacccaaatagagtcatgacctgacgacgttctggatagtccagtgataaaatccataccgatttcctcccacttccattctggtatcttcaaaggctgcagcaaacctgcgggtttctgatgttctgctttgactcgctgacaaacatcacatactgctacatattctgcgatttcacgcttcatacttgcccaccaaaatctttccttaagatcctggtacatcttagtactgccagggtgaatggagtataaagtatcatgagcttcctttagaattgcatccttcaagtctttgttgtctgggacacagattctctcacccaaccatacagttccttgctcatctttcaagaaactgatagctttacctcttctcatattcttcttgatctccagaatatcaggatcattaatttgggcttctctgacttgatcaatgagagtagtcttcgcttctaaagctgcaacaaaacctctgctgacaattcccagatttaatctttcaaattcgttgcataactccaatggcaactgtcgtccttctgtagcgtttcaatagcctttcctgctaagggcatctgctacgacattagcctttcccgggtgataatgaattctcatatcataatccttaattaattccaaccatctccgttgtctcatgttcagatctggttgagtaaagatatactttaaactcttgtgatcggtgtacacctctgtacgagtaccgaaaagataatgacgccaaatcttcaacgcatgaaccactgcagctaactcaagatcatgagtagggtagttcttctcatgcggacgtaactgacgagatgcataggcaaccaccttcccatcttgcatcagtacacaacctaatccaagcttggatgcatcgcaatacacttggaaacccttctttggatcaggtaaaatcaaaataggagctgatattaagcgattcttcaactcttgaaaactctgctcacattcttctgaccacttgtactttacatccttttgaagtaatcgtgtcatgggcttagcaatcttggaaaaattctctataaacctccgataatatcctgcgaggcctaagaaactgtgaatctctgaaactgtcttcggttgtttccagttggttacggattccacattactaggatcaacggcaactcctccggctgagatgacgtgaccaag

SEQ ID NO: 68149 - DNA, 2811 bp, Oryza sativa
ccacgaaggcgacctcccggagcgacggcgacgactggagcgacggcggcgcacggctggaacggcggcgacgacggcggcgcgagctacagggtgctagggcgctccggatacgagaggcgaaggcgagggtgccggcgggtagaggaggacctgggggtgcttttaaaggggttgaaaggcggcggcgaaggcccacggcggctggcgacggcgatggaaaggttagggttcggggagagagacgaatccgattcgagatcgaatccacggatttccaaaccgaaatagatgatgattccaaaagagaaaaggtagaggggatcccgaagatcatttcccctctattgatttcaccggaaacggaaaggcgcggccgaatttggaaggagacggcggcggcgcggcgctagggtttcgggcggcggccagccagaggaagacgacgagtccgacaggtgggacccacctgtcagcgagcgggagcgcgcgcgcgggcggcggctcggctgcgggccgacttgggccgaggagagagagagagtggttttgggctgactttcggcccaaagccaaaagagaatttaaaaaacctttttcaatttaaattattcattaaatgcaattccatttattaaaaatacttccttagctcaaataaatcccagaaaaatctaggaattatacaattaagcaaagtatttaatgaaattttgtctggcccacttttatattggaatttatttattaaaattagatcttctcttctaggctttttttaaaataaattctaataattccaattaaacaacgatttatatatttaggatttttagggtgtgacattcggcttcccaggccgaagccgccatggatggccgttcccgcccacgtcccgccgagtccggcgccctcccgctcgcaccctcgctctcaaaccaagtaaaatcggttccccactaccttctccaccttttcccccactctccccgcgaaaatcggcgccggttaactcctccaccaccccacgtcagcatcccacttcgccagccgttgccgttccgctcggctacgattctccctccccgagcctataaaaacaaacctagagctctctctctcattttccctcctcccccgagcttcccgttgcctccctcgctctccccaccgctgctcctctcgccgcgactccagctggccgctactactgctcctgccgccgcgactccgcgcgccgccatcagcggcttcccgtgtcgtgccgtacccggcatctcctcatcttccctattttgtcgccggaaccacctcctcacggcgctcccactccccaccactcaccggcgtgctccagtcgctgcctcccgtcgcactagccaccaccgagccgcgccgacaccaccatcggcatcgccatgtcgatctcaccctagcccatactccattttccccttgagcatgttaaaaagcaaggcaagattgtttgatcgcgaggaaaagagttccgtaagattgtttgaagaagcaaggcaagtcacacattccccttgagcatgttgagcctaatttataaatgtttttaccgtttgcaaataaagatgcatgttttgctaattacatgggatcagggtttacctatctgcttgcttgtgccatattatttgatatctgtcctttgtcaaccttgggtaataaatcgactagcttgtgttactttgttgatctagctagaactatcggcttagccatgtttaattaccactagctcagttgatgggataattgcagtattagacctgttagtatcatgatgagctgcggctcgagacatccggccatgtttcatggtcgtaattatccaactaaaactcgactgaatggtgggctgtgggtgcatggttttgctggtcgcacccatggcaattaaggaccggttcgtgggaaaccctggaagacatacagcgcttgccacaagcgggaatgggtaactgcctgacttgaagtatagcttttcgcttgctgacgcatctaggcaaggatgagcgtgatggagttcggatgggccctgcgacggcctatgcggctttctgattcgcctaggcacgagaggggactgcccgctgcctgctgggggcaggggtgaaacctgatgtgtggtgtgtttggtcagaggcggttatatgaagggtcttgtcacaatcactcgacatggtgacgtgtctggcctagcacggtgacatgccggtggattgtgtcttgtgggtacagttatgcacctctggccaaagtaaaactattcgattagccgtgcccgcggttatgggcgatcgaatagattcaccgtgattagtctcatacttaataaatcgacccaatgcactgtagttcaggtgggttggttgggcttgttatgggttggttgggcttgttcaacgtggtgtagcgttgatcagtagagatttaatattacattaatgactcaattgttttactgttttgctcaataaagtgttttacaactgcctttatgcaaatagccacaagccattcttgaatccccttgcacgtctgcatcattggtgtggcttgctgagtacggtggttgtacttagccttgctattattttccccttttcagaagtgtagtgcttctgagctgaagacgaagttagaggaccaagcctcagaccccagttgagttttgcctgtggagtggagctgaagcccctctaggatcgcattttttcgctgctgctgctttcgtttcagtgtgaggactaagtgcctcttctgtaaatatttacgttt

SEQ ID NO: 68150 - DNA, 14817 bp, Oryza sativa
gacgaagacgatgacgggcctgcgacgtactcttgaagaaacgcgggcaacgaacgagcacggcttgacgaagggagggccaacgaagagcgcaaccaggaacgacgagaggacgacgacgacgacgaccggggccagcgaggaggcgacgatggcagatggcagcagctgcatggaggcaaggacgcgggggagaggaggcggctgagacgccgagggaggagacagcgcggccggacggcgctcgggtgaggagggagaggcggctggaggcggccggcggcacgggagagagaggacggcggcggggaggggtggtgcggccacgggggagctcgggaagaggcaaaaactagagaacggaaggagagggtcccattttatagcggaggggaacgagccggccacgggaggagcggggaacggcggcgggattggcggccggcggccatggaaggtggccgggaacggcgcgaccgttccgggtgaataagagcacgaatcaagggagaataaagggggaattgaagaggaaggaaaggggattaattccccctaatcaattttggaatcccatgcttgaatcacgcggatttgagggagcaaggaaatagggttgtacggcagagagagagaggccgtgcgggaggaaggagatgcgcctggctggtgggtcccacgcgggaggcgcggtcagcgcgtgtgcaacgcgcatgcgcacgcggctggctcggctcggccaggcttgggccgggcggctgggccgaggaaggccgggaggaggagaggagggagaggaggcccgggagagaaagggagggggagggagccgggccgaggggagaggaggggaagactttgggctagactcggcccaaaggaggaaggagattatttttaggttttcttttaatatacattgctaattggtattgttgcttaataaatatttccggtgctctgaaaattcaagaaaaatttgagggctccttttagaccaatgagaatttaacaaaaattctcctggccacattcgaattttttctgtacgctttttaaggtttgccatttcttttcgaattttaattaattctattattttcttttagagaatgatttttatttcgggatgaatttatcaggacgtgacaacattgttgactttacatctttgctagcttgagatcttccctctaccttttttttctggtataccttgtggttcacatcgtatacctcggacaattgcatctgatcatgcaaccataattcaagtttggttgtacaagtgattcttgtcctttgtcaagagttatgcatggaatcatgctcacctaaagttgtagtcgcaccccctccccccgatcaaacatggcacctctcgggtcataccatctgctccagttggtaaaatttcataggatgtctagctccacctccaacaacccagtagttcagcatacaatgtttgccgctttaaccgttaaggatactttacaaaaatagaccaacaaatacatctgaaacgattatccaccaatcctatgttcattatctattcccaaaaatatatcaacatccataagtattttttacgagaaatccataacaggcaggggcgggcccactatgtattcatgggtattcagatgtatacccaagatttttggaaaaaaaaaataggtatatatactatatagttcatataggtattaaaaaaataaaaagaaagcttaaactgcttatattgggccttgtttccccatttcttctctattgggcctaaattttccactcgcctccctctttcctctcaacctgtggtctaattgggccacatatcagcccatttgcaattttcccccaattccccacccgcctggcgccttggccacccaaacctgcaaaccctagaccacaacacagcagtacagcacggcgacgggaggaggcgtgcggcggcgtgacgtgcggcggtcggcgggggctgcgtgcagcgtgcggctgccggcggcgggagccgtggcggcgtgcggcgcggccgtggcgtgcagcagcgtgcggcgcggcggcggcgacagcgaccggtgaggcggtgagccgccaaggccaagcgccaagcccgtgaccggcaggcgcaccgtgaccgaccggcgacggcgtgccgcgtgcgccagccggcgcggcagcctgcaggggcccaggaggcagccaggcaggaggctgctccaggccgtcagccgagcaggagcaggcgctgcacagctgcagcctgcaggtcggcgtccgccgttccacgctgaggcccgaggcagccggcggctgcgcgctgccgctgcggccgtgcggcatcctgctcgccggcgactgcctgacctgcaaattccggacaagcacattagcacagtgagtgactaaactccggacaacgggacaagcacaaaaattcattgatttagacatttagtattttagtgtagttgcttgcttgcttgcttgcttgatttagacatttagtttgtaggattgtagttgactagttgcctatttgagtatttgagtaattgagtatattggacactgggcagtagttcatagttcataccatattagcaaatttgtagtatttgaatgattgtttggttacattcattgaaagagaattctttttgcaagctaaggacaaggacatcatcaattatttccaaaatatcaagcgtcgaaaagttaatatctaaattgtaagttttcttcctaacttattattttctatcatttttgtattccatattttgacactttgatatgtttggtattagtatttctataagttaaacaatttctagtgatgatcaattctatcactgtgtgaactaatgatcaattttatgttctatacgctctaaattataattattagtgtatcataatatacaagcccattttttggctttttggtgtatggatatttttttaccccttcccatttcgaatacccaagtttaaaaagctgggcccgccactgattaacaggtaacatatggaaaataagggattatataatacaaagaaatttgctttgatcataaaacagatttatcaccaaacaacacgtaaatgtttttaaaattttcattgggaggtagagattataggaacggtaaaatatgtttaactacttttacaatcatctttttatagtgttgtaattctagtgacttttcaccgagtatactggaaagaatattagtggtaaaatttaatatgtcagaccgtatcatcgtgcaaaagatcttatatttcttacacgagggaataacttcgcatagattgtgcagaataaacatatcaataaatatttagctatcacaatgagtgtctagtagacgttacataggccaccgtccatgtttagcaatatgagtaaactgcaaatggtaagattagataagactatccaccatacttcatttcaataatatataacaaaactgtacatatgtttaggataagccttatatttggatactattaatcattggattacttttgcctatttatttcagttgtgctgtctatataaccatcgtaaaacaaagaagaagcacaagccacagcttcatacaaagcaatcacacaaatgggcaagcagatgccgaactgtagccgtggacttctgcttctgttgttggcccttctaggctgttttagcattcctggccacgtgtatggtaatctactatctaatattgaatctcaatggtgaatccaaggtttattttgatttcacaattattcaattcttctgtggtaatcacgatgtattaaagaaacatatctttcagagtaaaatttgtgattccaattttcttctggacatccatcttcacatatccatgtattgcatatggtttttctgtatctttcatgctttcctagtaaaatattttttatttttcaggtaaaaatctggattacaccaggagtgcatccatgaatgaaggacgcaacaatgtcaatataaatggtttggtacccgtaccaggcaacattttctccccatcgaaggtctgctgtagaaatgtatgctaccctagcttgcaagcctgtgaggcaaattgcaaaccaattgcttgatcggcttatcaagcctgtaatactaaagaaatgataataatattgtccgttgttcaccaatcaagagaatgatcaatctcctcatagatgaacatggtttgtccttttgtttaggggaaaagactgtcttattgatacataactggagatggccacaggagaatcacgagaataagcgcaagaaatagtatcgtgtagtcaatatggcatgtatgcaggtttgatcgtagtactcgtttacagaaaaaagtaggcactctttttgcaagtgcggtccgctagattaattttatttttgaggctaaatcgtatataccattgcatgtcaccaaacgaagccttgaatcaatgggcatccttttcaacttgggtcaatgtggcaggccaaattgggaccttctgtagtgtataatcattttttactatgtgcatctccttcgttttttctccttcgttcttaagcacaataatattatcacaagcaatctttcccgcgtgaattatcacaggatttatttagttgtactcctttcaagaaatcctgatattgtaaccttaagaacgaaactgcctgataatgaagtgaacaggcacgagctcttgtgattgttccttgtatgcattccgcgcccgggtcaggatttggaaaagtggtttcttctggccgacaatgtatgaagattcaaaagcattcgttagaagatgcacaagctggcagaggcaaggaggaattactgctcgtgatgcaatgcccctcacatacaacttgcaagtcgagatattcgatgtttggggtatagactttatgggacctttccctaagtcccgcaactgcgagtatattctagtggcagtcgactatgtctccaagtgggttgaggctatgccatgcagcaccgcggatgcgaagcatgccaagaagatgttcatagaaatcatcctcccaagatttggtacccctaggatggtcataagtgacggaggttctcacttcatcgacaaaaccttccgagacctcctacaagacatgggagccaaacacaatgtggccactccttactatccacagaccagcggtcaagcagaaacatcaaacaaacaaatgaagaatattgtgcagaagacggtcaacaaaatgggaacatggtgaaaggatagattgctagacgcactgtgggaagtcatgtcgactacccgtagagctcgagcacagagcatattgggccatcagaaactagaacatgaactttgaaggagcaggagaatgaagaaaaatgaaaattgctgaacttgaagaatggagagagaaggcttaccacaacgcaaagatatataaagaaaggacgaagcgctggcatgataaaaggataaacattaagaaattcaagccaggagacaaagtactgatgttcaattccagggttatgcttttcggccacggaaaattgcgcagcaaatgggaaggaccgttcgacgtcatcgacacctcttcacatggggcaatcacactccgtgatgattcaggtaatatattcaaggtaaacggtcaacgcttaaaaattttccttgtgccaaatgaaactttagatgaagaagtggatgttattgaattaatcgattatgagccataatggtctcatctattccatgctaaaaaccatgcaaagttgtcatttttgtgcttagcttaggaattagtgggcctaggaaaaaattggcggccagccggacccgccagggttcagccgaaccaaggcggcgcccgatcagtcccaattttgaatggcagtctcccccgctactgcttgatctgtttagatgcgagtttagagatagaacgatcggatcacgcccctgagctagttcttctccttcttcctcctttgcaaaagcctctccattcaattccccagtcattctcaaaacctttgatccaaacccttgtgccatccatggcttgcaaatctctcatgccttacattggttcatcctcaaacaacacctacaaccttgaaggagaacttacaccggggaatcaactcattccggtggaagaatacacaatggaaggggtaaacgttgtatgggctcaaccccttgtagttgttccaggttcccctgcgattttggagccaatcggttaggtccctggtggggttcggccgaacccttttcggccccattcggtcccccgttcggtagcgcgatccctctcccctcgccatgtcacgaggaccaaagtccgaggggattcgcctgcgcgacgaccgacaatgggcgagctcggtctcttgaaggcgcgtcgcctttttcaagatgatgagaaggccgctccgcttcccgccgagcgatatgtgggcaccctgttcaaaaaagcaggagatgaggtggtccacaagtacaccatgcccaccgctactccaaccactccaaagaaggaacggttctgcattcagggagtgcgaactcccgacgatgggtatggtaaaggcttgctccggcctttgacagcatcggagaaggagggggcagcggaatcccgtagccctccacttatgaaggtgaagcgtcatttgacgcccccctccaattgtaaggggggccggccaatttcaagaggaagaagtaaagtcgccggagccctcggttcataagctagcatcataagtgaagaagctccacaaggagaatattgagtttagggaccgcaacgcggagctacgggtagaactcgctgagcttaggaataatgttgatacccttagtcgcggtttgtgcgctaaaatcaagcatccatttgtagaaatgggtaaggagaatagagattatgcaaaatagatgtctcctctcccatgaataaagtagtaggtgcttagttttttttttccaatcatgtaagcacttgctataaataatgtggctcattggtgttaaccccaatgtttgccaaagtttttttttttgttttaggtttaataaagttcaggtgttgaataagtgtgggggagatatcccagcttctgacgtgcacatactctgaaaactgatgaaaggtctgaacacctggaagcactatacactgcagaaagttgctgagggatcaggcgccagagtggttcggccgaaccaaagctggccccaatccttctcaattttcacaggtaagcaggcgagcacgtccattatttgtatatctccaccatggtatagtactagagttgaaaattcaggaaacaattggttcaagcataagtataagataaaatttccaactaatgaaatttttcatatggttgatcttgtatattctttattctcagctgaacctgtgcttatgaacaaccatccatgtttagggacccttatacatctaagtatttgctatatgagagatgattaaagatgaaaggaattcttgcaacttttgttatgactcttgggaatttgttttcaaaataaaattgttttaaaagctcattcctccaattgacttcattctttattcctaccaaggtcgtatgcaagtatatctttgataaaccttattatgcgtatgactgcttgacattatgttaagctttaacaaatttgtgtgactcgtgctagatatctttcatactctcatgatcaaggggtcatttccatttccacatatataattaagctaagattttacactggaagttggcttcccactaaaattccattcaaataaactcctacattagactatgctttcttctgttagaagaaaaaaaaaggtcttagcaaaaaaaaatgagaaaaggagggaaaggcatggctatggaaaagaaaaaaaaaagaggaaataaagcttgctctcaaaacattgagcatgatgaaaagaaaatatagccatgccccttccatattcatgccaagaaaacaaaatggagagaaagtacatgaaaaaaggagaatcatttctttattccactattccacaaaatattttacttttctattttctaccacaaataaagacccttgatctaggagtatggctgatgatcttcttgagtccgtatttttggctttgcaatatatatgatgcaggtatgtcacagtttgtccctacggaactccacatatcagccttagagtagggataaattctagcacattttgtcttggtgaggatccaaaaataaaatattcatccttgagaaataagagagaaagtcaatatgaggaaaagagctggtttgcgaaaattcataaaaatctcatgagtctgacacagaagtaagaaggactggaatcgaggacgttccgtttatcaattactcaagatggtaagatagacactaataaagttcacaggtgcaggtatggttatgaatgatttatatgccttatttatatcttgaagaaattcattctacactaacttttactcagggacgagcaaagagctaagtgtggggggttttgttggcggctgttaaataccaattctatactgccaacatctgcataaatttcagataataaaacatccaacatagtgataggtgcttaatctcacatattctacaagtgttggtgtatatttgtatgcaggtgataaacactgaggttgggaggaaatctagactaaagtgaggacaaatatgtatccatacaaggatgggttgtgaacttcatcaaaatactagaaaatcagcctaaaacactgaggattggataggggaggaccaggataggagccaggccaaaggccaggctaggggggcccagcccaggttcggccgaacccccactgttgatcccaggttttggcgtggacgctccagatcactccttgatggcggttgcggggtagttcggacatttcctcttcgctaaccgtcatacctacctctatataaagacctcactttactcacttcaatgcacacttccaagcttgagatgaattataagaggctctgttgtactatattgtatactagaataggaagagagtagagtagaagaagtcggaagaattctggagttgtcgttaatcttctctcatttctgttattctgtttattactctgaattcaatataatattcttccttagtaatttagatttgtctagtgagagttatctcttggttagttcctaaatagcatacgggatcattgttcactatagtccatttatttatagtggttgctttagtgtggttgccagtgcctgaagtatcgtgttaggatgaaccggagaaagatctgaccaaacttggaatactctataggggaagtgctacagcggtatatctatgcgcttgtggatttcatctgtgatcgtaagaaataccaacacaaccgaggcgaacctgatctccaaatttagcccctcgcacatctctctgaattcattagagttgaactacttgccattgtcggtgatgaactctttcagcacactaaaccgacagacaatggtttttcgcaagaatttctggactgctgccgaagtgatagtatggagtggttcagcttctaaccaccgagagaagtactcaatagcaacaatggcgaaccggtagccatttcgcgccatagggaacgggccaatgatgtcatgcccccaccttgcaaacgactagacaggtgcaatgggccataattcatactgaggggctgactggcttcagccatgtcgctgacagctttcgcaccttttgatctggtcaatgcatactttgagtacggttgaccaatatacacttgccgaaactcttcggatgctacggtccttgctgcctgatgggctccacacaatccttggtggatttccttcaccacttcttcgcctccggctattgatatgcaccgaagcaaatgttcactgctaaaaaaaggagacaacactatatataggtgttagaatagctaaaactgacatttataatgcttttctcacccacacgggctcccgcgggggtgccagcggcaaaagctaggacattgctattcaaataggtgtcgattcctattaaaaaatggcactttcatacgaggtagaagtgtcggttttcaatacaaccaacacctatctcccgtcctctcatccttatctcctcggtctcttcgcttccttcttattctctttatgcttccttcttatcctttctcatccaattcgtgctcctctccctttccttcctcttccccaagccaccacctcccttacctctcctcccttctcatcttgtctcctccccaaataaccagccgtgactcaccatgccaccacctcccctctgccttcagggctaacggagtcagaaggggtagcgcggcactgatggggccgagccagcgtaggggcacctcgtgacgtcatcatcctcattgggtgggggagcggggggagtgccggcgcttgtcactgtcaatcacgcctcccgcaccacggagacattgccatcctcgcttctctaccactgccgccgtgctcttggaaggagaagcgtggcaccgacaaggttggtccgacgcaggggcaccctgcggcgccgtcgacctcatcgggtaggggagcgggaggaatgctggcgtcggtcaacgtcaaccacgtctcctgcgccacggcgccatcgccgtcctcgcccccatgccgccgctgctcattgagctgctcctgctcctctatgacgttgccacggtggaccgtctggggctcctcctcctcctcaaacttgttgattctctgatgtgaatgtttgattctcttatgtatgaacttgttcctcttatttgtactagtctcttttttgttagattttttgttttttttttgtctttgaagcatcgctgggctcgaattgagctgagctgttcttaaaccggcacctgcgagtcctcataagtgttacctctgttgtgtcggttcggaaatccagcacctttagcgcttcccaaccggcaccaatgagcaaagcccgcgacgctgtcgacctcatagggtaggggagcgaggggagtgccggcgcttgtcaccgtcaatcacacctcctgcaccacggcgtcgaggttgtcgtcctcgctcctctcaccatacgccgtcgccgctgtgccctttcaaggagaagtgtggcaccgacggtgttgaactagcgcaggggcacaggggtaccctggggcgcctttgtaacagtcctccctccagaaccgcatagccaaccaattcgacgggctggcccacttacacataccactccacttacacttttgttctcgcttcgtgtagaagggttaacccgggagtgacatggttggagggaagaggccttataagttggttccacttgtgctaaactagaggatctgacgtcctcgtcggtccaacttacctagccacttaggcatataggcaaatgtctaggaacataccccctcttagcacacactgacccgtacatgcaaccgcgagggtcggctctgataccatttgtaacagccctccctccagaaccgtgtagccagtctatccgacgggctggcccacttacagatacctctccacttacaatttcatcctcgcttcgtataaaagggttaactcggaagtgacatggttggagggaagatgccttataagttggttccaccagtgctagcaaggtggtacgaaacttgcgcacacagctcacatgggccacacgggcctcatcctaattgcgccaggatgtcacagccttccacctcgtcaagtgagggagcgggaggagtgctagcgcctgtcaacgtcaaccatgcctcctatgccatggcattgtcattgtcctcgccccctagccgccgctgctccttgagctgctcctgctcctctgtgatgttgccgcggtgttaacgccaaaattttgtaagctccgaagtcatcatcagcttagaatcaatattggcttcaacatcttcgaatcggctgatgagaattatcaagtcaccaataatcggatccttagtagatttggttaaggaaattaaactattaaaggaagtttattcagaagtgactgagttcaaggaggatgtggcttggcagtttatctattaattaggaagagtttgttagtttccttttatctctctagaaaagtgtgtttagtgtccgataaggattttatattttccttttatgattatgaaagtttctttcttgtccaataaggactagtatctatccatgggtataaatatgtacacccgaggtcattgtaaactatcacagagatctatacaattactcttggtgtatcgccaccctctttcccgaggttttatttatcatccggcagaacatggcacctaacacggggctgcattgactttcgatctccggcgaaggggtaagtcctacgtaccgccggcattggcaattgtatcggttacattggtgtgcttcaaagctgcatcgcttcaatctcttggatcgctctggttcggtttatatatttgcctacctatttgtcatatatcttagttaatatagcttagcaccttaatttgatcatatcggctgatattcattttagggtttatgctagtatcagctaaattatctgattagattagctaaggtatccaccatcctgaaaatttgtcgaagacttgatttttagactttttgcttcttagcatactttgtgatgcatcatccttagtcgtgcttaaatcataaaggctaacctgtctttgattataataagggtttcatcgggatttcagctgatgagttatttggacgttgaatcggcttataaaaattgaatacaagttggttttagccaattgcaacaaatgcttcattaattatctaatcttgtgtattctatgacaatagacctcccgctgatgtatactttaaccatcagatcacttattttatcatattattgttagttgattggtttcaactagatcatattattgttttattacattatcatcagtcgattgtctttatatcattatccacattggatatataatcgattgctcaaaaccctatcggcatcggctggtatcggcatcggctggaacttctccatcggcttgtcagctgatcggctatttgatctgttgtgtacacatatcttttctcaaaatgactggcacgcccgcatctcatcaatttttggaccaacactaaagctaagtagatctcctaggtcgttgctgttgtcgatctacttcgcgccaacacagatctagcattttcggctgagcgtggatttttcgtcaacacgcggcggactacccggggctcctcctcctcaaacatgttgattctctgatgtgaatatttgtttttttataaacttgttgtttctctgatgtgtactagttttttttgttagattttttgttttgtttttgtttttttttttgtctttgaggcatcggctgggcttgaattgagccaagctgtttttttatttcaatccatatgcctcacatgtgccggttcttaaaccggcatttttagtcctcctcatcagtgtcgcctgtggtgccagatcggaaatccggcacctatggggtttctcaaccggcaccaatgacttttttagtagtgattattgttttattattttattaatatattaatattgacaagagaatatgcttcaaaggaattagttaactaataactatattcattcggaggttgtcgacgaggatcagttttagcaaatccagctgtgtagcgaatacacagggaccccatatattcctcggaatggtagtgaactagtgatgctcatgtggtgctcagaggtagttgtacaaaaaattatatatcagtgcgtcacctttatttaatccctttagtttgtttgtattacgtggctagcaaaagcaattgtatacctagtacatccttgcatagaaatagagtaaactattaaaaatggttgatcatgatgcacttttggcatggtagcacatttggctaatgaaatgcaaagcacatgcaatataatagtaacatatatactaatgaaatggccagatcttataaatcctgggtgggtacaagcattgttaaacccaccaaggcaccaatgtatatcttgtttgctgttgttctagcatttgtagattccaaacttgatagagatatatatcggtcaggtgtacgcgcgtatagtccatcagtggcaacagtaacgccgtcgacttcaaccatcgcctggtacgtctcgttgtcgtgctgcttgtaattcatctagtttgtctacgttaaactttcttcctacttaactaggccaaatatacggtggaaccgtggaaactcaatctaacaaaaatctcatataaaccacacaaaagaagtctcacatgtagtcatgtagtactgtgtagataagatggatatcaatggtcatgtggaaactagaaaatcttatccaaattggttaagtttttctgagactaaaactaacatatctttcaagtactacctccgttttttaatagataacgccgttgctttttttttttttgtctttgaagcatccgctgagctgggctcgaactagtgatgctcatgtggtgctcagaggtagtagctgtacaaaaaattatatatcagtgcgtcacctttaatccctttagtttgtttgtattacgtggctagcacaagcaattgtatacc

SEQ ID NO: 68151 - DNA, 8127 bp, Oryza sativa
gacggtcctgtttagggaccggggtgacacaactgaacaagttggaggacctaaacgagtgatctgcaagtttaaggaccgggatgacacagtcgaacaagtttgaggacctgaacggtcgatttgcgagtttagggaccgggatgacacagcggtacaagtttagggaccggtgatggactttactcaaataataatcaaacactctctgattttacagcaatgtcaagattctgaattgctgatgccacccactccaaagcaggaacagttatgttgtcctatggggatgttcagcaagattacgattaaaaaaaatgttcctatggggatgttcagaaagattacaattaaaaaaatgtcatctcaagactattgtgttgtccaatccttgtgtctttttttctgccaaatttaagggaagtgaataatgaacgggagggattcatatgtattccctccgtcctaaaataactcaattcctgcgtttctgtgtccaacgtttcaccgtctgtctcatatgaaatttttttatgattactattttcattgttgttagataataaaacatgaataatactttatgcgtgacttatcattttaaattttttcataatttttttaaataagacggacagtcaaacgttggacacagaaactcaggaattgagttattttgggatggagggagtatagctgagacagtgagacaagagataatcaacatgacagggatgaaagactaatgacccacctacaagatatttttaaatatgattttttattataatacacacatgtatataataagtagatattttattttctcaaagtatttctaagacttatctatttgtttgaaaacataactactttattaaggtagaagcaaaggacatgcatggtttaaggtaacatccccaaaggggttggataataacatctccactgtaggacaagtcgatgaatgatgatagatatgagtgatattctggcatattttttaaaacctgtacattggcaacagttgcttttactttttttgataaataatctgccattttgtttagttttcttggaaccagccgaacattaagcgattgaccctgcagtagaaaattaagtaattttaagacttatctacacatcgtgttttactgtctccaaacaaaatattctgtaagttattaatggtcaaaagttctaatttttttatgttaaccttgtccaaaacagctagagcaggatataatactaattaacatggtgtttgctttgggtcttcaattaattctataatcagaatacatgaaaactaactttttttttaggtaaacgacggcaggagctctgccggaatttcattagaacaaaaacatgtaatattttgcaactggtttgtttgattatcagaacccactatatctggactcaccacttctgtcatcatcaggtgacaacgccaaattttcaccacagtcgcatagtatttcatatttatagtgccaattaatttatacatgcacccctgctcagcttaactgttttctcgagtaatggtaatcaccagtcgttatgaccctgaacctggcatttcataggaagcaggcaatcagcttcactcttttcttgagtccatcctctgtttttttcccagtgtggtttcaatctgtacactaattaagaacagaggaagtatgcaagtctgtaaaatgcaaatttggaatggtgcatattatgtactacttgacaattagattacttaaatatctgcttggatgttttcataataaatgcttatcataaacactaaccaaagagtacaaatcagaaccaccttgctagatcaaatccctctcatgagtcatgagaatatattatgttggaagatcttatggtcatgaacccttgacatgttaattagcgcgtactacgaaataatacatgaatataatccgggttttgtggataatagtaaaatgttgcaacaaagccaaataatactgatgagattcggttgtatcactggtgaccttttatttcgtgaatgaatcatcgctgtatgaaacaaaaaaattcatacaactgaaattagtttgcgccaataaattatcatgggtagggagctacacaccaatgtgataaaccatgacatatgggtcttttccatgccaactaccatcagcacatctggcggatcagtaatcctcggttgagcaggcagacaactgactgttctgagatatcattttcctgatcccgcgcattccaatcagcaattgacttgtttattgtcccccatgggctgggtaatacattcatatttcaattgaaatggaattaaatgtgaaaaataccccctacaaatcacttgtgtttcttctttgcctactactacttaatttcgtacattaaacccccacacaagacaatttctcctaacctattttcatctatttctaatgattgtggttggtctctcacaacctccttcctcccttacagtatctgccttcccaaatccccatatgagctaagatgatggcagaacacgatggcacaacttgtgcgccagctgtaatttctataataccaagttaccaacctatcgaggtggcatgagttactattgtcccatgacgctggaggcccatgcagcactagaaattgaaataactaggtgaaataattgacaatgggactgtggttaaagttaggacataaattaacttgttgggaggattttctgtatgaaattgagttgtagggggaaatagaaaaactagtgagttgtagggggttatttggaatttcactggaattatattatgagcaaaataaggcggatttcttttttgaatatttaaatgtcatgattcagctcctgttgtttttgcgtgctctagggcgcataattcctctggaaactcaggatgtatcctggcagaataagagagagaatgtggggatacgtgttacggctactgtaccaaatatgacaacgatgaacccgatcaaagtgaggcgtgttccacacatgccaggcttgccaatgttcgccttggtggatccggatgggaagatgtgctaattgtaaaggatgcgactatataagcaccctggagtggactggaagcttgaaaattaccgttggatcaaaaatagatgtccgagattcgtcaatgtcacggttaaaattttactcatagcaaaatttttactcgtgatgacatagacaaatatcagacgtctatttttcgatccaacggtagttttcaggtttccactacatatgtactttgcaccatatatttttccgggttagacacagatggattgggttagtgatcatattagtataggatgctgctagccaacagatggggaattgaggtttaaggaattactaagctaccattattaatattatttgttgtttctagattatcctttcgaaatcaaaggtgcatattaattcatttaggaggtacctgggtacctctcaagcacagtaaaatcctctcagaaatgtatgttgatatgagattgatcaggtagtgaccaacgcagtgtttaattagctttcttttgtgcttacgttttgcaaaaaataaatgaatgaataaataattagctcagatttgtcattttggtcttatacaatggtcatgatatatagagtcagaacttttgaaactttaactatcattagtttttctaatgctcattttaaaaagggaaaaaatagtatatatgcttagttttccctgaaaaagtattatcatggtataaaaacttattagatattctaatacaaaattgatagtcaaagtttgtaagtgagagattttacggtctggaggtaccacattttacctctcgttgtgtttggtactaggagctacgggtacctcttagtaactcttgagtgctagctgtaaaatttcaagtcaaattttgttctaaatattaagtatttatgcccggatggtgtatatgatacggatccgtatcctcaatacttcatgcagtttgtccttgatataaagttctgaaaaaaaaaaccttttttttggttgggccgggggggggggggggtgggacattgacctgctgtcttctctgctctgaacattcactacccacagatacacaccttctgctcttcttgcccgatcacctatcccttattattacaagtctcattttatttttcttattttcccatcactgcatgctgcaagtgttaagctactgcttagctgtgcattcaactcgagtcctgaataagttttggagatatatctgagcctagccaattgaatcagatgcatcgatttctgattcgggtgattggcagacatatcattaccagctagcagacgagaagatcaatcacaattaagttcagaactctttcctttagtcagttcatttgttggccctaattgttggtaactatctttgcatgggattgggaggtactgcgagatgtaagaatgctgattcgttggattctgcaagtgcatcgtgaagaaatggttctgggatttccttgctggaactgtatgtagcactgatgcagtgatatgtcgctaataccagatcatgtcgtaggattgtttcaggaggttagcatctctaggtggctacgagaatattaatagctagtatatctgtccataaatgtagcttcggagttttaggatgggatattatctaagaatatcaccaacagtgctcctattttatttctaaaaccaatttgagggattttagtttaaaaaaaactacttcaccagatactttattcttttgcatgatttttggagttccctaccctgaaattgtctgatacgaggggaagcgagccttttttggtagtttaacagaatagctcacttttagtttttcaaattaaattaaagttttttcttgaagagattatttttttcacttcctattttcagattaagaagccaaaaacaaaattttgggggtgaattatttcaattctgccagtgatgctataatattacgattggcggttctagaaatcttttagctgaacaaatataacgagataacaagcatacatataatctatataattatatagaccatttatgatttatctataccgtgctgttgggtaaaaccaacgtgatcaattaatgtagcatgggctagactaatatatttctgcgatggccttaattacttttgtcgaagcaagatttcgacaataataaaagggggtggctatcaagctaggaaagtggatgggtttggagataagaaattttatacaggttcaggccttcttattcaagaagtaataccctactcctatccggggatgattccgccgagtgtgttattgattgtataaaatggaaaaggaatcgccccccaagaggcacacggaccctcttatatagggaaaggagtccgctttacaaaatacagtccatatcctaatagaatatgggattatagataaaatacaatcgtaaccgactaagatcccgggtatttccttgacatacaagtttagaacctaacccgaatcttcatagagatattccatctatatttagtaccgtatatccgactaaattacaaccgtcatgtagatatggggtatccataatctccacagtagcccccgagaccttcgcagttgacaaaatagccttctcgaaacaaaaaaacagtagtccgagtgcttcaattcaacttgctccagcttgccgagtgctaaaaattaaaaactgtgaagggcgaaaataaaacatggtgcatcgagtagatgcacctaattaggtgtagcccccgagtatgtgattagttgaaaaactaaacatatagtcaagaaccgagtggttttatagcgaagcacgaatggtacttagtaagatacccagccgactgcttctcaacttgaatatatcaaggacaaaaaatacaagaagggccgagtgataaacactcaaaggtccaaaaataaacatgtttgataggaatccgagtaagaatctcataaaatgacccaccaaacaggatagaaaatcatggtaattaatgagtccaatagcctaggctgtgacccttaccataaccaaaataagcatataacatgctaaaagaatgactattaataaaccagtcatctcaaatcaacccaaacagcttttgcagcctaacaaagcttacaaaaacggtataacacctttctgtcgggcacctttttatgtgcatcataataattcccaagaattattgaatcgtgttaaaaaggattttaacagcattgggccacaccattgtgaacacaaatcgccaaagcaaaaagtgcctaagtccctagggatcacaacaggccacgctgattatagtattgggctgaagtactgtacaggcccaggcccattagtactcccgataccctaataataccgaagtgaaactcgtctcttcgtcttccccgccgagactctcgccattttccccatttcctgctacagtgcaaaactgcgccggccaaactagggttcatcaatccgctccaatccctcctcaaaatcttcacgaaatttctccccgtatccaccgctcaaattccccatccctttccagccgtatctcgaactaaatcagaccatccagttcacattcatggcggaagaaagagaaagcttcaagagtcagtgggcgccctccgatgtgacggaagacaatctgaaggagatggtggcgcacggcgttcttccagcaaaagagatcatcgggtggcaaccggcatttggtgaggcatttccaacacccgatacacacgaaatcgtggtatttgctcatttcttctacggcggattttctcttccaaccttaagatttttccggggaattctgaacttctacgggattagcttgcatcatctgaatccaaactccatagtgcatattgccaactttattcatgcctgcgaagcttttctgggcattaggcctcatttcgccttgttccgccgcatcttcttcctcaagccccaaccaaacaagagtaaaccatgcgtcgttgggggtgctggtttccaactcaggggaacactaagccaaaaatacttctccatgcccttcaagacctcaaataaaggctggcacgcaaattggttttatgttcaaaaccccgagcctgttcttcccgagtactcctgtcttcctccagtttatcgggatacttggaattcactgccaatgggagacgaagctgcacaagcagtagaactgatcgagaggatgattaagctgaaagatcagggccttcaaggaaaacagatcacccggcactttatcaagtgtcggttagctctaatcaaagaaagatctcgcacagccttcgaatttgacggcaagcatgatccaaaccgtgaagatccagattctcttgacttcaaggtcatgaaggaaaggatgtataagatcttctcaaacgccatcgttgttagctactctcacttgctgccagtcataccgttcaatgcattcaatcctcctccactggtacgtattcatacacttcaacctttctcaaaatatgatcttgctttcttgttgaatcagttaacaatgaaggatattacacccaggaatttgctttgatgaagtcggatcccccaatcgctcaacgccgatcgccccgccatcaaactgggcaagggagcggaggaccaagaattcggtctgaaactcaaccaagtgcttctgatccaatcggccagtcagattctcgaaagaagaagctggttctaagtgacgacgaagccgatgataccgccaggaggcctggagaccgagagacaaccaagaaactaccaaaacaggctactccaaggaagaaaacatccagtcgccctgtgccaaagatcaggaagtcttctaggtgcaactcatataacgacctctcttgcattgatgcgcacccattgcggcaataatactgataatcaaatttgcaggaagccatctgatatagatccgtctgggaaagactctgacccaactaacgtggacacaagttctttcaaagaaactgagcccactgctgaggatcatccgagtgacaat

SEQ ID NO: 68152 - DNA, 12656 bp, Oryza sativa
  unsure (1)..(12656): unsure at all n locations
caaaatatgatcttgctttcttgttgaatcagttaacaatgaaggatattacacccaggaatttgctttgatgaagtcggatcccccaatcgctcaacgccgatcgccccgccatcaaactgggcaagggagcggaggaccaagaattcggtctgaaactcaaccaagtgcttctgatccaatcggccagtcagattctcgaaagaagaagctggttctaagtgacgacgaagccgatgataccgccaggaggcctggagaccgagagacaaccaagaaactaccaaaacaggctactccaaggaagaaaacatccagtcgccctgtcccaaagatcaggaagtcttctaggtgcaactcatataacgacctctcttgcattgatgcgcacccattgcggcaataatactgataatcaaatttgcaggaagccatctgatatagatccgtctgggaaagactctgacccaactaacgtggacacaagttcttccaaagaaactgagccaactgctgaggatcatccgagtgacaatcaaccggcaaccgataatgtagaatccagtgaccaacccccgactggaatccagttggccgaagccgaagccggagttaatcaagatcccccgactggaaaccagtcggacgcagggccaagccaagagattccagaagtcgaaacccaagcaaacaaccctcgcggacaagacgccagcaatgaccggagatctggatcccctttaaaagtatccgaatccactcgtcctcgtcctgaaatcattacaggtaaacactttgtccgaaaccatgttgacccaaataactctgatcgattgtctaacctttgtcattggatgcattaggaccaatgatcgatgatgaagaagaaattccccgtatataagcaaccgaagattcgtgccctcctattctggtcaagtggtgggatgacaacttgcaacctcaaggaattgtaataaaccggcaaaaagaagacgaagaggtatgcctgctgaaaaagggactcaaccaagcgactcgcattgtaaatgtaagtttctttgatgcctgacctcagccatcttgtttactgtctagctcgagcgctgattaaactgctccgcagaggattcatcttaggaacgaggcgaaaaccgcaaccctagagagactagttcctcatcttggaaccctcgaagccaccaggagtcaactgcacgaggccagagaacttgccaagaagaatgaacacgatctgagggatcggattgctgagctccaggagtccaatttcgaactgagtggctcatcaaaaggttcgcgcaaactctgcccaactaatttgtgctgttatctttgtaaccttgattaaccgaagttaatgtagtgcaagctgccaagatatctcaactagagaagcatatccaaactctggaaaatgacaaggcagagctggcaagacagagggattcggctttaaaggaggttgaaggtaccaataatcaatacttcaaaagccattatcttctacatgctgattcattaatgtgaatctgttgacgcagaccgcaagatcaagtctcaagcacaatttgatgtcttagttgacaagatcaacaagcttgaaggagccagggataaagtcgctaatgccgctactccacttatccaggccatgttcttcaataacgccggttcgagtacacttgatgctgccgaaatcttcgacaagctgagagtcgctccagatacttacttcaagaacatcaaagaagctggaagtatgggagcaagtctggcattggcgatgaccaaatccctttatccaagagttgacattgatgccattgatggctttgcagacgggacgagcaaagaagctgctcttgacctcatcaatgatgcgcagaaagcggctgacaagattgctgctgatgtagttgagagattccaatatgtcgaccttcggccgactgggtctaataagtctgatgatgaaaaaactgatactgattgatataacaatgattttgatgatcaatgacggtggaggctcaatttgtacaatactgatgaatttatgctatgcttggtgttccatacttagcttctgatttcttaaaagcctttgtcaagccttattgagcctaaaacccgcaaaagctattaaaaaccttcagtcctcattggctaagtcgaaagaccaaacagggcaatgataaatcaagtaagcaaattgaattgataaaaatcacactccattactatcataatagccccctgactgaaaacttcaaggagaaacttgaagttagcagtcaaataggaaagatacaagcgaaatgcctaagcataaaatcgacgaaggtgttcaatattccaagaattgttgatgagagtaccgtcttcgcgcttgagtcgataagaacctggccgagtgacttcagcaattatgaactgtccttcccataagggagataatttatgccgatcctgtgttgtttgaattttcctcagaaccaggtcaccgactaaaaaggctcgcgatcgaacattccgattatgataacggcgtaacccttgcaaatatcgagtcgactgaattaaagctgcttctcgggcttcttctagtcggttgatgtcatctactcggccctcttcatagccctcctcgttgaagttccgaaatcgtagtgattcaaattccacttcactcggcaacattgcttctgcgccataaaccaaaaagaacggcgactggccggtagcccgactaggagtagtgcgtaaagaccaaagtacggacggcagctgatctacccacttgccagcatagggacgtagtcggtcaaaaactcgtgctttgatcccttgcaatatcatgccgttagcgcgctcgacttgtccgttattcatagggtgcgccacggaggcgtaaaaaattttaatgccgaagtcttcacaaaagtctttaaatgctccgccagtgaattgagtgccattgtcagtgatgatccgattaggtaccccaaaccgatgcacaatgttgatgaaaaaatctctaactttatctgttgtgatcgtgatgaccggtttagcctcaatccacttggagaatttgtcgatagccacaaagagatgcgtgtaaccaccgactacccttttaaacgggccgaccatgtcaagcccccagaccgcaaatggccagaacaacgggatggtttgcaactcttgggctggcaaatgaatttgtctggcaaaaaattgacaaccttcgcatgttcgcacaatcttgtcagcgtcggacaccgctgtaggctagaaaaaaccttgccggtaagctttgccgataatggtccgtgcagcggcatggttaccacaaataccagaatgtatatccttcaacaactgtctcccttcttccaaagacacacagcgctgcagtattcctgacggacttttcttgtacagctcagtctcatgaataatgtaaagtctactgcgcctggaaatccgctcggcttcattttcgtcttgaggtagttcttgtttgctcaaaaattttataaacggttctctccagtcggcttcgatcatgcttacgccttgaatatccatggcttcgactgtctcttttctgggcacggtcggttcgtaaaggtgttcgacaaacacatctgaaggagctgcttcccgttttgaaccaaaattggccagtctgtcggctgcctcattgttatgtcggaggacatgggtgagctcgagtccatcgaatttattttccaacttgcgtacctcttgtcgataagcggtcatattatcatctagacatgaccactctttcatgacttgattgacaaccaactgagagtatccacggacgattagtcggcgaatacttagagatattgcaatccttagtccatggagtagcgcctcgtattccgccacattatgggacgcagaaaaatgtatccacaatacgtagctcaatctttctccagtcggggagattaaaacaaccccagctccagtgcctgtaagcctcttcgacccatcaaaatgcatagtccaatattccatcttttcctctggcatgtcttcttggcactcggtccactcggcaaggaaatcagctaaagcttgtgacttgatcgaagttcgtggtttgaacgatatgtccaaagacatcaattctaaggcccacttcgcaatccgtctgtttgcttcgcgattatgaagtatatccccgagtggaaacgatgtgaccaccgtgaccgagtgactttgaaagtagtgagataatttcctgatggtaattaagacaccatataataacttttgaacctgaggataccttgtcttggagtcggctaaaacctcgctgacaaaataaattggtcgttggactttttgaatatggccttcctcttcacgctcgacaaccaggaccgtactcacaacctgggaggtcgccgacacatataacagtagcggctctggtggatgtggtgaggccaaaactggtggagtggtaagaagtttcttgaagtcttcaaaggctttttgtgcttcgggtccccactggaaattgttagtcttcttcagcagcttgaagaagggcatcccccattcgccgagtcgtgagacgaaccggctgagcgccgccatgcaaccagtcagcttttggacgtctttttgggagcttggcggtttcatgttgaggatggcgttgattttctctgggttggcctgtatgcctctttgagataccataaatccgagcaacttccctgatggtactccgaagatgcacttttccgggtttagtttcatcttgaaagcacgtatgcttgtaaaggtttcttctaaatccgcaatcagatcatccttctgcttggtcttgacgactatatcatcaacataagcttcaacattacgaccgatctgagttgaaaaacatctttgaatcatgcgttgataggtcgctcctgcattcttcaatccaaagggcatggtgatgtagcagtaggccccaaagggcgtaataaacgaggtcttcaagcagtcggattcttttagtcggatttgatgatatcccgagtaacagtccaagaagctgagtaactcgtagccggccgttgagtcaaccacctggtcaatgcgaggtaacccaaaagggtctttgggacaagatttgtagaggtcggtataatcgacacacatgcgccattgccccgtctttttccgaaccaggactgggttagccagccagtcgggatgaaggacttccttaatgaagcctgctgctaacagcttggttaattcctccttgatcgcatccttcctgtcctgtgcaaaacggtggagtcgttgcttgatgggtttggcgtcttccttaacatgtaaagagtgctcaatcacctctctggggataccaggcatatcggatggtttccacgcaaaaatatctttattattctgaagaaaggtgatgagcgcgctttcctatttacaatctaactcagcgcctattacagcagtcttatcaggatcggagggatctaagggaatctttttcgtcttggcatcactttcttcggtcttcgtcagcttggttgcaggcacttctccctcgcttgccgtggtcgcagccagtcggatctcttcgcgggcgagagtagtctcgtgagtttgggccatctcgcaactttctttgtcacatgtgacggcttgcttgatgtcgttccgtagtgatatgacccctcgaggaccaggcatcttgatcatcatgtaggtgtagtgtgggacggccacgaatttggctagagccagtcgtccgagtatagcatgatatgctgtctcgaaatcagcaacttcgaaacaaacattttctgtgcgaaaattctcccgagtgccgaaggtaactggaagagtgatatggccaagtggtgtagctgacaatcctgggataacaccgtggaagggtgcattactcggctttaattctgtgcgaggaatctgcatatcgtccagggtcttagcgaaaaggatgttgagtgcgctgccaccatcgatgagagttcgtcggagcttgacgttgcgaaccactgggtctagtaccagaggataccgccccgggtggaccactcggtcgggatgatctgagcggtcgaatttaattgctatctctgaccaccggaggtattggggcgtgttaggctgaactgcattgatctcccgttctgttagcttctgctttctcttatattcataagccaggggtccgccgaagatgtgattaagttctttgcgatgatcttgaaaaccagtcggggcatcgtcttcatcatctttcttctttgatgtgccttgatctccgtctgagggcttacgtgcgttcttcacgtattgctccgcaaattgtttgtagacgaagcaatccttggccacgtggttggagttggggtgatgcggacattgggagttcattatcttgtcgaaggtgttgacgcggggacgttgtcgggaagatggagaggttgtggccacaagttcttcgggcttacgcttgcgatccttgtggttgttacttccgctccctcctgcagtcggcgtgtccttctttggcttccaagtggtgcccgactgcttggacgctgtgatagcatcttcggctttggcatactcattggctttttcaaacatatgtttgaccgtcttgggaggtttgcgtccgaacttgccgactaggtcctcgtggcgaatgcctttagtaaaggcggcgatgataacatcgtcggtgatgtcggagatcttgttacgttgctcagagaagcgtcgaatgtaatctcgaagagattctccagacttctgaacgatgttgtagagatcgaagtgtgtaccgggccgttcaaaagtaccttggaagttggcgatgaagtggtcgcgtagctctgcccatgatccgatcgtgccgcggggtagcccatgaagccatgaccgggcagaatccgctagggccacaggtagatagttcgccatggctttgctgtctcctcctgctgcgcagattgcgagactatagacggtaagccaagactcagggttggtggtgccgtcatatttctcgattccagtcggcttaaagctggctggccaatccactcgacacagatcgcttgtgaaggcagcaactccgtccacgtcgtcgtcgtagcgatccggtgaatgatggcctcttgtgcgcggcgctggttgatggtgtcgcgaagatcgatggggcatcttcgatgtggggactgtggtcgttcgacttggcgctccctatatcgctcgggaggcgagcgaacggaccgttcatcatgtcccctgctcctgcgactagatttgacgccggcaatgctgaggcttggctggtgatagtcttgagatcgaagatgagggactcggctaccagttggggtgcgggtgcttgcggagttggctggaaccgaggcagcgatcatggtcttcgtctggttcaagatgttgactacatgataagcttggttgagtgcgtcttccttgaggagggtgtcgaggagagtgattgctgcaaccgcgttctgctggggggtgcgaaagaccgctgtcccatcaacgtcttgttgcccaatgagctctctcgctcgccgcccagattccaaggcgcgttgtcgtcgatcttcagcctcctttgcaatccgttcgtgatcttgttgctcacactgtagtcgttctcgctcctatcgctgtcgctcttcctctagtcgatgacgttcagcttcttgtcgtgcgcgatcttggtccgcttctcgggcttggtgctgttcctccatttcattgttagccttgaatacgccgaagaagaggggcgtgtagttatcctcatagctgtcgtcgaagttgtcgaggtcgccgtggtcgtagtggtagccgaaatcatcgtagtcgaggatctcggttggtcgagaactgacgccggaggagctgaggtagccatccaactcttccgtcgagactgtcccgagaggttggagtataacgccaaccttcctggatctagatcggatcggggccgaagccggagctcgcttagatcttcgagtgggagatgtcttgactgtgaagacagcggccaaatcatcaggaagtttcgtcaggattgagggataggacccgtcgtcttgatctggtcgcggaagagtagattggatctcgtccgagtggtttgaagccgagtcgggagagatgatcttggagtaggcctcggccgagttcggaataccgaacggcacggggacctggtctctccccgactggtttgaatccgagtcaaggagagagatcttgccgaagtcgttggtgatgaagttgaggctgccaaaccggaacacctgcccgggagggaaggcgaagtcgtcgatgccagaaacgaaacccatcgcacttagtcggcgagaacttgacgctacccctacctggcgcgccaactgtcgaagcaagatttcggcaataataaaagggggtggctatcaagctaggaaagtggatgggtttggagacaaggaattttatacaggttcaggccttcttattcaagaagtaataccctactcctgtctggggatgattccgcctagtgtgttattgattgtataaattggaaaaagaatcgccccccaagaggcacacggaccctccttatataggggaaggagtccgctttacaaaatacagtccatatcctaacggaatatgggattatagataaaatacaatcgtaaccgactaagatcccgggtatttccttgacatacaagtttagaacctaacccgagtcttcatagagatattccatctatatttggtaccgtatatccgactaaattacaaccgtcatatagatatggggtatccataatctccacaactttactaatttccttgttaatcaaacagggtacgtaataatgcagtgggcggagctctggcactcgcccgtggtggctgggtcttgactccgccccttaatttttcggactagagtagtacttgctatgtttgggaggagagattgaaaatattcttccatgcattgaaaacaatattatttattagcacatgattaatcaagtattagtaaaaaaacttaaaaagtagattaatataaatttttacaataactttcatatatttcttttttataaaaaatgaatcgcttagtagtccaggaagcgtatgcctagctaggaaattaaggagttgacgttgggaacctcaagaaatgaactcagatttatgggaggactgcaatcctttagtttttcacacacgagaagaattatggagggtcgattgatccccttgtgctcaagaaacaggaaacagataatccttatgcagtccatttctactaggaaccgcataagatagatcatcacaataccccaactaattaagctttggcatcttctttgtcacatgcttctcaacttctgcatcgatcttcactactgtttcagctcactgttatttaaaccactccttaggatttaggtccataatcttggtctgcagaatatgtctgctgtgcagagagcttcatcccgatgcaactcattccgatgaaaacacttgatccattaaaaagaatgatgttaattgtacatgaatggttaaaagaagacattgttaatattggctaggagaagaatgggaataaatagagcacactgctagggtctgctccaccctccagacgggtaaatggagtgaataattaggaggataaagatcttttatatatgatctttgttaggtaaggcgagttacataaagtttctacataaaagtaacaatgtgatcaggaaataaaccccaagttccctttagaactaaaataaaaccccatgttcagaaaacgtacataaagaaaaaatgggcaacgtttagcagtttccagacgattgatgaatgtcaatatatacttgaaaatataaaactattcagtcaccgagttcaagagataaatctctgagaattcgtaatcattagtacgttttgcaacctagtatatgatggtttactagctaacgtgatttcaagtgttcatacatcaaatttactaaatgaacttttctttagcaagggtaaacaatgtcaactctttttttttgttgtccattccatcattccttctcaatcaaagacacgaagacctccttcctgttcttcaaaacaacagaaaataatcatgtgaataaacagaaaatagcaaggcttcaggatcgatgaacacatcaatggagctaatatttcaacaaacctttcattcaataaaataattaaggccattgatccctctagctatatataggtacgaactaatctacgtggtgtttggtttgggtgttcaatgctgtaatgagatcacatgaaaatgggcaactttatcaactgtttttgtttgcttgctttgttatcagaaccaactattttaattcacaacagcgtcatcaggtgatagtgcagaatttaggcacagtcgcattgtattacactggcgattcttacatgcatcccttccttatctttcctgtgttttcgtgttccaaccagctggtgtttacaatgctagacctggaatctcatagcaacttgtcatgtgtagttatatgtatcatcctgtccaccccctcttatttttggttctttccttgaatccttttattttgatttctctgaatatcttacagtttttaacagaatgtaaaaggtaaccaatctggtgcgattaatcgctgcctgacattcgtgtgtctgaacctaatacttgcagaatagaacaaggtgttgatttggtgaatggtgctattgatttggatggatagatgatatatatttattttagtttctgaatatcttaattactttatagacatgcgcaattctacttgacgttacattcgacattcggccgttcggatcaacgagtacacacctcaataatcaaaggacggaccctaatcactatgagtaaaacgctgatatatcctagaaaattcgtttctaaggggagtcgaacccagaacctcagatgcttctgaggtttgaggctctggtaaccacaaggctacaggcccttccacaatttgatgcgatatgttgcttttcagtctgcactgttggacatgacaaggccgtttgattttgtttcacaagttactatcaaagggaagtggagatagcgtgtacaaccagcctattagtttgtatgatatgatcccagttccatcccagcctatcagtatattccctcctgttggaaatcaaagcaactcacgcgaacacagtggacacgaatcacaattgcacgtgaagaacacagggaagaagagaacacagtaccgagcatatttgtggcaccgcacatatacaactagtgccttttctcttgctatttcttcacaaaacaaacgattacaaggagcagctatttacaatccatgcatactactaatcgcacatacgcccacgtccggtttacttggccgcaaaactccacaagtatcgcaactgcttgactcaggccgcatctccactacggaagatgatgttgaaataaagattaagtgttcacacaaagcgagtggtaataacatgtgattaattgagttttaattattataaacttgaaaatagattaatctgaaattttagaacaactttcatatataaagtttttacacgaaacacactggttagcagtttgaaaagcgtgccacttttatccaaaattttattcacgtttttaattggattcgaacatgagtcctcccagacgtcgttgcttgcaccaaccaaataatatgcatgcatgcacatgcatctgcaactaactaacactaccagagaaagcgtttttcctctcggtttgtagccccctatactcctagttttataaccagaagtacgaatccgggactaaagataggtatctttagtcctgggtgaaatacctaggactaaacatccatctatagtcccggttggtgatacaaaccgggtctaaagatggcaacgccaatcccggttggtcaccatttctttcttttttttttcattgtttctttccaaatcgagttgtaactgcacaaatcgagttggaacggcacaaatcaagatgctccctatatccccaatcatatccccaaatcaaaatcaaagtatcaacacaaacatagattcacatcacaaattcttaaaaaaaatacatctcaaattctaaaagaaatacatcacatatccaatgaattacaacatctaaaagttctcagaccaacgaatcacaacttctaaaaattctgaaatccaatatatcacaaattcttaaaaaaaaaagaacaacaaaatcgagttgccgctgccgcctcccgcctccccttcggcagaggggagggcgccgctggccggcagctcccgccgccctcccatccgcccgccagcgcggncacgccgncacccgccgccctccgccctccgccctccgcacgggccgccgctccagtagtcgccgcctgggctcggtcgcctggagaggaggaggcggggagcgggagggggaggagagggga

SEQ ID NO: 68153 - DNA, 1582 bp, Oryza sativa
atcgatggaggctgaggctgagatggataagatcaacgcgagactgagatgggggctgaggctgttaatttaatgaggaagggggaggggataagatcgacgactgaccgagatcaaaatgaggcctgcgttctcggggtgaattttggtcccggctgatataataaacaaccgagactaaagatatttggggccctgactcgacctgataacttgaaccgagactaaaaatgatatttattcttggttggtaacatcaacagggattaaagataacaatgttgttagccaggactaaaaataatatttagttccggttcctattcgaaccaggactattgtggattttggacgaccaaccaaagatggtttctccaatagtttaatgcatgcaagactaattcaccacataatcctgagactagtcccaacatgcacgtacgcactacttggctgccaatctactttaagcattcttccaaattttgtgcttcacatgagattagctcgctatgccataacgactaacgcatgcagctgacaacttatagtctactcctatatatgatgacatgcaacaaaataaacatgatcacctaatacaacaagattatttctaacatctccatcccaaaataaaccaacatcgtatactagaatgtgatacatcgtccagatttatagtgttaggatcgatgtgtcatacctagtatgaggttggcttattttacgatggagggagaaacagctagaaccattaagccagcgaaaataagtgcaagacgatactgtgagttaaacagcaccatcatacactcacaggcacccatcttcttgctcaacaagatgcttcaagctctcattcactgacgagattgtgttcttctgacgccgctcatttccaatgcaatcaccatgcatatatattgtcccatggttgatcatctatcaccgttacatataaaatttaattccatcctatagtagatgaagataacatagaaattatatacagtttggatcaaaagttgagagaaagagaagaaagctaaaagatatgaggagggagctaggttgtattagagtatgagggtttattatattatgagcatcagtgacatatggaggctttttaaagcagtcccattgtccaaattggtggacactaccctcatatctattttgtttgtaaaaatagataaagataccataaatctagtcctatctgcaatttttgcaggcatgatcttaagtggtccgctagcaaaaataagagataatttttgcaggtgtacctcttaagaccacgtttgtgagaatcgattttcgcaggagaccttaagatgtccatctgcaaaaaaggtcataccacataaaaatcaccacctacccggctagattccatttccacccgctatgaccggcctctctccctccacccctctcagcgggcggccatagtagtcagcacagccctctcctccctctctcctagatctgaccggaggaggggaggggcagcagtgggagtcacaataagcgacagtgcggaggaggagctcccctcacctcccttcccact

SEQ ID NO: 68154 - DNA, 12186 bp, Oryza sativa
  unsure (1)..(12186): unsure at all n locations
gagcgacagaggcggcgctccccacccctccctatctccattcctactagatccggccagaggagggaagcgatggtggtggcggccaccgcaggcggcagtagaggcagcactccccttccctgccctcccctcccaccctccctcccttctagatccggctagatgggggaggacagcggcagcggcccctgccaacggctggacagaaggtgcctgtgaaaatagtgtattttcacatgtcttgaagtgtaggcggggtgaagagccgcctagaaaaatttattttaactctttgtaaaaaatatgttttctaataatgatcttttagctgtcaccagttatttgtcaaattttcaatttctaatattacttggattccctcctacgcacctaaatgggttaaaaatgttttaattcccatgccattgaaatcataaatacttaaaattttgggtcgtaaaaatactatttttttttttgacctggtaaaaaaatctttatttttgagggtagggagtaagagtagtgttgttatcattaagacacaatggtgaaacacccagcgaaaactccacgtgttgcagtggaaaagctgcatgtcacaaaagtagaggtgcaaactggaattgatttgtagcaatgaaatatggtttaatctcatctgatctgtacaattcatactttatcaatcattatataactgttcctttttggaaaatttcatatgatttgtacaattggtacaaccatacaactattttatatataggatttactaagtgttgtgagacaaattagagctattacaaccagcaagagatgttatataacgtctaaattaagtttcttaaaacctcacattttttaagataaaggaaactttattcatctaagatagtcacatcaagatttaaaaggagtctcttccatttttcttccatttcaagcataacaaaattgttttgacctcaaactttaaacccaccatcacatttcacaaataacttgtttcaatttcaaacttgtcagatttcatatgttttaagttctattaagatctttttgcttctttttatgccataacattctcctgaatttcttgaatactgaaaccaattatttaatctcacagagctttttggcctaaaccctgaaacgggctaagccggcttctgtgtcttccccaccttggtccggccagcttacgtcggcctagccgccactgtactaagcatgtagtatgtagttggcttggaacaatgtttgaatcgaacaccatttgcttcttttatagagcgtaggtcctaattaagtggcatgcttataagcctttgcgctccaatcatatcaccttgggttaaccattttacacaagatatgatgaaagtgtaaatgggataccatgcatatgttagctcgctcaatctatagaactaggctaatgcagattttggagcagatgtatcacattatatctatacaacaacgtgcatggtttctatagcaaacaattatatccctaattattgtttaacaaattatacttcatgcggccataatgcccatttccatcgcagcttttgacatgttcttcttgttcttcatgatgaacgattaccagaacgaccgttgaatgccatgacagttatcgcttgcggaaaggatataccacggggcactgcacatcacagcctatccactaggtcgactgtaatcttgcttctttaccactataatcaggttacactggcctcttgtacttcctccgtctcataaaaactaacttagtcttgaatattgacacattctactactacgattcaggacagatgcagcttctgatttatagtattataatgtatcaacgtcaatcactatgttgattttttcggtgacagggggagcacaaaaggatccgtcagacaataccatgattttttattgctgatgtctcccattccaaaacaacatcttttgatgttacgagatgggcatgttcataaagattgtgatggtcaaaatgaaagataaacatctctcatgttttctttcggtgctctcaactttatatacttttttcagcgaacggtatgtataatatattgcagccaaactgaagggaaccaaggacgacggaatggactcatatatacatagtcgagaggaaatcactcaggccccacaaaaaagaagaagaaaggaaatgcattgcagatatctactccctccgtcccaaaaaacccaacgtaaaaggtaatgtgacccctacttattcagattcgttgtactatgagggatcacatctcttcctaggtcatatcccctcctaggttagtttttttttggaaagatggagtatgaagtaacaaatggagtttgtattaacattaatgtatctacaaacctttcgttcaataatataattagggccattgtcctatcgactatatccaactaacctatgaaccccctccgttctagaatataccatctcagtatgggattagacacatgctattataggcaaattgaaagggaactgagcaatgattgagaggagttcatatgtatatatcttaaaccagaggtgagagtaatggctcagccacactattgcagtgtccatggagtgatgaatggggcttatacgtcaacaacattttctttaaaacataaaacataattaaggctcttcatcccaataggtatatacatagctaggtacatactccctccggttcagttgacattttcaataattgaacaaaaatgtacacgatctctaaaacatatttttaactctgagtttatattataatatataaaaaataagtaaatattttttttcttaaagtactttctaagacttatatacaaatcgtgtgtttattgtctccaagatgattattctgatagtcaaaagttataattatttcacgtcaaccttgttcaaaatggaacagggatgtagtagtaatcagcatgatgcctgtgcttcgggtcttcaaataattctgtaatcagatcacatgaaaatgtgcaacttttaaaaactggtattcttcgattgctttcttatcagaacccactatcagaattcaccacttcctcgggtgacaatgccaactttgggcattccattgtagatttatagtgatgattatgccaaatttgggcatccctgccttatagcttcccctttttgctcgagtaatggcaatcagcgaacgttatatatgatcctgaatttcatagcaacaaattttaggttcatcccctgttttttccattcctgatttcaatctgcactgcacactaattaataacagagaaagtatatatgcaagtctgtacatgcaaatttggaatggtgcatattatgtacttttcatcaattgttacttcaatgtctcccgcaattaatatttttatattgcctcttgggctaaaccactataccaattaagtttgagcaaagcttaaactccagcagaagctagcatttattaattgcaactgaatttggttcataactcaacatatcaaatggcgaggttgtgtggtaaatctgccaccaccgcaacaaccaatttcataatgtttgtgtaaaaaaaacaaaatttgctacggaacactcaaagattaaggtctttgctcctgggcatccgaaaaacgtgacaaggttcgtggacactctaaaaacctggtaatttattaggggacaccatcatcattattttattattattcggttaaatggagaaaaaagcatttataaaagacaagcttaccctttgggttcgtaacttgggtctgttttcaaactttcaacttttttgtcacaccaaatgttttaacacatatatggagcattaaatatggacgaaaaaaaccaattgcacagtttgtatgtaaattatgagacgaatattttgaacctaattacgccataagttaataatgtggtgctacagttgtcggtgacatgggaccgggagtatcatgacttagagacttgaggcagacacgatcacccacgtggcctaaccctctcgggggggggggggtcgggcccgagggtgatacggccgcccttctctttgtctccccgaggggtcggaccgctcccgtctcagccccgagggccgaggcgccccgaccccttgtgggtgttgcgccgcgtatatggggtaggtgagcatagcggggctcacctaaccacatttattgcggtttggacgagcgcgtcacgccgcatgtaacgcagtgcagcgcgctcgtttatccggtctgtgatcagtcacagaccagtcaaatcgtgggttaggtggcgacaggcggtctgacgcacgcctcgccccatcccgttaggacgagagcctccaagcactcgtccctagccggagccggcgtgttagctcctagagatggcacattggttccggtcagatatatgccaggcttcatcctaaccattacaagcaagacattgtatgaagaggggcgaacatgcagattgataaactaacgcgtttttgacaagaatgaccgatttgtgaccgggctgacactggtcatgtcgtctgcagacagccatgttcccacgttgcgctgcttctggcggaagtggaggtaggtgtgggccgtcccatcagaaggtcattcggacggcaaccatacaagtctccgtctgtttatgaaaagataggataagtccccacaaaagaaagagagggagagatggtgcatgtggtatccccttgagatataaaaggaggaccttgcccacttagaagaggggaggggaaaaaacgatcccagaacgatcgggggctggcccgcactttgtagcttcttcatacacagatccaccaaaacacaggagtagggtattacgcttctcagcggcccgaacctgtatacatcgcccgtgtcttgtgctttttccattctcgcgaaccttccacacacagacaaggagtttagaacctcacccagggcccccggccgaaccggcaaagggggggcctgcgcggtctcccggtgaggagccccaagctccgtcatctggcgcgccaggtaggggactctgcgtgtgttcttctaagctctcacactctttcgtgtgcgccaagctttttctgttcagcccaatggctgaacaagcaaaagcgcacaacctctctccgagtgttagcggtgacgacggggagccaaacccacgccgtcgagctcgtactccaccgccccctccacgccaaagtcctaggcaggaggaggcgctcgagagggtcgaaggatccgcgacttcgacatccacgggtgatggagaagggcgccgagatggggagcgtcgcctcctcgtctatggcgacggcagcacgccccagggcgcgctccgagctgcgggcgcgctcctacgtcacccgcccgttgtccctgacccggagtctccagcccaacgttggctggacgacgtggccaacttggtcatgacggcacggcagcgcctaggtgctggtgggcggtcctccgccaccaagacctccggcgctgctaccaccggctccgtgtcgtcaaggcggagggcgcggcgagcggcggctgttgctcgccattcggccgtcactccttcgtcagcgcctccgacccaggaagatcagcgtggggggccagatgcccgcatcgatatcgagcgccgacgtaatggtcggcgtgctccccacgcaacagagggcgcctcctcgtccggagtgtcacctcaacacggacgcggggatcagccctccgtgcccccggttggtggtgtcggctgtagagcctttgtggcgagccttcggaatgtccgttggcccccaaggttccggcccaccatcgccgaaaaatatgatgggagcgtcaaccccgccgagtttctccaggtctacacgaccgggatcgaagccgccgggggtgatgacagggtcatggcgaatttctttcccatggccctgaagggacaggcgcggggttggctaatgaacttgccacccgcgttggtccactcctgggaggatttgtgccaacagttcaccatgaactttcaaggcacatatccgcgcccaggtgaagaagcggacctgcatgcagtccagcgaagggatgatgagtcacttcgctcatacattcagcagttctgtcaagtccgcaacaccattccatgcatccctgcacacgcggtgatctacgcgttcagggggggtgtgcggcacaaccgcatgcttgaaaagatcgcctccaaagagccccagactaccgcggagctttttcagctcgcggaccgagtggctcgtaaggaggaggcatggacctggaatccctccggttccggtgtggcagcttcggccgcccccggatccgctgctcagacagggcggcgtgacaggaggaggaagaagaggtcagcccataccgacgacgaaggtcatgtcctcgccgtcgagggcgcttcgcgggccacccgaaaggggaggcctgcgggcgacaaaaagaaggaggccggcgctcccagcagggagcgcccaaccggcaagtggtgcatcgtccacaacacttcccttcacgacctcgcggactgccgcgcagtcaaaagtttggctgagcggacgaggaagtgggaggaggagaggaggcaggagcaccgagagggtaagtccccggcggttccttccggcaatcggcgaagtgaggacaagcagaaggcccccgccgaggacatcgatgacggcgatgatgacctaggtttccaagagcctggggccaccattgccactgtcgatgggggagcgtgtgctcacgtttctcgccggagcctcaaggccatgaagcgagagcttctggccgcgggcccctactcatgaggcgacgcgccgggcgcggtggtcggaggttgccctcaccttcgaccagaccgaccacccaccgtgcgttgcccgggaaggacagatcgcaatggtggtttcccccactgtttgcaacgtaaagctggggcgtgtcctcattgatggaggagcagccctcaacatcctttcccccgcagcctttgacgccatcaaggccccggggatgatgctccggccgtcccagccgattatcggtgtgacgccggggcacacttggccgctaggtcatatcgacctcccggtcaccttcggtggatccgccaacttccgcacggagcgggtgaactttgatgtggcggacctcaatctgccctacaacgcggtcttagggaggcccgtgttggtgaagttcatggcggcggtccactacgcctacctccagatgaagatgccgggccccggtggccccatctctgtccatggcgacctcaaagtcgcgcttgcttgtatggagcagcgtgcggaccacctcgccgccgcgtccaagccggagggtggcgacgagaggcttagcacatccgcccccgccgccccgaggcagcggatagtcacatgcgacgaggtcctggtcaaggaggttgccctgggcgacggcccgtccaagaccacacggatcggtggtcttctggacggcaaataggaagacgcgctcgtctctttcctgcgggcaaacgctgacgtcttcgcatggagaccggcggatatgcccggggtccccagggaggtgattgagcaccgtctcgccgtgcggtcgggcgcaaggccggtccggcagaaagtacggcggcaggccccggaacgtcaagccttcatccgcgaggaggtggcgcgacttctggaggccggattcatccgtgaggtcatccatccggagtggctggcgaacccggtggtcgttcccaaggcgaacggcaagcttcggatgtgcatcgactacaccgaccttaacaaggcatgtcctaaggacacttaccccctgcctcgcatagatcagattgtcgactccacagcggggtgcgaccttttgtgttttctagatgcatactctagttaccatcagattcgcatggctagggaggatgaggaaaaaactgcattcattacccccataggaacttattgttatacgacaatgcccttcgggttaaagaatgcaggtcctacttttcaacgtactactcgaatttctttgggtagccaaataggacgtaatgttgaggcttatgtcgatgacttggttctaaagacgcgcaaccaagagaccttactctcggatctagcggaaacttttgagagtctccgctccgcccgcataaaactgaaccccgataagtgtgtgtttggtgtacctgcgggcaagcttctcgggtttttggtctctgcccgaggcatcgaggccaaccccgagaagatacgagctatagagcggatgcgcccccccagcaaacttagggatgtgcaatgcgtcaccggttgcatggccgccctaagtcggttcatatcgagactgggagagaaggcgctacccttgtttaagctcctcaaacgctccgggccgtttacttggacggaggaagctgaacgtgctctcactcagttgaaggcgtatctcagctctcccccagttctggtcgccccggagccaaatgaacccttgctactctacttagcggcgaccccgcaagtggttagtgcggcgttggttgtggagcgcgatgaggacaatcctcattccgcgcacccccaccctgtgctggcttggcccgggagagagcagggaggagaggcccccaagccgaacggtggcccaaggcccccgacgaccggagcaggccctgtgcccgcttgtcagacggtgccaggtgcccccgacccccaggatggcccgagggccactgcgggaaggccgcacctatcgccctctgaccccgaggctaaccctgtgccgattcgacccgggagagagcagggagaagaggcccccgagccgaacggtggcctaaggcccctgacgaccggagttggccctttggccgcttgtccgacgacgccaggaacccccgacccccaggacggtcccgaggccactgtgggaaggccacccctgtcgtcctccgaccccgaggtcgtcggcacagaagacgagtgcaccccgcgaggccgcttggacaaagagcgccccagggatgtggcccctagcgaagaggatcggccccaccgaaaagtgcagcggcccgtctactttgttagtgaggccctccgggacgccaagacccgataccctcaggcccagaagatgctttacgctattctgatggcttcgaggaaactgcgccattatttcctggcgcatcgggtcacggtggttacgtcttaccccctcggccaaatcttgcaaaatcgagagggtactggacgggtggtgaaatgggcaatcgaactttctgagtttgatttgcactttgaaccacgccacgctatcaagagccaggccctcgccgattttgtggcagagtggaccccagctcccgagcccgtctcagtccccgaggccagctcgggccccccgcagctgcctcacaccgcccattgggtgatgcagttcgacgggctcctgtctcttcagggcgccggtgcgggggttacgttgacctcgccgagcggagacgtcctcagatatttggttcgccttgactttcgggcgaccaataatatggcagagtacgagggactccttgcgggactcagggtggcagctggactggggatccgccgcctcctggtgttaggcgactcccagctggtcgttaaccaggtctgtaaggagtaccggtgctctgacccgcagatggacgcttacgtgcgccaagtacggcgtatggagcgccattttgacgggatagagcttcggcacgtgcccagacgggataacacggttgccgacgaactctcacggctcgcttcctcgcgagcccagaccccaccgggcgcctttgaagaaaggcttgcccagccatcggcgcgacccgaccccttaggggagacggacgcgcctgacaggccaccgaggcccgtcggagtccaggcctcgggacccgaggggagcactcccagctcccttagattgattgcttggatcgctgagatccaagcatacctcacagataagactctacccgaggaccgcgaaaggagtgaacgcgtccagcgcatctccaaacgctacgtgctggtagaagggaccctctatcggcacgcggctaacggaatcctcctgaagtgcattcctcgggaacaaggcgtcgagcttcttgccgatatccatgaaggcgaatgcggagcccactccgcctcgcgcaccttggttggcaaagcctttcgacaaggtttctattggccgacagctctcaatgatgcggtcgacctggtccggcgatacagagcgtgtcaattccacgccaagcaaatccatcagccggcccaggccctgcagatcataccactttcatggccattttctgtctgggggctcgatatcctgggaccgtttaggcgggccccgggcgggtttgagtatctgtatgtcgcgatcgacaagttcactaagtggcccgaggcttatccggtcgtcaagatcgataagcactccgcacttaaattcattaagggcatcacagcccggtttggagtgcctaaccgtattattacggataacggcacccaattcactagtgaacttttcggcgattactgcgaagacatgggcatcaagctctgcttcgcctcacctgcccaccccagaagcaacggccaagtggagcgcgccaatgtggaaatcctcagaggccttaaaaccaagaccttcaacatcctcaagaagcacggcgattcgtggatcgaggagttgccagcggtgctctgggcgaaccgaaccacgccaagccgagcaaccggggaaacgcctttcttcctcgtctacggcgcggaagcggttctcccatccgagctcaccctgaagtcccctcgggccaccatgtactgcgaggctgatcaagatcagcttcgcagagatgacctcgattacttggaagagcgaaggcgacgcgcggccctccgagccgcacgctaccagcagagcctgcggcgctaccatcagcgccacgtccgggcccgatcactctgcgtcgacgacctcgtcctacgccgcgtccaaacgcgtgctggattgagcaagctgtcaccaatgtgggagggtccgtatcgagtgatcggcgtcccccggccgggctctgttcggctggccacgggtgacggcacagagctgcctaacccgtggaacatcgaacaccttcgtcgcttctacccctaaaggggaatcgggtgtcaggtttcgggctcgggccaaccccgcacccccctcgggtgtgcagggtcggtcgggggctaccacatatgcatattcttatttctcttatatctgtatttcaataaaagcattttcgatttcctaaaggctgtatctgtgctgttgtttccttttgaaggatcttgacttgaaataggtcactcgtgttcaatcctgccctcgggggctcgggtcggctaaaatcgccaaacggggcccagaaccgagccgtgccccggggcgtagtgaactccgggggggaatcagcaaaaacccacaatcgggtcacccataaccctcggtcaccacgctcccggcctggccagtctcgacatgtggatctccccaggcactagccccgacccgagccatttgaggactaggacctgggcacgagcccttgttcaagccaagacacaaaaggaccgtggcacagacatccttgtctcatacacacaacaaatagaattgacacaaaaaatttcctctttatttgattgcagattaaattagtctatacaagaagggggcccgaaggcctcggaagaagaaaagaagaaactatttaaagattggcgggggcctgggggctcactccgatgcacccgggtcgccagcctcgtcgccactgtcgcccactccgccgtcatcgtcctcctcgtcggagttgaaggcgaacgcgagccgaggggtcgaaccctcgaagctgtggacgatatggtcggcggggtcccggacctgcgcgcgcgcgccatacttggtcccgggagggaactcgtncagcgccgtccatggggagaaggtcggatccctggcttggtaactcgccagtatgag

SEQ ID NO: 68155 - DNA, 13212 bp, Oryza sativa
gccgccccgccgctacgcgcccttgcatccagctcccttgcctgcgcctcgagttcagcggcccgctggttcagtgcggccctctcggcgcaggcactttccagattgcgacgcgcttgttcctcttgcgcagcctcgcggagggacaggctgtccgccagccattgcgccgcggcgtcggcctcctcgagagctcgctcccgctcggtgagcgcggactattcttccgcacaggcggcttcgtgcaccgccagtgtgacctcccgaatagcaacagcggcctcgcgatccgccaggtccctctccacggcgcaggcacgctcttccagcgccatggcacgggcctcaagggcttcttcgcgccgccgggatgccacctcggtctccgccgcccgccgttctcgggcagcggcagcgtcaaggaccccccgggcggcgtcgagctttttccctagctccgcctcccagctcccgtattgaaggcggagggtgtcctgcgcctcgttcatcacggtggtggcaatgagggcagccctccgctcctcctccacctccttggcgatctcccccagcaccttccgacgggcttcgagctctgagacgtgccggcggtgtgccttgcggcccacctccaccatggcctctaccgagcgtcgcccctcttcgacacgcgcccatgcggcgtcgagctccgcccgctctgcttgcagggcctccacatgggcacttaacccgtccaacaccgtggtgtttgcgacggccaaggcctgcagaaggggttctgcgctcagtggagcaacggaaggtgtggggaagagccgcctcggtgaggatgccgcgcggctcggcccgccgatggacgtgccagactcagggatgtcccccggaccgggcttgtcctgagtgtcgcccgagggattgggcccaagcgatgcgcccgcggcctcgtcgcgagctgcctcggaagtcgtcgccgcctcggcctggcgaagtctggcctcctcccgagcggcttcttcagcttggcgagctcggacgcccacctgggcagcttcctcggcttctcgaaggcgatccgcggcctcttgccggtcagtttcacgggtcgcctcggaggatgtcgtcgcctcggcctggcggagtccggcctcctcccgaacggcttcctcggtctggcgagcccgggcggcctcccgagcagcctcctcggcttcccgaaggcgatccgcggcttctcgccggtcagattcccgcctccgggcctctgtggtcgccgggtcctcggcctcagactggctggacttggaatagcgggagggacgcgacgggatctcgctgaaacagaagaaagaccagaagacaaacaagatggatgagtgaaaactcgcattgaaggaatgaatacggccacgatgggcgtgggacgaacctgcgagggggtcggttaaacgaccaccttggaggggaaatgaggtttccccgggatggttctgtccccccccatcttgcggggccgtttcttcttccgctccccctcgggctgcgacgtcggcgtggccccctccgggcgcctgctgctggcacgcgccgccccgccccctcggggaggagatgggggaggggttccttcctacttcctcttcccccgggcgtcggcagggcggccgatccccgggcccccgacgcagggcccagaagcacgaccccctcccagggtagattgttcccccctgcggctcccgcccgcgccatcgtggcctcgaggagcccgctcctccgacgccccgaccgcctgcatgatggtcaggatggaggcgcggtctgcatcgcagcagagggggaggactccttgaggaatgagggatgcctccacggagctgagattcagcacccgttggaccactttcttgaagtcctcaggagcccagtcccatctgaccccctggtgggtcctcatacagtcctcggacccggtgtactcccaggcgccctgggcgcgccgctggagtggcgcgatccggcgacgaagatagtcgccgaacaccatggcccctgtgagcccctgggatcgcaggcccgccaggcggtcgagaacggcgtcgtagccatctcccagatctaccggcgtccgccagttggaggcctgcgctgggggctggctcggaagtcggaggcgcgcttcgtcggcgaggggggtgtagaaccagtcgctcttccagtcatcccacttcttgcgaaggacgcagggaatgtagcggttcagcaccggcccccgcggctggaagtagcaaccaccaaccaccgacggcggcgacaccggctgtacggtgaagaaccaccggaacagccgaagggatgggcgcaccccgatgaacatctcgcacaggtgcgcgaagatggccaatgtcattaccgcgttgggggtgaggtgcgccatctggagatcgtaaaactccagaacatccatgaagaaagaagaaaatagcggaaccagccctgccatagcaaaagggaggaagaagacggaccgccccgggtagcgtggcgccgggcatccctcgcccagcgagactatctcccggccggtggcagattccggcatgaagcggcgcggcagcccggcttgtctctcgctcacgatgcgggaaggcggcagcacgctaccatgacgccggaagaagagatgtttgagagcgagcgcgtgtggcgaaggtagggcacaggaaacaaggagtcagggcgcaagcggcgaagacaaggggaataatggcgaaaagaaggaagcaaatctcttcctcggtgactttatacccttgccaacgctatgcccggctcctcgtttctcgcgccctctatctgccccctcgtttctcgcgcccacacttccactaatcccattcgcccgtttgcggtgcatgaggtggatatgcggctgtggcagtcgagatggaacatctcgtgcgcgcgttaattacgctcgccgaccgaagcgccatcatcatatctccaggaaaaacgaaccggctcgtcccgattcgcgtgttactcgagtaatgtggcagtcttgaagagaccgctcattattgacagccgagtaaccattgccgatgtgcgtgatttgcgaccgttgggtttctgcccaactgtggagaccggtcccacctgtcaccaggccttaggaagtggcgtcacgcccgaccgcttccctcgaggagggcgatcgccctggcataacgccgggggctactgtcggtgacatgggaccgagagtatcatgacttagagacttgaggcagatacgatcacccacgtggcctaaccccctcggggggggggggggtcgggcccgagggtgatacggccgcccttctctttgtctccccgaggggtcggaccgctcccgtctcagccccgagggccgaggcgccccgaccccttgtgggtgttgcgccgcgtatatggggtaggtgagcatagcggggctcacctaaccacatttattgcggtttggacgagcgcgtcacgccgcatgtaacgcagtgcagcgcgctcgtttatccggtctgtgatcagtcacagaccagtcaaatcgtgggttaggtggcgacaggcggtctgacgcacgcctcgccccatcccgttaggacgagagcctccaagcactcgtccctagccggagccggcgtgttagctcctagagatggcacattggttccggtcagatatatgccaggcttcatcctaaccattacaagcaagacattgtatgaagaggggcgaacatgcagattgataaactaacgcgtggtggacaagaatgaccgatttgtgaccggtctgacactggtcatgtcgtctgcagacagccatgttcccacgttgcgcctgcttctggcggaagtggaggtaggtgtgggccgtcccatcagaaggtcattcggacggcaaccatacaagtctccgtctgtttatgaaaagataggataagtccccacaaaagaaagagagggagagatggtgcatgtggtatccccttgagatataaaaggaggaccttgcccacttagaagaggggaggggaaaaaacgatcccagaacgatcgggggctggcccgcactttgtagcttcttcatacacagatccaccaaaacacagaagtagggtattacgcttctcagcggcccgaacctgtatacatcgcccgtgtcttgtgctttttccattctcgcgaaccttccacacacagacaaggagtttagaacctcacccagggcccccggccgaaccggcaaagggggggcctgcgcggtctcccggtgaggagccccaagctccgtcaacagtaaacacttactaataacggattaattaggcttaatatatagattcgtctcgcagtttacatgcaaaatctgcaatttgttttattattaatctacgtttaatactttaaatatgcctccatatccatcaaactttctttttaccaaaacaactaaacacggcctgcatcttcctctgtcactgcggcttcctcgatgttgttgccaagtgcagcctctagctcctaggtcaaccttgccacgatcagcctgacgcgcgtcggccgcgaccacgttcagcgccgccacagggtcctgcagtgcagcgccaccgggtcgagcgaccggtgcgtctccgcgaacgcaacgtgaaccgtgtcccaatggtgtccagggccatgagcacgagcacgggcgcgcagggcgagaccgacacgtatgtgcggcgctgtgcacgacgacccagttattatttttccacttaataaatgtggctttaactgctcatcagtctatcacttgattatttgtcactcaatatatacttgctatctccattttaggcattttcctttaaacatcaactcatccatgcatggtaagaagaacatgtgggggttctgtgtttagaggaagaacagcaaattaaatggttaacaaagaaattttatggaaaaattattcaagttcctatggtttgagaaccaccggttcacagccgcacatgaaaaatttctcatgcacagacgcgatgggctggtgctgaactgctgatcaacttcgggagatacagagaggaggagaggggcaaaaactcgtcttttcaatgctatttctctctcaatttgttctgaaaataataaaataatcacaacagtgtcccttaacaaattatcagtttctaatgtgtccacgagccgtattagttttttcagatgtctagcagcaaagatcatatattttaagtgtcacgtagcaattttttttacaaaaaacagtgtgaggcctataagttcacctgttatttagaaaggcactatatgcagaaattcagtggcgccatatgtagaaaatgatgaaaaagggcttgatgattagagcaagtacataatagtgtcaagacgaaagagaggagagagaccgggtatatatgatgcccctcatagaagaggcagcttgcacatgatcgagctccaagagaaaaggagagaaaacaagtaaaataaattcttagtattggaataagtgtattagggatagtgtagggtgtcgcatatctagactcttaattaatgactagcaaaatgaacaaaattacagatagcaactactccatccgtccaaaaaaaactaacctataacccctcctaacttgagtttttcttggatggagggagtaccattcttattaaacttgatcttacacggttttagaggctttaaaataaatgagaatgttcttctttaattttccgatgcaatgcacatccagtctgcaagcaatgacaaaagaacagcatagggaaataaaaaaatggttttctcccattccattcccattaattattgagatgtatatgcctccttggtcctttccagttaaaggttaaaaaaaactatattgggttttttctatcctgacggaatttttctctgacaagctagtcctggcggaatttatttttctgacattgacacgtcatgtacaactttcctgacgtgttttttttatcctgacggtttttggccgtcataatttaagtaatctagtttctggtagtgtgttcatctttcttcttatcataattatgaaagaaaagaaactggatatcacaagatttcagtgttattaattgtaggaatttatcatctagttctcattagtgttttttacccaaaaatatatatacctgcaatttaatataacaaaagatcctggaaactaaaacgacccatagtcaaattctaattaactatcaaaacatattttatatttctattatataatataaaatatcataatgtagctagaatcatttacaataacatggaacctatgcctaggctggccatgaatcacttccagcattagaattgtttttcctgaagcattagaattgtcacggagatgatactggaagaagggcaggagtcatctggttttatgatggagttagacgaggatacgctcagattagcagccattccgggcgaccttctcaacaaatcttgcttctactgggcactcagtacattgtgttagcctcttgtacgaaaggcaccatcaggccatggcaagattctcagttgctgatgccactcattcctaaacaggaactgtttatgctctcccatggggtgttcatcaagattgcgattgagaaaaatcatgtctctaaatttttgtgtgctcttgcccctctatcgttgttgcaccgcgtatattgtatccaaattgaagcggaactgagaacaatggaaggggtttataagtgaaacagtttaagggtgatcgacatgatgacgaggacgatagtaataaaaagaggtgtttcaagtatcatgcgtctaacatcttcacttgataaggacgagagtaataaaaaacagttatgtacatcagcctgctctcgaatttaagttttgcttttacatgtcgggtggacgattttatatattcatttgttacatggatggaatgactcagtacatttttcaccaatctttttgaaaacaattatataattaaagatacagttgtagaggcacaactgattttatgtgcttgctatggtatatggaggagcctagacatcgggcgtctgatggaggagtagaaaaatcgagcggtgatgtcagcaagatgcatgtgtgcaaaaccactttaaattattttttctcttaaattatttatccaaatcatgatccgattacaccattaaattcattttaattaaatcttcaaaacaagacaacatatggatatatttcgacgaaaaaaattttagcttattattgaattatttttaaatgttgcacgttgttccaccaagtatatcggaattgtttcactaagtagatcgaaaatgtttcgatcgtttaaatcgggtgttgtttcactttatataaaaacaatatttcagcaaatagcgaaagaatgtttcagttcactgcaatattagatctatatatagtgaaacattgtgattgcactagatgaaacatttttagtggaacaaaaaataaaacgaattcccttaattgagggttttcaaaataagtgggtgatttgttgcaacgtcctgcatggtggggacacgtgacagtatggcaggggagacgtggtggggccctacgggcgcgcgcccacgcgtcggggggtgccccattttcgctgcacccccccccctccgatcctaaggattatcgttggtatattttgctctatctaggggttgttgcctacactagctaatcccgggttgatcccaaagctgccactggtgtagcttgcacggttggagaataatatccgtttcggtttttgttaggcgatgtgataggcacggtgggtgccgccctagtgattgtgcgagggcggcatgtgcgtgtgtgagtctgtgaggtgtggtgtgtgttttgtcgagaattggggatcgtcagttggcacgagataaagacttggcagtgttaaatagctaggttttgctttgtggagtacccattatgaattctagagaaataatacagagaattgccccaaaagttctctccgcctttccattgaaaattaactctgtttttgctctctctgaattttgctattcactacagtgcagttaccagggttcttcctgtataggggtcaatgttttatagttctagcttcaatgggcaatagaacactctctgaataggtagaatgcagttatagagtttagcgaactacatgctgggcgaccttctccccatgttcaatcccagaaggttacactagcctattgtaattctgaattactgatgccactcattccaaagcgaggatattgtttatgttttcccatccaatggggatgttcatgaagactgcatttaaaaaaaaaatcatctcccaaaattgttcctctgccattttgcagccaaagggtatatttagccaaactgaaggtaactgaggacaatggaagggtttgatatatagcaaagttcagatctgatcatgacaagcatgagagtaataaaaggagtatcaaatactccctctatttgtaaatatttgtagctattaatttttttaacatgtttgaccgttcgtcttattcaaataattattaattattttttatcatttgatttactgttaaatatatttttatgtatacatatagttttatatatttcacaaaagttttttaataatacgaatggtcaaacatgtgcttaaaaaaatcaatagtgtcaaacatgtgcttaaaaaatcaatgtgcttaaaaaacggagggaatatatcagacagccacctaaccacacgtaacattgaatagcaatgaaatatatataacttttcattaaatacaataattaatcaggctcttgatcccactagccatatactttctccatctagtcttgatagttatatttccaaatctgaaaaatttattttttgatagtcatatttcaatccaacaacctatcattttaatgactttctcggaattaataaatgactcttcactattccacacaagattggctacataggtattgagaaatgtaaatattaatgaatcgcttgtttacgagaaatgactagtagtatgtttaaatggatgataagtagaattgcttatccttgttctgtgtactaagatgaaatatgactatcaaaaatagatggagggagtagtataggcacgtaattaattagtgtggtgttcagttcggttattcaatgctgtgacaaaatcacatgaaaatgggtaacttcgatttagcaattgttttgtttgattgctccgttatcagaaaccactatctggcttcaccacggcgtcaccacgtgattgatgttaccatgctgtccatctcctgtttttttctttccttgatcaatcctcttaatttgatttatcagaacatattacattttcttaatgaaattataatgactaccaaaaatgtcaactgctgtggataatcgatgtctggcatgcatgtgtgtgtctaaatctagctactcttatagcatttctcacaacccaataacaactatatcattcatgttacagattcgaatctggattacattcataacataattatctttacgttctgaatgttcttaactactttggagagatgcctaattcaactgaatgttacatacggcatttggccacattgcaacatgcagatcgaactgagtagtactccctccgtttcataatgtaagtcattttagtattgttcacgtttatatagatgttaataaatctaaacatttataatatgaacattgctagaatgacttacattataaaacggaggaagtatagaatttggcgcgaccgttcgggcaaccacacctcaatatataataaggacgcatagttactaatcacttcttagataatgaaaatggtttatatctctggtctctgctaggaggcacacagccaaagtcagtggataaggcacccccaatctgatgttaatttccagtctatagcctgcactgttggacaggagtacaagaccaggctgtgattttttttctaagacccatttgttgttgtagggacatttaactttttaccacattaaagatgtggtaattaaatttatcacttgatgtctatgacttgtaggtcccgtgacaaatcttttatcaccacttgtaatagtggtaaataattaattatttccatttctacctcatgaaaagaccgtactgtctgcaacgttcaaccggcctatgagcttttagcttcccactgtcctcccagataaactgccgtaccatggagctaccaaaagaatttgaggaccagggtgcgagttaaacagacgtcgctctgaccttgtgctcatttgggccttctcggagctcagatgatccatcgagaagtcatgctaagctgagtttatgttctcctgatactgctcatttctaatcatacaggaatcaaacatataccgatattgcagatcatgttcaatttcatcctataatagatgaagagggtctagtagaagttgggagaaagaggaatgctagaagagatgaagagggatatgcaatggtacagtagttgagaggggggggggagggggtattatattcatgtggagtagaggataggtgaaatatgtattgctattaataattttgcccccctctataagttttgcttttgaggacataacacagggggaaaaatgggattagttggacagccgttggaaggtggttatgcgagcccatccaaatctagtacaactgttaaataatgtttaaaacaatatttaactagtagcaattattctaacttttcattattttaactttatttgttcctcctccatctcaattttttctagcatatgttttcttcagccgacgcgacccttcactgctcagcaagtggtctttagtcccggttttttcttttgttcattgtttttactgcttgcatattgatttccccaaatcgagttgctccctacatcctcatatcatagattcacagataacatcacagattcacaccacagatcaaatacatcacaagtttacatattcacatcacaaattctcaaaaaaaatacatcacaaaatctcgaaaaattaaaaaaagactgaacttcttcctccgtctaccgcacggccgtgctgacgtcgttgagccgttgtcgctccaccgccgcacagcctcccatcccgctgcctcccctcccgccggatctagcataggggagggcgagaccgcggcttctgccgctcggccgccgctgccacttctcgagagagcgagagagagagagagttagagagaggcgaggtgagagagagagagatagaggcaagagaggataaggacgtgtagcacatgtgggagatcgagggaggcgtggaaaagaaaggataagcacatgggagagagatatttagtcccggttggtgatatcaacaaggactaaagatcgttagggacctgacatagcctgacagttattgtattgggacacccgtgactaaagatcataaagtgccattgggcttttgaaccaggactaaagctgatctttagtgctggttcctatttgaaaccagactaatgtgatttttacatgatccggcaaaagatcacttgtccaggagtacttcttgctcactcctcccatcctctttcctccacatcaactgacatgctatggactagcacactaattaccgttgtacatgctgtaggaatagtatatttcaataaaaaaaataataggaatagcatagtacggcaccacatgccctgatgttaatataattttatatgaaatacaatattttgtgataaagttaagtagcctcgtgttgaaacatcggtatatatatatggcggagatgaccgatgagctaaatgtatgcaatgcagatttttcaccaaagatcataaccaaactagcccccaaggtacatagaacaattattcctaggtcaatgatagacaatttgtagggttctcctaccaaaatactcaaatctgttttgaaatacaaggatgacaagattatttagcaaatattgagattaagaaaaaaaagtctttctctcagcaaatatggaatagatggggtaaaataggaagaaattaaagtatatgagatgtgattgaatactatgaataatgtgctaaaaattattatattttgttatattttggaacggatagatggagcaaactcaaaacaagatagacagcggtgcggttcataattaatatggatgcatatgcgtcttctacattaaggtatttaattattggagatacaatattggattaagacgagctaatgctccctccatttcaaataaattacttgcgatgtgggtttgccggttaaacattaacatcattttcttgaatttgtatagtttgataagatgtgaattacatattgcgaaagtatttttcatgtgaatctaaagaaatttagtatgatgttaaactatataagttgttggatgatggttcgcaacttgcaagcagcttgcgtgcaacctccaacaccagcataggcaagacaagcatgcagaccaccaacaccaactggatccacgtctctgtgggccatccgatgaagccaggcccatgtccatgttattgtgtgaggataagtatgttagacctccctcacctcttgtccctgcttgaattgcttccctcaaccacaataccagatctaacgcatcttctatatttgaaaatcagagcaaatcgagtccctcggttgtttgaatagcagttttatcctaactggtgctcgtgggacccacatatcagtaagaaaaaataacaaaaataacaaccccacttgttagtcataatctttttttttctctttttactcacctctctcttttctagggatggcagtcgggtacgacgggcacgggtagtgactacccatatccatgcccgcgaggtaattcatgcccgcgggtatacccgttactatatgacgagcaaggaacactacccatgcccgttgcccacaggcgccatgtgcccacgggcatgcccgtttacccgtcacaaactcacagttcaacatttcaaccacaaatctccacaagcagagagacattatcacaatttaaagaaaggg

SEQ ID NO: 68156 - DNA, 9749 bp, Oryza sativa
attataatttattttgttatgagttgttttatcactcatggtactttaagtgtgatttatatcttatacatttgcataaaatttttgaataagacgaatggtcaaacatgtgagaaaaagtcaacggcgtcatctattaaaaaacggagggagtagaaaatagtattggcgatttgtttgaaaattaaaattctcatttttttgtctcgccaatgaagttgaatttggacaagactttttatactgctattgaacgtcatcttatctacatgtgggatttttttccatgtagatttagataacctttactccctccgtcccaaaaaaagtcaaactgcgggtttacgtgccaacgtttgaatgtccgtcttatatgaaatttttttataattagtattttcattgttgttagatgataaaacatgatgaatactttatgcgtgacttctctttttaatttttttcataattttttcaaataagacggatggtcaaacattggacacggaaatcagggttcgtctttttttgggacggagggagtatgtcgtggtttattcgagttttcatggtttccacagtatattttcgcactcaactaacaaatgcactattagcaggggcaatgcctggatggatcattaccttcctgctcatcctacagtttatttcgtcgctccgtggattggtaatcttcagcttcgttgctcattttttcctcgtcttcttcgctggactccgccgccatcaaccaaccggcgtgcggatgttcatcctgtggggagcgaaccagtttgcccgttgggctccggtcaccgtgctgggcacgctgtcagtcggcagcacgccacagaaagagcagctggtgacgctctgggtggcgttcatgctgctgcacgccggcatgcctgacaacttcaccgcctactccttggaggacaccgttctctcgaggcggcagcaggctggcgtgtggtatcagctgcttggatcggcgtcaccattccctttcctgctgaagaacatctccttcatcatcagcaatggcggcgacgccatgctcggggtctcctcgctcgtcttgttgatggccatcggcaagtattgggagggagcattccaagcgctgatgcagggcaacctgaagagcatgcaaagctcgagaaagaagatgaagatgaagaacaacagtacaaaatcagtacgaaacagcctccagatcgctaggcgtggaggcagggagccgaatgatgagcaaatccttctggctgctcatgacatgctagacatcaccaaggacgccttcatcgattttctggaccaaaataatgcggatgaacaagaagcactctctgctacatgggatgagaagctgtacagggtggtcaacatggagctctccctcatgtacgacctcatctacaccaaggcggccgtggtgcactcatggaaaggctacatcctccgtttcgcctctccgatcgccgcgacggcggcattcgtgctgttttggctccacagcaaggaaggtcaggcgacggccgacgtcgtgatcacctatgtcctgctggccggcatggtcgtcctggacatcaaatggcttctccgagcggtggcgtcgacatggttctactcgttccttgatgagaggccacgatcgtggcttcatcatgcacttctgtgctcagggaaatggcgactgatccgtcgcctcatcgtgtctgatctgaatctgtttcggatccttgacaataataagaagccaactagatacaggatgtggtcacaaaccattggacagtacaacttgttgcacgagtgcactcgctacgagagcgaggcaaggaccaagaactggaagagcggcatgttcaagcggttagcaccggaggagaactggatggagtacgaataccagcgcatgaggggcaatcatattgattcaagagatttcagggacgagttgttcaactctatctggcaagtcttgaagaaacccttcccacaacgacgaccaccacgacaaataatagtgacggaggcctggaggcctgcaccggcggctcctccatttacacatgctcatcaggaagcagaccttgccctgaagttcactcctgatttacaagagaccattcttatcttgcacatcgccacggacatattcctcttctcagcggaatcagaaattgaagcatcgcccaagtccaaaaaggatgtggaggtgatcaaggcgttgtcagattacatgatgttcctcgtcgcggtgcggcccgggatgctaccgggcctcgtcctcagtagccgatatgaagctgtcagtgaggctcttgccggaatatggaaggagaaagaaggtagtgatccttccttgcgtactagctcaatgatgagagagaaacgtcttgccgagatcctgattgccaacgaagatgaggagggaaattacttccaggtggacgattcgaggccccaaagcggctttctgagtgttctttacgacacgagtaatgttctatcagagggagctatactagccatgtttctgctacctaggataagaggtcctaattttagaaagaatatcattgaaaaagttggagaacacggcgacggcgagcccccaatactaaagaaatttcaccggcagtttccggatttgatggaattcgctaagaatgtctcttttccatcaatcgcaatgacgacggatgccatcatcggggagtgggcacgtcagctgattaacgtgtccatccgatgtacaagggattctcatgccaagcagcttgcccgtggtggtgagctcacgaccgttgtgtggatccttgctgaacatgctcgcatacttcgcatcaaaacagaaaagaaaccagctagctacgacgcagtataggcattcatgcatgtctctctccctactgaactgagagataactacagagtctcagatggatatactgtttgatctctcctttgtgtatctgtgtgatccatcggcctgtagatggttgtagttaattactttgcagggttctcatttattctctagacttaactaacctgtgtaccctctaaattgtggtttcaagagggttataattaattaatatcgcgtgaaaagtctaccattcgagaagacattccctaccaacatttcatgctcacttggtcattcttgataacattcgagaagacatggagtactcaacatcatcgaaaaaagatcaacgttctacaagtgaatttgaattaaagtctaaataactgccataaacaagcatgaaatcaacgtaaacgaacgagttgatgttctcgaccaaagaccttggaataacaatgttgttctcgcttgaccattctcggacgagcgagaaggtgcggagtatacgactaagtttactgacctgccgtaatcgagaatttgggttgaagtcaagaattttcatctcggtaggttcaccatctcttcattccataattttcgtcgaactccaccaatcgttctcgagtaattgagtagtcgtccaatcgttctcgagtaatcgagtaattgtagaatctgcgacaaagccctgaaatatgactttcttgaaatcaatactcataacagattgttagatacaaatagatctccgagcgaacgctcaagggtaacactgtaacatacccaaattctagaccttaaaaatttcctatcaaaatagttggaagctaacttttccatttttgagagctaaaaatttccatttttaacctaagtgtggtcaatctaacttgaacctaagtacaatttgagaataaattaaaactttttcatttataacctaggacataaatgcaaacacgagtaaaagcatgcatacttgcataaaacatgttttgacttgtccatcatgtgcatttgaattttttatttgcatttcataataggtctcatgaatattaactaagatctagataaacaactaaaccattagggcctagtgttagctagaggaagttaaaattgtaggatcgaacacaagaaaccaagcctacaagagggggggtgaatggtagggaaaaccaaaaacccaaaaacttttaacggaaataaaagttaccctcgaatcgatggaaatctcgacgtaatcctgtcgccgccgccggtcggaccgctcgcacgccgccagtcgaaccgcttgcacgccgccggtcgaaccgctgtcttgtcgcctgttgaaccgttggtatgtcactggtagaccgccgaacccgatgaaacacaaatcgaagaactctcaaagtagatgacaactttattacttctctctgtgtttacaaagtgcaacaacagcacttcttacaaaaatctcgactaaactcgaaaccctaagtaaactatcaactccacgctctgaaaagcgataccgaaaagcgataccaggaatcctcacgctccccctctatttatacatgaaaaaccctcctaatcaaagtagacgtaggactcctattcacagtaggactcaatctctcaatttcctttttctccgaaaccacagccgcaccggccatggaaaatcctgctccggatcggattcctttaccgatccttcgccagctcgcactcggtctcctcgcgccgcacggcctgggccggctccaacaagccacagccaccgagccgctctcctgctgctcggccaaccaatcatgcacacatacatgcttcacatgcatgtatcgatcacacacatacatgtacagcaccgtacatgcatgcatacctgcacgtataccacacatatatgcatgctgtacacaagcacgcatacacatatgcacgctacagtacaccaccgtactgtagcaccatacataaacctcttccaattcccttcgcgaacaccgacacttgcacgcacatctcgtgaagcccgttgcgaagatctctcccacacggtgtccatccaccgtatgccatctcgtatccaacttcatcacccggtatccttgaccgtctggacctcaactcctccctgagtctcgtccagatccccaccgttgaccgaagttgacctccaagaatccagactctagtcaccttctcacgtggtatcccgaccgcaatagacctctgttcctccctgaacatagtctcagtcctcaccattgaccaaggctgacctccagtcacctgcacacaatcagacgaaacaaccgtttctgggcacagatatcacaacctgacccacattagtcacacgcattcacaccaacattcacacaaactctcaaaccaattctttaactaaatcatttgcatagccaattgttcatcacaactattaatcatgacaatgatttcacaatctcccccttgatgaacacattggcaacatcaccaaaatgcaaatttgtgtttttgaaaaataaaaacaaaaatcacaaaagtgaaaaagaaaaactctccccctttttaaaagaaagaatttctcccatcaatttgcgatcaaagcacaaaattgactatttttaaaatcgaaacaattcaattctcccccttacaagaagcatgcattttgtatatttctcctcctttgacaatgatttcatcaagaattcaaaagagaaataataacaataaagcacaaatgcaattatgtcatgattgccacttggaataaccattttttattttatattttctcttttttttcgagagctttgaaatgtaccaaaagcaattcaagatcatgttttgcaagatatgggagataaattcatcaactagttagtaagcatgcaccatagtataaacatgaatcaaagatattacaattaagcttaaatcagcaataatgattcatgatttcaaatgatttataatgcaatatattcacaagcacatagattgaaaaataaacactatacatatatacctattgcatttatcactctttctcaaattagctttagcacaaagcaaccaagagaatttttactttttcttgagcctttttgctcataattttctcttttattccgggtacgtccctgtcgtcaagactgtttccagggattcggcacccattattttgctcacatcgaatacgtccttgtcgtcaagactgtttccaaggattcggtattcattgttttcatattttttattctcttttcacaatgagcatttaaagctatttgagtaataacaattcaataatgcatatatataaagcatttataaatcaaaccatatgctagcatcaatattgcatattttcgtaattcaagtaaaagatttagtgtcatgcatcatctcacttaaaagcaatatctaagcttcatataaagattaaaatgcatacaagctaacatagcaacaaatagacctcaattattttgctagcatgcacaagaatatactagaggtataaaacaaagctcttctttttcttatttttattaattttcagaattagagcaaatgcataaaaataaacatgaatgcatgaaaaagcacaaactccccctcaaattaacctccaattctccccgaagaaaaatcaagaagaaattaaagatttcgagaaagacatccaattgccaatgatatcaccaaggttatcatgaatcgacatatatccacttgtattaagaaaaactactacctcaaacactagcatatgaaaagctaataatcgagagagtagaaccaaaaaatatgtcaatccaaaagtaaattgatgttaccatgaaaagcaatctcaacgttgaatgcacatggggagtatgccaccaaaatacctacgaacgaagatgtcgaggcctccgtgttggggttagaaataagaaattttggaatccaacactgagtcacacgaccactagaaccagtaggtacatatgcactatatgcactaacaaaatcagaaccagacttacctgaaaacttaccttgtcgcttcacaaaagtccgatttgaattacgtgcaaaattgccccggggccggtctgaccgccgctgtccctgcggtctaaccgggcctggcagccggtttagctgcggtctaaccgtgctccttgaacaaaaacccgatttttgccaccgttgtttcgcaaaagcaatttctctttcctttttctgtttgcgggcaagtcaaaaacaaaaaccaaccaaatgtccatctttttcacaaaaagagcaagtatacttctcacgacaagtttgtgaagtagatgattttgaaattgatggttttgcatcaacagaaggttttgcattcacaccatttgatttcgaagaagatgcattcaaagaagacatgatgccaacagatttaaacacagtgttcttaggctcagtttcaatcaaaatttcacctctcctagaagcacccaaaacagtaggaggatgtctagtatgatgagcataagaatcaaaacctaaaccacgattgtgtgtgctaattttagattgatcaagaatcatgttgagagtctttttaccatcggaaaatctttgcaaagaacttttcaaataagaaacctcctgagtaagaatagcacaatttttgcaagcatccaaaagatctttttattttctacaagttgaacaagaaaacacctcatcttgtttaacaatttcttccatgtgtttaacacgctctaaagcatctttcaacttcaactcattcaaaacacactttgaacaatcttgagaaatcaaaacaccattgttttgtgttgccttatttacacatgaagcattgactaaagaacttgcacaaaaagcaactttgtattttttcaaaacattctttgtcaaaatcaactcatcaacaacacgagcatgtaaagcaaatccaagagcaaaagaagactccaactttttagatttttcaatctcaaattccaatttcttgcaattaacagaattgacatctcgcaaagcattaatttcagaaaataaaacttcacaagattgacaattatcatcattatgaatcaaagattttaatctagcaatttcagcatttagaatatcaatagtgtgatccttctcatcaagctcaatagaacatgtttgaagtttcttagcaaacttataagcagcatattctaattgatcataactaagcttttcttcattatcatcatcagattcatcaacatcagaacttgcattacgagcaataaaagctagatcaacaacttgcttacctttgccctcatcttcatcttcagatccatcaataacttttatgagttcctgaactaaccactgcatacaatgcttcttcttctccttctccttcatgttcttcttcttgttcacgtcatcctctttgactcttccatcatcttccttctttcctctcccaagcttaggacaatgcgaacgaagatgatcaagtgctccacactcaaaacaacgattcagttctcctcttttcctgttcctaacatttttcatagctcgagaaaatctgttagatagcaaaaccaaatcctcctcctcgaactgttcgagttgatcatcggatatggcattaaataaagcaagaacagaaggcttcgatgaagaagcaccaacatccaaaaaagttgaagacgaaaccaaagcactagacttagaatcacctttacgagaaagaatattcatctcatgagttttcagttttgtgtaaagcgaatccaaagtcaaagaagacatgttcacagactcctgaatagatgtaactttcatctcccaaatagacatatcgagaccattcaaaaagtgacgagaaatctcagattgtggataatttgcatcataagaagaatcaacagatctaagatcactaaaaattttattaaaccgagaaagataatcatccaaagcttcttcaggtttcatctcaaatttaatatattttgaaaagatcacgatgaagttctttaatgttatttgttccctgatgaaaattactcaaagcaatccaaatctcatgagcagtttgaagatgagcaacatgatcataatcagaacgagaaataccactcaaaagaattttgcgagctttgcaattttgttcaaaagcagttttttcagcagcagtattaatagtttcaggaatcacataagcatgagaaacttttctccaaatatcataatcttcagccataatgtaagattgcatcctactataccaatgagaaaaatccgttccatcgaaaacatgaggcttagttgaaaacctagcgggagtagccatggcaaaaactctagatcggttaaaatccaaagaagaaaacaaggctctgataccacttttaggatcgaacacaagaaaccaagcctacaagaggggggtgaatggtagggaaaacaaaaaacccaaaaacctttaacggaaataaaagttaccctcaaatcgatggaaatctcgacgtaatcctgtcgccgccgccggtcggaccgctcgcacgccgccagtcgaaccgcttgcacgccgccggtcgaaccgctgtcttgtcgcctgttgaaccgttggtatgtcactggtagaccgccgaacccgatgaaacacaaatcgaagaactctcaaagtagatgacaactttattgcttatctctgtgtttacaaagtgcaacaacagcactccttacaaaaatctcgactaaactcgaaaccctaactaaactatcaactccacgctctgaaaagcgataccgaaaagcgataccaggaatcctcacgctcccctctatttat

SEQ ID NO: 68157 - DNA, 24594 bp, Oryza sativa
catacatgcttcacatgcatgtatcgatcacacacatacatgtacagcaccgtacatgcatgcatacctgcacgtataccacacatatatgcatgctgtacacaagcacgcatacacatatgcacgctacagtacaccaccgtactgtagcaccatacataaacctcttccaattcccttcgcgaacaccgacgcttgcacgcacacctcgtgaagcccgttgcgaagatctctcccacacggtgtccatccaccgtatgccatttcgtatccaacttcgtcacccggtatccttgaccgtctggacctcaactcctccctgagtctcgtcccgatccccaccgttgaccgaagttgaccttcaagaatccagactctagtcaccttctcacgtggtatcccgaccgcaatagacctctgttcctccctgaacatagtcccggtcctcaccattgaccaaggctgatctcaagtcacctgcacacaatcagacaaaacaaccgtttctggacacagatatcacaacctgacccacattagtcacacgtactcacaccaacattcacacaaactctcaaaccaattctttaactaaatcatttgcatagccaattgttcatcacaaatattaatcatgataatgatttcacaaaaatagaaaccatacaccttgaaatatatcaacatggctaatgtcaagcctcacaaaactaatttggacatccatctgaagacatgtcatgaacatgaaagtgaacaaataaattatatcatatagggtatattctatcttaatcatctctataagcattctcttaatttaatgctaaagtaaatttatgcataaataggtaaggagcttatgacatgtgtaaggtaaattgtaattctaacatatcaatatcacctcaggttaataagagtccaaatataacttttataaacatttacatgcatttaggaaagggaaacacatataagacataagtcttgcgaattatctaaaataattcgtgcaagataaaatcatgagaaaattcatgtaggctctactcaacacatacaactcactgtaattttggtataatttaataactaaatttggtacctcaaataaatcagtcaaactaataaaaactagattacctgtagttcttaatcggctaaaaccatactttgtctaaaattgcatttaactgcataaaagtgtataagtaaaataatttattaaaatactaggtaatttatcatgaataaaaataatttttccagaatttatcttctctgtttaggtctcctaaaaattcgaaatattttccaaagaacccatattcctctaatttctgtgagtaatctatccataatttttgagtgcaactaaagaatacggaatctaggtatcttcatataccttcagaaaaatccacactaaattattctacccacaaattaaataattgaattactaaagtgggagagagaaataatcctgaaaatcattcaaacgttttcttcacccacgtttctgcccaaccctctcaccctagcttagtttgccacgacctggacccacttggcagccactctggctcgtcctcaccctgtgcaaatcttccagccgaccagagacagccgagagagagagattggtgccggctgtgtacgacgcgtagccacaacgtgtcgacgccatcaaactcctattctagccttctcctcctcccagctgcatctccacacatcattctccacctctaagccgaagaaaccgagggaggaggctctcaacttctccgtcgccctcatccttgccgccggccgcgaagaagacgactattgtactctactctcctcaccatgccgaggatttatccttttaatttcatcctctatcgtgcagcggatcgacgggaacgccgtcgtgcccccggcactccggagcgcgctccaagcgccgccgcagccgacatcgtcgtcgttccgaccactgtagaccaaaccaagccgagccgtcgcgccaacgtcttctccttgaagtcttcctcaaaaaccctcaaaaatcctaggcaatggcgcagcaagtgcggagatcggctaccgtcttcttcacctccggtcgccgtcgccattgtcgattccgcctcctccggtgagccattgtccgattcttcgcgtatacaccatccctgggacctcactaaccccatgaaaacacatgcatgtcaattcgatgagtggatcgagccgttgccgtcttcccggagctctacaccatcgccggaccatcttcttcaccgctgccgctgtccagactttcccgcgcctcgttcaaggttcggtgagcacccttgagcccataggattgcattcatgcatttcattcacttagaatcgagcaccaactcaacatgcagtagcagcctaagcacagccgccgctcggactcgccgccggcgtcactccgatgtccactgaccgagaaaagtagaggaatggaatcggaatagcatgatcttcattttgtcttttggtcgcaccctcaaacgagccaccgtttgccgctggcaagcttgagatcgagctcagccatggcttgatctgcttcagctcgaacgagggacctcctcacgagaatttagattaatatagggtcctttctgcaaaagctcaagacacacagaacagtcataggactgcggtttgatttcctgaaatcctaggggccttttcgcatattggcctgagaccgacaggtggaccccatgagtttaaaatctgaaaatgtaaaagataatactaaaagcctttactttttaacagcaaaacacctaaacttgtaaaatccatataaaatcaaatataacttattttgagatgattcaaatttctgtaggttcacaaaactatgaactttaatgtggtaacattaagcttggcaccctcagcacagaccttgtctctaaaatgggtctaagataaatcatacataaagcatacacaaacttataaaatgcatataaagtacatctcaactcattttggagcaaactcagtttctacagatccaccaacttatgttctcctataaagcaaaatgaaatagtatacatactatacatcaaatgcctctaaaactattacctttaaatgactagttttagatgagctgaattttagaagttcatataaaattcatcttagatcctttttgagtaaacccaagttctgtagaatcaccaaaacatatacttccaagttataaaataaaattatatacttactgtatgataaaagcctctaaatacttatgtaagtaataaccatcatagagcaaccttaaattgtaaaatttgtagaaaattcatctttagtctaaatgaagtgaaccaaatatctatagaaccagcaaacagtgggcttcaacatagtaaaataaaatatggaaccttctgtacaggttatagctctaaagtttaaatttataggataggtgctaatcacatagtatcgattgagcaatatgtatatatataaatgtatatagaaatacgctctagctataatgaaacccaaataaaacttgttagaccagtgaatgcatagttccatcctcatccaccaaaacttaaggcacttatcttatataataatttctaggttgatataataaattgctagcatggactagagctcccctagtttataaaatatgaaccatgataataaagaccttaagcctatgaactaaggttagattagttaactaaaatactcattttatacatcactagctagactagccaccaacccgtgcaacgcacggcgtaaatttgttaatacctttcataaatattttttcccatgctgaatatgtggtatttctttataatttcttgattccaaattttatttttgtaacctgctaattattaatttcagtattaaattaattacataatggatagccactatggatacaaagttcatgtttattagttcctatcagttacgaatttaggattactgaatttttgaaaaacaaaaaaaattaagtttaccaaaatgaaataaccccattgtatatttaatggtatgtttcctttaacacaaaattgttttcatatagtattgttaacattagtaataatcacattttaatcaagcttatcactcagttttgattacagaaagaatttcaaatttgattgctaaactatattgaaacaacgaatataaattaaaacatatgttgttcaactcaatttggacaaacaatgcagcaaattagtgttgtaagatggtacagaacctgtaatttaacttaaaatataacataaaggatcaaaatccaacaatttaaatatccttaattagacaccaaacactacaccgggattagctcgagtatacaaatcaagagtagttaggtgaaagccatatcgatcaatatttcacttagatgatgtcatacgttttagagcatatacggatttatcagagtatataaattgatagaatacttacctgaatattgtagatgaggggaccaaagtgcaactttccaagcacaagtgaaattaatgaaagcaaacttgttgatttgtagatcaacatcttaatacctaatatttacatactgtcatatggcaagcatgtaaagagaactgaattggaaaatataagttcaaatatttttttcatccagaaaatagcaaaacgaagctcaccagttgctgcattcatgctaccggccgcattcgtgtaccttgtctcatttttgctttcgaccaagatttgactacctgaatacttgtgttaaaaatgactcattcaacaggcaaaagatcaggaacataatttattatttcaatcaaaatagaaatacctgagttgattgtgtatgcaactaacacaacgaatcttcctagatgcaagcgaacttgtagatttttggatcaacatctcaacaccagaaattcatcggatcaaatgatggcatagttgatcagtcctgctcgatctagttcaggtgagaaataggtcaaaaaaaaaaaccatggattaaggagttcaaaccaaatcttgattgagagaaaaaaaaaagcacggggtaatggagtttagcatcgatctatctgactacagaaagcatcaatctactgcaacatcaccttgtttcataaaacctgtgtaataaattactgccgttgtttcctcaatattaattttacctatcatctatattaatttcactataatgaattgaggatcaacataaatattcggaaacaacaggaaagagccataatactctgaaacaacggcagtactcatctatattaatttcacttgtgcttggaaagtggcactttggtcccctcatctacaatattcaggtaagaattctatcgatttatatactctgactaatccatatatgctctaaaacgaagtagatggcttataaatttcttgatcgattaagagtctgaatatttcttttgatttgcctgctttaacctggagaaagaagcaccgaaataacctggttattttagcgcaaaactatacaaaacttgaatttaaacaacagacgaactaactttgttgtttcgcattccagccctgcagaatcgggcagagtcaacgtgaaaagacaacaacaacattgtttgattagcgcctcggccatggctgatgtctgtagattctgacggaaggttggttagagatttgtattacagcatctgatctactccctccgtttcacaatgtaagtcattctagcatttcccacatttatattggtgttaatgaatctagacatatatatctatttagattcattaatatcaatatgaatgtgaaaaatgctagaatgacttatattgtggaacggagggagtacaaaactatcgatacaatactgcattgggttgcaccttgatgtgcagagcattaccgtaccacatttgattgatttgaaggaaattacggaagtataaagaacatgtaaacagagcagataattacaggattagatcgatttgtagaccagataattacagcaaaaagatgaggaccagcagtacctatcagtgaaatcattgccgtataaccagcagcatgaacatgcatctcttgatggggctagggagtaagggcctagggcacaccatgaagaacgacaggatcatctgttttttcgctagggaatttggagataggatcggctggaggtgaaaatacggtgaacgcaacacacgttagatggtttttgaaaggtggcccacaatattaggtggaattggattaaaatctacgtacggatgtgatattgcaatctactaattaacggctagatctttttaattaatgtgggagctcgtagaaagtgcccgattagtataggtatagaggtatagatagatacatagatgatgagagggagaaattggaggccagctgggcctcctttcctggtgctcattcgtcctcccccttgtcaggcatctccgccggcggatctccgcgcatctgcctcttccactcaaggaaccaacccatccagcgccgtcgcagcctgcacgcctcccgccttccctagcacattaccaaagatacaataaactaacctaaaagcatagcatgcacgtatcatgaagcgagtcggatagacaaagaaatgagaaatcgaccgaccaattacgaattttgcaggtgactgcagaatagaaaaagggacgttttttttttcttctgctaccaggcaaccgactgggagttctctctgaacttgtacaagctaaacacggctctatctccccaatcccaatttttgtaccgcttccaactgcttcttcttccaatgcaagtcgtttctctgttcgcatttcccttgtcttctttgtatcaagaaacataacatcgtgtatcagagcaatcgatctagaggttttctggcaagccacgctatcattcaggagcacagatcatgacagacgaggaggagcaacaacttcatgcgcataacaagttgatccaggtcaagtggagtcacaggaggagatcaaggtggcggtgcgggacctctttcactggcaaccggagatggacaaagcggtagtatactgagttaaaaacagatagtttaagtgccatgcacgggcacacggctagctagcttgcccaaaaattctgagtttaatactgcgagcagagtaactagtgtatgcaacatatgctagaggtttggtagacagattagctgtggtttgaatgtggaaaaattgtgaagagggttaaaatttatggtttaattcctgttttatcaactttgaccgattcaatcgacgtatcaaatgagttgacaaaattggcaaaaatttagtttttttagaactaggaaggtagcctgcgcatatgcgtgggtacgtgcgtaaaattttattacgaatgtccatgtgtggatggttttctatcaaaaatattctttcactttatcataaactaaaattgaacttatttaatttgctttgaacgctggttacttgtaaaatataaattgtgaactaaaattactttaaaccgtgctgtttctaattcatgagaaaattttgtgtcgaaacaacatatgtgtgtcatatgaatgtccaaatttttttagattctgtttgaaattttaaacatatccatttcattagtcctgctaaaatgtttgaatatttctatttacaatgggtaataaacccaacaaaaataaattttaaattagataaattttgctcaattctcatttctttttatcttcatttttttggataaatccactttatgaagcatctttgaaatgctttgatctctgtaattcgggatgaaaatataagtcggttgatcctacaacctggcatgggtaaaggcataaattataaattatctcgcttcaattaagtaagaaaatttaaaatagatgtcaaagtattttcttagcaaattaccactatactggagcgtcgtgtaataattacacgtttctagactttctatgctatatgacacaaattcatgatgtactgtacaagttttaccaaaaaagtggatatagttttttaattccgctctggaattggcttatatattgctggggccacatcatggctatttcactcttaagattccttggtgcaaccaacgtggttagcacgatcagtatgttattcaactagccatgttatatatatataatttagattctataatcatcttaagattatttatttatctccaaaaatgatcatttattgataaaagcatcaatatcaaaatgtatgggtaaatagctcctatatacaagctgagacaacaaaagttgatagaaagtcgatagatgtctaacgggatataagtactgggtctagtagtttgaaaagaaattaagctgggatattttgatttttagtgagcaattttagtatttcttttatttagggtaaaatgtgctacgggacattataaaacgtgtaatttgccgggggacaccgcaagaacgcatatctgctgtgggacaccgaaaaactggtaattggctattggaggcctgcgttattattttataatatccaatggaaatgaagagagaaacaataagaaaaatatgacttttcgcctgcctacaagtctggctcacatacaactttgacgctgcaaccggacccatcaccggtgaggtggctctctagagggggcggggggtttcgaggagggcccgtgcgcctgggcttgtggctcgctgtcgttcccacactcgtcgccgctgtagcgcgaggaccatgcaggcaccgatgctctgccacacaccgcgctcagggtgagcacaacatggaccacctcctgattcatgtcgagcaaggcgccacagagcgcaggctattgttgtcagtctcgcagccgtgccacggcacgctgccataccctcaactatccatacccacatggaaggaaggagcaaaatcatactttcgcggttgtttctctcttcatttcatttggatataacaaagtaatgccacgggtatccaacagctaattaccagttttttatggtgtcccatatcagatatatgttattgcagtgtctcttagctaattatacttttttttatgttctgtagcaaattttaccttatttgagtagatgcttcaatggatggggtccataatgtaatttttttcttagcacttaaatatagtcaatatgggcattaagttattgtttttacttataaaaataatagctggctagacctactaggtcgagatttgtttgtggtcttttctttgcccataaaaataattttaattttaattatcatagagatagaaaaaaaacagagaaaaataacgcaacacaccgcacgggaacggggatggacggttgggatgtttcttttttttagaaaaaaaattgattgatctgatgacttaaaataatgtgttgatatttaagtaaaaaaccgatggttggatgttatatttttttcacagatttattaggattttttctaattcaaatgagacaagtagcagcttagcaaaacgcccatagggatggagagtaagggaagatggtttacaatgtttttgtattaaaaaaactagatacaatatcgatgtaaagtaatgtgtaagtcgatttaagtggaaaccaatggagagatgtttctctaatttaagaatctcatcgaacgatttggaaatatttataagatatttaatgaactttaacacctatttttgagatcattttccataaatataatgttatttttaatcgtgatagggataaaaaaaaacataaaggaactagaagccttcaaattgatcagtacttgcgtggtgcacagtatggagacgtgggaggttttggtttcctaatatagatctaacaatctagaataataggtctaccgatttaaatgataatcgacggttagatttctctattttattagggtgccacgtggtgacttgagaatatttatagggtgccacgtgacggtttgggagtgtacgtttgtaggatgcttaatagacttttagtatatactacctccatattttaatgtatgacgccgttaactttttgtcccatgtttgaccattcgtcttattcaaaaaattaatataattatcatttattttattgtgacttgattcatcatcaaatgttctttaagcatgacataaatattttcatatttgcataaaaattttgaataaaacgaatggtcaaacgttctgaaaaatcaacggcgtcatacattaaaatacggagggagtaatagataaatagatcaatggtaatacgtacatttggtttttttttttgctatatataaaattatgttttatatttttcttccgattatactatgtatgttttttttacttatcacacagccatttttgtccttccgatttttctttttcttccagcgaacggacagaacgtaagctttatttttttttccgaaatatacgtactgtacatatttacgatttttgtttgccgacatacttatgatttttatttgctgatggtacgtattttcctttttatactgggaaggtatatatatatacacctaattattgtaaactaatgggtccaccaatttaaataaaaatcaaatataaatgaaaatcaaatatagatatagatataaactaatggtctaaaattacatgtccaccaattaaataaaaatcgatggtgagattagatagtgccacgtggtggcataggagtgttcgtagagtgccacatggcaccttgagagcgtttaggagtgtttaatgaatctgccacgtgccacgtgttcatagatgtcgaattttttgatccacatataagttgtatgaattattctaaggccaattttataatgcacgtcagatgcaactatatatgccatgcaagaaaatccagcaacataacaaaaaaaaaattagcacgcaaaggggaacaattatattgctgagaacagatggtttgacgtttacacgttttgggaatgttacagtaatatcctttaagattgaatatagagagaatatataacactaacaatagatattatcattgcccgacaggtacaactttttttccttttgtttttgttttgtatatgtgttcaaccattagccacacaatagtaataaactcaccaccagtgttgagcttcttggcatgagactccctgttacacctgttggcagcatagaggagaaaagctgtccacaggttaagcagcacggtcactgtatctggctccatcgattgattatctccacctttccagtttattatttccctggcaaccaaccctgcataagtaaggcgaggaattgcggtgtcaaaattgctgggcaggctcttgtaaaggattttagcgagtgcgttcgtctgcctgagcccaatagatgttgagctattattatggccaccgaacagcttcatgagcaccataaagatcacattattagcctttccaccagaagaaatgagttcatcacgatgctctttgcattttttatcaaggttctcacaggtccgctggtacaaccatttttggggaaggccggcaagcatgtctgggtgagccacaaggagaacatcaaatagttggacagtgccctgatcaagccgacacgctggacttcttctgcatcgtcttcgctggacttcttttctctcatagcgaggatgaggtctgtggcaatgtgccagatgatgatgctctcgtggaagtcgacacccccagatgatgatgctctcgtggaagtcgacaccccacagttccttcagttctttattttcttcaacacgtttcttcagttcaggatacttttccatgccagttcatcccaattatacctgagcaagcccatggtgttgagatcaaaatcggagaccattctcaatgctgtgtccttcaccagctcgggaattgtgatgtcccacgaataacaaccggtgtcccccttgtcgccataccccagcttcttaaagagcctaccgagttgcttgttggttgggttcagctgtgtggtacggaagtagagcaaattgaactatcctatggtgcccgaccagtttcttgatccaccgagaaggcctcccgtcaaggctgcgacgcgcttgcgaacagccaggaccgcccgtcggagctggtgccatcttccaacgcatagagcgatatgttgaagccaactccacctcctggcgcacaagaaggaaagagtccagcttgaccccagagcgctgaggagggacgttgtttccatcaagaaggcgccacctaacaggacataggtaacggcggtgtcgactccattctggccatccttggcctcactgccgctgaaatagaacagcagaaacgaggtggcgatagcaatgggtgacaaggctcggatgcagtagccaatccaagtgtggactacagctgccttggtatagagaatatcgtacatcagggacagttccatctccattaccttatacatccgctggggctttttactgagattattgattatttccttggtggtttccgcctcagccttctcatggtggtttccgcctcagccttctcagtatcctctgggatcacggagtctactatcccacgcttacatatgtgaaacagggagtgagcacgctgcagaaggaattcatcattagtgttgttacgatcctcattgtgcaggtacccttagtaccaatggagttggttacccggtaactcctcgagagagctcccgatgctactaaatttgctgcgattgagcgcccatgtcctctcacaatactggacccactacaagaggtatgtggttttttttacattttattatgtcataatatatgaaaattatgtcaaaaattaagatttgtgacaaacagatgacgtaatttcaaacgtcaaaaagccaccgtcataaattcatcatgtgacgtttgaacattcattgtcacaagcatatgacattgatttattgtcacaaaatcctagggcttgccacgtggcagctgacatggttcaaaaaaaaacgtcacagaatcagattcggcctgctaaagcccatgtagctcatgagccacaaatatattttttctaaggttgttgctagctggccgaacatattttttgcttgttcgtttgagtgcagcctatacaaattttcagcccacatcaattcggcccatatgatttttccaacccgcacaattcagcccatatgatttttttagcccccacagtttagcccatataattttttcagcccacaaaactcaactgaaattttttcagcccatacaattcagcccaaatacaatatttcagcacatataaaatcaaattcaaatgaattaacattccacaaatgattgcaatatcacatgcatttcacattccacaagtcttaaaatgcaatatcattacatccatccaccaattcaatacatatccaaagtctcaaatttcatcttcctgctacagcgagagcaacagcagcacatctgcaatagcatcacagcagcagcagcgcaatggccaaaagcacaacagcaacagcacaacgaccagaagcacaacaacaacaacaaaataacatcccacaagcacaatggtcgcaagttcagtgtcaccttatgttcatatgtattgctgcttcagcccgttcatctgccgcatggcaacgcgcccgacggcaacatccctaaggaggcttttcaccttcttttacaaatggttttacacacaacctcaaggttatgggctaaccatcccatcacccattgacacgtactctctttgtccaaaaaaaaatcccaatcatgagtttgaatctggacatggatttggttctttttatgataggggaagtaagtaaagagtaaggaaggaacaatcacaacatgaaattcaaagccccggtagtaacctaatatgatatatcgaaagcgcaccaccaaaacaaaactcctacttacaaaattactcatgaacaatgtgtttttgcttctttttttccttatcatagtatcagttggcctaagaaacgataatttagacatcaataaattatccgatagaccatagcatatactccctcgatatttcaaattaaagcaacttacttgcctacagttatcaaatacatcagcactccatcacctaacctaacagatgctcagcaccattagacctaacaacttgtctagaatacatatgcatgcttaaaaatcatctaactactcacacagtttggttggttcgccgaatgatgtcttcctatctgcatgtcttgctctcttgttcatactcctccttccttgactgatgcatgtatccattcctcctgtcagaaaggaaaaaaaacaatcataacacaggccatgtgttaattttccttttttcaatgggcttgtcaactcgaagcttaattcctacaagcagctgatcatcttttaaatcctagtcaaatcaacaaaagaatcataagcccagcgagggaacaatagaaaccatgaaagggtgtttagtctcaccgctcaccaatttggtaggaaatattgctaaagttctaagaataagttgccctaaatcctaacaacatcttattgcatcaaaattgctggtataatgactctgtttagcaagtttgggccttctttcaaaaatctgggtattaaatctgcctgcattctgaaacaaaaacatgctggcataatacaggttaagattagtcagaacctgcagccccccctcccccaccggttgtggatcttggagttgcacgtgttgccgagattcctgagcaggtcggctcgcacgcagaagacgttgtccccgagcgaaccctcctggcaacggtgcctgagttcccgaagcttcttgcgcatgagctccttaacgtagaggttggcgttgatggggtcccgcggtccagcatccgcgcggcgtgcgcctcgtagatgagagtgacgcgcatcatgttccgccagaacttgagccagtatgcagactacacctgcggacggacccccacgcgcctccagaaaccccgaagcaggagcccgccggcacaaacggcgtggcagcgagctccgtcgtcgagccgcccggggactgccgccgcgcgatctagccgccctaggcccgggagcgctgtcggccgcagatccaccactcccgagcctggcgccggcggagacggaggcgacgcagtaagcggtgagggaggagtaagccggcaccacgagcggcgatggaggaggaggacgccgccgcacgctttcatcgccgatacccgccgccggagaggagaggagaggagaggggaatggatgggagaagtgtggcggctgagggtggagagatagagagagagagaggaggggtggagaggagggttttatatggggctagggttaggcacggcgatcagaaccattagatcgtagatggccggtcagaaatagttgggccatttgggccaaaacaggaatgatcttatggtatttttttaatttcaatttatgagaactttaaatgtaattttaggctgattcttttgtttcaaatgcaaaaatcataaataacaaaattgtagaactaatcgagaactgtgactattgtattggttctttttacaaataagttcatttgaacaattcaaattttgaattttcaaaatttgacaacttcgaataaaaattggggttaataaatgatttcaaatggaaaagtcaccaaaaccaaagttgtagaactcatcgaggcgaaaaagttttattttggtcatttctccatatgactctatttgaactatttgaaatttgaaattcaaagtatgagaacttcaaatagaatttttttattagtgaacgacttcaactgaaaaagtcataacaacaaagttgtataatccatctggatctacaatttttattttggtcatttgttcatccgacaaagtgacagtaggattgttcacaaaatttacatatctcttctatggttttataaactataagagagatttgtaaattttatgaacaatgttactatcactttgccaaataaaagatatgaccaaaataaaagttatagatattcatgagttatacaactttgttgttgatgactttttcagttgaaatcatttagtatttgaaaatgttatttgaagttgtcataatttgaaattcaaattcaaattattgaaacaaagtcatatagcaaaatgaccaaaacaaaagttgtagatcttgataagatatacaactttgttgttgacaatttttttcatttgaaatcatttaccacaaaaaaaatatttgaatttcttatattttaaaattcaaattttatataggtcaatcaaactcaaatggagaaataaccaaaataaaattggtagatttaaataagttatacaactttgtttttcaaaattttttcacataagtttatttagtatgataaaattcgattaaaagttttaatattttgaaattaattgagaggagggaggcaaaatagacttctcgactcgctaggagtgcgctgtgggctaagtgggaaggttggaggcctgccagattagtttctttagaagatataaacgtgatatataaaataatatgcaaaatctaacaaaacattatctgtggcttagtggttggcccaatgaaaaaaaaactgatgtggcagtaaggcttgtctacatgaacaaaaatatttaaaataatataataaataatttgtgacacacgggttggcccaatgaaaaaaaaaactgtggcagtaaggcttgtctacatgaacaaaaatatttaaaataatataataaataatttgtgacacataaataggtcttatgacatagtaaatattgtcattggatgacattagactaactatatgacatttattgtgacacacaattttttattgtcattaagttgacgtgcttgaaataaaatgtcataaattagatgatatagtgatattataatctgtgtcatattaaatacgttaaaaagccacacatatcttgtagtgaccaagcccacagcgaagatcaatccagtggccactctaaggattgtggcctccctacgaacgataatatgtttgtagaccacatacacagctccgattacctggaaaacaagattcagtgcgtggcgcaaccagagtttgttgtcctctagtgcataggccgtgatgttgtctgggccaccgaggtgcagcaacaagaatggtgcccaaaatgctgccagacggtgctcatcaactgccacgctgccgaaggagaggttcctaagggcgtatattgccgtcgagtcggccagctggtaagctatccactggatgatctttggtgagtactttacgccggcgagtaccagccaggaggaggaggatgacctgcagcgcgaggctgaggagtacaaggatttgtatcccccatttgttccaaaaatccactagagacatcgtcacgccccttatgacgagttctctgttgtgaattttgagcttaggccaaccgagggcaggtcgcctcgcgtatatatgctggttgctgcggttgttagtgcaccaaccaatcgatcaatatatgcgtatatatgtctgtctatatatatgtagattgtagaattgttagacagtcccgagaaacattcatgttagtccagaaatagtgaacaaatctatacatcgttctaggcataggatccattataacggatttcattaaatccacgtacgtagttatccttcttagaattaaatttaaaaatgtactgttcattttttcttagaaatattcgggttgtaattcttttgacacaaatatactgtcatcgctatatgggagtgcgacatcgatacgacacgctgaaccattgtgtgagaatgacgatgtgggcggtctcgcggggtgggaacgtgacaccgcacggtctcacacaaccacaacgccggtctgagccgagaccatgcggtctcgcatgcaaaaaagccacagcgctttgaaaaatagttaattagtgattaattatcctaattaatgttaattggttattaataatgctaattaaaataatattaattaattaatttctaattatgctagttaatttattaatcacatgagtatggatgggaagtcggtctcgcaccctcgctctgcgagaccgtagcgactcttgcgatctctccggaccgccctgcgacagtggtataattctacaaatttctcctgtgcatgtatatttacgtaaaaccaatgaaaaaagatatatttgtaggatcgaaacactagaactaagccaaccagagaggggtgaatggttggtatgcctaaaaaccgaattttttagcggaaataaaagttatcctcaaatttgacggatcgtggtctaaccgaaagtgttgcaccggtctgaccgcctgaaagccgtcggtctgaccggttagatcgatcggtccgtccgccctgagatcgcctctgctccctgtcgctgtcgccggttagaccgccgaaacccggtgaaacacaaatcgaagaactcttaaagtggatgacgactttataaattttctctatgtttacaaagtgcaccaacagcactccttacaaaaatctcgactaaactcgaaaccctaactcaactatcaactcaattgctctcaaaagcgataccgggaagcctcacgctccccctctatttatacctgaggtagacaacctaaagtgatccgtagaaccacattcaaagcaacgatttggtccacctcttttcctgtacctaacattagtcacagctcgagaaagtcagttagataacaaaaccaagtcctcctcctcgaactgtttgagttgatcatcggcattaaacaaagcaaatgcggaagactttgatgaagaagaaccaacatccaaagaagttgaggaagaaatcaaagcactcgacttagaatcaactttacgaaaaagaatattcatctcatgtgttttcagttttgtgtaaagcgaatccaaagtcaaagtagacatatcaacggactcctgaatagatgtaactttcatctcccaaatagacatgtcaagaccattcaaaaagtggcgagaaatctcagattgtgtataattaatatcataagaagaatcaacagatctaagatcactcaaaaatttgttaaacctagaaagatagtcatccaaagcttctccaggtttcatctcaaatttaatgtactcttttttgaaaagatctcgacgaagttctttaatgttgttagttccttcatgaaaattactcaaagcaatccaaatctcatgggaagtttgaagatgagagacacgatcataatacaaacgagaaatcccactcaaaagaatattgcgagctttgcaattttgttcaaattcaatttttaaagcatcaatattaatttgttcaggaatcacataaggatgagaaacttttcttcaaatatcataaaactcagccataatgtaagattgcatcctactacaccaatgagaaaaatcagttccatcgaaaacatgaggcttagttgaaaacctaacagccatggcaaaaactcgtagatcggttaaaatccaaagaagaaaacaaggctctgataccacttataggatcgaaacactagaactaagtcaaccacaggggggtgaatggttggtatgccaaaaaacaaaaacttttagcggaaataaaacttaccctcaaattcgacggatcgtggtctgactgaaagtgttgcgccggtctgaccgcctggaagccgtcggtctgactggttagatcgatcggtccgaccaccctgagatcgcctctgctccctatcgttgtcgccggtctgaccgtcacgagcctgctggtctgaccgccggtgtgtcgccgattagaccgccgaaacccggtgaaacacaaatcgaagaactcttaaagtggatgacgactttattgattctctctgtgtttacaaagtgcaccaacaaaactccttacaataatctcaactaaactcgaaaccctaactcaactatcaactcaattgctctcagaagcgatatcgggaagcctcacgctccccctctatttatacccgaggtagacagcctaaagccacgaaccaaactcatactagaagtcctaatcaccctaggaaacctcttagtacaagaaacaaactttacataaccaatcataccaaatttggactgcttccaaattcaactccgtatcccatacgcacacaataactccatcatatgccatatggaaccttcaccttccatgtgcactgaactctaaccatagtatcccgcatgatctctgaccaccacggacgtcgcttattcccaagccgactcccggtccatcaccgcaaatactctcacggcatctcgagtcacctacacatagaataaacaaagaaaccatattccgagaccaagctatccccaacttgactcattagtagcaaacgacagtattacatatgcatagtatccatctagaagtcagaatcatgaaacaatcacggatatccaaacaaacaagccgaaaccgaaaccgacacagagtcggccggttagcagtacctgtaaatcacctgtgaaatccaatcatctccaaaaccacttcgtaaataaattccaaatatcaaaaccaataatcttcaatgccaattgttcatcacagaataataataaaaaacacatttgattttacaatattttcattttttaaatatcttacattgtcaatagggcaaggactatctagcactttgcgagttacttaaactaaacgacgtgcatcacacccttccaccatcccacaacactagcatcccaaggtcatgtttcccattcccatcctcttcgcacttctcccattgtaactctcttcaactattgtgtttatatcttatactatgtatctgaccaactctttctgccaaaaccactccagtaatttttggatcttgctgcactggatagaaactgaccgagggaagaggccgttcattttcccttcagcttcccctttacctgcgataagcataggaggagcaaatggtgaggaagaaaccatgacgtggaagggagcgtgccagagaagaaggttgcctacaccgctcagagaccggagacttccattgacctcacctttgctggttttgtctaccccgcacatacctggcttcaaatctgccacctccatagagcaaaccaatcttttccaaattggagctctcaacattgttgggacaacttgggaggagcatccttaatggcaaccccattctccctctccgcctgattaggttgagggcatttgcctccacatcaagctatccctcctcaacccatcaacgatgaagacctatcctcgtctcctccgctgtggccaccaccgccttgtgccgacaactgcacagtcccaggcatgcttaggctgccttcttccactgaaggatggatcagtcccaacactaatcccccgatgtcattgagatttctgcacatggacgtttccccaatggcaatgtgacgccggcgacctcgttcgctgccccatgacttgagctaccgatctcatccacaatgccattagttcaaagggcggtgataaggactagattatgattgcaaatccagacctagcgacgcaatgatggctagccgacagcagcagatctaactagcaaagtttgcacccggaggcaggaaaggtaattggtggcggtggtgccatagccttcgagcggagagtaggagaaatgccattaccataactctccaatcgctcctctctattgggtttagttccatggagctaaaagtcaaggcctaggtcgcatgggctatgatacaacaaaagagattgttgggcctagattgaaataagtcttcgaggccacatgggttgatgtgacggaggagattgttagggctgctggtgatggaggagattgttaatttcagtcttaaattggtaaaaccgacgatacgagagcacaactcaaaatatgagggcagtctgcacctatcatctactcatttgggttgtgtaggttcactacactggtcaaggtcacctgtgacgggcccaaaccctcatctttgacggcttcgcgcatggtcagtgatcagtggtcactggtgagtccagtcacctttgacgggtggccggccatcacaggtgacacccacctctgacgggcaagttactagaaggccgtcagaggtgttggtctccgctagcctagggcgagttaggacccgtcacaggtgactcatctctgacggccctttaaataaaggtcgtcagacgttgaggtcttcgtagttagaagctgtcacaggtgatctacctgtgacggccccaaaagtaaaggcccgtcacaggtaggtcacctctgacgggcctttatttgctagtccatcacaggttaggttacctttgacggatttttgttccgacccgtcactgatgagttaattccagaaaaaaataaatgctaaatattggctagcctcaggatttgctagccatgccctctgaaacacagatacatcacagatatattccagtcacagatccatcacagatacatcacccccccgatataacatcacagatccatctcaaacatcacagatccccaacaacacatatatgcagttcaaatgccacaattttgcacggcaaattcacaccccttgaaagccacaatttcggtcgttgctcatagaaccgcatatatacttaccaaatggattaaagccataatgtattcgacctccacaacctgtcaataaggaaaaaaaaggagaaaacagatgaatagtacaacgtaaatcgtagttgatcaaatgtgatgacaatttagtaaactaccataaatattgcacatatgaaagtaaattacattgcactccataaaaacataattttttacatcgcaagatattataaaaacatcttttttacatcacaatgaattatctagccaagttcatgagtctatttgacatgaaaacattctttcttgtccattatttctgcaagaatgaaggcgcacacttcgcctctaatagcggggggttgatgggtgagatcttgaagccagctctacctttctgtttaataaataagaggttaattagcacgttttgaatagcaatgtaggtattgaaatgagcttattcgccattagcaacaacctcagggtcgaaatctttcacctctcttagaagtgttgacatgttgtggcacacgtggaaaccacattggtctccgatctgttgtgcgcatgcaaacttggtgtcatgataaagttcgtccttgccctccttgtgcctaccacccttttccacatatgggccccaagccatatttaaggccttggtgatttcactgaaatcataatctttggacttattggagttaaggtaggtaaccctactccacttaggtacgatgactaggagaatccaatgtcgcctgcgcagtggttatgtagcgttagtactaagaaccttaacttcaaaaacaatatacacgaagggtattgtcctcttactcttggttgtgtgcgcacatgatgtactccttgtcttgatgggcccataaacaccggttgacatagtcaaccacctcagtgaagctctgtcgtaaattaacctcattcaccatggatggatcaaggaacccaacctgattaccaaggcgacgactctcgatccaacacaaccttaaaacatttacgtattagaactaatttaattaggagatatagtccaatcatatcacaagtatagaaggtatgcacttacaaggagtagcattttagaagaccagtgtccaacttctggatcctaaaaaggtcgaagaggtcatcaaagcctatagttatataggcaggcgacgataggaacggctggtggtcgtgatgtccaactatggatgactccctcattttccgcttggcattgcttagctccatgtattgcttatgtagctctcggcaagcaatacccatcacagctaacacattgtcctccaccaatagcatgcctagctcaaattgggctggcgccctcccgaccttccccgctttgctcaccggcatcgatgtcgcagccttgcccctttttggctccagcgccaactccccgaccttccccttgccagctcaaattgagatggcggtggagatggacggtggcagtcgagagagtggcggcgagaagggcggtggagaggtcaggcggcggtggagagggcggcggcgagcagggcggtggagaggttgaggcggcggtggggagggcggcggatctggatcgagagagagagagaggcgaggcggcggtcgagagagtgagtgagtgagagtgggtgccggatctggatcgatctagaagatgttcaaccctaggtcagcactagtcaaactcacctgtgac

SEQ ID NO: 68158 - DNA, 3203 bp, Oryza sativa
ccgtcacaggtgagtttgcctacagcaattttattttattttatttcacttagttcttttaatttccttaacatatttccacatacactacatatttttgttatacttaattattttatttcactaacagtagtaattgcacttcattattatactaattttattattttatttccaatggttatacttgcttagttattttatttcacttctagtgggtgcttcacttaattattttatttgactatttcataagcaatatactattgatcattgcgaacatattagagtcatacagataacagacatgtagacataaactacatacataaattacaaaaataatccttgctcatggtcgacacgtgcatattgaacttcatcttcttcttcctcctcttctagaggtatttcttgacctatgccgtggacgtgctggttgtaatcatcctcgtctgcaatattgtccaatccaacaattctccttttcccttcacgaacaacatgtagtttcttgttacacgggtcaactatgtagaacacttgaacaacttgtttggcgagaacaaacagttcatccttgtacgcgttgttagccaagttgacagtggtgaaaccttctgtcacgaccggaaataacccaacgggcgttccttacgtgcgtgtattattccttgtcccaggaggcaaggtacaccaaaagttgatacaagtcagagtctaacaagcggaagcgtaaatagttaatttattacatgggcagcgaaggcccagcacacacagagacaaacgagaaacagcgaaagactagggcgacgaccacaggcgcttgacggcaggcacgagctagacaccaaagccttcatcttctaggggctcctcttctggggttaggaaaaattgagcaagactgagtacaaccaccgtactcaacaagacacacccacaagtgcagaataaatgcaagggagtacaaaggagttatactataaagggttagggtttgcagtaaacagcaattaaaggtacttagttgctcaaagctattttgtaaacacgattctagaactataccatattatttaacaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattttactctgatcagaggtgtacatctttacccacaagacacattttcctcacgtgtagccacgtgccacataccaccacggtatacagaaggaagacatgacatagtttccaacccatcctagccatagacaagagtaccgacccaatcccacctacggccggaacccccgggacaggcaggcaggactgagcccctagcagcaggacaccggccctgtgccatgacatctcgactaccgggccgcagctcgtgtagccttcatttgtcctagagatgtccatcgacccctgacttcttccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggcggtgtgaagccaattccacaataaccaaaccattccatagtgtccaggtgatatgaatattcccaacgtctagagttgaaaaaccacctaatgttacctaattaaaacgcgaagcatctacctaaaatcatactagtgataccatgagtagagtgtccactagttggggttttgtttattctagggtgaacaaggtaataataacaataacaataataataaggtcataacaaaggtaaataggcatggctagataaaacagtgataacgcgggaatttaaataaagcgataatgcaataatttaaatcaacataattttacaaactgggattcaatatgttcaaagatgatgtgacttgccttgctcgctttcccaaacgtcggcttcaacctccacgaagagcggatcttccgaagctgcagcgtctacacgaccaacggaaaagaaaaggcttttactctaataaactccatataacaagcagaaacaaagcacaaaaatgggttcttgacttctcagggaaaaattagagacttgaacggtccaattccgagttcaaatggccaagttatggccatttgaagtttatatgctctttaattgaatatttgcgaatttcttcatttaaattttaatttaaaatcggatttattgcgtcagccgaggggaggggcgcgcggaccgggtccacgggagtggggcccacgcggcagcctcacggtccacggtggactggttgcacccggctcacaccggccagcgccgtgggtcccatgcgtcagccgcacccgagggcgcgggcggctgacggccgggccccacatggcagccgcggggcgcgcctgaaagcggcctcgccggcacagccgacgggaggcggcgcgcccgcgcccctatggtcgccggcgccggccataggcatggcggagcggcggccgagagaggggagggaagggggaaacgaaatgggcggtccacggctcaccccgggtcgacggcgacgacgggaacagcgaccggagcggaggaaggcggcggcgcggcacaggttgacggggacggcggcgttccggcggttggcgaccgaaacggataggtggacgaggtcggcgaggttgcggcgaacccgaagaaggcgacgccgaagcgggagaaggtccggggcgacgacggcggcggaccggagctcggcggcgacggtggagagagagagcgacggcgcgggctcgattccgacggagagagagagcggcgagtggcggaaacggtggagggaggcacggggagcgtttatataaggttgggagggggagagagcggccgggggagggggaatcggccgcggaagatccggccgccattgatgcgccggcgaggtttagggggaaacgtttccgaacgaat

SEQ ID NO: 68159 - DNA, 582 bp, Oryza sativa
tgaacaggggaccgaacggggccgaggggggttcggccgaacccttggtttggccgaaccagggagctcgccgacgggctccagattcgcgcacgggagcccgacaccgtagcaaggggctgcgcccacagtgcattcaccccttccattgtatagtgttccactgggatctattgtttcgccggtgttggctctccgtcaagattgtaggtagagttggaggaggagccaatgtatgggatcaaggacttgccagccattggtgaattggaagtgatggagcaagggaattgagatgagatggagaggaggattgcaaaagtgggagagaggaggaagaacaggtgctctgggtctgatacgactaatctacctccgaaagctcatcacaacggactgcaaacgagcgggggagactgctattcaaagttggggctgatcgggtgccgcttttatttggctgaaccctggtgggtccgactggccgccaactttttcctaggcccactaaatcctaagctaagcacaaaaatgacaactttaccgggttttaagcatgcattagatgagaccattatggtt

SEQ ID NO: 68160 - DNA, 3643 bp, Oryza sativa
atggccccacgctactatcaagctcggcaatgaggttgcccttttatggttacaaagaaggaaaaaaaaaagtggaacaaagcctcggaggccggaagcatctagactcgcggggccatttgaccaaccgaaactcgacggcccacccaccaaccaccaccaccaccaccacacccgctcctcctgctccaccgcactctgcagtccgcacccgcgcgaggcttccgctccgctcccctccgatccgtggcctcctcatcgcccctattaaacgggaacccagcccggcgtccccttctcggcttcctcctccaccatccatccatccgcgcgcggtgcgtagtagcgagaagagaagggggggagggcaaagcgatggctccgatgaagctgtacgggtcgacgctgtcgtggaacgtgacgaggtgcgtggcggtgctggaggaggccggcgccgagtacgagatcgtgccgctcgatttctccaaaggcgagcacaaggcccccgaccacctcgccaggaacgtacgtgcccaccgcccctcccctcgctcgctagttgtttcctttctttttgttacgatttccctcagtcgacgacgagatatgttgtttccatgccctcactttcagtcaacgggagcgattttgctgcggccgctaatatcttgggacttgggagttatcacccaataagaagtctaggagttctacgatgaggcgtttaggtttaagacgaaaataaaatatgtttaagaagtactgtgttccaagtagacatatgaaagaggtatatatagtttcttccggtaatccttcaataccacgaattttgggttctgtcatccacagcgtagacggtagtaatccttgcttcagcatcaaaccaccctttctccgcccccccccccccccccccacaaggctaacatcctcacttcctgcaaccaccaccgacgctgccacgtacacacagcactatggtatgtcatgatcatgctatattaggctaccattttgatgatgtcgtattcgtatagccctcaagtggaagatctgatctgtccatcttagatcgaatggctgatgttgacccaaagaaattatggtgtgcttctctgacttgctcctgggatttagacgatctccagttttctatttgagaggtttgtttggatggtgccctgacctgagcgctctcactggcatccaaccacaggccaccaaaatcggacgcctgttctcagggtgtgaaccaaacaggccttgatgataaatgtgcgcagctttaagttcaagagtatgtagcaagatttgggtgggtgaactggatcaaatgtggaaaagtttattgtttatatccgttcaaagaacagaaatttgtagttcttctaataaactgttcgagagaaggtgaactggatcaaatgtggaaaagtttattgtttatatccgttcgaagaacagaaatttgtagttcttctaataaactgttcaagagaattgctaataagaatcgatttcctgccatgttaatttgtgaactagttactcctgatctccaaatccatttgagagaaagggaaagggaaaagtgactggagtgaaggaagctataggtaggcaaagaacaaacaaatgcctccatttaattttctggggaacaaaggaggcgtgataattaggtgatgaggtttagaatttaaaaggaggtagtagatgaccacttgtcgctgccaggtgtttcctatagtaaatattgtctggtagaccgtacagtattgtttgaggagaaatttttttaatcaactctgcatgcttcatcagccttatcctgaccaatataaatttgctggctgtgctctattacttctaacattttcagtgtccaacttatggactttttgcctcttccaaccattgaacagaggaatagatgggaatgccatcttttacacgtttgttatacaactaaccagatgcccatgcattgtaatggtttctatttttctaataaatatgtcgtattttttaatttgagaactcctaaaataaatatagttttcaaccaaacatcaatccataaaggacattattaaaagtcacatgcacaaatatcaacttcttagataatcctggcaactcaaagaggtggtaggggctggcacatttcaccaccggcaccaccattagcttcctttatattactcatgtttgatggtgatatatttatatgtgtatgcttttagttggtttgtgatgtagcaatttaattttttacacttgttaccatatgtcacctttctggaatctgttatgtcgtgagtgaaggtccctatccataggattatctcaccagcataactttgacaataaatacatttgtcgcacttgggggataactatgacatttgtttgctaaactcattgtttcttgtgatatcctctgcagccctttggtcaggtgccggctttgcaagatggtgacttgttcctctggggtatgatgctatctcttggtgttgttttatccttttttccccctcgtaaataaagggaactgatgctttagctgatttttctttcaccgtggaaactatcatgcctcttttcctaacatatactaacaacgctagcacatcctcacatgaccttttttctggaagcacctgattcagtgttatggatattctttattaaaggataaatgagtccttttttttgccgggttggccaaaagaagcgaccaaccaattgcattaagattaaaaggaggtgtctacaaagataaaaggagtctgcgaaattcattaatacattatggtgaaaaatacaattaataaaaaaaaggaatagccaggaggaggctaggtatcttggaattaagaagaaaaggttcaagaaatccccgaggagaaaatttgccagattcaagattcaaacccaggtgggctgtgggaacaaccctgcaacaaaccacctcacccaatgaaaagtacaattcattgccatcgcgaactgtcattgtgttgtcagggttaaggtttttattggtaaagtattaagagtaaccaaactgagccttttagtcatgcaccatagtctcatggtcgggatggtctcaaactgatgaagcaataaatttcttttgaagaatatgatgaaacaatacatactattactgccaattacgagttcaagccaatgcctataaatcatgtttataattttaattcctacgacaggcatagtattgcagttttgggccagtctcttagagtaagagaccactgttgagcatatgcctgtagaatcttggtcatttacaaatgttgtttttttaaccataactgatagctctgtctaatttcttcttgttagaatcacgtgcaatttgcaagtatgtatgccgcaagaacaaaccagagctgttgaaggatggcgacctcaaggagtcagcaatggtggatgtgtggcttgaagtggagtccaaccagtacactcctgcactgaaccccattctttttcagtgcctaatccgtccgatgatgtttggggcaccccccgacgagaaagttgttgaggagaaccttgagaagctgaagaaggtgttggaggtgtacgaggcgcgcctgacgaagtg

SEQ ID NO: 68161 - DNA, 25412 bp, Oryza sativa
  unsure (1)..(25412): unsure at all n locations
atatccatgcccgcgaggtaattcatgcccgcgggtatacccgttactatatgcgagcaaggaacactacccatgcccgttgcccacaggcgccatgtgcccacgggcatgcccgtttacccgtcacaaactcacagttcaacatttcaaccacaaatctccacaagcagagagacattatcacaatttaaagaaagggtacagttgtaccaagttcaacaatacaagcattacaagttcatcaatactagatggtggcatttatactaatttgactaagggaccacatgtcagttggtttttgcgggtaaacgagcgaagcaggcatgagtagcgactacctatgcccgtgctcgtatgcccgttaggtataggttttgacccaataaaaaacccatgggtactaaatggagaacaaacccaactctattaggatttttatccacgggtaaacggacaaacgggttaaactgccatccctactcttttccatctatcgtgcatgccaggcagcaggagcccgcgatcaaagagctcctccccgtgcgtgctgcggccggtgactcctccccgcgcgcagccgcctagcgatctcctggccgtgcaatgccattcggagcttctgcaccgacaccgctgccgctgcctttttcctgctaattgctattgctcctgctagttgatgtagagcacgccgtatcggactcgtagcccctccgcctgcttcgccatctccagctactgcagtgacggcgagatcgagagggagagcccctggccatcctccactgccaccgttgaacgctgcacaggcaccgccgaatgcatggaacgcttcgtggtgctgccatgctagtggatagccgactaggcgtccgacagcggcaccaacgtcgacaaccgaaaccgatcaatactgatgtgggatcatcgagaatgggcgcatcgctgcggccaggtcagtggcgaggccctctatggcgcctccttgttgctccggtgacaacgtctcacctaacgaacacatgctagccctatagatggccgtaaggcccgcccggcacagcccggcctaggcacggcccaccggccatcgggccagcacggcccagtcggcacttcgtgccgggccgtgccagcccatgggctgcacctttggcctaggcacagcccaccagcagtcgaaccgtgccgtgccggcccgaaagcacgggtggcccatcgtgtcttttttaaataagtctatttttcttccctcctcgttgggttgtgacatatctatagctaaaatagtctattttttctctctcctctttgggctgacatatatatatatatatatatatatatatataaaataagtctatttcacgtccttattctctgaaccatggcatataatatgtctatgtttgctccctattctttgtgtgtcgggcctagcctgctggcccatcgtgccgtgccagcccgatcatgccgtgtcgtgcttggaccgggccaaaataccataccgtgggccggccgttgagcttcgggccttatggccatctagagctagccccaccgagcaccaacccagtctggccgactgcgccgccgcggaaccaacctccggccaatctagcgacccctcttcttcttccgcagctacctgagcttatcattaccagcgaccgcgcagcttcatcagaccagaaaaaaagaaacaactccccttaaaaaccgaataatccaaccacaagaacacaacaacttgatcgaattggaggtactaccaccactgctcctgcctcctgatgctgctgattgcataagaaaaatttctacttttttaggttttttttattttctaattaagttatttaagggtgcacgttgatcgacccctgaacccacttgcacctttaaagttagtattatggattcatgatgcagaagtctaataatttatttatcttttaccaattttcaggtttttcttgttttttctcactcaattactacatgcatatggattaatcctatgaccacactacaagagaatggatttttcgtgactgcccctcactctcacgaaaagtcaaaagcctgtcacaaagatctttggttaccacatactgtcacaaaatgtcagtcacgcttgattagtcacgaaatctaatatttggtgaggggaagcagtcacaagctgttaagtgactgtcaagcagtcacgaaaaagcaattcccccaatttgcatgttttgaccatttttctaacagttttgattaaccgttgggaatactttttcgtgaaggtggtagctgtcacagaacatcaatttcttgacagacttttgccattaggaaatacctttcgtgactgggtggctgtcacgagacacgcgatgtgcacgtaattaatatgaaaattcatgtaaatcaatctcatatgctacaaagtgagttcagatataatacaacaaaatcacttattttacccaagtccaaattcaaactcacaaaagcatatattagcattgaacatcgtgagtccttacataattcatagaaaaacaatatttaattatgcactacaaatttctacacaagtcttgtatcagtccaacaattcttgaagtgacaagcccaatataatgccatagaatagagggaagcagccttcggtggccactcataaagcaagctccacgtgaaaaaaggaagtcttctgagctttccataaaagaacaattctacaattatctacaagatatgatataatatattaggaaagtttcttcaaaacaaattagtacatcaaagtgaatcatcaaattgagttgaactgtatcactggacttgaaattgttgccttaaaattcaatgaatgtcacttgaagattacagcaagctacaatttagttattagctaatattattactgaatagctccaaattcaaatgaaatcactagtcaacaccgtaaaaaagcctataaaaagcttgaatcagattaatcacatgaggtaatcaagtagatgaatcatcggtaaattgctcttatcatgcataccgattaaaacactgtactggaatgaagtcattagagccatgcaaaattacaatagttttcttggacctttagcaaatgctccaatatttttgccatgtttaggttcaataatgaatccaagataaaaagaacacacgccaggcagctgtcagataactggataagcacatttctgtgcagagtttcagcatctaagataaaatgaatacatgtataccatgtagcttcagatatctaggaaaaataatttctagatcaaagaacgcaagcatgccatgtagcttcagataacaagggagcacatttgtatgtgttaagtttcaggacatctttaagaaacagagacaatttccttaaatcttgcaagccattaggtaccttcagtatgttctagtttcttaaatacaaagctggtcattttggcataagatgactagtatcaaatcaattatgaccaattaatggtagcatataaatgagtatgataaatataaaaatgactcaccaaaattctagttctgatgcatcaaaaacagcagtcttcctctgtgtcccattcttcagactgattagaacagtctacattagatttaaaagccatctttagaaatgaaaggaaaacatattaaagatatgacacaacaagtaattaaccatagtatttttggaaaagcgaaaagatattacttccaaggcatattaaagatgtcctgttccactatttactagcaacaaatcattaaaaccacattatgcgttgcacaggcagtaaactatatagaacttaagaatggactgcagaagttcagaattaatctaattcccacaatgcattacatctagtagctgtgtaggcacaatggtaactgcatctataagctatccaactcctcctaaacatctgcatagagttagacagtgacaacaacacttgcatgatagccggtnacaagaaaagaacagaaaataattcagaaaacacttgcatggtgacaaagtaaatgaaaagaacaaatgattcttcagttttaccttgtggatgttcaacagatacttcaggtgatgtcattgatctgcagtaaactcgctgtaggatcctataaagtgtaaaattagaagaatttagaactctaacaaacaatatggaattttaactaaaagttagctgattttttcaaaagtacacaacactgacaagtatacgagaaaaatgaagtataatttcagtacacctgcaagtagtagaacaatatttgtgcattatctacatatacaggaaagggaacacaaatgtttataattgagatgaacattaaacaacttgccttaatattttactatgaattaaaatccaattcagaggatgcaaacacatgaaaaatgcagcttgtaaaatatctcactgttgtaaggaaccaaaaagctagtgtacaaaaaccaaggtcagtaaactatccataattgtttatcataaattatcctaataccactatctaatgaaatctgagaatttttgcatccatctaataaaagcattgtgacaaattactggtttaaaagcctcagacataaattcaaccaaaaatcgctgcattggcatttcatcgaacacctatgtgtcaccctatggaaaaaacagagggaactatttctggtggaaggattgagagcatagaggagaaggcaggtcgctggagtgtagagtagcgatcgcgcacctcacggcgagaagagcaatggtgacgcgacccacggacaagacacggggacggcggcgaaacccaccgtgaggagagcagcggcggcacgcccgtcagagaggagagcaagggaggcaagaccaacggtgaggtgagaatgtacgggctccttcgccggcatcactaccggcgacgaatcgacgagcagagttgcggcgtcgaggtggaggcgtggagctcactagggcaagagccatggggaacgagaagagcactctgtttttagtggttcacaatttcagacagaggcagagcagcttggcccatttaagtccatcacacagtatggtgagggctttatattactgcaccgtcaccaactctataactcggtgactggctgctcttcctagtcacgaaacacccaatttcgtgatggtgttctaatgcctgtcatgatatgtcttcttggtgactgtgtttacatcgccatcacgaaatctgtggggcagtcacaaaaaaatgattttccagtagtgccaggtcagccactttattaacacggttaagaaaaatgatagaagctatgataaataaataattaatctaataatattgcatgacaaaagataggcgaaatgataaactacactaactagatgcataggagtatatagataaatgtgatttcgtaggttccagccgtccgacaaattgaagctagaacgaacgatgaatgttgtgtaacataggggcttgcccaattagatccaaaggtatcattgtatacctaaggttttttataaaaaaaattagtatatgcgatactccctccgtcccataaaaaaccaatctactactggatatgactcattctagtactacgaatctgaacatatctctgtccagattcactgaactagaatatgtcacatctagttatagattcgtttttttaagacggagggagtatgtgattcgtttgtgtatgaaaaaaaagcctattcaaccaaagaagcaaataaatccatcttcttatgccggccggccgggctccatcctctcttctctaattaaccaatccgcacaagtttgatgatctactttggcaatttgcacatgccaagtattagactttcagttgtaaaaaaaatacggctatggattttgaatcggttttgcgatctagttgtcgaagggcaacctcaaaatcctaggtcggctccactgtatcatagtataaatttaagtttgtgaaatgctaacattatttatgaagagttccttctattttctgcaaaacaaatataatttttcatggaagtttaaacctgacacatttcacaaatattttatttctactagaaaaaatgcacgtgcgttgcaacgggtgaaggctattttaattttattattgttaaatggtttaactaaggtgaaattcattgtggcaattcgctttgatgtattttttttaaatcatgagctgtggttaggagtctgatcgttacaaataagcatacgagtttttttaaagagatttcttatacgactccttctgtattttcaaaaacgaacgaatttaaaaactgactcaaatatggacatgtattttcaaaagcgaacgaacttaaaaaccgactcatacacggatgacgtaccaaagtaccggtaaaaatatctttaatttttataacagtagagatagagatttcgaatattgcgaattccacaaaaaaaaattgtcttattcattttctcctctaattgggccaaagtcctaaaccagggcaatcctgtttcttgcctatctcggtccaggcaaccaaactccggctcaattccggcgtaggatggcccactcgccagtgtactgcgctggctagcttgcacttagcttgggatgatattcctttgaatggaaaaccatatttgcctcttgcttcaagttaacaccatcatgtacatttttatataccctctcagtcaaaaaaaaaatcaatctaaaaaagaatgtgacctctcatagtataacaaatcttaccagagaagtcttatccctttcttggttgagaattttttgtcacggagaaagttaactagtgaagacaaaataatactccttgcatgactgaccaacgtcaaatatagaaaagggcgaggattcgacggacaggacgaattatatatatcaccatttaattaccgcaacacatacacaaacacacacgcacattaattaatgccactacaagattaccagctgcgaggatcaaactagcgagtacagtagcctccaagtgtgattcactgactgattaattaatcaactagatcatagagagagagagagagagtgatgactaattaactaattaatgagagggagggacggcgcgcagacgacgcacgcgacggacgcggcgtcgtcctcctcgctgaagcagctccgcttgaaccgcgacgccttccccttgttgcacggcagccgcaccagcgctgccgacgcctccttcgtctgctgctgcggcctccctgatcccggcattgacagctgccgccgcagccgccgccgcgcgccgtccgccgccgcccggtgaaccatctccgatgatcagctgaggttgagagaattagttgagagtgatcgagagaggggatcggcttggtcgagctagtgaggtgtgggggagccatggcgatgtgttgcaagcggctatttatagagggagacggagattgtttgcccttgggtcacgaacgatattacgcatctgccatcgttaacggattggctttaattcgaattccatttggaagctactgccggcaagagagggaacgaaatagcattcaaaaaaaaaagaaagaaaacaatgggacatggtactactgcttgctagctagaaaaagaaagatgagagatgagatgcgacgtgaggattccggattgtcgttgggcgtactgaatgatttgaatccacatggaggcaacgcaagctaagctagcagagacatggcgccgttacgtggaggaagagaacatggtagggcatatgcacagagcgagcggcaacagtagtagttgatgaaccgaccggccgggaccaatgggcgatcgatcgatcgatcgcagtggatcggctgctcgtcttgccggaattttgtcgtacgtctgccaccatccgttcaatcgatcgatcgaggacgggttttgttatgttaatacaactttattacttttggcttcttttgggggtaagatttttgaacttttggtatggagggataatactttaggtctctttaattcgtaggatagaaaaagaacagaacctgaagtagtttgattctttcatcctgcgggaataaaaacacatgaaaagataaaaggtacccaagctttgagccggcaagcctcgcctccaccttgcgggggcagctgatgggcaactagccgcgtgaggatgcgcgtcagttcgaccccctctagcctctcctctctctcatctctatacgtatatatgtatgtataaacttataaagtgtgtgtgtgtatatatatatataggtaaagtatatatatgtaaagtatatatttttttatgcatatactcatttgatgtatacaagatatatacacgtatatacaaaatttatacgtacaattttttttaaaaaaagtcatgtatataaactttgtatatttatgtatacatattagaaaaacaaacaaaaagaaaaaacgagaaaaactaaaaaataatcagaaaaaacaacgaagaaactagagaaaactgacacgtgttgccttcaacgcaaccccccctcccccctctccgcgcgtgccgcatggctgtgccgtgtaggcgggagggcgcatgactgaccgctaattggcggttttgctgccttgcgccgccggcagtcggctcacactactttatatctctatcactgttggtttgttggatactaatatgtgacccctggtgttctcattccatctccctctgttttttttcccacaagaagcgcaaaggggcacacagtttaccgccaaacacatgaaaacggcgcgaacgacagacctcttccttattttcatgtaagggatataaccctaaggaatgttttctttcatttcctacgaatcaaaggcatacatatgaaaaaaaatccgtaggattgtgaatcctaaaaaaccctataccaatcctttgaatcagaggatcccttactccgcatgtacagaagggttgacacattttcttaagatactccgtctgttctaaattactcaatgttctagatttgttctatgtcagatctttgtatctccgatcttcaatttttagaaatttatgtagtttaatttcagaaataatttcataatatctaattgacggaatgttaaactacataaaattttaaaatttgacggcgtaatatagaaatgtttgatttatgataaagctagaacgacaactaatctagtaaaatggagggatcagaagtattgttgtttcccgcactgagttatttgcacatggtactgcaaaaccatatcgctagctaatagcccttacaggaaggcgaattctcagagcaagaaatttatatcaaaatcattttgcctagtcaagtaataacctttgtcgagaataatgatagttattttacatcgtgcatttgttagaaaatatatatttatatgtattattgagctagatcactcagtctaccaatcaatgttacaattaccatgctatgttggcacgcacaaattaatttacccgggagctgaaatttgaaagttttttttttctaattttctaaaaaaaggaaaaatgtttaaaatttttaaatgaaatagttcgtgccgtgcagtactaaaaaccatttaccgtgcggtccgaaagaggtttttgcgtgcggcatggcaacccgcatgcagcaaaaggtcagcgaaaatcactattttggcgtgcgggtggcgcaccctgcacgcaaaattaaaaaaccgaaaaaaattaaatccaaaaaatacgaaaccctaaccttagaagccgacaccgacgccctcgtcgtcgctgtcgccggattggccggcaccgccacacctccccacagaacgccggccaccgcgccagcccgcgcgcgagcctgcccgtcagccgccaccgacgagccggacgtccctgccgccggatccacgctaatcctggcggaggacggcccccgccgccaaatccgggcgggggcctccgtctccaccggatccaggttgggaccggtcaccatcaccttccacatgcggccaccgtcgcgcgcctgccaccgcgcgcatgccgtctgctgagatgctctcgagcccgccgccatgcctgctccagaggcagtggcaccgagccggccacctcccaccctccccccccgcgctcgatcggaggagaggagaggagagcacacgaagagaggagagaaagagagagaggagtgaaaataaaaggaaaggaagagagaggaggtgaaaattttgaagcgagtgagagggaaaagagagagaggggtatttttgcgtgtggcctacttaagaggttcgcctgcaaaaataggctcatttgtgcgtgtggtgaacttaagaggtccgcacgcggaaatcgattattctgtgcggtcctcttaagaaaccgcacacaaaaatagaggatgatttttgcagacgcgaccagttatgatccatatgcaatctaaagaggtcattgtatagaaaactcgtttatttgaagtagtgatctgtagactgctttggagtgcgggagtaggatgttcatcagtaccaatttttatttctcataagtttgagaaatttgtagcgtttcaaaggaggccagatgtacaattgaatctatctacaaaacttttaaagctttctacaaaacttttagggcgccaaaagaattgtggatttatttaatttactgaactttaaccatgacaatggctagcattcttcagttgactctgcatatcccaccatatctatccagcacatgcaacttctgaatgccgaggacacgtggcaacgcacacatggtagagtacacactaattagccagctggtcttatatatagaatgtcttcccatccagtgacagacatataactgactatacataactaactagctagctgagaccatctatcaaccccataaacagatccaaactaaatcatgaagaattcagcacaagatcacattgcaataggtgacaaaagaccagatgatgggaggcacatggctgatggctgtcatattacatggctaggacaagccatgtggctctgttgattaggattaataaggacaacagaaacttatgagtactctagctaccttgtaatcattttatttcaaatattctttgtgtgtgaacagcaaataaaatttgtatggactatcttgggtgtactgtactccgatactttcatgattagctaattcataaactcatatcatgtactacagtaaatcaaatattggctttcgaattgtaactgaaggctatgttgaaattttttgaaattgagagaacaccctgtaaccccttctcctctcactccctttatcttcaccccatatatttatattgttctgcttcttttaaatattctgtctttttttattacaatacaaacagcaggggctccctgctgtgtttctctaaaaaaaaaattgagcatatatcaatatactactaactaggtgacaaaattaagcgcatgctttaataaaacattggcaatatatttacatatacttccctggtaaatacaagaaaatgtctatatttggttcacaaatggttctcacgtggtttatttttctttctgcaactctagtgttggatatataattaatgtgttctctaatctattaaaatcatctactccctccttgctataatataagggattatattttattttaaaagttaaaaaaagcaaaaggacggggcatagtaaaggttatggtggtgaaataaagtagtagaaaacttgtaggtggaaggataaaccagtaagaaagtaatgggtaggaaggataaactagtaaaaaagtgatgggtacaataaaccagaaaactcgtaggttaagtattgtattggaattacaaaaactcttatattatgagataaatttgaagagtataatttattatattataggtgaaaagggagtctatatgtagcatagagctggttgtggttaagtgggtggttttcagtgatgtggctgctacatattcttaagcccactcatcatattagttttctaagcgacataagcgtagctaaactggttagatttcttattgtggaaccagttcacccgggttcaaatactagattttacacgggtactcgtatttatggctaattattctttcagtcatagacgatgtacacctcgacagcgaggcatccatggtgacttcgtcaatctcaaaatatactggtataatctttcggaggcgctcataggaataggatttacgtgtctacattcatatgggtgagtgtgcatgcgtcgtgggcgcttgcgtttatactgtgtttgtaaaaaataagattagctttctaaaatgcaacttaccccattctttttatcttattcattggattattgctgccgtgtgtgtctgcattcatatgggtgagtgtgcatgcatcacgtgttttaaagaaaatcagctttctaaaaatgcaatttaccccgttctttttagcttattcactggattatcgctgccgaggaggatttgttggtgtagtatgcttatcgcagcaaagcagataaggtttagcttctatgggtgtggtccaccaatacataccacacaagacacatacattgaagaacatggccggttgtctaacggcaagagcctcagtagggggccatgtatatgcattgcacttgttcctgacccaagatcatcaataattttgcattgatttggtcaaatctcctatggcatacctgagatgataattatggacgccgaatttcataaatatgtacataagacaggtcatctgatttgaaattaatggaaataattttgttttggcctagttagctttagtagtagtacatgccgataattaatttcaccgaaattaagttcacagtaaatggttcggttaacatatatatacaggaatcaggacagttggttcaattctgtcaaaatggaagcatatatctatggtggtttagtcgtggtcatgtaagactacgtactaccgaaattgttttcttaattaacgcatatatatatttatagccataatgaaaactacttcatccgttttcatccgtttcaggttataagatgttttaactttggttaaaatcaaactgctttaaatttgactaagtttagagacaaatatagtaatatttacattaccaaattagttttattaaattaataattaaatatatttttatactaaatttatcttaggtcaaaaatattactatttttttatagacttggttaaacttgaaatagtttgagtttgactaaagtcatcttgtaataacctgaaagagagggaggacgtactacagaaattgtcgagagaggtatcaaaagaagagctgtctctgctatatatgttcatgtatatattatgtacattactatagctcatttgttaggtgatctctggtacgatagtactgaataatgcatatgcccatgcatgggcttagaatggcacatgtatatatgctcgatcgtatactcacatggatgcttgaccagacaaaaacggtcatgatcaacaagacgtagagatagctgaacattcagcgatgatcaatgcatatctatagtcagcattattccctcttgttccttttgcatgactgccaaattaaaagagtattgcacatgtttaatttatttgaaattcctacacacatattaatgataatcaatggagaaacaaattaaagaaatctatctacttctaccaagtaatatactccctccgtctcaaaatataacaatatctagtactcaaaatttatacaaaaataacaacttctccacctatattctttttaaacaatcttccaccattcaaattccacacatattttctgatatccaccaatcacaacattcatacacatttaatttcacctattttttaagtacccgtattaactttagaaatctttatattttaggatggaggaagtaacaaattttggagtgagtaaaacttccaataataatacgtgtccacatgcttttttgtttttccttcaagtctgcaacaactatatcaggagtatcagctggagagctatagcaattcttgtcctgctccagatatctctgtttcaccacttccgattccagcttctgcaaattaatgcatctgatctcatccctgtttcacccaagcagagttagttggcatctctattatctggttatgttaattaagcaaagccaatcttttcacaaattgaaagatctttttgctcaatcgcgcgcctagatgcataatttggttaaaatgcttcttgcaggaactgtgttgctgaacggctcatacattttctaattgtattgtgtgtgtgtctatatatatatatatatatatatatatatatatatatatatatatatatatatatatatatatatataaacgaaaaagaggccatattcaatcaagcctgaaaaataggctattgaaaaatttactacttcaaaatttaaatacactaccttaaaatcctgagtcccactggtggaaaaaccctttgtagtcccggtttgtaaccccctttagtcccggtttccaaaccgggagtaccaatccgggactatagatcgctatctttagtcccgggtgaaataaccgggactaaagatcgatctttagtcccggttggtaacactaaccgggactaaagatggctcaaccacgtggccggctgagccatctactaaagatcgagctgaccctttttttttgcatggccctattgctgcatggtttatatatatatatatatatataaaccatgcatatatatgtttcaatacatatatatgcatacatatatatatattatatatatatatatatatgtataaatagttcagtacatatgtacatgcataatatatatgtatttatacataatatatatgttatgcaaatgcatatgtgtgtatatatatatatatatatatatgaccaaaatatatttacattatagaaaatgtgtacacatgcatatagaaacatatgtagtcatgtattaattacaatccattatatgtcctagctagctacgatttcgacgtagtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcgtgcgaataaactatatgaatgtatgaaattgattagtaattaaacaagaaatcgttacgtaataaaattttgaatttatttgtacttacatcgagctctcttgtggtgttgatttggtctgcaaggcagtggcaatactcacacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgtggaccaaatgacggaaccgataccaagccctacatggagtttaaagctatgatttgtagtagcaattaacataacaagattttcttaattaacagaggaacttatgacggtacctgtctataggttcgaaaaccttgtcaaacgtagactcttttttattcattgagtcatatacgttgacggtgcaggccgacaggtcgaagagtaaaagcacccagtggaatctgtaatgtgcgtgggatgcattacatatgaaacacttagcaagttcgtacgggaatgaaatttggtatgtaggaagacagtaaaattaaactaactctgtgttgtacggcaacagtatgaacgtcttgtaatgctgcgccttcaggagatggacgagattgtcctttgtttcttgtggatattggtcgagcattgcgacgtttactctccgagtgtcgatgaatccagtatcaaaaaccctccaccgtcgggccctttgaatctccattctacaacgataaaagggagtatattattttctatagtctacttatatacaaggacctaattaattaaaggagacgtatagtaagaaatctaactgaacgatatacttacaaaatccagcaactcataatagagacgtcgagggcgtccagctggtatagttcatagattcccttgaaattgatccagagaatgtcatctccttgcaagaactccgtgtccctgatcctcgctccgatcatctctctaccggtggcgctcatctccatgtacagctgatggaacttgtacatttgtgtgggtagggactgcagcagctcaagcttgacaagcggtttaccgagttcatacatgtatttctcttccgccttttcgattggtgcgactcctagcaattgatccgtagttagaccggtgtcagtaataaattgttctatcgtcatttctttaccagtcaccaacggctcgatctcctggtttggttgctctccaagctgagggactggtttggactttccagaagatgctttcttcagcgttcgctcatagtccgatagattgatggcctccttgacagatgcagacatacccctaaagaagttcctgacactggggtctataagaatcttcttttctggacttcgaggcttgaattgtctcttgacttctgatgcaacgtaagcgtcaagctcctcttgcgtgcaatcgtaccccgggtccttgttcttggcggcgtcaactttcgccttcttggtttcccttgtgtgggcaggcggtggagctgggggggcccttgactttgaaggtgccggaagaggagcttgcggaggagtaggtgtagaggcccgaggaggagtcggtgcaggatcctgaggaggagtcggtgctggcagatcatgaggaggagacggtgcaggatcctgaggaggagatggcggagccagaggagatggtgcacgagacgccgcttgtcgcccagggaggatgatgtaccgcctgcgccatagaataatggcatggcttgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttaggatggccatgcccgacgccaccttcatgttgtgagagattatttattagtaatcaacatatataagcagcaactagcggaatggctaaatctaaaatatataaactacgagcttacctttattgataagttcttgtaaggaatatgcagctcacatggtgtccgctgagtgatgtcatcaacgagacaggtcgattcgtcctgtgtttgcatggcgtccatgctctgtgatcttacctgccccgttgaggcgcagctgctacggtttcctaacgggctcaccattgcaggaggaatggtcggctggggatcatgggaccgatgtgcggccatgcgttcatcaaccttccttgccccctcctcttgcatgctgagttcgtagctcgatacccggaactctagatctgcaatcttcgcctcggtatctctcttactcctcatccgactcctgtacgtgtggatgtcctccttgaaaccaatcttccaaggaatcacccctttccctcgtgttcgtcctgaatgctctggagtctgcagggcgagtgtcagctcgtccctatctctgtccggtcggaacgtgccctgagaggaggcttccactgcatctgttagtcgtcgtgcagcctctcgtatctgatcaccgaagaccagtgagccatcagctgggttgagcgttccaccgtgagcatagtaccagaacttcgatcgttccggccaattggcggttgcctgttcgatacccctctcaatcaagctagcctccatctcctcccacttcggcatcgcgacgctatagcctcctgaccccaagtggtgatggtacttcttcttggcggcattttctttgtttctttccatcatcgcctacccttgttcacctgtcttatatgcaacgaactcgtcccagtgatcccttagctttgggaatgtgtcaaagttcggtgtctgccccttcaggatatatttcttgtacagctctcccttgaagctctgaaactgttctgccattttcttcagagtccaccttatcactttgtcctctgtacccgcgggaagggtgaatgtctcgagcattgtggtccacagcatctctttctccgaatctgggacaaagctctcatgatctccgcatgcccttgttcttcgccagtacaccgtactgacaggcacgttatcccgcacaacccaaccgctgtgacgtacatagttcttcgtggcttcggccggggcactaggacgtccatcttcttccacttccgttatgatgtgccgaccctcaagcttcttcgctgcacctcgttgcccgcgtgccctcttctgtccaacagagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtattgtataatatctgttcctcatcgcggtcagccatctgttgatactagaaacatctggtaagtcacgagacatttatgttttaacaatttaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatgctaagtgttccgtgcgtatatgctaagtctaattaagactacaatagtcaattgctaggagtcgcaccaattccgtactcaataattacatactaattctaattacaaataaagtaatcttatattaaaactcaaataatattacatgctaagactgaaagagtcatgtatactaagtgtaactgtcgtatatgctaagtctaattaagactaaaattgtaaattgctaggagtcgcaccaattccgtagtcaataattatatactaagtctaattacaaataaaataatcttatattaaaactcaaataatattacatgctaagactaaaatagtcatgtatgctaagtgtttcatgcgtatatgctaagtctaattaagactacaatagtcaattgctaggagtcgcaccaattccgtagtcaaaaattacatactaagtctaatttgcaataaaataatcttatattaaaactcaaataatattagaacactacacaatcttatatgctaagtataattacaagtctaatattcttaattgcattacaaatataacaatcatttatattattacgtcacttgcctgcacgaattccttctagggctagctcttccactcccagcttgagggacgactccgacaacacgtcttttctgcaagatacaaaaaatatgtattaggataaatgcaaagtaacatatatatattgcatttcacattcacgttcgttcgctcgttttcattcacgttcgttctcgttcacgttcgttgtcattctcgtcacgttaattcgttcgatcgttctcgttgtcgctctcgttcgttcgatcgttctcgttctcgttcacgttctcgcggcaacgtacgttaacgtgttcgttctcgttcatgtgttcgttaacggcggtgtgacggcatcgggccggcgcttggcatggcggcgtggtggcgacggcggcggcggcggcggtggcggcttggcgacggcggtggcagcgcggtgttgcatgccgcggcggcattgcgcggcggcgaagatgcggcatggcgtggcggcggtggcgttgcgcgcgcggcggcgaagtcggtggcgtggcgtgccagcgcctgcgtggcgtggcgtcggcgtggcgcggcgtcgtcgtggcgcggcgtctcgtggcgagcggcgcgacggagagagagatagagatcggagatcgatgaagggagaggcggcggcggctctcaccccagagatgcggcggcagcggaggagacggaggtggcggcgaggacgacgagctcgagacgacgtcgagatacggcggcgtcggcgcggggatttgccctaggcagtggcggcgaaaggagagaggccgagagagatcgatcggccgaaaatgttaactgttggtggagaagatgagggcgcgcatcaggaatatatatagccctcgatctttagtcccggttgatgagaacatccgggagtaaagatatctttactcccggttgttcccgctattttcaaattctttttaaacctggttagggttaagaaccgggactaaagattatagcactgcatattattttcgcttacatatgtgtttctaaaatagaagttaatgcattaacattatttaaagtacaaagattaatgtcaattacttcgaacaattatttttgtctgtaataaattaagtggataaatcgtaataagcaaatatatgacttaaaattaataaaaattccaataatcatatatacttagcatatgaatgatattattaaattggtaaaaactctaattaagatatgtatgtacatactgcatgatttaaaattaataaaaattgtaatcttcatatatacttagcgtaggaattatattaaattaaatgttaaaaagtctaattaacatatgtaaatgccacatgcatgatttaaaccttttaaaaattcgaatagtcatatataagtagcatatgaaagatagtaaattaaattgtgaaaaactctaattagcatatgaatgatagtaaattatgccatacatcaattgatttatatggataatcaatacatccaaaatagtttacatcgtgtacacaataattacggcattacattggcggtgacggttgaccgcacgtactttctcctcactattgttccctccttgtgatcgctgcatgagtaaggggtgtcttcatttgataggaggatgctagggtcaatcgtcaccgtgaaagggggttgcccatccaactgatcgtaatcctcgtcagtcttgtcctcaactccgatgatttttcttttgcctgggagaaccacttggcgcttaggctcgtcaggccctctgcccttctttcctttgctagacatgtccttcacgaaaaagacttgcgttacatcattggcaaggacaaaaggttcgtccgagtatccaatcttgttaaggtcaacagttgtcataccactgtcatcaatcattacgcctccaccagtcaacctaacccattggcaccggaacagaggaaccttgagaggaccatagtcaagttcccatatatcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgattgacccagacggtcccctcgccaggaaggcaagttgttggttgatcgactcgttacccatgagatgttgtcgtagccacgtggggaaagtatcaatctgatgccgtgtaatccatgcatcggacttaccgatgttcctggcgcgaactagagccaagtgctcctcgatgcaaggagctaccaatgaagagtgttgcagaacagtgaaatgggctttacggaataaattgttgtctaccgtcattattgctttccttccgagagttccctttccccgtagtctcccttcatggcgtgattcaggtaccccgattgggcgaaggttttcgataaattctacgcaaaattcgatgacctcctctgtttcataacccttggcgatgcttgcctctggacgagcatggttacgaacatacttcttcagaacgcccatgtacctctcgaaaggaaacatgttgtgtaggtacacaggcccgagaatacagatctctttcacaaggtgacaaagcagatgcgtcattatattgaaaaatgaaggtggaaatatcaactcaaaactgacgagacattgcaccacttcattctgaagggcttctaatctatccggatcgatgaccttctacgaaattgcgttcatgaatgcacatagctttgttattgttgcccggacattgtctggaaggataccccttattacagctgttagcagttgtgtcatcaacacgtgacagtcatgagcgtacgtccaagaattcccaatatggtaactcccaaaatatagagttctttttccacatcgccgcgtgaccatcttcgctctctataggctggcttccaagcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttcttttttccacaactgtttaagatcttcgaccagtggtcttaggtacacatcgatgtcgttaccaggttgcttggggccttgaataataatcggcatcattatgtacttcctcttcatgcatagccaggggggaggttgtagatacacatcgtaccaggccaagtgctatggccgctgttcatctctccaaaaggattcatgccatccgtactcaaaccaaccggtatgtttcgtgcgtcctttccaaattctttaaattttctgtcgatgtttcgccactgcaaaccatcggcggggtgtctcagcatcccgtcctgttgacacttttcagcgtgccatcgcaacattaaagcattccccttgttcatgaacaaaggccttagccgtggtattatagggaaattccccatcaccttagcaggaattctcttctttggtagctgcccgtcaacttctcctggatcgtctcgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaattttcttgatgagtttcaataaatcgccaaatgccttgtcactaaccccaatttttgccttccattgcaagaactccaaaatggtatccaactttttgtgcccctgctcccagcctggatacaacgaaattctgtgatcctccaacatcttgtccaatttatgggcctccttttcactttcgcagtcctccctggcgtcctgcaacatctgaccaagatcatccgcaacgtcgttaccatcagcagctatttcctcctcgcccgtttgattttcttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaataatcctggatgtagaatactccttctgattcttacacttattgcatggacaacaaataaaacccctttgcctgttcgcttcggccactctcaaaaaatactgcatgccgtcaataaactctttggaccgccggtcagcgtacatccattgccgatccatctacatgagtcaaaaaaaaccgtacacaaataattattcttacaataatgacagtcatacaataattataagatatctttattcatacaaaaatcataaaatattacaccaaataattcttaaaaactatttttaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaattaaattttggagacaaaaaaaagtgtgaaaaacataggtgcaaatgtagtatgacaaaaaaaacattggaggaataagttgcaaaccttttaggcacctccgatttgtatgtaatcaccaaaataaattcaatagaatttttggcatgacctcccctcttttttgaagaaattttgaagcttgctcgggcagctggaggaggaagaagacatatatataggggtgggacttttgtcccggttagtagcaccaaccggggctaaagatcaccaggatctttagccccggttggtaataccaactagggctaaagttacgatctttagtcccggaccgggactaaagatcccgggggggcctaacatgccctaacagcattcgaaccgggactaaagatgatctttagtcccggttggtgttaccaaccaggactaaagatcaaatatgcccgttacccttttgaaccgggactaaagatcatctttaaccctggtttttattgcatccgggactattgtggaaatcggccgaccgacgaaagatggtttctccaccagtgtccgcaccatgtaacacgtagcaaaatcaccactgcgcacaggttaattaatttcttggcaactagcttctcaattcgaaggcgaaatgagccatctatatatgagacgatgacggcatacaatgtatttaagtgtttattaggtttcggtgcatggaaagctatcaaattgaatcagttcttaatgtccatcaattgatttttttttcgataatggaatactccatcaattgagttattagttcatagaaaacatacaaaacgacgtacgtcgtcggcat

SEQ ID NO: 68162 - DNA, 1125 bp, Oryza sativa
cgatggtgagaggtttttaaccattctattccccatggtgagtagatattaaccatccccgtcacctaataggtgaattcaccacggggaaacggtgaacgggtccccattgccatctctaattgcaactccagttcaaaattttggacccccggggggggcaagtgattattttggctaaaattttcggtttttctcgatttttttaatttgatcaaaatttagtcaaattcagtaaaattaggctaaaatttcaaaaaaatctgtccaaaaagtgttgaaaatcctgaaattttcggtagaaacgaaatgagcgaaatttcggacatactagcttgctaagatactatgccacaaaagttataaggtttattatggttgaaacagtggtgttttagcaaactatgaattcatttgtatggaactccagtaacatacataccctcttttgagcattccatagaattcctttcacacacatgtgcagcttgactagtaacgtgtacaactccgtattaattgcacactgaacattgtggaatactccactatatttcatcaggacaaaggtgtgtataatactgttttgttatcacaaaacaaagaaaatttaatacctaattaaaaagtcctatcttgttaatttacatgatcttttgattcccataaacacgtacggatcataacccccaaaattatccaaattatcccaagaacaaaagctgcacaaacaagatcaaatatatcacatcacaaatccataaataattaaaaacgagctgacaaattcccagaagcaatttttccttgccaaaaaaaatcactccgaccatcatcagctcagagtgcaagcaacgctcccatcagcagcagcgccgccatcgtcgccgcggcggccgggacgacggcggcggcggcgccgccgctcggcgacgagcccggcggcggcgaggtccccggcgcggagctcttgatcgggcacgcgtagccgcactccgccgggtcgaccacccggtagacgcccttgctggtgagcaggtagacgtcgccggcgttgtcctcgccgaaggagaagatgtagcccagcgacggcaggtgctcctcgccgcggcggcgtcgcagggg

SEQ ID NO: 68163 - DNA, 500 bp, Oryza sativa
aaatttaaatttttaattttaaatttaaagttgattttggggttcttttatcaaagtttatttttaacatttgcttttacatcgctaagaacatgtatataaaagttttattcacaaattattttccgtttgtaaatatgtcgttttggccgtctcggaccttttactttccgtttcgctttagtttcctgtcgctgtgggcacgcttgggacccttttaccctccgtttcgtcagccttcttttccttgggaaacgtcagtatgtattggtgaaaccattgactgactgtatattaatatacagtcgccgggccggccggcgtaggggcgctatatatacggaataaatttatcaagattctggacattacaaaggcaagttgggcctgacaagtacttgttgcaataatcttgctccggagtaagtggttataggatgcaagtacaataactagttgtagacaaagtcaatgacgatacggagaagaataagcgcaat

SEQ ID NO: 68164 - DNA, 691 bp, Oryza sativa
ccctctagatacttatatgcactaatcaagttattgcgcaatatacttactcatcttttccagtttctcaatctgctccagtatagcctctggatcctttttcaaaatcccaacctctcgtactttcttcctttcttttttattctggcaagtaaaaaaggtgatgggaatttagaatgtgaggacagaacaaactaattggtatctaccgtatttatatcagcaaccataaaagaaatagaacttaacaagagtacaagattaaagaaaatctgtaaaaggctagattggtttgctacacttaccgaaatttggtaataccgaaattttggcaaggtagcaaaaaccaaacactccaacaaaaccttcttccacaaaaatgttggcaatgcccatatatgtgcctcataatagcccaattttagcaccaaatcaaacctcttagccattctacactaccgaaatgtggcaataccaagattttggcaaggtacagaaccaaaccaaccctaatatacaagcagtcatacagatagtgggtacacgtgcaacaatcatggttgtcaagtcgtaaagtcaagtcgaggtacccctggaccgacttgtcgactagttgacaacttgtccagttgtccatgacttggtcatgcaaaaacaggggatgcaatatatagtataaactatggactat

SEQ ID NO: 68165 - DNA, 1513 bp, Oryza sativa
ctggatctggacaaggaatacggaatgaagagatggtgtacccgccgagatagaatttcttgacttcaatccaaattctcgattacagcaagacatgagacttagtcgtacactctgtactttcttggttgacatcagagattgactcagacaaaccctttaggtacccgcacgaggctgacaaaggaagtctaacgttatctctgaactcaccgagaacggtcacatgagctagataacagttactccaaggtctgcgcgtggttgagaatatgaattcgttcatttgcattgaagtcgggggttactgtcagggttatggatacaaaatacctaatagtagttgactacatctcggcaggacccaccacataccatgtcctatacggaaacaaccttcggatataggaggagttatgataaggaaagacaaccagagttcttcatggaaacgacaaggactattcggattgtatccatattggtttccctagttctacttggacaaggggacacctatgggtataaatacaagaccccctaggaggggaagagggcggacacctaccagggagaaccaacacaatcaacacggtcaccacgatcgagacccaccacgagacaatcaactcccaacacaatcaacatagaagcctacatacgccaagacaagccgccggatatcgacatcagagatacgcctagatcgaccctatccggtaccttcagaggccggccgtagggatctagcactatctctgattccgtcgggcgcgagcttgaggaggaaggctaccctgttgtcgactacgagtcagaccttcagaccgccatgtcgacaacagttagatagactaccccacatattatactggtgtgattatggtgaataaaaagcaacatcggctccggccaacaggatgtagcgctattacctgattgctcaggggcccaaacctgtataaaaatccctgtctccatctcttttacctcagtctcgcgtataccctagcaccgacgatccccatactgtccaaataccgtagtcgagacatcaaacgtcaacaggcgcagattggacggaaccctaatgacgatggcattttttggacacacacttgtcaatagcatttcttggattttgacatttgtcaattgcatttcttggattatcacatttaattaagtttgaccaggaaaaaaatcaaagtgacatagagtattatattttaggatggacgtagcattaatctatcttactaatgattttttggacgacaataatccatctccgaggtatgtgacctggtgccagtcagccggtttagcttaatatgttcagcccccacctcctccccacccacacaaacttttctattttattgttggatccgcctctgtagctactgaagtgtaacagcagcagcactaggccaggatgccactgaacagctgcagcgccggtggcagtgtcgatgtaatatgtgttcccttcgtcttgaaaaaacaacat

SEQ ID NO: 68166 - DNA, 3977 bp, Oryza sativa
cacgtagcaaaatcaccactgcgcacaggttaattaatttcttggcaactagcttctcaattcgaaggcgaaatgagccatctatatatgagacgatgacggcatacaatgtatttaagtgtttattaggtttcggtgcatggaaagctatcaaattgaatcagttcttaatgtccatcaattgatttttttttcgataatggaatactccatcaattgagttattagttcatagttttcatacaaaacgacgtacgtcgtcggcatgtaacctttatgagtgaaaatatggtattatgtacgtcatgaaacatatttccatgttgtttcttagtgcttcatgtgaatacaaacaatcaaatatatgcattaaaaattgtatcgatatcaccctaaagaacaaacaaaaaagaataatttgaagctgattttaattaaattctaaattttgattttataattaatttacagggccggattttcttggtcgcattcatcgcaaactcttttcatgatcgttgctaattaagatgataactaaaaaccaatctaaaatatatcgttcttaaaatccattctaaatttattaggctatagtcctaagttgtgctagctagtcagcaagttcatgcacttcactgccagttagctaattagctggatgcattgcaggcaggcaggcatgaattggcatgttgccgacaacggcaatgtatcgacggcattccacatcacacatttgatcagctcccgccactaattaaattaagctactaatagctgcatgcatgcacagtaaatgttcatgttgaacctaacacagtcaagtactgcacgtccatctgaaatggacatatcataaggtacaatttaatgatcatgcatgcatgcatgtaccctgtgtactggctcctcctgagtctgcggcaatatatgcatacatggaatgacagagaattgacctcgagaaaaatggggtgatatacagggaagcagaccacaagggatgttaattagtaagatgaatgtcgacacaatatgtacttgaaattagagcagtctcaagtgcaagatactagtaccaattactccactagagaaatggtcatctgtgtaagttacagtccaacaagaacatgacggttcagtcacccgttgcagtcaattgatcacgtactgatgatgactagtcgcatctctgactgttcatatctattgaaccatcgaaggttgtgtttagttcagcgcaaagtttggattttggttgaaattaaagatgatgtgactgaaaagttgtgtgtgtatgacaggttgatgtgatggaaaatgactgaagtttggatccaaactttggatctaaacacagccaaaatgtagtaaaaacaaatataataattaaataacttgcacgggaccagtgctcgtcatggttgtcgtcaatcgtcacccgcctcgtccaagtagccattgccacggagaggcgaaacggctacagtgcatccacgaccgacccctcaagtgccttctaccacgctatttcattccacctccaaaaaaaactgagccattgagcatccaactcaggtacagggaacaacaacttaaggtgtgtttggttgggtggataaatctggatgggagatggttctcatcgtcgtcgcactgcttcatgctgctactccacctccttgtgcctatcaccatacccgtctcagtcacaaaggattactcacaaagaggggaagccgttgagccacctagctagatccaggcgtcgtgaggtcatgggtagttagatcaggtgaccctgatcttggggaagatctgacacccctcgaggctactgcgatcgtatctagagggagcatgagctccacaggggggtggcggtgatggtgcttaggaggtggagggggaggcaccggtcgtcctttgtagagcgagaaagatgtgtcgccaaaagcctggaggggaggcactagattcacctacccagagttagggcaactggatctggtgtctctagcatcctgtgtcccctcatcatgttgtcgagaggctcacactattgcgagctacgtggaggacccgagcttcttgttgggccttatgtcgagccttgcatcatcggacggatgaaccacctggccctcgtgtcatcgcacctttgtgtggtctccactctctcgattgaggtggagaggataagggggtgaaagataggagctgagaagacgaccgagtcttctatcaagaggagccatgtaccctagagtctgggatacaaccaaattatggttatccactactacagaattgattttttctggatgatatcccctttagattgcatgtggaccataactgctcccgcctgcaaaaatcgctccatcatgatcagttcaaggcatgcggccacttaagagacctgcttaggaaaatagtcttattttcccaggtaggcctcttaaatgaccgcatactgaagtacaacttcgcaaacggacttcttaaaagtctgacctccctcctctcttttctcttagcatcttcaaaatttttcaagtctttatccttatctcctaccttctctctctcacctctcatttctccacaacctcctctttctctccccgctcatttcccccccccctctctcccacttcctccaaatgcagcccagcatcaagagcaccagctggcccgggtgcgagacagccatggggagcggcggagcaaactcgacgggtccccatgagcaggacgcaacaagggagccgcgaggcatggagcaaggctccagttaccaggtgaccactagccatgactcaggtaggcgacggtgacgacggcagcagtagggagctcgtggtgggagcgacgccagcgagcggatccgccgtcattgccctctggagcaacaccggcatgcagatttgacagcctccatcctcaggaatagcggcggtgggattaggaggcgggagcaagcaggcatgacgacggtggcaatggcggtgacgacgttagtggcagttctgacgacgatgacaagctagggtttcggtgtttttttgggatttttatttttttccaccaaaattattttttttcacgcggtcggtataggtgaccgcatgcgaaaatcctgtttttcatgtgattaggctgcccgcatggaacaatattaattttcacatacacctaggtgcaggcgggccgtctagctacatgtagaaaccggttttggctgtcttgaaaaatgatttttgtactagcgatctatataatgattttggaacatagacccatcatgtagatgatgcaaatcatcgatctataacggttcatgaagaatgccgacccatttgaaatgactaatcacctgtaatatggtttatacttacgaggccttaagatgtggtgcatgataataagggagatacattttttaaactgtacgtaatgaactaccctaaccatgtgtctagaacgaatatgtgcatcacactggtgattaattagtcatcttgatcaacttttagcaaagcacaaatttatataaagtacactcctgtgctaactaaatatagcatattatcgtgcatgttactgtcgctacatgtgcatatatgcatgtacagcactagctaggaagaaatttatgaatttcaacttaatgattggcagcaggtacgcttgggcacatgagaattaatcatgaattggtcctattaaattaatttcgttgtgtggtcgtttggaggtctatgtcacaaatctaatttggaagtaagtcgacacatggattcaagggactctcccaaagaaagcgagatttcctttggaatatatatcatatgacatgcatggattatcaaaattaattatgggtttattgaatttattgacaagagcctatattgtccctctagttcgaccttccactgtcctttctctctcaagcaagtaggatc

SEQ ID NO: 68167 - DNA, 1259 bp, Oryza sativa
tcctgcagcccaacaaggagccggcggtagtggcggtgcacagggcagccagcaagcgacacggcagcggctgcgctaaggttagagcaacaacggcgacgacacgaccgagggattgaaacctaacccgaggggacacggatagaagtctcaccgaaccaaagcgatcggagagggagggtcgacgtttacgatccggcggcaacacacggagacgacgacgacgctagacaaacaacggattagattagattggattaagaccctaggaaaaaatctacaccggtgaacggcatgggagcggcggttgccggtgaaccatggcacaataatgcaaacgggggcaccgggaggtagagaaggcgacggcgattcttaccaacacttacgcgacgacagacggcgacggaagatggccggtgacgagcttcgaagggcggcaaggtactgtccacggcggcgacgattttccggcgacgaacgacggcaacagaggggtggacggggttcacttcgcagctgcgatgccgagggaggctgcggcgaagcttggcgatgacgggaggagcagcaaggcctcaccggagatcaaaacgcgatggcgaacttcggcttgacggcgacgatggagctccggtggatttcggcttcggggaaccggctgccgggcttcatcttgctcctgcgaacccaatggagtcgatggcgacggaaagcggcggctaaggcggctgctagctgcggctggaggcgccgcaaaggccgaaaccttctggttcgcgtcggcaagcggcttccggctggatttggcacgaaggaaccaaaggccagggtagagctcgactttgcggagccgagggaagtggcggcgctgaccgacgacggccggggcgacggcgcacggcggctggagcggcggccggaggtggagagagagggagctcgcggggagagtgcttccggcaacggcggagagagggagaggtggcggccgaaagaggagaaggagggggctctatatatagccatgggagcccagggatcgagcccacgacgacgggaaaaactcgggaaagtttaggatttcgccggaaaaaggaaagattgaaccacgaaattggaaaggatttccatagaaacttttggggatttcttggggaaaaggaagaggagattgagaggactccactcccgcaactaatttggaaaaaggagcaacgaggtggccggatttcggaaggggatcggcgacactgggc

SEQ ID NO: 68168 - DNA, 838 bp, Oryza sativa
ttcctgcagcccgtcgcttaagttgttcctccccgattctattcccaggccgcccacactattgggccgcctcatggaccacgtgtacgcgctccgtatggaacaagttcactttaggtcacttcagctgaactttttttatttcattataaatatattttcttaaagagctcatatcatataaaactaaaccttaatcttataaaatttttatatttgttataattttaattagccgtcgcaacgcatgggcattttttctatgtcaaaaaaaagaccacgacatacaagtgagagatatataccacacacacccgcaggctcatgtttaaatgaactggcaacatattttcaattataggtctaattgttttatttaggtgattaaatttgttttcatttatataattagtttgctctatttaagctttttaaaaattgctaaaaatttgagaataacttttcctacttcgtattatattatttttagctaatggaattaatggaaaattaattatatattttttatcttttttatcaaaggttactgcaattttatttcattattattattattattattattattattattattattattattattattattattattcctttatatttttttcccatctgtataaatgattaaaattacctttacccgttgcaacgcacgggcacagtaaaaaacaaaatcactctggacaaggtccggcacggcccggcccggcccattgctatcttccgttccacccgctcccgttgagctcaattatctctctccgatccccttccttccggatccatcacccccaccactacatcaccc

SEQ ID NO: 68169 - DNA, 1625 bp, Oryza sativa
gggtgatcggttttgcatagttaatggacctcatatatctggttttgtggtttgaggacgtttttgtaactcgatgacaaattgagggaccttcggtgtactttttccatattttgggctagcgagatcgcttatggctccttttgtagcccaatccccgggaggaaggccagcgggagaaaattcaacgggccaaatcttcttgtccatttggaagcctacaaggtgggaattttatggcccaatccgcacagaatcgtgaggtcaagaaaatttcctctagctcgatacattgcgccaccgcttctccatctcgcgattgcgagcagacgatgccaccgagcctcctccagcgagatgctctcaccggtcctccttattcggtctacccctaccgctctatccctctctccttagatcttgggtatgcccttcttctttcccctcttctcctagagtttccgggtttcctatttgacaaagttggtgatgagccgctctgtcctaaagtgaacaagagttatgttatggttggcatgtctctatcttaagaggatttttccattggaatgggttagtttatctcttagatttagggtattttatataaatagatggccatattgaaagggtcttgagaatcgttaattttgcctagaggaggggtgaacgggtgctttgtgatatttcaaaacttgcagcgagattagaactaactagacaaaccgacacaacttccggtagtccaactatagatgagttggatagttcgactgctgtaggacaatccgattagtgcaacgataggaaaaatgataagtgacccgattgtccaattgctccaggacaatctggttaacacaaggatagaaacttaagtgatatagtaagaaacaaactagaaggtccacttaagcatgctttctacaagggcaagtgttgacggtcattatcgatcagttgcgaccgtcaatattaccaaaatagaggagaactagttatgcttgcaatacatatacaagttagaataataatattccactagtattgggtgtactaaccttttgcagagaataaccataaagtggagaagaattgatatcagcacatttcataaatctatcgcacgatgtcgagaatccaacttatgcatgaatgggccaagaactcagaattgacataatgcattgggccaaaattcccaagtctaagaagtgaagtaatggaggaggccacatacagaattcggccgaaccccctagcaccgttggatgcagggtttattttggatggcgtggatcactccccaatgacggttggagagcaattctgaccattccaactgccaccgaccatccccaaggagttcactctattcacttcaacacacacctcaagcaagagctctctcatattctctcaagttagtttagtattcttaagctagtggaataggaatatagtagaaattaagtatgggtttaggtggcttccttttctttttggtaagctttgtattttattttagaataatttttctatatccatttatggtattgaaatactttccgagtatatgaatacgttctttacattatgttcatgttatactgaatatactgcta

SEQ ID NO: 68170 - DNA, 2185 bp, Oryza sativa
cgggcataaatagaagcccgacacccataagagtcatcggtgacgggctccaaagaaggcccgattgagatggccttaatgcccgtcaccgatgactcttataggtgtcgggcttctatttatgcccgttagagattagtgtgcgcccgttagagatgacatttttttttggcccgattgagatatactttgcacactatatatactccagcagtccgttgtctgtagtttatcccgctcttcactattttggtgggaggtttaagggggcgaatttttgtattttttttgcaaccaaaaacaggaaagtcataaaagtaagtaaaagagtactaaacatttcctattaatttagtagtacttatgttatgagatgttaactaatattttgttcattgttcagtgatggatagaagttggatgtacacgactggcttgaggtgtcagtacaaagagtatagagatggcgtattaagttttatgaaagccgcagaggaggataggataagaagaaccgacaagtacatgtgttgtccatgtagcgattgcaggaaagagattttgtgggaagatgaaaaggaagtacacgctcacttgatacgccggggattcatggagagatacacatgttgggtgatgcatggagagcaagatctgggtactgatggtgcagctgcagacggaagtggtgcagacagtcatgaagaaggagatgaagaagagcatgacatgtttgtcccatctccattgggcggtgaaatggttgatgtggaccgtgatatgctgcaagacatgttacgtgacgttgatgacccagctatgaatgagagagattccatgaagttcagcaggttggtcagtgactcggagactcctctatacgcaggatgcaagccaaagcacaccaaattatcagcaacattagacctaatgaagttgaaggctagtagtggatggtcagacgagttttacagaacttttgggaatactgaaggacatgcttccttacttaggagaacacattgcccgagacgacatattgcatattgtaccacaagcaatacgcggacttagatgcttgtcctgtctgcaaggcttctcgatacaagcgaaagaagagcgcaggcgagggaaagaagttaaagcggggtggtccggcgaaggttgtgtggtatctaccaatcattgatcgtttcaagagaatatttgccaaccccaatgaagcaaagttagtacgttggcatgccacagagagaaggaatgacggtttgctaagacaccctgcggattcgattcaatggaggaatatcgatcgaaagcacaaagactttgctgccgaccccagaaacatgaggatatgtttgtgtacagatggcatgaatcctttcagagacatgagtagttctcacagcacttggccagttctcattgcgaactttaacctcccgccatggttgtgcttaaaagaaaatatattatgttgtgcttgttaatccaaggtccgagacaacccggcaatgacatcgatgtgttcttggagcctgttatcgatgaccttgagattctgtggaaagagagtgtggaaacttgggatgcatatggtcaggagaatttcacactacgagttctattattctgcaccattaatgattatcccgcgctgggtaatctttctggacaaaccgtgaaaggaaagaaggcatgctctgactgtatggaacatacacgcagtaggtggctgaagaaatcaagaaaaatggtttacatgggtcataggagatggctccccctacggcacgtctttagaagaaagaagaaaattttcaatggtaagaaagaacttgggtctgcccctgcagatttgtctagagatcaggtacacgatatggtgaaggacattactaatgagtttgggaagaaaagaaaacgtagcagggaggacaagaagaggatgtggaagaaaaaatccatattttggcggctaccttattgggaagatcttgaggtccgtcattgcattgatctgatgcacgtagagaagaatgtgtgcgatagcttgctggggctattgttaatatgcctggcaagacaaaggatgggttgaatgtgcgtctcgatctacaggagatgaacattcgcagtgaacttcagcctgttacagatgagaagacgggaagagtgtacc

SEQ ID NO: 68171 - DNA, 715 bp, Oryza sativa
  unsure (1)..(715): unsure at all n locations
ctgtcttacatattatttctatttattattatcataccaaacttctgcagcaacgcgtaggggtttcatctagtatttattatttttgttacaacttgtatgagtcaaaccgtgtattatttgtcaaattttcgtgtaactgtgacatgtaagaaataaggtgacatcgatctgtcgagtgattgcatgagtcccattaattaattcctatatctgtatgtctccattactgttgtgagacttgacgtcaaccggtagcagtgtcttctgaacaaacggtatgtagaaagcctccttccctaatatgagtatcacgacgaccggagtgcaggcgccgatggtgatcaccaggtacgccggccacctcttggtagacggaggtcatgagggagacgatcatggcaaggcaggctatgacggtgagcatgtgtnnnnnnnnnnnnnnnnnnnnnnnnnnnttgacggggtcgcgccacgcccagatgaagcagaagacgacggtgatggagctgcacatggcgacggtgttggagacaaggaagatgtcgaacgccgcgcggtcggcgtggatggcgaggccggaggtctggttgtagccgccgggcatggtgaaggtggcggcgaaggtgacggtggcgatgagagtggccacgagggtgtaggtgccgacgccgagctcgaagtagtcaccgttgccggagccagctgacctgtg

SEQ ID NO: 68172 - DNA, 630 bp, Oryza sativa
ctttttatgtgcatcataataattcccaagaattattgaatcgtgttaaaaaggattttaacagcattgggccacaccattgtgaacacaaatcgccaaagcaaaaagtgcctaagtccctagggatcacaacaggccacgctgattatagtattgggctgaagtactgtacaggcccaggcccattagtactcccgataccctaataataccgaagtgaaactcgtctcttcgtcttccccgccgagactctcgccattttccccatttcctgctacagtgcaaaactgcgccggccaaactagggttcatcaatccgctccaatccctcctcaaaatcttcacgaaatttctccccgtatccaccgctcaaattccccatccctttccagccgtatctcgaactaaatcagaccatccagttcacattcatggcggaagaaagagaaagcttcaagagtcagtgggcgccctccgatgtgacggaagacaatctgaaggagatggtggcgcacggcgttctttcaagcaaaagagatcatcgggtggcaaccggcatttggtgaggcattttcaacacccgatacacacgaaaatcgtggtatttgctcatttcttctacggcggatt

SEQ ID NO: 68173 - DNA, 1793 bp, Oryza sativa
aaaactatcattttacgttgtttctctctcatcaattgaccgagtattatattttaatgtgtccagtgttctgcagcaaattatcacatttttggagtgtctttgggcaaattcacgtctttagggtgttccagctaattacacattttttttgagtgtcctgtagcaaattttaccaacttatatatacatcatctgtgccataaaaaatcaatatgtgtagattcattatactaaaatgtgttaaattacatatactgtgccataaaaaactaacatgtcaagattcgttatagaatgtgtcacgtccgatcctaagttgttattttgggacgaagggagtacatcacagtaatgtataaaatttactgcaagtaccgtgtatgacatgactttagatgagatgtttgatattttaacatttcataaagcgggtttcgattatttaacatagtaggcatagataaaaggagacaatctaaattgataaatcctgacggatttaattagtatatatttgtataagttcatctcatagtgttatatgtatttttctttaatttttccctctcatacatgctagcttttcctttcactaaaaacaaaaggaaaagagggataacctaatatttcctcagattatttcttccttggaggagactgttaatttctaccgcctcagttaattgctctcaacttggagcttaactctgagcatatgttgaggtattgaagctgtgggccagaaagcctcttcagatccatcaggtaattcccttccccttctgacttgtacagctacaataagcacaagaggtaaaatttttatcatgggtaaaaaaaaattaaaggaacggttaaacacatgtttttttttgcaagtattaagatttggagggagtaataattgtcaaggggagaaacactatcagtctcattgtttggcttattcgaggaacaagccaaatgatatatttaaaaatgaaaaatatttttttaataaagttcttatatacatgttcttaacgatataaatgaaaagactaaaaaataaactacgatgaaaaactttaaaatcacctctaaatttaaagttaaatatttaaactttaactgataaatataaatataagcgaaaagatgaggttacgagagtgtatgaatgatgcgcttgaggagaatacctgaatttcaaagaacacagccgcagacaagctctcgaggacagcatcatcgacgggagctccaccgccatggccagcctcacctctgccactgccaccaccggcggaggaggaagaggagggcgcgtcgtcggtggcggcgaggtagctgcggatgatgcggcggacgccggcggcgccggcgaagcgtgcgcagagcagcttgccgtagcggccgcggtcgtcgtcgtcgtgcgcgtagacgacgccggtctcgcgcagcgccgccgcgatggcgcgcatcgcctcgcgggggcactcgtggaactccacccctcccagcgcccatccgttgttgcgtccgtcgtcttctccggcgacggcgaccggcggctctccggcagcactgctgccagttgcttctgctgctccctgtccagagcaaataggtgtatgatggtgttgaatcagttgatccaatacagtgttagattttttaaaaaaaaggaaaatccactttgtttagtacaaagaaatttcttgatcattattgtgcaaataaaacatttttgtctataaacattactccaggttgattatacttattgttttggataagagtattgtcaa

SEQ ID NO: 68174 - DNA, 1050 bp, Oryza sativa
actgcttaaaagatagtatttgaactgaacaaaaaactattttttttgtgtgaaattcactgttaaatggacctcatcattgcaactaggttctgacttgctgacatctctcctgcacacaacggtccatttccctgcatttcttctccaacttttgtctctaaattcatcccatccaatcgcaattactggcaactgttcagatcaacatgttcacaggatcaatgcaattcctgttgcgatgcaatgccgcaattactgaacacatttagatcaccatcagtggtctgctgtactaatactgaacctgggtatccggcaaccggtgaacatacaggccggcgtcagttactggaccactggctctcctctgagcagcagttactaaggatgcagatatcagtagcatccatccatccatctattgctgcaggaactgatactttctggcttagctagcattagcaattggaatagtagggaccagatttggtagtaacagtagttaggagatttggtaataacaatggtttgatatgcagtaatttgttttgttgcttgctctcgtactttctaatggattctgtcattctggggtgtaatgtaatggaaatgcgtttcttgttttgtgaaggatccagtggtgagcaggattgaaaaaagaattgcagcatggacctttcttcctgaaggtaactcttctgggcttcctcagattgtctcattgtttggttctattgattgttcaagtagcaaggttttccaagttaatgttactgctattttttttcatcagaaaatgctgagaacattcagatactccgatacgagcatgggcagaagtatgagccgcactttgattatttccatgacaaggtcaatcaagcactgggaggccaccgttacgcgacggtgctcatgtatttgtccactgtcgagaagggaggcgagactgtgttccccaatgctgaggtaaatttcaaatatcacgtccttcacttttccaaatccaaatgatgtatgagtttttgtaacattgctggtgctaat

SEQ ID NO: 68175 - DNA, 588 bp, Oryza sativa
atcggcatcggctcgaagataaatgatatgccatcggcaactagccgatcggctatcgtatatggatttaaccgggggtttcttgtctttctttcttgtgattacaggatcaaatcaactagcacgctcacgaacctaaaagcaagattttggacctgcactgaagttaagtagatcttctaggccagtgtgtgtttttcacatcaacagttgtgaagtcatcccttctttcttccagctgcgcgcttttcaaactgttaaacggtatggtttttacaaaaaaatatatatatatatacaaaagttgctttagaaaatatattaatctatttttttaaaaaaagataatattaaattaatcatgtgctaatgagttgtttcattttgcgtgctagggagattagctcccaaccccatggaaggaacataggcggttcattttacttttagaactgtagatctaatttaattatcatgaagttacgttggatgataaaatctatattattattattattattattattattattattattattattattattattattattattattattattattattattattatta

SEQ ID NO: 68176 - DNA, 648 bp, Oryza sativa
tgccatggcgctaccggcactgttgtcttcgttgacgaccaagtacctcctcatcatgctcggtgtcagcagcgtactctagttcttcccttgctgcgatgctgctattagcatcatggccattgtggttgcgcctagccgatccatcatgaccatctttgctcattctctccaatgtattcaagatacctgcaagagaagtgttcacagccacaagggacctctccaatgaggaggaaaacttggagttggtgtcaatttgagcagcctccaattgaccaaggcgatcattggcgaccctatttaggggtaggtatgacggttatacaatgcgaattgtcggaaatgccccgcaaccgccatcaggagatgatcaagaccgtccacgccaaaccccagcctggatggctgagattgtggttcggccgaacctcggctgaacctgggctagtgtcacgcccagaaatttagcccaaatttccagactattttgtgtattaaatccctgtccaggaccagccagggtacacaaaacaataagtaatatacagttccaaacgtaaataaagcgtaaaatacttacagaagatgcacttagtcctcacaccgaaacaaaagcagcagcagtggaaaaaggcgatcctagcg

SEQ ID NO: 68177 - DNA, 536 bp, Oryza sativa
ttggattgaaatatgcctatcaaaaataaatttttcagatttagaaatataactattaaaattagatggagggagtactaattaccactcgacacatgtccagacaccagaatataggccaagaaaattcacgcacgggatggactagcagcgccgtcgtcttgctcaaccaccgccagttgcagcttgcagcactacgaatgaaatcaactcatcagtgacgacgccgtcgctgaaaaggctaggcatgatgagagaccagccgatttttttactgtaactacccttctttatcgtaccggtccacttcagggaacctccaattatgcccaggaaagcagagacagtgctgccacaaagtcaatctagcgacatacgcgaatgacttctaccgggctaatcaaccactagctttttcatctaccgtttcgaactaattgaacaccccttagggcacctgcaatggttatctataggctctctacaagagatccatatcagcatattttcctacttggaagagattaaatgaagag

SEQ ID NO: 68178 - DNA, 2561 bp, Oryza sativa
  unsure (1)..(2561): unsure at all n locations
aagttatttttgtctagcgtcaataaagaaaacatcggtccaatagatccagaaaattcacacctgagcagaaaaaagagtttaaagaaatgttgcagcaagcacgggatcagttcttgaactcattcatgcagacccgcaaggggacacttgttcaaaagtacaaaataaaagtggttagtgatgatcctgggaccagttcttctaaggatggagatgggaaacaagctcgagacggctcggctcaaccgagtgacaaaaggtgctaccgacggttctttaggaaatcaaggcgacaattctcaaggagtccatggagtgcaagatcacggagtgcatggagtttaaggtgatggtgcccaggggttccatgtagtcctttcttaatcagaatagtcggcgtcctcaacgttgtgtcaataattccggagggggggtgcccgccaccttggcataagggtggggtccatcagtcatcccttacctccaaccgctcctgccgcctcgtcagtgccctagcgcagcgtccgccgcgaatccagcggcctcaggccgtctctgcgcgcaataaagagggggaaagcactccccgtgattccctctccctttccccccacttttccctctctctctccccggaattagtacgaaaagtttccccctaacttcgacggcgcatcaatggcggccggatcttccgcaggcgattcccctcatccggctctcttctccccctccggaccctatataaacgctccccgtgcctcctnccaccatttccgccactcgccgctctctctcccgtcggaatagagctcgcgccgtcgcccctctctttccgcggtcgccgccgagctccggtccgccgccgtcgtcgccccggactttctcccgcttcggcgtcgctttcttcgggttcgccgcaacctcgccgacctcgtccacctctccgtttcggtcgccgaccgccggaacgccgccgtcctcttctacccgagccgcgccgccgccttcctccgctccggtcgccgtttccgccgtcgccgtcgaaccggggtgagccgtgaaccgcccatttcgtttccctctcccctcccctctctcggccgccgctccgccgtgcctatggccgccgccggcgaccataggggcgcgggcgcgccgcctcccgtcggctgtgccggcgaggccgccttcgggcgcgccccgcggctgccatgtggggcccggccgtcagccgcccgagccctcgggtgcggctgacgcgtgggacccacggcgccggccggtgtgagccgcgtgcacccggtccaccgtggaccgagaggctgctgcgtgggccccactcccgtggacccggtccgcgcgctcctcccctcggctgacgcaataaatccgattttaaattaaaatttaaatgaagaaattcgcaaatatccatttaaagagcatataaacttcaaatggccataacttggccatttaaactcggaattggaccgttcaagtctctaatttttccttaagaagtcaagaacccatttttgtgctttgtttctgcttgttatatggagtttgttagagtaaaagccttttcttttccgttggtcgtgtagacgctgcagcttcggaagatccgctcttcgtggaagttgaagccggcgtttgggaaagcgagcaaggcaagtcacatgatctttgaacatattgaatcccagtttataaaattatgttgatttaaattattgcattatcgctttatttaaattcccgcgttatcactgttttatttagccatgcctatttacctttgttacgaccttattattattgttattgttattatttccttgttcacactagaataaacaaaaccccaactagtggacactctactcatggtatcactagtatgattttaggtagatgcttcgcttttaattaggtaacattaggcggttttacaactctagactttgggaatgttcgtatcacctggacactatggaatggtttggttattgtgaaattggcttcacaccgctccttctattcaaaatccccaaaatggttttaggctgggctcggggtgcatggttttgatagtagcacctcggccatataaggaccggtcttcgggcctctgttgcaaagcactaccgtactttcacatgtctagtgggtaaggcttagtttgtgactcagtctagttataaacaaaagtacacggatggagatggaagaagtcgggggtcgatggacatctctaggacaaatgaaggctatacgagctgcggcccggtagtcgagatgtcatggcacaaggccggtgtcctgctgctaggggttcagtcctgcctgcctgtcccgggggttcccgccgtaggtgggattgggtcggtactcttgtctatggctaggatgggttggaaactatgtcacgtctttcgtctgtatacccgggaggtatgtggcacgtggttacacctgaggaagatgtgtctttgtgggtaaaatgtacacctttggtagagtttatctattcgaatagcgcgccttcg

SEQ ID NO: 68179 - DNA, 1912 bp, Oryza sativa
ttgtaaatttgttttattttgaatttgatttgaaatttcagtttaagttctcaattgccatataatataccactttaatatttttttccaaattcaaaaaaattgcaatttaaacatatcttttgaagatagtatcagagacaaacagaaaagaaaaaaaataaagagtgagagagagaagaaaaagaagaagaaaaagaaaaaaatggttttttttttctctcgactattcactcttattctttacaaaatgacagtttcgtttgtaaatttaaagagtgtgagagagaagaaaaagaagaaaaaaagaagaagaaacagaaaaaaaaaagggagagatggggggtcgaaagaagaaaaaacggagaaaagaagaaaaatggatgaaatgggggatcgaaccctgctccatagggttagagtagaatcctactaccactatgctatcgttgagttgatgaagatgaatgcctccgtagaaatttaaatcatcaagacctcagcgccaaatatgatgactcaacaaattcatgccacctcggatttgagcttagcgccaacaaaagttggcgctgagacgttatagctcagcgccaaggtccatggcgctgagttcacggcctatttttggttgaagttttttgcagggactagtttcgaaataagtttttaaaaaagactaatttgttaaaaaaacggtggttgtggcggctccattttggggaattttttttgacttagattctaatttgctacatcaatgtctgaacccaacaaaccaacgtaggtgtccatcaattcatctagcaagaaaaatcatagcagcatacaagtggtaaaacatgttgaaggatacaaatatattacattgtgaatctatcaaatattaattaagagagccatcaatgcgagcagtgcttttgcatacgtagcaggtcgatgaccacatccaccaccctagaatccattgccacctctagattggtgcacccttcctctccactaccaccattccgccatggctccaccctcattccgccatggctctaccctttgaagccctgccactaccaccatcgctgaaaaaaaagtaaagggaatatagggactcacctacgctggctagtaatgatgacaatgatggacgaggcgttgctcggtcgatccggatggggcgggagctccgtaagaagagagcaacaccaaagttgttgtttctctttccaagatagcacacatgctaaatttaaagatagggttggtgcatctactagattagctgctgatgttattgctgttgatgagggacgaaatagataagcaagcagctaggaatgctctaagcccgtaagtgtcatgattagctggtaaagaagctgatgtgttatccgtgagtagaatgatgggttttttgtccggaaatcatacgttacaaactgttttagatcttggtctaaaaacaagctcaatcaaatttttgactaggaaatggtgcaaatcatatcaaaggttcagattgttcctcaggataatgaggacaaactctattggattcctacttcttcaagagcattacttcaaaaagcaattataagcaggtttctaatatttctcacttccagttcgtttccactgcaaggagcggataaaattttggatattctcggcacgcttttcaaactactaaacagtgtgtttcgtgcaaaaactttctgtatgaaagttgttctaaaatatcagattaatctattttcaagtttgtaataattaaaactcaattaatcacacgttattaccaccttgttttgtgtgaagcacttaatctttatctttatcttgtctcctctaacatcacctctttacagagtaatctccttttgaaaacttggtccactaaatacattccttctaa

SEQ ID NO: 68180 - DNA, 2032 bp, Oryza sativa
aaatagctgactactagtctaaaaaagccagagaatctaaatatgagttagcagctctaaattaccaaaatattagtcatgcttgtaataataatacttgtcctacaaagcaacttatgcaagctactccttggaaagacaattgtgtatctcttgtgcacattttccttctaatgtttaaataaaaaattactaagttgtaaaaacactgtttttagagcacatggcaaaccgcttttctgcagaccgaggagtaaaaagactatcactgacagatgggacccaccaaccattgtctctcactctctcccctcgcaccgcagcttctccaatccgtcactttccccatccctcccgcgaaaagcagacagacgcccacaacccaccaccacgtctagggttccgccgctcctccggccgccgccgccgccgccgccgacccccctcgatctcctccccgagccgccataggtggtggcgggggcgggggagctagcatccgtccgtcaacgcacatcgtcactgctgcttcctggtgagcatccatccgtttcgcatatcctctttctcatccctctctacccacccactttttcccctcgaattcgcgtcaaccctagcttctcttctagatctgaaagctgctgcttttctttcaatttgctattcttaatacgaataacagtttcgtttgttccccaaaaaaagtttgggatgaatccccatgtcccacgttagatccgcccctggttttatgtgcggtattgttgtttgtggtatgggtaccaacagctttcgttgttttcaccttttgcagaaatctgccaccatgtccgacatggagtccatggctacacttatggagtccacaggctccaagctgcagcagcttcagcgtgcatttgcagagctcgagagccagagcgctgtttccttgaacttaaagtggaagcaactggaggaccatttccatgggcttgagcagtcgctcaagaaaaagtttgatgatctgaaaaggcaggaagaggagttcgaggagacggttgcaaagtcagagcagatgctggagcaacaagaggctgttgtcgtggcaaaggaactgacttctcttgaaaaactgcagcagaaaagggatgccgcgttggctgtgatctttggcaagtccaagctgaacttgtctacgcctcttatcaacccaatcagcaaatccgtgaataacaatgctgtgtttaatggaaacatcggtggtagtctttctgttaagtggcccaaacctgcaactgcgcatggtgcatacctgcaagatgaaaacactgctgtgaagcctcgttctcaacttgttgtcctctgtgaagagatgaatgttaacgggcttcataagttcatatcagacaatcgcaaagacttaacatccatccgtgaggaaatccccgttgcacttaggggagcaactgatccatatggcttggtgttagcttctctagaagacttctattttggagacaatcttatattggatggcaaaaaggatggaaaccttctgggtgtacggaggacgtgcctcatgttgatggaatcacttgctcagctgcaaactgatgctactactggtttcatatcggaaggtcaagtgcttactgcaagtatcaaggagcgtgcaaaaaagattgctcttgagtggaaatccaagttggatagccttgactttgatgctagcaatgggaactgcctggaagcacatgcgtttcttcaactcctggctacctttggtatatttgctgaatttgcacaagatgagctgtgtaagctacttccctcagtcagtcgtcgtcgtcagacacctgagctttgtagaatacttggattgtcccagaacatgccaggtcagtgctatcatcgattaataatgcagcttgttccattgagcatcaataataaatgggattttctatttccctttgtcactcagatgtttagagaacacattttgaccacttcaataattgttcatatatctatatagggctgcagg

SEQ ID NO: 68181 - DNA, 793 bp, Oryza sativa
taggttctatggctgtcaagtcgtatactgtaattgttcactcacttatttgatttatttatcctggaatagttaaagtacggggtttgatcatatcataaagttagcaaatcatttagccaccaatcagcttcaatgtagaagctgcagtgctgttctgaagaacttgaataataaagagctactttagcttgcaagatactattcagctatagttgcttgctaccttttctttcttgtgtggggtaacaaatattttctcttcttgctggtctgtacattttttaagcatatctgcgtgcattcctaattaattgtgattgtagtatatctgatgaattaccatattattcagaatgaaatgaatgaacgagagctgtctgccttgaaagctgctattaagtgtatcgaggagcacaaacttgatgagaaatatccgattgacctgcttcagaaaagagttatccagctagagaaagctaaggcagacaagaggagggctgttgaagctgcaaagccacagtctaagaggcctcgtgccaatggatccgtatatgcgccacatactagctttcctgacaaaagcttctaccaggctgctccgccgcagaggcattcctacccttacgagaggcagtatgtgtatggtgctgaggcccatcaccatcccacaatgataagctcagctccctatggcatctcacctgcccacacaacatattatggtaatggctatcaggttcagtaccaggtaccatatatccactgatggagagagcgggctgcaggaatt

SEQ ID NO: 68182 - DNA, 1099 bp, Oryza sativa
ttcctgcagccctggccaagtggaggaaggtaggaggcagtggactgggctagggctaaaaagtaaaaagaatgagctttcggcccaaaaccaaggatgaattttgattaactttttcaattataatgtatgtagggatcccaatattacaggaagaaaaccctttacctatcgattttgctatatatttgtcgacaaatttttccccaaaaatttgacagatgtaattacagtataatcgtagtgtaattacactgtaacttgcatgtaattatactgtaactatagtataacttgtatgtaactttcaaaaatctctccgtaacatgttatttcggtaaaatggaggtcgtgggaacaaattatttcacatatgtgtgtgctatgatttattttcttcctcaccaaaacaaatcttgtaatagatctaacgattcaaaattatgtgtagttacatgcaagttacagtgtaattacatataagttacagtgtaattacactataattgtactataattatatctgttaaatttttggggaaaaatttgtcgacaaatgtatatgtagtctcatgcgagtacttttctaagattaaactggtaatagctaaaaagttaagattaatttcatttattcaacacaagaaaggaaaaaaaacgtgtagaagccatcgtctctctcttccctagcaacaacaactcattcctcgcttgctggctgctgctccgtcgcctttcccatctccaaccaccactccactccacctcctcctcctccgccgctgccgccgcgcagatccgcgggcaaggggctacggtgcggcggcgccgccctgcacccccacgccgccctccgcaccgcgcgcgcatccagcagtcggaagagttggaggaggaggggatgaaggatgtggtggggagcccggggacatggagcgggatgtcgctgcgggtgtcgcaatgcgtcttcgccggcgcctccgtcgtcgccatggcctccgcctacggcttctccaactacaccgccttctggtaccctactactaccgcctttccacgtctctctctctagcctcctctttccccctggggctgcagg

SEQ ID NO: 68183 - DNA, 678 bp, Oryza sativa
aaacataccattagtataattacatcgcaacccagtaggattagaaagggtatgtataacccacataatttttgcaactacaagatgtttcttaagagtgatcaatgagcaacattagttttttacaacatacacctttgtcatctcgcagatcggtgggctgctgtccagcaatgatgtcgatggcctccaccaccgccagccccttttgcccttcacccatgcccagaggacgcaaatgcacagttcgagttcaaggtatccgtctactcaatctatgcagtactctgtaatctgatcgatttctgatttcttttgcttaatttgggggtacacagctggagctgccggagcggatgcatctgataagtcgctcgagattatgcgcaaattctctgagcagtacgcccgccgctccaacaccttcttctgttccgagaagtccgtcaccgccgttgttatcaaggtaatggaaccaaatctattttctacttctctcttgaatcctcgttaaactttacttttaaaaaaatctcactgcgtgcacatacaaatcaaatactagcaaaaatcatcttagccacaaacaaattcttctatgctgctatttcatgtgttctgtacctgcagcttgataagaagattattacgccctattgctgctgttgaaagttgatg

SEQ ID NO: 68184 - DNA, 2077 bp, Oryza sativa
agaaacataagtgctcaaaactgtttttgtaacccgattctagacctatccaattattaatcaggccggtgaacccacacgaacctcccttacccaaaggcctacgatgattcagcccgaactgacaacccgaccatgggtcccagctcgtcccaagccaccccaggccaaccattccacattttagttgttaagcaggttttaagaattaaaacactaacttgggtacattgcacggcttgcccataaccgagggcgcggctattcgaatagattatactctgatcagaggtgtacatctttacccacaagacacatcttcctcacgtgtaaccacgtgccacataccaccacggtatacagacgaaagacgtgacatagtttccaacccatcctagccatagacaagagtaccgacccaatcccacctacggccggaacccccgggacaggcaggcaggactgaacccctagcagcaggacaccggccctgtgccatgacatctcgactaccgggccgcagctcgtatagccttcatttgtcctagagatgtccatcgacccccgacttcttccatctccatccgtgtacttttgtttataactagactgagtcacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaaggagcggtgtgaagccaatttcacaataaccaaaccattccatagtgtccaggtgatacgaacattcccaaagtctagagttgtaaaaccgcctaatgttacctaattaaaagcgaagcatctacctaaaatcatactagtgataccatgagtagagtgtccactagttggggttttgtttattctagtgtgaacaaggaaataataacaataacaataataataaggtcgtaacaaaggtaaataggcatggctaaataaaacagtgataacgcgggaatttaaataaagcgataatgcaataatttaaatcaacataattttataaactgggattcaatatgttcaaagatcatgtgacttgccttgctcgctttcccaaacgccggcttcaacttccacgaagagcggatcttccgaagctgcagcgtctacacgaccaacggaaaagaaaaggcttttactctaacaaactccatataacaagcagaaacaaagcacaaaaatgggttcttgacttcttaaggaaaaattagagacttggacggtccaattccgagtttaaatggccaagttatggccatttgaagtttatatgctctttaaatggatatttgcgaatttcttcatttaaattttaatttaaaatcggatttattgcgtcagccgaagggaggagcgcgcggaccgggtccacgggagtggggcccacgcagcagactctcggtccacggtggaccgggtgcacgcggattacaccggccggcgccgtgggtcccacgcgtcaaccgcacccgaaggctcgggcggctgacggccgggccccacatggcagccgcggggcgcgcccgaaagcggtcttgccggcacagccgacgggaggcggcgcgcccgcgcccctatggtcgccggcggcggacataggcacggaggaacggcggccgaaaaaagggaggggagagggaaacgaaatgggcgggccacggctcaccccggttcgacggcgaccgcggaaaccggcaaccgagctgatgaaggcggctggaccggcttgggtagaagaggacggcggggttccgccgttcggcgacccaaaccgaaaggtggaccaggtctgctagggttctgtaaaccccaagaaggcgaaccccaaacgggagaaggtcccgggcgaacaccggggggggacctggacttcgtggcaacggcagaaagaaaagggccactgccccagctttttttccacggggaaagagagcctgcaatggccggaaatggtggagggaggcaccgggagcgttttttttggc

SEQ ID NO: 68185 - DNA, 10136 bp, Oryza sativa
tgcatgcgtgccggtctccactgcggggtggaaccggttttcattaataggcaattttgcaaaaaaaaaacaacacatatttgtatgaaatatctcatacgtccttggaccggttaacacccgttgcgtttcttccggaaaagccctcctatttcacagaaatacaatacgaagaagagaaaattccacttctagggatagcgttgtaaacataaaaaaggaagggactgtttcgaaaaaacaaccacatctaccccaaaccctagcccatgcggccgccactccactcgcgcccgtgctcccccgctgccatccgccctccacccaccgccgccgatgtcgtccgtcctccccccactctccgttgcacatccttgtgtcaccaccgctccacctccatacccccatgctgtcggaaagggtaaagtgtaggggcaaggatggcggcgcacaaatccaccgccccccgtcctcgggagcgacagaggcgcgcggatccggcggcctctgtcttctgaagcaaccaggtacgagtgggaaggaccacggcgtgcggatccagccactctagcgtgctccccatgccacctcagcgccgcccccgccacggtgacagcgccagccactttggcgcttcaaaaaggaccatttctgggataagttttttcagtggtctatttacgaaataagttttttaaaaggaccaaattgtaaaaattccagggtagatgtacaggtagtagtgcttggctccaagcaccaaatcgtgagacgcgcataccaggaggtagaacgcgaccacgagctcaggaatgtaaatcctgcaagggtgaaaaatcagatagacatgtagtttcaggcatgaattttcagtttttcactgctctgctatcagaggataactggtatgatcgtaagtaatgtttttacctctcgacgcagtctgttggcttcaatggttcaagaagagggacttcaagcttgtcctttacatgatcaccaaccttctcagtaaccacccactgattgacattcatggtctcgagcaagcctgttagagctgcacgcattcggtgcatggccatgacattctcaaatagaatctaaaaaggcatcagatggagagacctggtatatattagataaaatctgtaatcttggaaaattgatgggcagattgagagacattctctgcaggaagaattcattcttacccaggatttctgatggcgttcatgatggtaatggcagtgggaatgcagaccatcccccagacaggaatgctgatttcagggaccatgacagacagcggaatcacaacacggtagaacaggaaggtcaggatgggagcgacgaccctccttacgaagaaaaagctgtagagtagatgaagttttttccatacagatacgccctgaatcacatataatcgggtaaagaaacttattgcatgacaatcctgtaacatgttccattctgtcatattgaagaaggctagccttgtttttggcaatttccgttgcatttttctgaagaggttggcagtaccacaagtccatctatgctgccgatgtcggtaggctttgaaggtacttgggagttcactcttaacctgctcaagattcattattaaaacagggtaaaatattcatatatgcttattaaaggatcaacatatacatacccttatatcaccaacatacaggaattgccatcccttgaggcttgcccgtacaggcgtacagccaagtccatgtcttccacagttgtgtgatccttccaacctcctgcttcgttaatagtagctgatacccgccacacagcagcagtacctgtaggcagatcagtgatgttaggaccaggcatgattagttcacgtaagtagttctgatattggatcttaccgttgaagccaaagaatgaatgcatagatgagcctgattcctgctctactttgaaatgatagtccagtgacatcttctgtatccttgtcataaggcaaacatcatagttcactgcaaaattgcccagcaaaggccagggcagaacagcctgtaatcagaatgaacaaagattctcacttaaaataaccaaataacaccacattacccattgaaaacttgaacaaattgcatcagagaattaacagttatatccaaattatgggttttctgggacccgacaaaatttactttttaataacttaaaacggtgcaacattggatgtgcccatttttccgataaacttcctttcattttcatttagtgctataaggctataagctcttcatagttcagtctatttgatgaacatgatctgagagtttagtagacaagcaatacatataacagttgagtgaccaattcaacagaaacataaatcggactatcagaccaacaactgaagcaccgctatttaatttgattaccctcacaaggttggaatgaaacaatgaaaatacttgcttaccaaactcccaacgtgtctgaaccagaccaatcttagggttatgcacaagaaatggtattatttttagaaggaaatcagattcaggttggaaatctgcatcgaaaatggcaacaaaatcgcactgttgggtatagatatgttccatgcccttcttcaaggctcctgctttgtatcccttcctgttatctctgatttcatactttatgttaatttcttttctcgcccaatcaatgcactcaagctccactagatcctgcatttgaccaaaatctaagtaaagaaaccaaaatcatattttaagctctaactctaaatagaaaataatgatggattgtgaaaatatcttctgtgaaacatgaattaactgcatgctctccaggaaactgatgcatcacagtaacacacagccaccaattcacatgtttccagttcatttttcatcactacactatactgtcctatctacagcaatgcatctctatctttaacaatttgttgctgctatcttggcaggaagccgtactgcgagaccggaacttcgaacgccatcatcttctcccctcgagcaaacccgttgcggtcgtaggacgagatctcggtgatgtccagctccttgcacgccctgatgagctcctccccgatcctcccagctgcctcctgtcgcaacaaggccagctcaagatattactattacttacaaatgagcagtgtctgtttaattactaggtgaaattcggggaggaaaaagtggccggcgtaccacggcgccgcagggagggtcaccgcagatggccttctgcagggtgctgccatagaagaggatcttcttgttgtggtcgtcgacgagcatggcatagagctgcctgttggagcagaacacggatagcctcggcttcgtcgccgtgccattgaactgcagcgccggcggcggcaagaaccatgtgagttgtgagcagaagagcgactggtggttaatttgtgatttgtgcagttgagctggggtggatggaattgaaccgtaccttcttctgcagccggcggttcctgaccttggggttctccttcctcgcgccgtgcctcgccgtggcctcgatcctcgggtacgcgcgccggcgagctactccgccgccgcctgcagaatccagcggaaagaaaaggaacacgccaggtgcgaagcgcggcgggaacacgaagccacgcctggagcctggcgagctgggagggcggcagcacgccgggcgcggcgagaatggcagcccggttgccgcgcggagcgatgccatggggagacctggctagctgcttggggtgggcaatctgtcgagcaggtggggcgcggaatcccggggggagctctacagtacccgagattaggatttatgaatgatatttgtcctcatttctggggccccacctgtcacctgaaaggtaatctttatatacgatttcaggggtggaaatgaggcgtttgattgggccacgtggctcactgattatttagggttagttcatctgaaaatcagccacgtgtccctgtgcaatctcagatagtcagatcagtaacttctcaagctggcctgtcttctcctacctgattggtccacatggacttacaaaatgttgacacgtggaacaaagacaagatgcagcctgcagctagcctgctagctacgctctgctttcatggttacaatcctctagatacttccaagctcgtagaagtatagtcaataaattaaattaagaacacctagatcctttggatgatctcaaaaatattaaccctagaataaacattacacagcgaaaaacgatacagcacaaaatttaggaaaaactaggagaaataccataaattggaaaatgaataatgacatgttatagtgaaaaaatagttgtcaaaagaaataataaggccaagactttcttttgagaaaaatcaacaactcaagtctagagtctagatgcttttgagctaagggtacaagcggctacccacaaaaacccacttataggctaaactaacctgcaaactcgcttattttgacctataagtgggttcgcgggtgacccgcttgcaccccaattttgagcgggtctttgaaactggagctcaaaaaataaatagagaaaacaatggaaaattaaaatgtaaaaaaaaacagatctctaaaattgaagctccaaaaaaaaagataacacaaccgaaaatcaaaatatgtaaaaaaaaaaaagggagctaaaaaatagagaaacaaaccaaaatccaaaatgtaaaatttaacagcggagcctcctctactgtgttccttaaaaaaatcacaatgtaaaagaaaaagaaagcacccatggatatcagttgcactgtatagctctgacgatttcagatgctagatgtggtcgattgactatgataataattgaaaatccaacagctcgcaaacaaaattttccaatttatgaaagctacacgtaatttcttactgaacatgcatttttaaataacaagtaggtaacataataaggcatatattactattgtatttccactctcaacctttgataattaaattaattatgtaaagacttgcaaaattaatctgatcatgtcacaggctataaattttgaagcacgccaactggcgtgctgatgatttttctagtacaaggcttaagcaagggaaatcgtaaaatgccccctgagtaaacgccaggtcaggtttattctttccgtatccatcttgtgctctctctcacctcaattaatttcaaacccccgtcaaaaactactcacgtagtacaagtacaactacaagccaacccgcttgcgctttgcccaccatttccacacccgcccaaagctgcgcgccctagcaacgcatggaggggcagtgggggcggtggctcgccgcagcagccgcctcctcctccattatatattagtagtatatatgaatttaatgtgaacataccaaataattaatcaatgaaaaatttaatactaatacgcagcatggtcaaaccggtacacatacataaaaatagtcatttgcatactggtattatcagtgatgtctttgtgaccaaaacttgtgaccttgatgatcaatggggaccaagcagcatgtgacctttattattaatccaaacagatgaattactgatcctcacattatgcaccaacttgtgaccttgatgaatcagcatgtggactagtgcatgcacgtgtgctgcactcttgccgtatgcgtgtaccgatcaatgtatgttgtggacagacttgccgtatgcgtataccatgcatgtacatgccctagcaatactaggaagccatagaaaaaatacaatggaaataaaggatgggatttgtgccttaccacggcgggcactcagacggagccataacccccaaaatccaaaccctagacaatccgatctgcaacaaaaccaaccaaatctaagacaaattgttgccaaattgaagaagagaagggggaaacggatttatctcatacctcgttggccgtcgcagtgccgccgccggtgaatcgacagcgccgccgccgccgcaggagtgaggctgggacgagtgaaaatgagactggagaggggatctgtagttgaggcgctggtcgaggaggagaggatgggcgccagccaaggaagagaggcgccggcgttggaggaagtggcgatggtgaggaagggctggcggtggcggaggaagcgaggcgacggactctgctcgtgcgtcacggaggctgggaatgaagagaaggatttggtttttttttattttttttagaatggtatgtgggaccctgaactgaacctgtgggtcgttgattttagattaaattgcatattgtgccacctttctttaccctcttttcgggagtgagggttgagaaccctcacttttcggcacacaaaacgaagcagcgttttaatacgtgattaattaagttttagatatttttttcaaaaatagattggtatgatttttttaagcaactttcgtatagaaactttttacagaaaacgcaccgtttaacagtttgtaaagcgtgcgcgcagaaaatgaggaggaggagttgggaacttgtactaccgaacggagccttactattgtttcaacttgaactagggtagagtaacctttccactttggaccatctatatttacatgtttcattttgggctcttcaaccttcaactccatcggttttctatccgctctccctgaattgcacgccacactcatcctcaagctctgctgatgccacactatctcaagtcccgctgtttgccatactctacctcgagctggagcttgacctcccaactaggaggtcgatctcctttccaagcgggtggaggtgactccgacggagcttcggcacgaatatagcgctggtgatcacttgtaggcctgcttgtggtgatacttctagccctttgcagtcaagattgagagaagaaatagagacaagagagagggagttagatgtggaagaagaggcccaaaataaaacaaacatgtaaatttaggtggtccaaagtgaaaagattgttctatccctggtccaaattgacacgatggtaaagcaaggtggctcaaagtgcaatttgctcttgattttattagctgagaccacggtgcactgtggggaattgaaatatgtgatgcgtggcttcattcactttttttttgtctatgtagagcacatgtccacatgaaaaaaagtggatgcattgctaatgcacttatgagtgagaggggcataggcaagatggacatttcgcgttccattgccaccttggttggtggtgtggcagccggggccctgaaattgggtgtaaaatggcatattagagctgatttgtggggaccggggggcaaattatctaagttatttagaaagatggcatttaggaatgctacatcgaagtgaatgcaaatagtccaaaatctcggttaagttaggcgattagcatcagacattcagaatttcggactgaaacctttataaaccaaaactgcaaagttcctacattggatttatagttaacaaagtttatagtcaataaaatgtcaaagtgaggagcctagtggtatttgagtttttctattagtgaatacaccacttccattcctttttctttgaagtttttaaatctaatatacaactttgaccattgttatcatattaaaatttagtaataaaattacaatgtcataattaatataaatccaatgacataatcctcatggacaccgccgtagggccaatcgccccacccttgacatcactgaagctcgattcacaccaccgaagtcgatatggtgccgtgggaggggaatgggatgggagggggcaaagggaggtggctccaatagagatagaggggaaaggtgtcgccggtgaagggagaaaacggcgggtctgagaggggaggagaggtgtcgctatcggagaagagaggagagacgatattatcgtggacggagatggagacgcattgcacagtaggggagagagagagagcacgcgatcgatcgatcccgcaccctgtaatcctgtatgcgtgggagggagagaaaaagaaagggaaaaggtaacacgtctccctcaacagtaaaaccgagtggctgagggaagcgattcaatgagagcaagctatggagaggcaacatagacttttttcccaggttaaaaccaaacctgggccgtgagtaatgctacaatcctatacaggcccatatttgaaatcagtaaattcttatattgggccgctaccgacagaagcggtccctaccaagctttcgcgtttcttcccacaaataggcgcgcaccttttcccttttcaaaatttctccccccgaaaatttccatttcgcgctccctcgcctcgttccccttccacttccactcccagatgccggcgaaccccaagctcgcggcgaagccctcgccgtcgccgccgaccgccgccgcagccgcctcccggccgaaagccacagccaaacctcccctcggtgccggataccgcgacaacgacgacgacgacgacgatttccagagccctccccgtgccagcagccgcgccgcccgcgcgttgaagccctccggtaatggcgcggcctcgcgccgccccagcaagaggttgaagccgtcgtcctcgtgttgctccgggaaggagaaccgtccagccgccgccggtagtggcagggctcccgctgggagggccgcctcgaagggcgcgggggttggcgaaaccctaggtgtcgtctcgagggttagcagcggcgttccaggcggggacaaagcgaggggcggaggaatttgcggcctattgaggtgcggatctgatgactttagttcagtttctaatgggaagaaaggattggatagatattggcgtcgcgatggaggtttgcattctcgccccaatccgatggattccacggtttcgatgccggatgccacatgtgatttggaaaatgggggttctcaagtggcgcaaatgctcagctccaatgaccgtatctcagttcagttggaggggaacgctaaggtggagttgggaaagtctgaatctgaccctacgactatgcggaaggaacggaatggctctggggcttgtgaaagtgatcatcctgcaagattgatcgagccgaggcttctgacattggttacaaattgtgattttggaggtgcagactccatggattcaaaagagcttggttcagcgattcatccctctgtttccaaagataggaatgtggagaacgaatctgggggggcatctgtatgtacatttgcacttcataacaggaattgccactcgagttgtgttgaatccgaacttgagatgttgaatgcgaagtatgatttgggtcctcgtgattgcaaggaaagccaagagggtccgggactttgtagcttgatttctgaagagaggacagttgcggcagaaggtgatgcaactttcacattcgaggaaagggggaacacatcaagtggacttgaggcttgtaaggggagtcactgcttggatccagttgaaccaaagcttatggactcatgtgcaacacatgcacttgaaggtgatggttgtgatgattttgagatcggaacacaacttaatgagctcataaacttgtgcatggaggattacacggagggtcctttgagcaacaaggtggcttgccttgaagggaatggaatggattgtgggagttttaattcatcttgtgaagtgcaatgccctttgtgtggatcaaatatttctgacttaagtgaagagctccggctggtgcatactaacagttgccttgatggagataaacctgctaaggtgattcttctatgtatttggaaaattaaaaattgttgtgatctagtgtaatgaccgtgataattattgctgctgaattgttaccttgttagaaagctcaaagacaatcatatggtaaccttaggcacaattttgcttcttgaaatttcccggttggccttcagttattcctctgcatgaggatcatgttagtatgtttattcactgggttctaatcattgttgtgccgatttttgtgtgtccatcattaagttcttatctgggacaatagatgaatacatcttactacataggggctgcagga

SEQ ID NO: 68186 - DNA, 4210 bp, Oryza sativa
atggcgagctcgccctggccgttctcgctactcagtcgcgcgagttaacttttctccgcatgaagtcacacactcatcgtgcaaactcgtgatgacatcactaacacgttatgaatttgctcactcactttacgaactcactgcgagttcgtattcccgctgtgcgacaatggtatatttctgccaattccttctaaaaatatgtatattcctgtaaaatcggtgaaagaaatgtataattttaatttattttccgttatttagttagcctcctaccgtgccatgtcaaccatttaggggcgggagcatgtgaattttgagtctaacagttaacaatccgcattgcaaagaaggtggcaacgcgaggttcaaggtatcggatcaccattgctgtgatctgagaaagtcagaatgtgatcgagccgccgatcgagctgatggtaacgtgaccatcgtccgtatcgcgccgtaggggaaaaaaaaccaccggtcacgtttttcagctacgagttactccatctaggagtacaacaccagtagtagttcagtgcggttggtcgttgccttagatcttatttagataaaaaaattgatcaaaaacgtcacattaaatatttagacacatgcatatcatattaaatgtggggaaaaaaaaccaattgcacagtttgcatgtaaattgtgagacgaatcttttgagcctaattacgtcatgatttgataatgtgatgctacagtaaatatttgctaatgacggattaattatgcttaataaattcgtctcacagtttacagacggaatctgtaatttgttgtgtattaatctacgtttaatacttcaaatgtgtatccgtatactttataaactttacacccacaccttcatgccagtggtgagcagaggcagacagatcatcactgagcacacaaaaaatatctcggtaacacaccgctaacgctgtgtgtgtgacgaatttggctaacttgtcgatcgatttctgtccggccggtgagtacagcgtcgtctcgtggtgcacgttaagccaggttgtcaggatcggggcagtattatttttttaaagtaatatcgtatcgtagaatcgggatactatgagatttctttttttttcaaagtttaattaatatttatattaattatatatagccattatatattaaaaaatatagtaatgatatatatcatgcaaatagagacatttatcaagagaaaccatgttggtttgatatatttaactgatttttatataaatttgagcatgtttatttacattattttcaaaccatgttattttaaataatattttatagtatcgtagggatcgtagaatcgggatatcacctaagatttcgtaggatcgtgtagtaatgaatagtaggatcgagatactatgaaaattaggatattaggtggaatcggtattgtttcggcttgataggatcgtagtatcgttagatagtaggatacgaatcaggatactgactaccatgacgttgaggaagacatgaaccgtacgagcatgaatgctagtagtagtagtagtaataagggggcaaaatggctcacataaagtcgcgggggataaagacagctcgatcgatcggtcgatggtccctaaacaaggaaaatgtgcgcccgcacgctccataagcggacaaaacgcaagttgttgcttccgttcaatgcaaaccgatggttggctggcctggtgaccacgggtatgtttcggagagcttctagcagctgcaggttcatttagaatttttatttgtcaaaagctccttaaacagtttagcttttttcccagattctgagaatatgtaattgtaaaatctgaaaaatgagctagaagccagaagctgggtttccagcttctccagattctcaccagctagcttctcagcagctgcttcacagaattttaaattccctaaacaggcctaaagttggcttcgtcaggtatagtggcatgcatttctcgtgactaatggccgtaccagctgctgcccgctatgctatgctatgctttagtgctaagactattcatggtgtctatacgtacgtctcgtataaccacaagttgccacatcagagatttccctccattccgtatagctctgggcgtgcccttgcgaagaaactcgtcctcccgcaagggcatgcatggatgccccactgtgatgcggtctcctcctctccccttcaacccagcctacctagtaaccaacctctggcgtgaagctttgagcgatgatagcaagaacgagcacgtcaaggagaaagagagacctcctgataatcattatcagctaatgacagccctaaccataccgtttttctccgtttttagattttctttttggatatcctacttaattacacgtgtacgttagctgctgttggctcctcggtccccatcggttggtctaatcttattataacctataacgacttattagtgattaaaaaataatatgtgaatatatatatatatatatatatatatatatatatatatatatatatatatatatatatatatatatattcttagtggttgaaaagccaaagttaaaaaaaaaactatgttgaaaaagaatcaaattcaaattcaaaattaagttttaaaatttaaattttggctttggcttataagccatagggcaaacgatgaggcccctcgtgcggcgtctttcatgggcgatttccggtgcgccaatcttttataccgattgcaaagttctaacactgccaagtgattgggccacgtggcgtcctaggaattaagctctacccctctgagaatctgccacgtgtttccttggctcttctcctgcaccgttcgatcacgtatcatcatcatcatatgttctaaaaccgttcggctgaagtttgattatatgttgctctttggtgcgtcgactggctctggtccgtatccttcactccctctggaacaatctagctggctacgaaatacaaggcacaccgagcgcacgctgtagcttctcggatttgtgacaccgttgcgtacgttgtgtgttactctccggtaaatcgcatgagtaggaggctaggagcgaacataaatacagcatgtaaaaagcggaggaaaatgaaaaaaaaacaagaactaaataaaaaaacactactctttatttttaatagatgacgctattaacttttagatattacgttcaatcatttgttctattgaaaatatataaattatacttaaaaaaatctttaatgataataaatgatgcttgcatagttttcttaacaagacaaatgcgcaaacaccacatttaaaagtcgacaatatcatctattaaaaattgatggagtattttgaattcttggataaatagaatatattgcattataagtcaaaaagacaaatataaaattggcgaaaaggacgtgtcatcattaatatcctatatttttacaagaaacaataaatagaagaataaatgacccatctaaaagatcggatccaactttacattctgaagaaccatattttaaatatttgttgtacattgtttctttcgttctaaaatataaaagtatctagcaaatttaaaaccaatcaaagctggaagacaaaagtctgaaatggcccacattaaacaagcaggaccactcctgattggcataattaccagccgctattgagctaatccatgctgattggtggaaaggctttgcttggttaatcctttcaatatctctttttggattaacagccttatacggttgcacctattaaacttatagaagattttatattttagatgaaaatttaaatgccagaagcccgtttattttgggaccgagatggaggaatatattattagtaaaatgcaaaactgtcagattttgctaaatcactacaacatgggcttaaacaacaaaattaatgacaagcataaattactacttcctccgtcccattataagtgcagccataagtttccgtaccaacgtttaaccgtccgtcttatttaaaaaatttatgaaaaaattttaaaagttaagtcacgcataaagtactattcatatgttatcatttaataacaataaaaatactaatcataaaaatatttcaaataagacggatggacggatggtcaaagttggacactgaaacccacaactgcgtttattgtgggcgctaattatggg

SEQ ID NO: 68187 - DNA, 2043 bp, Oryza sativa
  unsure (1)..(2043): unsure at all n locations
gatgcgtgtcatgcgtaccgcaagtagttcatcaccggatcttccgcaggcgattccccctcatccggcctctctctccccctcccgaccctatataaacgctccccgtgcctccctccaccatttccgccactcgccgctctctctccccgtcggaatcgagctcgcgccgtcgcccctctctctccgccgtcgccgccgagctccggtccgccgccgtcgtcgccccggaccttctcccgcttcggcgtcgccttcttcgggttcgccgcaacctcgccgacctcgtccacctattcgtttcggtcgccgaccgccggaacgccgncgtcctcctctacccgagccgcgccgncgccttccttcgctccggtcgccgttttcgccgtcgccgtcgaaccggggtgagccgtggaccgcccatttcgtttccctctcccctcccctatttcggccgccgttccgccgtgcctatggcccgccgccggcgaccataggggcgcgggcgcgccgcctcccgtcgactgtgccggcgaggccgccttcgggcgcgccccgcggctgccatgtggggcccggccgtcagccgcccgagccctcgggtgcggctgacgcgtgggacccacggcgccggcccgtgtgagccgcgtgcacccggtccaccgtggacccagaggctgctgcgtgggccccactcccgtggacccggtccgcgcgctcctcccctcggctgacgcaataaatccgattttaaattaaaatttaaatgaagaaattcgcaaatatccatttaaagagcatataaacttcaaatggccataacttggccatttaaactcggaattggaccgttcaagtctctaatttttccttaagaagtcaagaacccatttttgtgctttgtttctgcttgttatatggagtttgttagagtaaaagccttttcttttccgttggtcgtgtagacgctgcagcttcggaagatccgctcttcgtggaagttgaagccggcgtttgggaaagcgagcaaggcaagtcacatgatctttgaacatattgaatcccagtttataaaattatgttgatttaaattattgcattatcgctttatttaaattcccgcgttatcactgttttatttagccatgcctatttacctttgttacgaccttattattattgttattgttattatttccttgttcacactagaataaacaaaaccccaactagtggacactctactcatggtatcactagtatgattttaggtagatgcttcgcttttaattaggtaacattaggcggttttacaactctagactttgggaatgttcgtatcacctggacactatggaatggtttggttattgtgaaattggcttcacaccgctccttctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtgactcagtctagttataaacaaaagtacacggatggagatggaagaagtcgggggtcgatggacatctctaggacaaatgaaggctatacgagctgcggcccggtagtcgagatgtcatggcacagggccggtgtcctgctgctaggggttcagtcctgcctgcctgtcccgggggttccggccgtaggtgggattgggtcggtactcttgtctatggctaggatgggttggaaactatgtcacgtctttcgtctgtataccgcggtggtatgaggcacttcgggagcttgatagtgtaaagagttttatgggtaaagatgtacacctctgaacagagggtaactcattttgaatagcccgcgcctctggggaatggggcaaagcccaaaaggtgtctcctaaaactaaggggggtgaacttttttttagagcaggttttaccaaccaaaaaatgttttacatggcctggtttcttggggggtgggctcttggaaa

SEQ ID NO: 68188 - DNA, 2960 bp, Oryza sativa
aagtgaacttattcctttccacgttgtacgatcttttctcagaaacaataattaattttttcctagagtgatggaaaatgttaaatgcatctgtaattctgtatgcacgagcaatacgtcttctttccccaccgaatatttcacaagcgttaaactatgtactcccacaataatgtatggggaatcatccagcatattttacatgtgtgggccaacagccgagatggaacaggtgcaacaaatagattagcatctgagaaattttagcacttataggattattttgctatagaaggcaagttccactgctgttctggtggaaaaggtacatgtgtgtttgcacagatttttttttattgataatggaagatttcatttggtcattggacgagtacacatatgatttcactctcggaaaccacctgcctcttagttacatccaaaatgcatgaccggtgcacatctcaacatggtgtaacatatgatatcttaaccaactttgcacaattaaataactcctaatgataaccttaattaattatcactcacttcattgtcctaaatcaatttccattagcatgttgatgccttttgtccattaggcaataattatcaggcatttgtgagttacatccaacatagtgtatcattcattcgccttgtcatgctattcaaatgaaaaccgcaccacagtatgcgacaaacataaaagtgtaaatcatggagcctttaggaatggagttaaatgccatcatatgtgtggcatatttacatgaatgccaccgtctattctgatactacctcctggtaagttgataatacttattcttttggataggataaggacatggtcttgaaaaacaattttaactattaatttttattataacatatataaaaatattaataaatatatactttttgaagaattttttaaaaccaatctctatagatgatcataattctaagaaaagtattttagatgctatttatagttaaagtttttaaagtttgattataggctttgtccataaagataataattattaacttggagatagtagttagtagtgcgttatgtagctttccattaagatatatattagcattttaatattatgaatgtgttttcagtagaaactataatgacacaattttctagctaactttaaaactgtgaaggcgtagattccatctttttaccattagtttttgcaaattcttatggtttaacaacatgcaaattatatgcataaaagtatttcccatggtgaatctaaagaaaatctgatgatattatactatatgagtttttaaaagttaatggttaaagatgaaaatatttgacttcagatgaactagagtgtaagaaaatttgaaataaaggagtacacgaaaccaaaacacacattgaacaaggacggtccagtggactcttgcccgagaaaactccaaatgctgtacatagtggcttaatggtaatttacctcgtagcaaatggccacattggggttcagaaaaatgtcgtcagcaggcccctcgaccagctacaattgtatatcacttggcctctggccagattggtggagaaaggcaagttctcaggctgcagaggaagcagagctccaatctgttcatgccaatggctgctggcacctgggtgaaggtaatttctcttgcttactcatacatatgcaattgattgtgtactcccttgatctataccttttcataagaaaggtttggttcagttttgggggaatttttttggctgagatttgttcatgttgcaagagtatttggctatttgctgcttcgagtgatggttatggacatggattagttgggaattggggcttgtttctgaaggttgttcatatattttggggagggttgtggattgaccctgctaggatgaaactttgttctaacccaagaattttgacatttggggattttttttttctagagcagatcactaaggaatcagaacatgaggcttagaatttttgtttttaaggaattagacttcgaaaattgagtagcatgttcagaagctagggatttcagattataaaaggttggggtttaattagcgaagaagtttcaggttgtgatgctatgctgcggtgttgattgggtaacagtgacggattgatagccatggacatgaaaatgagttgggaacttgggttttatgttggtgatagtaactgtttgaagattatataaagggtcaaatatcttcggtgtatcttgttgattccagttttccaaggtttgttgacaatgaagattattcgggagggcgttgtcagaatccatttcagtttcagctctctggagttgaccaagggattttgattccaaatttccagggcgatagcaaaatgctgacttcaaatttatgtgtcaataacatttccagtcagttttgagaagtacaatttgtgttattcaggtgtttctgaaaactgtcgactgtcttcaatatcagatgcacaaagaaaccctggaaatgcagaaattcgggccattaggctcatgaacatatgcaaataaaaagcgccgccacatatagacatccacatattagatgtcacttaaactaattagtgaattcctggaaattttatagaaattacaatcctgtatagaacgcaagaatttcatagcaaatactaataatcttcgaacacaaattgctcagcgagagagtagtaattttctttgcagattgcagcatccagttttgtctaatttgattagtaattgacatcagttaattaattaattaatcacgcgcagctagagcagaagggagatgggccgggagcaagaagctcccacgccatcaccctcgtcggcggcacggcgtacgcgttcggcggcgagttcacgccgcgcgtgccggtggacaacgccatgtacgccttcgacctcaagtcgcagtgctggtc

SEQ ID NO: 68189 - DNA, 627 bp, Oryza sativa
agtagttattagattgcgtagacgcggtgtctgggtaagaatttctagtggttgctgcgtatcccacagttcgattgaggtaggtgtagaggtggtgacagccctcaagagcacttaagtcctctctgtccaggtacatactatagcgacatctgggaatagcggattgccagtgcctgaagtattacgttaagattaaagttaagctttccctagacattgtttctcaccagtaaatcctctctatcctggcctatcatttccttggtgtccttgaatgaaccagaggaagatctgatcacacacgttcccttggattcgatacccttggaatactccgtaggggaagtgctatatcggtatatccgtgcgcttgcggattttatctgtgatcggtaagaaataccaacagcagcaaaggtggaggaggatacgctgctcccgctgacacgcagtggcacagcttggggggctccccacgacaaggggaattgggggatggctatttctagatatttttccccacaacacccctgaagtcatactagtcacattgggcctgtttggttgctaccctgagcaacctgcctgagtattttccatccctgagggctgcctgagcttgct

SEQ ID NO: 68190 - DNA, 754 bp, Oryza sativa
tcaccttgctgcagaaaatcgtggcaaagaattgggggggctttggcaatctgacgcgcacagaggaaaggagagagttagaaattttgattcccttcagatctggacaaagtactcttctttttctacttacctgctagctctcacggtcagagctacgctctaacagatcaccaaatgcaggacttttactggaaaaagaaacaactggccaccagatctgcaagttccttggtcaccgctgctggagccatggaagaatcgatgggaactggtctccgcaagaaccctaggctagcagtgaggaggaggaagaagtggtctcgttttcactactgtatagaagagcggtgattttactcaggcaggtggagcgaaatgctcaggccacccattttgtacgcctgactcaggcgagtacactcaggcaagatttatcaggctagaatcctcagggtagcaaccaaacagatgccaggcgagttacaggcatgaccttaggccaggcttattatgccaacgaatcgttggatcactagtacaacccactactatagcatagtacggtgaaccataaaggaactctatctttagtgttaagatagcccctaaaatgtagcaaattatagaaatgcaacaagtgctacaataaaatttcacaaacagtattattgataaatgatgtgatatgatcttggagtgcatacacgtttgttttttttgttccgcaaatttatttgatgaagggctgcag

SEQ ID NO: 68191 - DNA, 516 bp, Oryza sativa
ttgaacattgccgaaccgttgacaagtttcacatcctctataatatttgaagcaatcatcaatcatcctcggccaatagaaccccgctctcctaagcaaccaattcatcttgtgggccgattgatgagtcccacaaattccttcatgtacctctcccatagccactttagattgatcttcatctaagcacttcaacaagacaccatctatatttcggcgatataaatcttcatcaagcaatgtgtacttgaatgcttgccgtcgaattttccgatcaaccttaagcgtgggatctttcaaatatcgaatcaaaggaatcctccaatcttcttctgtttcttgggcacaaatgtccgaattcacaattaattcggccttaaaattgattgaaacgtgccctccagcgctctgcctagaaccggtcagaccggccataccaggtgtcacaccctgaagttctcctcctaagcctaaaattgaatttataaaccagcctaagaaaatgccggtgcaaat

SEQ ID NO: 68192 - DNA, 650 bp, Oryza sativa
agagcaacttcacataaatgatgtgtagtattaagatgagctaggggattaagcaagtaatatacctcatagaaaaaggcaacagatacacggtaacgaggggaattgttaacaactcgatgaagtgttggttgatatattccatttgaccaaacctaacccaaatatgacatgtgataagtgtcacaagtttgatgacaataaaaagatgacaatgaaggtgcaaacgaagaaaaaaaaagaccttcagcatgtcaccaatgttgcagacgaaggttcccgggattggtttggcataaatccactcacctgattggtttttgacctgaaatatattcaccagatatttcactcaaatcaaaattgtttgcttcacccagttaaggctaaatatgaacagtgggcagcaactgtaatatggtaattacataattacttatgcatcttagaacatgcttagaatgttacagaagtgtagaagcatctcatgctagatcatccagtgagaaattctatataaccatgcacagctcagatgtgctctgccatgaaaaaaaatactgatctttaaaataattaaaaagaaactaaaatcaaggtctcatctttgatctgtattagttcccctcttctttattattataaggaaa

SEQ ID NO: 68193 - DNA, 5436 bp, Oryza sativa
ttcctgcagcccttggcggcacggcgcaaagctccgatcgatctgatagattactatagagacaggctaattgagcacgagcagctaatagctggcctaacctgattgattacctgacccgaccaggccggggcctacgcactcacggtcaggtatgaggattgaggaggcgtgaccaacactggcactgtagcgttgtggcgcctcgccacctccacacgcgtgacactgtgacgatggatgtgatgattgagctcgctcttgtgtcctcctgttgcccggtggggcggcgggcgggggtattttttaggttggcatgggtagtaagaaagtgggtgggaatgattggagaaggtgtatgattagttgaaaagataaaataggactgtgtttattagttacttgttaaaaaaattttaacgtatacgaacacacatttgaagtattaaatgtagactaataagaaaacaaattacagtttccgcctgtaaactacgagacgaatctattaagcctaattaatccgttataagaactgtaacaccatattatcaaattatggcgcaattaggctcaaaagatgcgtctcgcaatttacatgcaaactgtgcaattggtttttttcgtccgtatttaatgctccatatatgtgtccaaatcattgatgtgacagaaaagttgaaagtttgaagggaactaaacacagcctaggtgaaggagaatggttgtgattggttgagaggaggagatagatgaaaaaatagctttattttgggacaaggtattgtgtgctagaaatagttacattttgggacggaagaagtaataactactccatccgtcacataaaaaatctactggatgtgacacattatagtactaaaatgtaggattggatgtgacacattatagaactgtaacatcctagtactataatgtgtcacatccaatcttagatttgttttttttggacggagggagtactatggctgatatatggtgtcaggttcacatattagtcgctattatatatttattgtcttctacttaaacatgtgttagatgttaaaggaagatgattagtgttgaaaaagtatatatatgaatctgagaaggcaaaacttattcgtatcacttgctacgaaaccattttcgcttaaaactatagtactccatttaatatcaagtcctcttagaaggggagatctttggcttatatgcggcgcaaaaacgataagcaacaatagagcacgatgcatgactaattaagttatttaattattataaagttttaaaataaatttatttgaaatttaaaacgcttacaaaaggtcttttcacgtaacacaccgttcagtttgggaactcatctctccatcgttcagtttgggaactcatctctccatcctaaaggaacgggctgggtggaacaatcaatatttgatgctaattaaaaaagataatgatttagtttgtatatacttttttttcttgttatttttgccggattggtttgattaaggaattcctttcattaactataccgcactttcgaaatacgattttcttcaaaaagaattggcattaacatcacttatgctgataacccttatcgatctaaacccctactttaacgtatttaatttgtccaaaataaccataatcgtgaggatgtatctagataccgtattagtattaccctgtagatacatttttaggattaaatttttatagaccggatggagtaggcttgatctccttgtgtgcatttgcagggacgaatctaaagtagaagtgtcggtgttaggcgacaccgatgactttctataaaatctatagcaaaactgtttaactatgttataacaccataatctaaataaatttagtatactatgatagcgatagacacgttatgtcacatacgaatcgattttctggatcagtcactgtgcgtttggttggcgtacattgtgttcatgtgggtcgatttattcgtgttttatttaattagcgtcctcataatctcattgtgtcattgagttgcgtgccctatggcaccatgggatgacgcgaaatgaggaagccttggtgcccagtatgtgcttttgtggctcgacgatcgtggcgtgcattctggccaaactagtttgcacggtttcgttcttcactttcaattgtaaactcgctctcttgattgcccatgaaatattttgagttcgtgtgtgttcagggctaaccacttagaccactaattagaatatatttatgccttgtctagtagggttgtttcagctccatttatcttagattccaactaaacggtttaacctctataaaaaaagagcataatggggtttagaccacttcactccatactttgttttcgaagttacgacggccacatcaaacagactcttaatttttttccataataaactattggagtaccagtaattaataagtatccattaacttttcatccaaatctcctccaagaaaaacctgaccttcccaagttcaagccaacaaccctgacagccgcatggacatacctagaggtggtaataaatccaatattttagcctatgaaatatgagggttgaataaaaagagttaaactaagattttttttagagaggggcatttttatcttgcctctatatccaatcggatatatgcatcctcattaagaaacttagcctaacgaacaggtaacttagtcctcaaataacccaatctaaaaggaacttagctttcaaataacccaatctgaaattcgctcctagtgaggttaccgcaaccactaggcttcatgccctttcacaatcattaggtcttgtacgtttaatccctcctataagaaaattgagggagttttagaggggatttatttcatatctattggggtgaaattataccccttcaattttcttcgttctcttaaactgaggattaacgaacaaggcattacggtctagatgggttgtttaacagggttcatggcccctaatccattactgcccctactcccaggcataccgtatacgctcgccgcgccggcacgccattcccttctcgtcaggtcacgcgtccgaaaccgaccacagctggaagccgatccgatcgagattcagcgtgctcgcgatcggctccccatcggcttaaacccaccacaccgaccggccgctcgcggcaaaagaaaaaacgtatcgcgcattcgcacgcaacgtgccatttttgcacacggcccgcggtaataagggaaatgggctgtagtgtactcctccaaccttttcgcgccggctgtggaccacccgcggacgcgatccccgcctcgcgtcgtcgtcgtcctcgccgccgtcgctctcaccaccaccacactatattagcatttgatatttgctcacgtgtttcaggcgtctgcactgctactgctcgtaggtagcctcgcttgccccgcccgtcacgacgagcgaggcggagacaaacgagagggatttttaaagggccccgggtccaacggggaagagagagagagagacaaccagacgggagcttgtcggggaggagagagagagagagtggtggtggtggtggtgagatggccggccgtgcgacggcgacggcgacggcggcggggaaggacaggtccagcttcgccgtcacctgtagcctcctcagccagtttctcaaggagaagaagggcggcggcggcgggctgcaggggctcggcctcggcttgcggccggcgccggcggcgccgcccgccgcgggagctggaggtaataagcgattgtgttcgtcatgcgattaaattagcagcgacttgttttgtttcttaccacgtatggggtgttggtctttgcaggtgctttccggccgccgccgaccaccatgaacttgctgtcggggctcgacgcgccggcggtggaggtggagccaaacacggcggaaacagcggccgacgagctgcctctcatcaaggccccggccgatcagcaaagcgacgaaagtgcaaggtacaaacaatctctagtacactctgcatcctgacatctcacgatctcaaacaaactctctcctgttcattaaaaaagagtagtaaaatgaacataaaacatgttatcctgacttgcaacttgcatccttatacaatgtctagaagaagaagaaaacacacttaattttttggagtagagataatttggttgcaactgtctctttggttctttcttccagtgaggcagctggagagaaggctcaacagctgaccatcttctacggtggaaaagtagtcgtctttgagaacttcccgtccaccaaggtcaaggatctcttacaaatcgtaagcacaggcgatggcgtcgacaagaacaccggcaccgcggcaacgcagagcctgccccgacccgcacacaacagtcttcccggtaataacaactgttcattcttttgcagttttacattttaccatcacagtgctaattaatttccatctactatgcttaaatttatctactacatgtgaaacaatgtaggaatccttaacgaatgactgatttttgatttgttacagatctgccgattgcaaggaggaactcgctccataggtttctcgagaagagaaagggcaggtaggtaactgagtggctttcaacttctatctgaaatacttgcctttcgctgtcaaaaactggctgtcagaccaagtttatggccctaaaattctccatgctcttcaaccactccaggatgaatgcaaatgctccataccaagctaactgcaccgctgcaccgtccaagcaagctaacggtgacaaatcttggcttgggtttggccaagagatgacaataaagcaggagatatgatatgacctcttagcttacagttcactgtcaagtgtcaagtgatctgtggggaagagatgcgtggttggctggttgctagtgctagtgtattcccccgtagcttcaaagcatgaataattactcaatactactacattactactagtaagaacttaatcaatactaggaatcaagctggtggttaattctgcctgaccattggcatcctggaatatatataagcacacacacgggttgtttgttctccacattgtttgctgctggagccgtatgctcactgcagtttatatctgtctagctggttacccacctcagcctcaccatgtttcgggaataaacactgtgtatgtgcaaattcttcatttctcgttcggtttcgccgtataaattacattgttactattttggctccttgttgcttgaggatttatatgtttaatatgggacatatatttgtgtcttatttttttttaatctagagagatatttgtcttttaatttactgggacatctgcccttttatagatgtgttcgaacaatgtaatgcatttggcacatgcatgtttc

SEQ ID NO: 68194 - DNA, 7868 bp, Oryza sativa
  unsure (1)..(7868): unsure at all n locations
tgggagcacataggttcgagcagaatattagtaattagttcagttgtgcattttttgaaaaattttctgattcgattgtatttttgaaggtttgttctgtccccatttactgagagcattcgtgcatgttcaagttgagaagattcctcatacatatgtactgcgtcgttactcaaaggaagcaaagagtgatgtcaattttgaccggcgtgatcgtccaatatcggggccagacggtgttaaattatcatacaggacaaaggtgttgtcattggatgcacaacagctagtaaagtgggggaggaggtcgtcggttgctttcgaaagggcaacctcagtgatgaaagtgctgagaaagcagctggaagagattccggcagatgtccatgggttagatgtagatgatggtgtgagtgagcatgaggctgatgttggcgatggagctgggccatcgatccatcggggtggaagtgttggtgatgaaattagcaggcgtccaccgccaaagtcaatgacaaaagggaggggaagcgaccccaatgagacggtccgtctaggtgctcccgaacctaaaaaatgcaccggggctgcagttggtgtggtacatgccctaaaaacccggcgaatttcgaacgtttagcagcagctagcagcaggggcaaagggaagaggggtcgaccaaggggaagtggtagtggtggtagtcgtgggcaaaaagacgtccggaggacaccgatggacgagtgggagggtggacaggaggaggagggctgtagcgttcaaggagacgaaggtgacggcatcagcgcgccaaacgatggtgattgggagggtgaatcagagtgactaaaagaaatttatgttaaatcttgtgtttaagtgcatatttgaactaaatgattgtaactggatgacatggactatgttttgatgaattgtggtcggatatgtgttgacaaacattgtaaggtgatatgttcagtttgtttctattaatattggtagttgtttaattttggtaactaaataaatggtctatgatatactgtgggaaacatttgtgcaataatgggcgcaataaattaaagaagttacaatactggtgccatggagaaacagtactgtaaaaagggggctcaggtcagaattcgtagttagtagatgatttacttaatgtgttcataaggtggatggcttacagtagcaccattcgtagtgtaattgctggcaactataggaacggtgaaagttaagtacgggcgatagtaccggcaggggagtggatggttggaatggatgggttggtgtagataataatgtaactggttcagttgtagtaataaaaaaataaatgaatagcgaaatagcgaccgcatgcattcaacgcttctttggatgtagagtgatgattggaaatgtgtttactttgaattttgagactgtggcgggggtatgattagattatatgtaaataatttctggtgtgtttgtatggatggggtgatgtccatgggagatattggcgccaagatggtggataacaattaggatgaaatggtcaagcgcatggttgggatgctatctttagctaagtcaatatgtatgcgttatatatagtacaccaacgggctgcacagttgcacatcaatatccaggtgggaaagcataggcgcataggctgtctaagctacccgatggctcgccggcctcaccctcaatacatggtgattcatccggctcgcattcaccagagaggttgactccatctccggtgatgcgtgaggtggatctacctcctgagttttgtgttagggggtcgccaacgccagactggccaccaccacctacagaatcagatgaagagaggtttcgagaagatctggagcaatactacaatgatgggtacgtgtccactccatgcccgtcaccaccatctgatctgttcgattgcgaagaaaatttggaggatggagatgtggaagatgataatttgaggcatggggatgtgctgcctaaggataatcaatcaaaggatacagcgtcaccaccgagcaagcgcaagaaggtttaggatagtaccgataagatttgtcgtatttaaattgattattgaattgtcgttttaaataattgctactttttcttagtggctgtgcttaaatttgttagttgtgaatttgtgagttttgatctaatttcatgggcatgaaataaataagtttataagtgtagtgtagatgtcagtgtcgctatcatgatgtattcagaagagatatattcatgtgatttgttaaaacaccatatgatgtgtgctgttagagttatcactgcatggctgtggtgctcgtttggtgtacatgccgtcaagctgccagaaagtagagcagttacttagggaacccaaatgatgttctcactccttcgggatggttatttgccttccagtaaatggtttactatcggctaaattttgcttggggatgacatttcagtgatcacatatgaaaacgaaacggcagtatgaatgcacaatatttttacaagaagatacccacattaacattaacaaaatgaagtagtctcatccacatcggttccattagtacatgtcctaaagttcgcaagcagtggtaactatcaacaaagacttaacagcggtgtcactagtgggagcttccttcaccgttgtcaagaggacgaaggtcctttatggcagagtggatgcatggtgctaggttgaagcgatggaaaatcagttggtgcagcatctgtgcccgaagaacacgtgattcaggctagcaaaaaagaagaaatggcataatcagtttgaaagttgtagcaagtgataacaagagattgcagatggcaatactgtaatgaaatgtgttgtgataaatattaccggttgaaaatcatcagcaagcttgtcaggattcccctggtaccgctccatgtacctcatgacatagaacgcacagtcatttgagcatggcaccatcttggggcatttaacgaactcacgatggtagttgccaaactttttaaatactttgggtataaaggattggaacccattgctgagacgcttgaggaccctctaggccaatgggtagtgatgctggctctcctttcctcctatttggtcgtagtcattggagtccaatatatcaaaactcccttggttcaggtatacgatgtggagtgtccagtggtcattgttgatgattggcagtaaaagctgaacagatgaaacagaagtaaaattagataatatataaagcatggcagtatatatattaacaattggtgtactgaatcctgacctgctcggcctttgaaaggttgacacccttcagacatttagacaggtgttcggctagagcgcgtgggctgaagttgtccttactgccaactctagtaacattctcaatgttgaggagaccctgcagttatatgttaatgagaagcttgttggaaggaatgtgaaataatggatagaaaacgctaaaaacaaatcatgcagtaccgttacagaggtgggtatgaagatcttcttgccaaatgtttctggattatctctcatttcatccttaaaaagcaaagatgcaaaagcatctatgaaaatcccttctgtcatgcttcctgccttgaatgatgcggctatgtccgtggctttagcactgtaacaatccacctcgattaagggagggttgtgaggtaagatgtttgattgggttagtaagtgcggtaggattgaaataaagcagttatggagttgcagtgtacatgaaatgggtaaaaatggaacaaagctcccaaattgagttgggtctcacagtatcaagtcaaggagctgtacggcgacgttgtcatctttgggtacggattggctagctgggggcacgtacctcgctgccctcttgacacaacgtttcacggggctagcatgttgtctagccccgtcgtcagcctctttgttgacctgcatatgatacacatagctagggctcggtggtctgatgggataattaatgccgtgtacaagtgaaagatgggacaggagaagcaggtggtaacctcagtactatcatgataggcaccttccataatgcaaatctgatcaattttcgctgctggctgggagtcagtcaataattcatctgggggcagtgagtgtgacaagttgtcatcatcgtcgtgagaagaatcacctgttcatgttgcttggaagagagccatgattagacatttgaactaatggaatgatgaccatattaatagatgtgctggttgtatgtgattaaggagatggggtcactaaccttgcgtgttatgttcagcggtttcgtcttgtacatatgccgtcagtgctagaagggtattaggaacaccgaagtctggtagtgcaggttcaacggcgggagcagtgggctgaataatacctgcaacagtaaatcatatagtaaagaccaagtgtgcttgcgaaatgatcagtctgtaagcaaacactagctctctaattaaacactagctcccggaccaacagtaagctgcactgtgacagattgtatatttaaaggggtaaccatattgtgaatgcaaaccagtaaacctattactagtatttgctgcacttgggtgcagcgggataggggtcgaactattactgatacataagagtgtagtagaaaataatgaaacagagttaagtacattggtaagccggttggaaaagagaatccttagtaaaattattacttaagagtattagtgatgcaaattactagaagtaaatggtaagcaaaatattggtaatgaggtgacagtaactgggttactggcaaagcatggtattccagcaaggtaggggtccggtgtgtgtattgtgatggtagtgagtgtcttactatgtggccagtttgttgaatggcaaatagaacaagtggtagtaattgaattactttgaatacaaagcagaactatgacatcactgaatataagaagtttaattttgcaaaaaatgagaacaatgacacattatcacaaaaattaggaagtaagaaatgaagctagtgagataaaagccgctatgaaaaccatagttgttgcgtcccaaaacgactctaaaatacatcctcaaaattatgcatagaataagtaaaatccatgtgaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaaaggttttataaaaagaaaaaccctaaaaagtccctttttccccccttcccctcttgggccggctcggcccacctccctccctctctctcctctcccccgcggcccaatcggcctcctccccgcgcgcgtgccgctgacgggcgggcccgcccgccaccctcgctgacgggtggggcccacccgtcatcccctacctcccgccgctcccgccgcctcgcccgtgccctagcgccgccgccgccgcgaatcccgccgcctcccgccgtccccgcgcgcaataaagagggggaaatcactccccgcgattccctctccctttccccccacttttccctctctctctccctcggattcattcggaaagtttccccctaacttcgccggcgcatcaatggcggccggatcttccgcggccgattccccctcatccggcctctctctccccctcccgaccctatataaacgctccccgtgcctccctccaccgtttccgccactcgccgctctctctccccgtcggaatcgagctcgcgccgtcgcccctctctctccgccgtcgccgccgagctccggtccgccgccgtcgtcgccccggaccttctcccgcttcggcgtcgccttcttcgggttcgccgcaacctcgccgacctcgtccacctctccgtttcggtcgccgaccgccggaacgccgccgtcctcgtctacccgagccgcgccgctgccttcctccgctccggtcgccgtttccgccgtcgccgtcgaaccggggtgagccgtggaccgcccatttagtttccccctcccctcccctctctcggccgccgctccgccgtgcctatggccgccgccggcgaccataggggcgcgggcgcgccgcctcccgtcggctgtgccggcgaggccgccttcgggcgcgccccgcggctgccatgtggggcccggccgtcagccgcccgagccctcgggtgcggctgacgcgtgggacccacggcgccggccggtgtgagccgcgtgcacccggtccaccgtggaccgagaggctgccgcgtgggccccactcccgtggacccggtccgcgcgctcctcccctcggctgacgcaataaatccgattttaaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcggaagatctgctcttcgtggaagttgaagccggcgtttgggaaagcgagcaaggcaagtcacatcatctttgaacatattgaatcccactttataaaattatgttgatttaaattattgcattatcgctttatttaaattcccgcgttatcactgttttatttagccatgcctatttacctttgttacgaccttattattattgttattgttattatttccttgttcaccctagaataaacaaaaccccaactagtggacactctactcatggtatcactagtatgatttttggtagatgcttcgcttttaattaggtaacattaggcggttttacaactctagactttgggaatgttcgtatcacctggacactatggaatggtttggttattgtgaaattggcttcacaccgctccttctattcaaaatccccaaaatggttttaggctgggctcggggtgcatggttttgatagtagcacctcggccatataaggaccggtcttcgggcctctgttgcaaagcactaccgtacttccacatgtctaatgggtaaggcttagtttgtggctcagtctagttataaacaaaagtacacggatggagatggaagaagtcgggggtcgatggacatctctaggacaaatgaaggctacacgagctgcggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtctttcgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcttgggttggcttgggacgacctgggacccagggtcgggtgcccagttcggtatgaatcatcgtaggccttgggttaaggcaggttagagtgggttcacggccttgattaataagtgtatagttctagaatcgaatgtctcacaaatttgatggncccggtatgacatgaggtcaannnacccac

SEQ ID NO: 68195 - DNA, 11732 bp, Oryza sativa
cctgcagccctcctctctctcactcttctctgcgggggcggtcgatgggtgcggaggaggccggtggggcgaggcaggagagtgtcgacagccggcgacggcggcacgaaagaaggggatgtggctatttagaggtgaagagggtgtcggtggccggcaacgggtgacccggtggcagcaacaacacgggagaaagagaggcagcggttgtatagactgttggagccgacgagcaccgacgcggcgcgggcccggtatgtggcgagccaatccgccctcacaccggcaccatccgtgcccacattgaaccacccatatgaggcctcctccacctcgcccctgtcgttcacctccagctccgttacatcgagtccgccttcggtgccgcggcacccacctccaagcgaaccaccacggcgcttggccccgcctccgcctttgtgcccaccgccatgctttcccttcactccccccccgggtactcctgccgccgacgccctccccttctcccgcgttgccgccgccacgtcgcctgctaccggacctcctctcccactagcctcctccccacctatcagtcaccctgcccagacaaggagaagagtgagagataggagggaggagaaaagagaggaaaaagagagggtgatgacgtgattaccctaatatgtggggcccacatgggtcgcacgctaactcaactgccacatcggataaaatcagggtcaaaaccgcttaagaacccaaagtgacgcagttttgtaatttgaggaatgacgtatatttggttttacggttgagagatgattttgtaatctgatgataagtcaagggacctcatacgtactttttcccagcagctaatcaccatggcccagcccaaaacttgtctcatctcaccgtagacataagtcacgtaagacaaactgccctgcctgtatattcacatatccaaagcgaaatgacaccgaaacataaactgctcaaatcaccctttttttttcgtaacatctcattcatcatttcgctgtcttttttttttttgcaacatcgcttttagcattttcatctgtagactgcaacgtcccaaactctaatcccgtcaatgggacgtgaatgcctgcaagatcaaaaatcaagactagttaattgattaattaattaactagcaaggtggtccatgcaaattgcgcaactagcattattatattttctctcgtataatagcatatatatatgttttttttctcaatttattattaaaatatattaaaatgacaacataattttaaattttgtactatctttaccaaactaccaatgtgtaataatcatattgtattttatatatgtgatacttattaattaattttaatatcagttttagttatttctaaattatattcctatatggcctgtaaactcgtcttctaatattttttttttattccgaattttcgttatttgtaaattgtatttttatatagactctagcctcttcttttaatattatttatttctaattctgaatttttattatttctaattgtatttctatgtcgactctaaactcatctttcaatattctttatttttttaatttcgaatttcagttacttctaaattgtatttctatacagagtaactcttcttgccatattttttatttcgaattttagttatttgtaaattatatttctatatggactctaaactctaattgtaattttattatttttattccaaattttagttcattctaaattcctatatggactctatgcttttgttctaatattccttatttttaattctttatttgtaaattgtatttttttatatagactctaggctcttcttccaatattatttatttctaattctaaattttcattatttttaattgtatttctatatggactctaaactcatctttcaaattctttattttttaaattttgaatttcagttacttctaaattatattcctatatggagtctatactcttcttgccatattttttattttgaattttagttatttgtaaattgtatttctatatagactctaaactctaattgtaattttattgtttttattccaaattttagttcattctaaattcctatatggaggcttctttttctattactttaataagataatagattataatatgctgcgtgcatgacggggctcatcgtttcctctgtgcagaattagctagggccaaaatttaaatttaaaacttaattttaaagttttttattgaaatttatcttctaatgttggtatttaaattgctataagcacatatgtaaaagttctcataaattattagcattttttactaatgcgccgtaagacgtattattagcatttggctggctgagtagagtacgacgcaccgagaagacgttgcagtggccggggtcggcgaggtgatgcaggaggttatcaatggggccctcgccggtgtagacggcctggaaccagaaccccacgaaggcgagcatggcgagcctcccgttcttgatctccttggtgcgcagcaccatgacgggctccggcgatccccggccccagttgccccagtcgaaccacagcccgccggggtagccgacgtccggcacggggttcctccggttgggcagccgcggctcgacggcgacgcacccggggttgaggtagtccgcccaccgccgcccctccgcccaccccatcagtgccatctgcgacacgaacagcgtccacgggtccgcgaagtagtcgcgcgcgccggcgtcgatccatgagtagtcctccatgaacccccatttctccagcacctccgggaccaggatccccgccaccgccagcatcgcccaccggctgtgcatcagctccgcctgcgcgaaccaccgcagcagctccggatccgaccctgcaggcaaaaacgttcgattgttactgcacaagacacaagtgttgataattttgtggaaagaaattaaatgcacttttggactacttttattgtcgtagtttaactttgaacttcaatctattcattttatactagataactttatgtttgttgcactttgaatcacctcgactatatcttctcaagtcatattcatattatacaccgacaaatatatggcctacttataggtagaggatttcgctaacgtggtaaaaccgacatgtttaagatcgttaatatgctaaataagtggttttgggtagttcaaagtaaaataaacgtaaatttagctagtccaaagtaaaaagattggactagagtgatctaaagtgaaactacgacaacaaaaggtggttaaaagtgcaattcgctcaaacttgtgagaagatgtgcgcataggttggttacctaatccaagaggatcgaaaccgaagtctcccgggaggctgccgtcgagccacggaggaggggagctgccggggaaccagagcggcctgtcgggccccagcggctcgcacaccgcggacacgccgcccttcgtcgcgccggcgcggtggccggccatccttgcaacggcggcgttctgcgacggcagcgtcggcgcgcgcaacgccgcccgcaccctaagctcagaagaacacaagaatgacattttcgcaacacacggaatcgaattgagatgcttcaatggcacaacacaaaaaatgagggaaaatgagggagaaagggaagaagaagacgatgaaatagatgggtgttgctgaattattatgattattattaccttggttggatgctacatgccgcgaatgagccggagggcagagccatggaggagagtgaggagaacagggagagggcgagtgaagctggtgaagtgtgaaggagggaaaagtgcagagcagtttatctgcttggagtttaggatagggagggagagggcgtggcgttcatcgacagggagccaatgaggccttgccaggtgtgaccagcatctatcatacaagttggggtcctgacttttgtgggcatgtaatttggaggcccgtgatacaaatctgtttagagtttggcccgtttaagattacaagaatcttgaaaagctggaaaatccaacttatgactaagatagcccactactagctccaattcatctatagccgatctaatagctaattcatacaatagttgcttattatactattaacatatggtcccacctgtcatacacacattgcatccgtactgcagctggatacagatatgtagcccgctgctcttctctctcatcttttatttcattaaaatatgtttatagctggctaatagtatgctattgcacatgctctaacaattcttaaaatataggtgacaacccggactatttgaggagctcaagattttagaagttatggttgtgaaaagctcccccaagcaaggcctctatatgataatgatggcttccgagtattataggcctataatttagggtcttagtattgagcatatgaaataattgaagcaattttgtagcttcggcaagctaaacttcatgagatgatttaacttcatgagaagtaacgaaaaggaggaacttattgaagtatacaaaacaactttacggatgtgtaaacgaagaactttattgctctcaacagagaaatttgttgctaaaaaggtgtacaattgagctatgggcctgatttagtgtgtacaaatacatgactgaagtggaaacatcagtgtccttttgtgaggcagtatagacaggtggaacatccttaaatacattcctgagactctgagagtgaaagctgtaaaaagctacccaaaaaattctctgtaactgttaactgagcagtgaatactcctacagcaatggtacagtgaaccgaaaaaaagagggtgccgccttgtcaaaaactgtagtcgatatcagagatattctgcagtgctgattgtttaaccagctcacgccgctcgttgtacagatccaggttcttgcacggtacagggaaaacatagccaatgacctgcccctggacgaaggagcactggaaaacgtggttcttcctgtccaccaaaccgactgacatatcatggaaagtaacattcttcacggggatctctgcgctcccctgtatcctgactggtacacgcaccccatgtccatggattgaactgtacgagatgttctctatgatgggaactgccttggggtcgaagccttcgtccgggtgctcattgtagtcggtcttgatcacaatgccaactcggatgtgttctagggttatgttccggtacgtgatgttgcttacataggcccctcttccaggggcagtctttatcctcacacctcgccgtgaatcccagatatggacattctctaccaagacatttgaaacaccgccagacatctcacttcctatagatacaccagcactgtccaataaaatagaaaaaaaaaggtcacacacaatggcacaatcacatggctttagaaaagtctcgactactggcacttaacaaataaattaagcgaacaagctagcctacttaataatgaagagatgtattacaaataatattgatatctgtgatcctagtagataaattaacttgtacggtaaggaaatgcaatcattagaccaaagaaaacatcacaagttcacaaccaatatgctgtgtattagttaacatattcacagaattatctaccggataacttataccaattcatattctgaacatctaaaacttctaatagtgaaccaaaccaaactgagaacataatgaaacatgaggaaatgactcacctgaccatggagcggattgtgacgttgtgaataataatgttagtagatggacgcccataagcaattccatattggtcccaaccactctttatagcaatcccatcatcaccaacagaaatatagcagtttttaatcactacattctcacaagaatctgcatatatagtaaaataattgagaatcttactagtgaagcataaagtttactaaataatacaaatgactccaacatgatgtaggaatacagggttgtctggtacatattgtcatctacatgtacatattgtcattatacagtcataggagattgtaagatataagaaaattgcagctgtggcattgccctgtggttctaaaaaaattataagctaacagaaatgaagaaaagctcagaatcacaaaaaaaatgaaagagataaaattgggaaatgacctggatctatcccatcagtgtttggagctccaacaattggagccaggatggtggtatctgatatagtaacatccttgcagtcatatatatgaagtgtccagaagggagaatcccgtagagtgatgttagaaatggtaatgttacttgaccgcatgagttgcacaagaggaccccttgtgtgattgaggactttcttccgaaatttgctccaccaactttgaccttgcccatttatggttccattttgtcctgtataaggtagggaaaaaggagaaaacctctcagctgatgaaaatacaagccaatttcagcttcaggacaaagagctgctagcaaggataagagtacaaggaacaggctgccaataaataatacacaaaaggaacaaattatatgaccagtgccaacatttagcctactcctaacagaatgatagcttataaataaatgtcagttagcttaattgcaactgtttctgaaaaaataatccaggacctctcttttagtcttatatgctgaaataggacatgtcgacaaccaaatacgattcatattaaaatttagtgactgagaaataactttttcaaccatttgcatgatttcagatatagtggtttcaagatctgatggaacttggctctagaattgctttaacaacaaatacactgcaccaaatattcatacctcctacaatgtagagaaaaatatgctattaaacaagatcgtatctttgtcaagttattctcaatttgccacatgcttgctggtggaaaagatatccagtaccgctatttaaagtttcaagaaattggtgattgtatttactgttatattttagagaacatgtgcaggatgagatcaactgacgagcatgtctccatatgatcaagaaccaagtgattggagttaaactcaaaagtccttgaaaagatagatgacaacataagctccaggctccagcatatgaccacacacttctatcatataatgttttcttttccgaccactatagctgagatttgtcatttttggagactgaattttgtggcttgatcctcacatttgttgcctcgaccctaactgcagcaatgagggtcttaaaggtgatggccatgttgacaagttcaaatgataaagccatacggcttatctttcgaaattccctgttaaagtcaagctacattcttgcaatattacctgagaatcttttacttctctacttagtttgattttataagcacagcattcacgatatcaactgagtattagaatgcattaaaaaaaaccaaaactacaacttaccagttatagtcacatccttgaggtcttgaccatgtataaggctcccatacctaggccccctgtgctctcttccgtacccatatgatggtaacggagacatcaacggccaatatctttcatccttacatataagtaaaagttgactcagttggtaagaaatgcaccaaactgtaaaaagtaacagaaaattttaagtaagaaaaaactagacccgcattgcagcggaaggttgagctaacttcagataaactaaagatcagtatgccttcatttgacagcatacacaggtatatctctcagtgggaaacaaccatttttgactaacatatccattcaagcttcatccaagacataccagataaattacaaaatactgttactccctctgtttaacaatgttagtcaatttaattaggtacaccgttttaaaatgtttgttcactgcagaaaccatgagtaaaaatattgcagctcttccaccatatgcacacctatttagtgttgtaaaaaggggccacgataaacagaaaattaaagtattaagcatttaaacctgaatgtaaatgaaccacgttgcaccacagaaagttaaaagtttgccattgtagtatgatatatgacgctacggtctaattacgtgacacttcgtgaagcgtagccctatgtgcataaacttgttaaaaaaaaccttaaaattcagcaaagagatggggattgcagcttgaaatgcctcacctggaccccgaggatctcagcgccggcggcgaggaatagcgtcatcctactggtgaggttgaacggcgcggtcagccacctcccggcgggcacgacgagcctcccgccgcctctctccgcgatggacgccaccgccgccacgaacgcctcggtgttgagcgtccgcccgtccccgacgcccccgaactccctcagatcgtagaccggcggcgcggccacccactgccccatcccctgggcggacggcgcgcgcttcggcagcagcggcgggcgggtgtagagccgcgcgcggcccaccgaggtgctctgccacaggaacacgagcgcgaacccgaccagccacagcgcgagcagcaccgccctgtacgacggcgagatcgccgccgcgccaccccaccgcctgtggtggtgccgcccgcccaccccgcccgcccgcggcgacgacgcgaccgacgccgaggaagcggcggcgcgcggggaggaggccgcggcgcgcggggaggaggcgacggccaccccggtctcccccatcggatctggcgcgcgggatctacggcgcgcaccggctggtcgtctgggccccgcggcccatggagcagggagacgcgcgctcgcggaggcgatggcgagggcggcggcggcggcggcgctcgtcggaggagcagcacgggtttaaaaggagcgggagacgatgatgcgtggagacggtggagttgggccggaaccaccacgacggcggcggcggtggtggcggcgaaatgaccgaattgccctttgccggccactcgcggcctcgcaccgcagccgttggatcgactccacgagcggcggcggcaggtcaactaacagatgagaagaagagaggagaaaagcggatttgtagcacagactctcatcaatatgtgaaccaagtttaataatgtgctatatatttactttatataaaactattgtattgatagtttattaaagtacggtagatgatatgttaatttttaaaactagcagttggctagattaattaaagagcattgctattgtactatttttttcttagtaattttttacaaacaataatctcgaccgtttaagttaggtaaataaaagttataaaatatctactctagatacactcacggcatgacaccttggtgttaataattaaataataataataagtttgtatgtataacagttttccttaattaaacttgctctttttttaagaaacacagtccataacacgcgcacacttatctttatgaacactatgaaagttagaccgatatatcaatgttaataacaaattaataataaaaagtttatatgtgtaactttttccttaattaatcttgctcttactagcagcgtgaagcgttcagacctccacgcagtgtaaccgactgacagttcagctgaggctgacggccaacctagaaaggtaggtgtgggcccacaaggcagcgggatggaccagcttccacgggcccacctgcgcgaggttggtccaagtccaccgctaggtggaggtgcggtgcgtggtcgattggcacatgcgagtgtgtgacatgacacggatcgaagagattcgtcgtctcgtgctcgtgtatgacacggccacatgatcgtacgagacacggatttcacaaaatagggattaatttggccccccgtgcgtgaccattggctaatggaggaagtaactgtttgatttactttgtcttaagtgttcagttagtccgatggaagagaccaacacagatcggatcaaatagcgatcacaccacggagaatagatacgtctgttttgactccttgtaggagttgttggctggtcagatcgccaccgttggttgcttcatagcatactccactttgaacctttgatccgccggccggaagagcatgctatgagttgggccgagatttaccgtttacgcgagaacttatggattgggctcaaatgtgctgtttcggcccgtcaaatggagtgcagagtagcatgcagcaactgtttcggcctaattgaagtactcggagggagtacttgactgggctcaagcgggcatttgcaaaaaaaaaaaaaaagctaacgggcgaccaatcgcgtgggccctctctcgcgtgactggacacgtgtcgcacacggagggggcggcggacggcgcccacgcgggattttctttttttttctttctcttcctttttttcggttctttctgttttggtttttttcggttttattcggtttctcttctttttgtttggttctctttctgtttggttttttttcgttttttggtttctcttcttttttcggttttctaagatgtacgtatgcaaagtttatattcgtatgtatactaagttttgtattttattttttattcgtgtattttttttctcggtttttaatatgtacatatacaaaatttgtataagcgtatgcaaactttgtatacgcgtatacaaactttgcatacgtgtatataaagtttatatatgtgtatgtacgggatgcaaggtttgtatacgcgtatacaaagtttgtatttgtacctacgtataaaaacctaaaataatacatatatataaattttgtaaatgtgtatatagactttatatacgtgtatacaaaattggtatacgtaggtataaaaaccaaaaaaatacatatatacaaactttatatgtgtgtatacaaaccttgtatacatgtatacaaaattggtatacgtacgtataaaaacctaaaaatacacgtatataaaatttgtatttgtgcgtatataaagtttgcatacataagtattaaaaaccgaaaaagatattgtcgacgttggatgtcgcaattctggtatttgcatagtatggggatcatcggtgctaggatatacgcgagactgaggtaaaagagatggagacatggatttttatacaggttcgggcccctgagttacatcctgttggccgaaaccggtattgctcttattcaccataatcacaccagtacaatatgtgggtagcctttctaactgttgtctacatgtcggtctgaaggtctgactcgtagtcgacaacagggtagtctttctcctcgaatctgtgcccggcgagatcagagatagcgcttttgtatctcttgacggtatccggagacaccgtaggggaatagccatgcctatccctgaagtcgatatccggcggcgtgtcttggcgtatgtaggcttgtatgttgtggcttctagtgggcgtgtgttgattgtcatgggtgtcttccatggtccttcctccctctcctcctagggggtcttgtatttatacctataggtgtctccttgtccaagtagaactagagaaaccaatatggatacaatccgagtagtccttgtcgttttcatgtagaactctgattgtctttctttatccggaactccctagaagccggtttccgtataagatatggggctgcaggaa

SEQ ID NO: 68196 - DNA, 74134 bp, Oryza sativa
  unsure (1)..(74134): unsure at all n locations
ggagagttttttgttcctccagctgtttcagtgacacattagaatgctcaagcttgcatgctgaacaggctgacacactaagtggggcaaaccaccccgctgcctccatggggccttgctgctcgattcattaatccacatgctgccacaagggcgcctgctggaaagcgtgcaaaaaccgccacgcaagtgacgtgagctaaactacttattcagcaccgcaggctttacactgtatgctgaatcctctgcacaacctactgccttggcggtgtttgctgaaacaatcggggattaattaattggcctggagccgaaggtggtacagcaggtgcgggagccgatactggtgccgttggctgagccgatggtgcattaagagggattgactggacgaattgttgattatcggtgattaatggccgataattcgggaatactcctcctggtaggtaaattggtcctgtagcttgatactcggccattgaaccatcaaccattgaaccatcaaagcatggtgtacagcatagtcaacctgatcttgaaagttgttgaactgcaactgtgctgtattgccgtcttgattagggccttcaccttgaaccccctgagtaccatcaccatgaactctaaacgcgttgatgaagcctaggggggtgaacaggctgtccctgaaaacttaaaaacaaatcgcagcggtcaaattcaatcagacacggaacttcctggtaaggaactccagaacttccggcctcccaggcccggaacttccggtgttctaagacaggaacttccgggtaatagaagagagatgaaatttaaatttcaaaacaagagactaagccaatcttcacaagatggtgcacaggtattctaagccgaggatatatcacaaaatcatccacagaaacatcatagaaagagacaagagcgattttttcccaaagttcggatcttgtgatcctactctccgttgaggagctccaagagctgggtctcgattaaccccttgcctcacttgtgcagaaaccccagaggaaatccacagcctttaaccccaaacacccctaggcaaatttctagaattgagtgaccaccaagatccaactcaacctacttctagaaatccaccacaagtgtgggttgctctacttggaaaggctctagaatctcagcacaagaacttcactaacttacctcgttccctttcggaggagaggaaatccttcacaaacttacccgggacatccacaatatgcaatggattctcgcgggtgacacctaaccgtctaggagatcatctccaagagtaataagcaccaagatgacagcccacgagatattccaagtgctcacccaagatcctagtcttcacacctctccaaatcttcttctctccctctcaatctctctttcacacaagaattaggctctagattcagtgtaaagacaagaaacacttcggagaggctagcaatagctcttggttcgaaaagtgaaagtggaatggccaaggaacgagctggaaacgagctgcatatgtataacggctaggtgacgtcatctagccgttactcacaaatttgaactggaaacaagacaggaagttccggacctggaagactggaacttccggactacacttaggaaaatctttttcacaagaccggaacttccggacctggaagacaggaagttccggacttgcatttttgggcagatggagtatttgcaaaaaaaaaagaactcctagggaaacttgatacttggttcacactaagagcgcttgatatatctcagagcatcacctggaacccctcttaatagtacggtttttcctaaaaactcgatttcagaaaataaactatcctatgcacttctcgagttccggtcctctttgattttgtactttttggggggtctccaagcatccatcttccacatcttggactaatgcacctgaaagctactcaatgagctcattagtcccttaaccacatttgtcattaatcacgaaaacccactaggaggattaatgcactttcaatctccccctttttggtgattgatgacaacatggttaaaccttacaaaagattgataagaattttgttttgaatggtccacttcacaaaatcaagccccttcttggtgaatgaaactcccccttaatgtatgcatatggaagatatgagtggagctcatatgcatatatataagggagcaaccgaggagagtttccttcatccctactcattcgtgagatgcaaaaagcagtaagaatagatattatatgcaaaagatacgacacggtgagcactcaaaaagataaaatcaacatcacatcacaaacaacaaataagacactcatagcataaatgaagagcagtataaataaaggcagctaagagcatctaacagacattacattcacacaaatagagaattagaacatgtccatgagttcttaagaataggggccaaaggattgccaggtccggaacttcccgataaaataccaggaacttccggacaagctgacatgacaataaggcgagggagctgccaggtccggaacttccggataagaggatccggaacttccggattaaacagacagcaggcagtaagcatcaaaaacaaaattttgacccccttcgattgcaattttctcccctttggtatcaaagcaccaaaaagagacaaaatcataaggaaagaagaggatcaagcctcatcaatatcgccatcagaaggaatgatctcagtgtcgccggagtgaggagagtcgatgtcttgcccggcggcgtccactgcctcatcgggatctgtaggaacattctcggtaggggcatctgactcctcatcatcactgctctcctcggagtgacaggactcctcattgaagaaacgagaagtgccagagggaccctcaccactaccaatgtcttgagcagtctcataagcagcaaaaggatcaacaaactcctcatcatcagaaatgtcagagacatccttgcctactgcaatccaatcttccttttgacgcctctctatcttctttaccttcttagctgtcttggcacacatgcaaaagatagccttgagagccttctttatgggagaagaagactcagaacgctgaggtgcagcagagaaagaaggagcagctgaggtggaagcacttgtcactctggtggtaggagtagctgaagtagtgggagcatgtggacggaaaggcttgtattgattgtccttgaaataacaaatcccagtcttggcctcaatcatcttcatgatataaggagcatagatgcaacccctctttggctcacacactgtctcatagatctcactccagataagcttcatgatgctgaaatcgggcttgttgtagcgcatgcgactgaggaggagcgcatgcctacctggaagagctgtagcatctcccactttggggagcaaagaccacctgaagatagagtatagcactctataatatggatgcaaccctcgagtagtccccaaacaatccttgggagcatccttctcatacataaaggtagtgctggtcggtgacagagcatcctctacaaagatatgtggacgactcaggtcatcatcatctaaccccaaagctgcaacaaattgtgccatagaaaccctatactgctgcccctgaatggtccacttcacaaaatcaagccccttcttggtggtgccaaagaaagcagtggagtagaactgtccaatcacttcctcattccaggaatactgcaaggccaacaaatctgccgcgtgcttgtgctcacacaccttgcgtacctcattgaagactatgttgttctttgaggacatgtacttccagtctagccacttcatctctaccactggatgagatcttcccatgatcacagagttataccaatcaacctgcaccaaggtcctgaatctgtcatcctgagagtcagctggcagagtatcaggactaaccattctgtcctttccacacttgagtagattcttcagatagttcactcttgggcgtttaggatcaggatcaacagcccttgtcttgtacagcctcaaaggattgctttcagaacctggctcatcctcattgccaccatcatctgactcagatgcagttggggagggagagcggggtgcatcacgaatgacaatgctaccagccctcctggaatggatcggaatctgactcccactgtaaaatctctaactttttctttgcccaatctccccctaggaccacgaaccggggggctcgagtcagcaggaatatcttgagaaagcttttgtctcttctcacgaggcataatgactactgcaacaagaatcaacaaggttggagtgcaatggttaaaagaaacagtattagaatcaaggttactggctgactggacagagaccggaagttccgggccaaaaacaccccggccagcaaaacgtaagaacagaggatttaaccaggccagtgcatgtgacaaaaaaaacctatagatcggcaatccacaaggtagcaggaacaattctatccaaaaggttttctccctaggttcacatatttagagatcggtgcagaaacatgatgaaccaaaagagaagatcaaaagtgctaccttgagagggaaaatcgcaaatcgatcatgggatgaacctcctagccaccaatgtggttgattccacggagaggaatcaaatttccaatgttggaagagaaaatcgctgagaggagcactctagcggcggctagggtttgggaatcggggagaagaagaagtgaggagagagataccaggctcaggctccccctgggtatttataccccccgacccccggaagttccggactggggtgaccggaacttccagcctgacagaacagagggcagtcaggcccaagttcaatggaatagatgagaattcaatgatttggaaatgaaaacctatggacataaggagacttatgatgtatatgaccagccaacagtcaacattacataacaatggtcaatatacatcacaagaagggataaaaaccaaattttcgcaataaaaacacaaacaaaatttttcacataaggtttttttttggataatagagggaatgtttgagctttattcctggtatcaagaccttcttctccacaagaagtgatctcaagacacaaaacctcaatttttttttaatttacgttttagtgacacatgtttggctatgaattagccaaccacccatcacctaatgttacgagagtctaagatattgagctcactcctcagctcgcaaaatcttttctcatctaaaggcttggtgaaaatgtcggctaattgactttcggttgtcacatgggtaaggcatatgtctcctttagtctcatgatctctcaagaagtggtggcgaatgtctatgtgcttggttcttgagtgttggacgggattgttggctattttgatggcactctcattatcacataggagtgggatcttggtgaagttgtagccaaagtcttttagggtttgtctcatccaaaggagttgggcacaacaagaatcggcggcaacatattcggcttcggcagttgataaggcaatggaattttgcttcttagaggaccaagaaacaagggaccacccaaggaattgacaagtcccggttgtactttttctatcaaccttacacccggcataatccgaatcggaatagcccaaaagctcaaagccacaacccttaggataccacaagccaagattaggagtgtgaactaaatatcttagaattctcttgacggcaatcaaatggcactctttaggctccgcttgaaaacgggcacacatgcaaacactaagcatgatgtcgagacgagatgcacataagtaaagcaaagatcctatcatggagcgatataccttttggtctacacatttaccattatggtcgaggtctaggtgtccattagtaggcatgggcgtcttgataggtttggcatcctccatcccaaacttcttgagtatgtctttcacgtacttggtttgagagatgaaggtgccctcttgtgcttgcttcacttgtagcccaagaaagaaggtcaactcacccatcatagacatctcgaaccttttagtcatgatactactaaattcttcacaaaaagaggcattcgtagaaccaaatattatgtcatcgacataaatttggcaaatgaatgaatcactcttaaatttttttgtgaagatagttgtatccgccttcccaatttcaaaaccatttttcaaaagaaaatctcggagacattcataccaagctctaggggcttgtttgagcccatagagcgccttgtggagcttgtacacatggtttggcaactttggatcctcgaaccccggtggttgctccacatagactaactccgagataggtccattgagaaaggcactcttgacatccatttggaataacctgaaatcatgatgagcggcataggctaaaagaattctaattgactcaaggcgagcgacaggtgcgaaggtttcaccaaaatcgagaccctcgacttgggtgaatccttgcgcaactaaccgggctttgttccttacaaccaccccatgttcatcttgcttgttgcgaaagatccacttggtggcgataacattttgcttgggtctctccaccaaagtccatacttgattgcgagtgaagttattcaactcctcttgcatagccatcacccaatccggatcaccaagcacatcttccaccctggttggttccaaagaagagacaaacgagaagtgttgacaaaaacttgtgatacgagagcgagtagttaccccttttcttatgtcaccaagtatgttgtcaacaggatgttctctttggacagtgtgatgtatccttggatggtgcactggggggacctgagcctgatcagaatgctctaaagtgccctcagcatcgatcccatccacttgtgccgttggcatgtcttcactgccactgatccaaaggttccggactatagaacccggaacttccgggcctagagatgtccggaggttccggtcaataggacccggaatttccgactcagcagacacaacacttgtagggctgttggatgccggtgacggaggttgatccctatcttcttggtcatcctgcgtctcgactggtcgtatgtctccaatagccttagtaccaatagcttgatttggatccacaccccctacaacatgtacaacaacttgctctccttgggagccattagattcatcaaatgtcacatccctagtgacttcaacaataccagaggttttgttgaagacacaataggcatgtgcattagattcatagctaagtaagaatccctcatccaccttaggtgaaaacttagatgagcgaggcctcttacttaaaataaaacatttgctcccaaagacacgaaaatatgaaacattaggcttcttaccactcaagagctcatatgaggttttctttaggatcttgtggaggtacaagcggttgatggcatgacatgcggtactcacggcttccgcccaaaagacattcgaagtcttgtactcatcaagcattgcccttgtggcttcaatgagggttcggttcttcctctcaacaatgccgttttggggaggatcatagggggcagagaactcgtgcttgattccttcttcatcaagaaattcctccatttgagtgttcttgaattctcctccattgtcgctttgcaccctcttgatagtgagatcgtagaggttttgggcttgctttgcgaagcgcttgaagacatcttgatcttcgcttttgtcatggagaaagtacacccaagtgaagcgtgaaaaatcatcaacaatgacgaaaccatacttgttacctccaatgcttatgtaggccacgggcccaaataaatccatatgaagaagctcgagtggtcttgttgtagtcatgatgttttttataggatgtggactcccaacttgcttcccggcttggcaagcactacacacacaatctttctcaaaagaaacattatatagaccaagaatgtgttccccttttagaagagatgccaaattcctcattccaacatgggctagcctacggtgccatagccaacccatagaggatttagcaatcaagcatgcctccggattcactctattcacgtcgaaatcaacgagatagagatcaccctttaacacacccggaatgctatggaagagtcatctcgcctaaaaatggtcacatccacatcggtaaacaagcaattaaattctaacttacacaattgagacacggataataaattgtaccttaatgaattgacaaggaggacattagatagagattgattcttggaaatggcaatcttaccgagatccattacctttcctttaccatcatctccaaagacaatattttcacgacttccagccccctcatcaagacttgtaaacatactcctctctcccgtcatatgattggtgcagccactgtccacaacccaacttgagccaccggaggagtatgcctacaaaagagatcaagcttcgatttaggaacccaaacttgtctaagtttgggtcccttgatgttagtcaccaaagcctttggcacccacacacaagtgcggtactcatctttgtaattcccattaaaataagcaactactttgccctctgaatttttggaaattacatatgaatcatagtaaagaccctctggccggaacttcctggcattatacccggaacttccggtcagccccttcggcctattagaagcccggaacttcttgaaaaaacgtccggaacttcctatcttacagggcagaaacttccggtcattttgcccagaacttccgggtgtctgaccagtgaggggacaagtcacctcacttgcttgtggagcttttccttctcatacaaacatcaagcattctttcccatttaccatcacacgcttagacacaggacttccaccagaaaacccgagcccgtgtccatccatgttaagatgattgattgtcttgtaaagggcatcttttgaatggtatgtcttcatgcatccatatttcaccaatgtgcccaacctttcattctctttcttaagagcttgcatagcatcaacattagtagtatgagagttcaaatcaatattgtaacacctagcacaaccattgcttgtagatgggttggaagaattagaaaccacatttggttgagaagtgctattccaaagagtgtcaaattgaacttcaagatctttatgacttttgtctaaactagcaaacttctcttgaagagtttcattgacatcactaaggctagctagagaaccattagccaaattaagctcattagccagttgttcatttttagcacattctttagctaggctctcctctaaggcaaggtttcttttcttctcaagaataagtaattcttcttgcctttcgagcgattgttctttactatccaaagctctcattaacttagccaaatgttgcatagcgggttttctaaagctcttaagcacatcatctaattcattatcactttcctcatcactagaatcaacatcaagagaggtgtgagagcgcttttgagtcatcaccttgcggccttgggccatgaaacaagagtagtggtagaagtcgtcgtcgtcatcactcaagttgttgaagagacgcttcttgcttgaagaagatgacttgaaggcgacggtagcaacaccaccttctccttcaaccttgtctttcggcttgggcttgggcttgacctcgggatcttcttcatctccggagtaaaacacctccgccatgtgtgcctccgccacatgagcatgctctggcttcttcttgcctcccttagccttagcttcatttgacttgggacaattggctacgaagtggccatattcgccacaattgaagcaagccctctttgattgcctctttcccttgtcatcatccttcctccctttgccatagccactgttgcgaagaaagtgcttgaatctcttgacaataaaagccatctcttcatcttcactttcttcacaacttgactcttcttattgttttgccttcaaagcaacttcttgatttttgatcatgacggcattcttcactatttgcctcacttcacgagcttcctcttcttgcatctcatgagacacaattcttccaagaatgtcacttggggtgagtctcttgaagtctttcctttcccgtatcattgatacaagagtgggatttcttggaccaagtgcacggagaagtctcttgagcacaaaatgatttgtcatgtcctcactcccaagtcctttaatcttgttgacaagaatcatcgtcctatcatacttctcttgtggtgtctccttgtcatccatcacaaatcttccaagccttccttccaataagtcaatcttggcctcacgaacggcgggtgatccctcatgagccaattgcaaagtatcccatatctccttggcctcctcaagcccatcaaccttgttgaactcctccggactcaaggcggagagaattgcattggaagcttgagcattgcggtggatgagttgctcttgctccgaagtgagctccatgtcatcatggggtacatcaacacctttacaaacaactttccaaatacttagatacaaagagattagatgcaacttcatcttgtgcttccaagcggcgtaatgtgtcccatcaaattgaggagcacgcccggaaggcacggagacaaagttgtgagggggaatggtatgtttcctgtaaccaaaaggtatagtagctcccttgggtgatggagtttccttgctgctcgctccatcttcatttccattttctccgttctttccccctaagtctgacatcatggatcactcaaagcggtgaagcttgaatcaagagcaccttgctctgataccaattgaacgcgctgatgaagcctagagggggggtgaaaattcaatcagacccggaacttcctggtaaggaactccggaacttccggcctcccaggcccggaacttccggtgttctaagacaggaacttccaggtaaaagaacagagataaaatttaaatttcgaaacaagagactaagccaatcttcacaagatggtgcacaggtattctaagcagaggatagatcacagaatcatccacagaaacatcacagaaagagacaagagcgattttttcccgaagttcggatcttgtgatcctactctccgttgaggagctccaagagctgggtctcgattaaccccttgcctcacttgtgcaaaaaccccagaggaaatccacagccttcaaccccaaacacccctaggcaaatttctagaattgagtgaccaccaagatccaactcaacctacttctagaaatccaccacaagtgtgggttgctctacttggaaagcctctagaatctcagcacaagaacttcactaacttaccattttccctttcgaaggaaaggaaatccttcacaaacttactccggacatccacaatatgtaatggattctagtgggtgacacctaaccatctaggagatcatctccaagagtaataagcaccaagatgacagcccacgagatattcctagtgctcacccaagattctagtcttcacacctctccaaatcttcttctctccctctcaatctctttttcacgcaagaattaggctctagattcagtggaaagacaagaaacacttcggagaggctaccaatagctctaggtttgaaaagtgaaagtggaatggccaagcaacgagctggaaacgagctgtatatgtataacgactatgtgacgtcatctagccgttactcacaaatttgaactggaaacaagacagggagttcgggacctggaagaccggaacttccggactacacttaggaaaatctttttcacaagaccggaactttcggacctagaagacaggaagttccggacttgcatttttggacagatggagtatttgcaaaaaaaaaaagaactcctagggaaacttgacacttggttcacactaagagcatttgatatatctcagagcatcacctggaacccctcttaatagtatagttttacctaaaaagttgatttcagaagataaactatcctatacacttctcgagttccagtccgatttgattttgtactttttggggggtctccaagcatccatcttccacaccttggactaatgcacttgaaagctactcaatgagctcattagtcccttaaccacatttgtcattaatcaccaaaacccactaggaggattaatgcactttcaatgttaagaatcaagctcctgtagccaatgaagccacagcctatgaagcaagaaggttggctaaagggaaaagtgttgtaattgcttcggtcaacatggttttcacgttgcctgctgaatttgggatcaagcaagccaatgtcgatgaagtggaagcagaatcagctaaattaattttatcactgtagaaggcaattttcgagaagccagagggtacagaaaattggcatctcaagtcattatatataaatggctatgtcaatgggaagccgatgtccatgatgatggtcgatggtggggctacagtgaatttgatgccttacactacattcaggaagccgggtagaaacgccgaagatctcatcaagacaaacatggtgctcaaggactttggcggcaatccatcggaaaccaagggagttttgaatgtggagctgacagtcggcaacaaaaccatccctacaacgttctttgtcattgataggaagggttcttacagcttgttgcttagaagggattggattcatgctaattattgtatcccttcaactatgcatcagtgcttgattcagtggcaaggcgacaagattgaaattgtgccagccgacaagtcagtcaatgttgccggtgccgatttagctctttgggagatggatggtcttgattgtttatctggaaaagtttgggatggagattttctaaaagtgtccgattctgatatacagccagttgaagatggagaacccaagctattattttgagggtgtcgtggagggttcaaacgtctacaccaaggacacagtagatgatctcgatgacaaacaaggacagggtttcatgtcggctgatgatttggaagaatttgatataggtccaggtggtcgaccaaggctgacatttatcagtaagaatttgtcttcggaattcagaaccaagttaatagagctgttgaaagaattcagagattgcttcgcttgggagtattatgaaatgcctggtctcagccgatcgattgttgaacatcggctacctattaaaccaggggttaggccacaccagcaacctctgagaagatgtaaagccgatatgcttgaacctgtcaaggctgagattaaacgattatatgatgttggttttattcgtccttgccgatatgctgagtgggtttctagcatagtccctgttatcaagaagaacggtaaggtaagggtgtgcatcgatttccgaaacatgaataaagctaccccaaaggatgaatatccaatgccagtagccgatcaactggttgatgctgcatcaggacacaagattttgagttttatggatggtaatgcacgatataatcagatctttttggccgaagaagatatccataagacagcttttaggtgtcctggtgcaatcggcttatttgagtgggttgtgatgactttcggcttgaagagtgctggagctacatatcaaagagccatgaattacatatatcatgatctaatcggctggttggttgaggtctacattgatgatgtggttgttaagtctaaagagatagaagaccacatagccgatttgaggaaggtttttgagagaaccaggaaatatggcttgaagatgaacccgacaaaatgtgcttttggcatatcggctagctagtttttgggatttcttgttcatgagagggggattgaggtgactcaaaggagtgttaatgcaatcaagaagattcaacctccggagaacaagacagaactgcaagagatgatcggcaagatcaattttgttagaaggtttatttctaatttatccggaaggttagagccttttacaccattgttgagattgaaagctgatcaacagtttacttggggggcagagcaacagaaagctttggatagtatcaaggaatatcttagctctcctctagttttgattcctccacagaaggggataccttttcggttatatctgtcggccgatgataagtcaatcggctcggttttgatttaggagcttgaagggaaagagagagttgtgttttatctaagtcgtcggctcttggatgcagaaactagatattcccctgtggagaagttatgcttgtgcttatatttttcatgtacaaggttaaggcattatctattgtccagtgaatgcaatgtcatatgcaaagccgatgtggttaaatacatgttgtcggctccgattttgaaaggaagggttggaaagtggatattttccttaactgagtttgatcttcggtatgagtcgccgaaggcgattaaaggacaagctatagccgattttattgtagaacatcgtgatgattcaatcggctcggtcgagattatgccatggactttattctttgatggatcggtgtgtactgatggttgtggtatcggcttagttataatttcccctagggggcatgttttgagtttgcttatactatcaaaccttatgcaaccaataatcaagctgagtatgagacagtgctcaaagggttgcaattactcaaggaagttgaagccgatgctattgaaataatgggagattctctgctagtaatcagtcaattggcaggggaatatgagtgcaaaaatgatacattaatggtttataatgagaagtgccaagaactaatgaaagcatttcggctggttactttaaagcatgtatgacgtgagcaaaatattgaagctaatgatttggcccaaggggcatcgggatataagccgatgatcaaagatattaaggtcgaaattgtagcaataacagccgatgattggagatattatgtgcatcagtatttacagaatccatctcaatcagcttcttggaaattaagatataaagtgttgaagtatactttactggatgatgaactttattatcggacaattgatggagtgttgcttaagtgtttgagtgccgatcaggctaaagttgcaatcggcgaagctcatgaagggatttgtggtactcattaatcggctcataaaatgaagtggttgcttcggtgtgcaggtatttttggccgacaatgctggaagattgtttcaggtattacaaaggatgtcaagattgtcagaaatttggagcaattcagcaagcgccggcgtcggctataaatcctatcattaaaccatggccattcagaggttggggaattgatatgatcggcatgattaatcctccatcgagtaaaggacataagtttatattggtggcgaccgattatttcaccaaatcggtagaggcggttcctttgaagaaggttgattttggggatgcgatacagtttgttcaagagcatataatctaccgatttggtattcctcaaaccattacaactgatcagggttcaattttcgtgtccgatgagtttgttcaatttgccaatagtatgggaatcaaactgttaaattcttcaccatattatgcacaagctaatgggcaagctgaggcatctaacaaaagcttgatcaagttaattaagaggaagatttctgattatcctcggcagtggcatactcggctggccgaagcgttgtggtcttatcgaatggcttgtcatggatcaatccaggtccctcctcataaacttgtttatggccatgaggctgttctgccatgggaagtgagaatcggctccaggagaacggaattacaaaatgatttaacaaatgatgagtattataaccttatggccgatgagagggaagatttggttcaatcatggttacgagcccttgcaaaggttactagggataaggagcgaattgctcgacactataacaagaaagtggtgcccaaggatttttcggaaggtgaacttgtatggttgttgatttggccgattgtggagattatgggtaccccatacccacacggcatggttatccgactagtcataggggatagcttatatatatggaatatgtaaccgatcatgacttgggtattacgtttccttttatattatggagcggcttaaagtcttgatttgataatattgtaaaatagatttaggaaaccaataccgtattggtgaaggtttctatcttgtaatcctgccccccatcctatataaggtgggcaggaggccctctagggggcatgacacaaactgatcatcagatcaatatacacccggcggattcaaatcaccaaacaggagtagggtattacctctcatcgagagggcctgaacctgtctaaatcctttgtctccgcatctatccacttttaggtatcgtgcgctacccccttttcatattgccgaaaatttgtttcgacagttggcacgccaggtaggggtgcgtcgagtttctatcaacaagtgcgatggaataatttttagaggtcgccggtatcgtcttggcttctgtagcatgagatccacttccgtcgacatcgccttcatcttcggactggttcttctcttctggagtctgcctttcattgccattgccaaaatttccaactggaccaaaccagtcaaccgggcgtcactcatccccgatcaattcaatctataaccagaagcagctgtttccatcaaatcgactttactcgtgagatcaaattggatgtcttcatgtccgtcgaaatcatcgaagaaagtaactcgccgagattgatcacgaattggcgtcaacggctgcgctgatcttttcaagaaaaaacactagttacagcacctcatcaattaattttcctcgagattgagtcttttgcacttgaagtccgaagcggagtctactaacaacagatcgatctggagccatacatagcagagtaaaatctacttcaacggcagcagggcacatcaagcgatcaggaaagaattatctagccactgctcttgatggtgcattacttatttaattggcctatagctgtgctgtacgtgcgcccaatcatgagggctgtcaactagttgacaatcttcattcatctatctacaatgcaagcatgcagcaagcgacatagtcttgcatcaagacaacaaccaaggtctcgatccggctattccgagttgattcatctctgttacaaaaattccggccgccacgacttggatcatcaacaattatcagtcgattgctttcgctgccgccgactggtgtcctcgcctatacggttggttggtcacaccactgtttatgggcgaccacgtcttcaccgatcggcttgccttcgccgccgccgactggtgtctccgcctacacggctggtgtcacgaccggaaataacccaacgggcgttccttacgtgcgtgtattattccttgtcccaggaggcaaggtacaccaaaagttgatacaattcagagtttaacaagcggaagcgtaaataattaatttattacatgggcggcgaaggcccagcacacacaaagacaaacgggaaacagcggaagactagggcgacgaccacaggcgctagacggcaggcacgagctagacaccaaagccttcatcttccaggaactcctctcctgggtttgggaaaaattgagcaagactgagtacaaccaccgtactcaacaagacacacccacaagtgcagaataaatgtaagggagtacaagggggttatcatataaggggttagggtttgcagtaaacagcattaaaagacacttagttgctcaaagctattttgtaaatacgatcctagcgctatacaagattattagtcaaggccgtgaacccacacgaacctgccttaacccaaggcctacgatgattcggaccgaactggcaacccgaccctgggtcccagctcgtcccaagccaacccaggccaaccattccacattttagttgttaagcaggttttaagaatcaaaacactaacttgggtacattgctcggcttgcccataatcgagggcgcggctattcgaataggttatactctgatcagaggtgtacatctttacccacaagacacatcttcctcacgtgtaaccacgtgccacataccaccacggtatacggacggaagacgtgacatagtttctaacccatcctagccatagacaagagtaccgacccaaccccacctacggccggaacctccgggacaggtaggcaggactgagcccctagcagcaggacaccggccttgtgccatgacatctcgactaccgggccgtagctcgtgtagccttcatttgccctagagatgtccatcgacccccgactttgtccatctccatccgtgtacttttgtttataaccagactgagccacaaactaagccttacccactagacatgtggaagtacggtagtgctttgcaacagaggcccgaagaccggtccttatatggccgaggtgctaccatcaaaaccatgcacctcgagcccagcctaaaaccattttgaggattttgaatagagggggaggtgtgaatccaattccacaataatccaaccattccatagtgtccaaatgatatgaatattcccaaagtctagagttataaaaccacctaatgttgcctaattaatcagcgaaccatctacctaaattcatactagtggaaccatgaataaagtgtccactagttggggttttgtttattctagggtgaacaaggtaataataacaataacaataataaggtcataacaaaggtaaataggtatggctagataaaacagtgataacgcgggaatttaaataaagtgataatgcaataatttaaatcaaaataattttgtaaactgggattcaatatgttcaaggatgatgtgacttgccttgctcgctttcccaaacgtcggcttcaacctccacgaagagcggatcttccgaagctgcagcgtctacacgaccaacggaaaagaaaaaggcttttactctaataaactgcatataacaagcaggaacaaagcacaaaaatgggtttttgacttcttaaggaaaaattagagacttgaacggtccaattctgagttcaaatggccaagttatggccatttgaagtttatatgctctttaaatgaatatttgcgaatttcttcatttaaattttaatttaaaaagggtttattgcgtcagccaaggggggaggggcgcgcggaccgggtccacgggagtggggcccacgcggcagcctcacggtccatggtggaccgggtgcacacgggctcacaccggccggcaccgtgggccccacgcgtcagccgcacccgagggcgcgggcggctgacggccaggccccacgcggcagccactcggcacgcccgagggcggccatgccgacgcagtcggcaggaggcagcgtgcccacgccccgatggtcgccgccggcgaccaccggcgcggcggagcggcggccgagagagggaagggaagggagaaaggaggcgacggtccacggctcaccccggggcgacggcagcgacgggggaggcggtggcgcggctcgggtcgacggggacgacggcgctccggcggtcggcgaccgaaacggagaggtggacgaggtcggcgaggatgcggcgaagccgaaggaggcggcgccgaggtggaaggcggtccgaggcgacgacggcggcggaccggagctcggcggcgatggtggagagagagagcgacgtcgtgagctcgaatccggcgaggaggaagggcggcgagaggcggaaacggacggaggaggtgcggggagggtttaaatagggttggaagggggagagggcggccggaggggaatgaaaccggcgcggcattctcgggctccatcaatggcaccggcgggattaggggagggtttccaaacgaatccaagggagagagggagggaaaaatggggggaaagggagaggggatcacggggagtatttccccccactttattgcacgcggggacggcgggatgcggcggatttggcggcggcggcggcgcttggcgcgggcggagcagcgggagcggcgggaggtcggggatgacgggtggtcccgacccgtcagcgagggtggcgggcgggcccgcccgtcagcggcgcgcgcgtggggaggggccgaatggcccacgggggagaagagagagagagagagagggggaagagcgagatgggccgagccggcccaagggagggaagggggactttttagggtttttctttttataaaaccttttcaactttgtttatttcttaataattattatttgtactctgaaaattccactaaaatttatttacacattttaggcttttaggaaatatacaaaaatcctctaaggcttatttgacttttactttgcacattttaatttttggaggctttcacatggattttaattattctaggcataatttaaaggatatattttagggtcgttttgggacgtgacagctggcctattatgccgccgttgttgggcgtcttcgctttcaccatcgaccgccttcgttgccgccaactggtttcttcattgttatttatggacgactttgttcccacattggccacctctgccatcaccaaggggaataatgcaaagctaagtcatcatttatttcattctttatatgatattttccttttcctctgcgtcactatgtcaactggttcgccgttgactagtgagtcaggggctagagatgttatatcatattttttaaacattttttataatatttatcttgattgcttgcgacatattctgagtacaaaagtgtctatcgagttatggagttccatcttcctatgctttctgtttgttttgccaatggatagttgcctttgggccgattcctagcacccgggggcttgttggatggaccgaataacgcaaggtgctaagtatgattcgaaataaattaaaagcatagagataagttaatttattttctgctcttaataattgcaaaagtacccgagtagtaaactctgacccgtgaaactttgttccattaatgacaaactcatgtcactcatatgcatgtttgggaagtgcttaggccgactcctggtgcttggtggctatgactagtcagacagagtgtttaaacgtaatgagtcatctgctcggggaaaatcaaaattgacaagagaagaaatacatatttataaatattttaaaatacttgaatttttctcgagtattatatttatatcagatactactcatcctatatgtttgttctacaggatgcaaatccagatatgcataaacgagattcatggctttaagcttatctcttacgctccaggaatggatcagtcagaacatcaccgccggtttgctttcgccgccaccgactggtgttaccgcctgcacagctggcctattatgccactgttgttgagcgtctacgtcttcaccgaccggtcgcctcgtccgccgccgactggtgtttccgcctgcatggctggcctattatgccgccgttgttgggcgtctacatcctcaccgaccggctgcctcgtccgccgccgactagttaatgaagacattcctagcattcactcatctccaaatgaagctacacttgatatagctggtccaattacaaggagtagagctaaacaattggagaaggaaattcattctcaggtgaacgctaaccttatgcttaataatcagattacattgaatgaacctatgcttttgagtacttgtttcaatgttcttaggaatgatggagtgcacgaacaagcatgggatgatgatggattctgcccgccaaatatatgcaaggaacctggacgtgcatgagagaggaaagaccattcagctaccatgaatatcagccattgaagtgcaagcaaataattcgggagttaggaatgcatgcaaccagcaactgggttgctgtccacacacgctccagcatgcatgcagagaataccaaccagccaggcgtcctactaggcttggtttttaataaaagtagtgctgcaacttcccactacatgttctcaattattttccaccaagctgaaactccactagtgctatatatccctgtaatggatgacgtgaacagtaactcgtgattgcaatttcagaataccaactcttggaattcttgttccagcgtgagtcttgagaggcttgcaaacttgttcttttgattcctgagggagttgtcgaacgccgaactgtggttcacccagtttgtgccttcacgtctatacggcgtgattgcgtgggctgttcgtcggtacgtggaagggtgattgtctcggtagttcgtcgcgtggacagcctcgcggtgcattgcctcttcaccaggtcacgcaacgacaatttatcaagttcgcagatcctacgagaagatcgggccacaacaacttgctacacgtgctgcatagacatgtgcatatcatctggtatcagagccaccgtttcctcagtaggattgttcttgtttttggtaggatagagtttaaatacctactgtccactgatagccaaaaagaaaacctacagcccaaattcatacgtgctactgattttgtagtttgctttatcgagttttaatcctttaagatttgtctagttgctgaattttcttttccacatcgttctagttgttatctttgttctaatcatcaaatcgcttgctgcacgtacccaaccatcccacccttgatctgatcgtccttgcttgctgcatatatataaacagaaaaaaaaaatatatacccacccatcccacccttgttttcttcccgccacatattccccaaccgagtttcttgtttttgtgctgcgccatccatcttagtgatccttatgagcccctttagttgaaagttgtgctgtgtttgtcacaaaggttaaaagaaaagatgtctatgggtcaaaagaaggactgaaaacaacgagttcttgaaaaaaacaagaaaaaaaaaaggaaagaaaagaaataaaagagaattgtgttcagcacaccaaaaggggtttgggcagcaacaagttacggttggtgcaaattggtgttcatctatccacttcctgcatcttgttcctttctttgtacatcttttcctttatattcagcaacttagacttgtgttcttggattattattcggttttgcatccctacatttcagtgcattccacttacatattaccccaccaagctccacttaaaagcaccgtgagttgttgcaccgtcgtcgctgttacaatcacttttccactacagattgcagccacggttcttgctcttttcagggagagaaagaacttgttttgtaagtggtgagggagtgattccacatatattccacatctatattgtcctatttttttcccctctactaatattgcaggacgtggagatggtgccgctgtttcggtggatgaatttcaggagttgcgtacacaaatgaatgatttggtgcagcagctccaaactctccaattgaacatgccacatagagaaccgccaccaaatgaggatgatgacattgaggaggaggatgaggtagggcgtcgtcccgctggccgtggacgtggcgggcgcggtcgtggttttgctaattttggtcgtgctcggcgcgttcctattggaggtggaggagattatgatggtgatgatcatatgttgtccgacatggatgatcatcgacatggtggccatcatggttatcgtgaccgccatcgtcgtcataatgatgatggtttaagacacgtgaaagtgtctattccccctttcagcggacaggagaatgctgatgcttattttgaatgagagaccaaggtggaacaaatatttgatttgtatgaatactctgctgaaaagaaggcaaagcttgcagccattgagtttaaaggctatgccataacttggtggaatcaggtccgtactgaatatcagagagttgggcatgttcgtataacttgggaagacatgaagagagaaatgcgacgtcgtttttttcctgcatattactctcgtgatctacatttgaagctgaaacgtcttgtgcaaggtactcgtactgttgatgaatattttcaagaattggaaatgtgtttacttcgtacagggataactgaagatgaggaatccacaatggctcggtttctggttggcctcaataaacccattgctgataaagtggatatgacaaactacacatgtctcactgagttggttcattttgcaaagagggctgaaaggcaaattgctacgtcttacaaatacaatgcttcatggcgtcattcccaacagcaaggggatgtcatgcctcaattccaacagcaagtagctgcaacgcccaaatcctcatctcgtggagcaaatagatctcttccaacttcttccaaacaactggatgtgaaaggtaaagctgtgagttcaagtcagcccacttcttctactgcagccacccaacgcaagacaagcaagattgagtgttttaagtgtggtggtcatgggcataagcaagctgaatgtcccaatcgtcgtactattattgcacttgctgatggttcttatgattcacaaagtgaagaggaggacgagtttaacaatgtatttgcagatcttaatcttgacacttgtgagtattcagcagaggatggtacatttgagctaggtctaaattgtttagccattcaacctattccaacttttgctcacaatgacatattacaagatgttgtttctccatctttcagcgagattactagtgatgattttgatgagttgcttgctgattttcctgatttgacgccttctataatgaacacaccatctacttctttggtggtgaggcgagttctttccactcaatttgttgctgctgaacaaggccaacgccataatttgtttcaatccagatgcaaagtgaaaggacaagtgtgccgtttcatcatagatggtgggagctgcaataatattgttagtgctttgcttgttgagaagcttggtttgcagccacgtcgccatccacatccataccatatgcaatggttgaataattctgggacagttaaggtttcagccatgattcgtttgtcattttccattggtgattatcatggagaggtggattgtgatattgtccccatgcaagcatgccatttgctgcttggtcggccctggcaatttgatgtggactcggtgcattttggacggtctaacaaacacactttcattcacaatgacaagaaggtggttcttgttccattatctccagaggagatacatgcttcagatatggctcgcaagaaacgagaggaatctgacaaaagaaaattgagtgagatccccaacacaagtaagggagagagttctaacccatccagccacatacagcctcatgccaatcctaaacagccacgccacactaagtgtctctttgtgagcaagagtgatatgtgtcgcgtcccaaaacgactctaaaatacatcctcaaaattatgcatagaataagtaaaatccatgtgaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaaaggttttataaaaagaaaaaccctaaaaagtccctttttcccccccccccttcccctcttgggccggctcggcccacctccctccctttctctcctctcccccgcggcccaatcggcctcctccccgcgcgcgtgccgctgacgggcgggcccgcccgccaccctcgctgacgggtggggcccacccgtcatcccctacctcccgccgctcccgccgcctagcccgtgccctagcgccgccgccgccgcgaattccgccgcctcccgccgtccccgcgcgcaataaagagggggaaagcactccccgtgattccctctccctttccccccacttttccctctctctctccctcggattcgttcggaaagtttccccctaacttcgccggcgcatcaatggcggccggatcttccgcaggcgattccccctcatccggcctctctctccccctcccgaccctatataaacgctccccgtgcctccctccaccatttccgccactcgccgctctctctccccgtcggaatcgagctcgcgccgtcgcccctctctctccgccgtcgccgccgagctccggtccgccgccgtcgtcgccccggaccttctcccgcttcggcgtcgccttcttcgggttcgccgcaacctcgccgacctcgtccacctctccgtttcggtcgccgaccgccggaacgccgccgtcctcgtctacccgagccgcgccgccgccttcctccgctccggtcgccgtttccgccgtcgccgtcgaaccggggtgagccgtggaccgcccatttcgtttccctctcccctcccctctctcggccgccgctccgccgtgcctatggccgccgccggcgaccataggggcgcgggcgcgccgcctcccgtcggctgtgccggcgaggccgccttcgggcgcgccccgcggctgccatgtggggcccggccgtcagccgcccgagccctcgggtgcggctgacgcgtgggacccacggcgccggccggtgtgagccgcgtgcacccggtccaccgtggaccgagaggctgctgcgtgggccccactcccgtggacccggtccgcgcgctcctcccctcggctgacgcaataaatccgattttaaattaaaatttaaatgaagaaattcgcaaatatccatttaaagagcatataaacttcaaatggccataacttggccatttaaactcggaattggaccgttcaagtctctaatttttccttaagaagtcaagaacccatttttgtgctttgtttctgcttgttatatggagtttgttagagtaaaagccttttcttttccgttggtcgtgtagacgctgcagcttcggaagatccgctcttcgtggaagttgaagccggcgtttgggaaagcgagcaaggcaagtcacatgatctttgaacatattgaatcccagtttataaaattatgttgatttaaattattgcattatcgctttatttaaattcccgcgttatcactgttttatttagccatgcctatttacctttgttacgaccttattattattgttattgttattatttccttgttcacactagaataaacaaaaccccaactagtggacactctactcatggtatcactagtatgattttaggtagatgcttcgcttttaattaggtaacattaggcggttttacaactctagactttgggaatgttcgtatcacctggacactatggaatggtttggttattgtgaaattggcttcacaccgctccttctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtgactcagtctagttataaacaaaagtacacggatggagatggaagaagtcgggggtcgatggacatctctaggacaaatgaaggctatacgagctgcggcccggtagtcgagatgtcatggcacagggccggtgtcctgctgctaggggttcagtcctgcctgcctgtcccgggggttccggccgtaggtgggattgggtcggtactcttgtctatggctaggatgggttggaaactatgtcacgtctttcgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataattgtatagttctagaatcgtgtttacaaaacagctttgagcaactaatgtctttaaatgctgtttactgcaaccctaaccctttatagtataactcctttgtactcccttgcattcgagacccctcgtgctgagcccgcgcccgtggttccccaggagggggaagcctccggcgttggtagcacggaggatgcgctgttgctcaccttccgtcctggcccgtcgtagcggtagacgagcagttagtaggcttgcgcgtgtgttctttctcgtttgtcttcttgttggagttgtgtggggcatggttatgccggtgtgtggcataactgtgtcggagcctgtctttattttatttgcctaagcaacttgaactttaatgaaccaatttaatagcagtaataaattcaagaattatggtagtcgtgggtggttagctttaattgtcagctctctctgtttgctggttctgtgtggggttttcagatgttgacgaccaggagaagtgctgctaccggtgatggcaaccaacccgaaggcagcaaccaccaccaccagggcaggccaccttcacctcctcctacgcctccaccaccaccaccagacaccaacgccattctcacccaaatcctcgcccagcaggccaacatgatgactgctttcctccaccacctccaaaattcgccacaacataatgctccaccaccacctccccaacactctaaactcgccgagttcctccgcatccgcccacctaccttctctagctccaacaaccccgtggatgcgttggattggttgcatgccgtggggaaaaagctagacactgtgcagtgcagcgatgaggagaaagtcatcttcgccgcccaccagctgtaggggcccgcatctttatggtgggaccatttccaggctacgcagccagaggggcaacctattacttgggctcgcttcaccgccgctttccggagaacccatgtgcccgccggagtcatggcccttaagaaaagggaattccgagagttgaagcaaggcaaccgctccgtgatggagtatttgcatgagttcaacaacctggcccgttacgccccggaggatgtgcgggaagatgaggagaagcaagagaagttcttggcaggaatggaccctgagctgtccgtccgtctagtctccggggactatccggatttccaacgtctggtggacaagagcatccgcttggaagccaagcacaaggaactggagtcgcacaagcgccgcttggcgaatttccgcaatcaacagggtgctaaccaaagggtccgctacaccaatccctatccagggggatcctcctcgcagcagcaacaacagcagcagcaacctcgctccgcgcctcgacctcaattcgtggtgcgcgtcccacagccgcagcagcagcagaatcaacaagggactcgtgcgccccgtcctcctacgccaactgtgcagcctggtcaaggccgcagggacgctcaaggtccgcagcgtctgtgcttcaactgcttcgagcccgggcactttgcggataaatgcccaaagccgaggcgtcagcaaggccaagcgcctccccgctccaacaacggtgggaaggatgtcattcggggtcgggtgaaccacgtgacggccgaggacgtgctgacaactccagacgtcatcgttggtacgttcctcattcattccatccctgctaccattctgttcgactctggagcttcccactcgtttatatctgtgccattcgtggggagaaatcagttgggggtagaaaggcttaggaaccctctgctcatcaccacccctggaggggttatgacagcaaagtattatagccctgccgtccccatagaaattcaggggattccttttccctcggatctgattctgctagacaccaagaacttggatgtgatccttgggatgaattggttggctcaattccaaggagtagtggattgtgcgagacgcactgtcactctgtaccgagggccggaacaaccggttgttttctttgcacccccaacctctgtcagtagttccgaacttcatcagataggactgtcagaaatccccattgtcagagagttcggagacgtgtttccggaagaactacccggtatgccgcccaaacgacagattgagttccggatagatcttgctccaggaaccacacctctgtacaagcgaccctaccgtatggcagcaaatgaactggctgaagttaagaaacagttggaagagttgaaagaaaaggggtatatacgtccgagtacttccccctggggtgctcctgtgatttttgtggagaagaaagacaagacgaagaggatgtgcgttgactacagagctctcaatgaagtcaccatcaaaaacaagtaccctcttccccggatcgatgatctgttcgatcagcttaaaggtgccactgtattctccaagatcgatcttcgttccggatatcaccaattacgtattcgtgatgaagatattccgaagaccgcattcaccacgcgatacggactgtatgaattcacggtgatgtcgttcggtttaaccaatgcacctgcctttttcatgaacttaatgaacaaagtgttcatggaatacttggataagtttgttgtggttttcattgatgacattctggtatactcacaatcagaggaagaccatcagcaccatctccgtctggtattgggaaagttgcgggaacatcaattgtatgccaaacttagcaagtgtgagttctggttgtccgaagtcaaattcttagggcacgtgatatctgctaaaggagttgctgtggaccccgaaacagtgaccgccgtcattgattggaaacaacccaagatagtcactcaagtccgcagtttcttaggtttggcaggatactaccggaggttcatcgagaacttctccaaaatcgctcgacccatgacacagttgttgaagaaagaagagaaatttgtgtggagcccgcaatgcgagaaggcgttcaaaactctcaaagaatggctggtttcctcgccagtgttaatcttgccggatactcgcaaggacttcatggtgtattgtgacgcttcgcgccaaggattggggtgcgtgctcatgcaggatggtcatgtggtggcctatgcctcacgccagctacggcctcatgaaggcaactaccctacccatgatttggagttagctgcggtggttcatgctctaaaaatctggcggcactatctcattgggaatcgctgtgaaatatatactgatcataagagtttgaaatacatcttcactcagtcggacctgaatcttcggcaaaggagatggttagaactcatcaaggattacgatgtgggaattcactatcatcctggtaaggccaacgtggtcgctgacgccctaagtcgaaagagccattgcaacactcttaacgtccgcggcattccacccgaacttaatcaacagatggaagccctgaacctaagcatagttggtcgcggattcttggctgcgttggaagccaagcctaccttgctcgatcgaatccgcgaggctcagaagaacgatccggacatgcatggactcctcaagaatatgaaacagggtaaagccgctggtttcacagaggatgaacacggaaccctatggaacggaaatcgagtatgcgttccagataacagagaacttaaacagctgatacttcaggaagcccacgaaagtccttattccatccaccctggcagtacgaagatgtacttagacttgaaggagaaatactggtgggttagtatgaagcgggaaattgcagagttcgtggccctttgtgatgtgtgccagcgtgtcaaggcagagcaccaacgaccggccggacttctccaacctctccaagtacctgaatggaaatgggatgaaattgggatggattttatcaccggacttccaaagacccaaggtggatatgattctatatgggtagtggtggatcgattaaccaaggtagctcgattcattcctgtgaagaccacctatggagggaacaaactagccgagctctacttcgcaaggatcgtgagtctccatggcgttcccaagaaaatcgtatctgataggggaagccaattcacctctcacttttggaagaagctccaagaagagctgggtacccgattaaacttcagcaccgcataccacccgcagacagatgggcagaccgagcgtctaaatcagatcctagaagatatgcttcgcgcatgtgtcctggatttcgggaagacctgggataagagtctcccctatgccgagttctcctacaataacagctatcaagccagcatacaaatggcaccttatgaagcgttgtatgggcgcaaatgccggacaccgctcttgtgggatcaagttggggaaagccaagtattcgggactgatatcctgagagaagctgaagctaaagtcagaaccattcgggataatctaaaggtggcacagtcccggcagaaaagttatgcagataaccgtcgccgtaacctggaattcgcagtggacgattttgtgtaccttcgggtcacgccattgcggggtgtacacaggtttcagacaaaagggaagctcgcacctcggtatgtgggtcctttccgtatcgttgcccgacgcggagaagtcgcttaccaattggacctgcccgcctccttgggcaacgtgcatgatgtgttccatgtgtcgcaactcaagaaatgccttcgagtgccatctgcgcaggccgactcagagcaaattgaagttcgcgaagacttgacctacgtggagaggccagtgaaaatcctggacaccatggagcgcaggaccaggaaccgggtaatccgtttttgcaaggtccagtggagcaaccacgccgaagaagaagctacctgggagcgtgaagacgagctgaaggcagcccatcctgatctcttcgccagttcttccgaatctcggggtcgagattccgtttaaggggggtaggtttgtcgcgtcccaaaacgactctaaaatacatcctcaaaattatgcatagaataagtaaaatccatgtgaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaaaggttttataaaaagaaaaaccctaaaaagtccctttttcccccccccccttcccctcttgggccagctcggcccacctccctccctctttctcctctcccccgcggcccaatcggcctcctccccgcgcgcgtgccgctgacgggcgggcccgcccgccaccctcgctgacgggtggggcccacccgtcatcccctaccttccgccgttcccgccgcctcgcccgtgccctagcgccgacgtcgccgcgaatcccgccgtcttccgccgtccccgcgcgcaataaagagggggaaatcactccccgcgattccctctccctttccccccacttttccctctctctctccctcggattcattcggaaagtttccccctaacttcgccggcgcatcaatggcggccggatcttccgcggccgattccccctcatccggcctctctctccccctcccgaccctatataaacgctccccgtgcctccctccaccgtttccgccactcgccgctctctctccccgtcggaatcgagctcgcgccgtcgcccctctctctccgccgtcgccgccgagctccggtccgccgccgtcgtcgccccggaccttttcccgcttcggcgtcgccttcttcgggttcgccgcaacctcgccgacctcgtccacctctccatttcggtcgccgaccgccggaacgccgccgtcctcatctacccgagccgcgccgccgcctttctccgctccggtcgccgtttccgccgtcgccgtcgaaccggggtgagccgtggaccgcccatttcgtttccccctcccctcccctctctcggccgccgctccgccgtgcctatggccgccgccggcgaccataggggcgcgggcgcgccgcctcccgtcggctgtgccagcgaggccgccttcgggcgcgccccgcggctgccatgtggggcctggccgtcagccgcccgagccctcgggtgcggctgacgcgtgggacccacggcgccggccggtgtgagccgcgtgaacccggtccaccgtggaccgagaggctgccgcgtgggccccactcccgtggacccggtccgcgcgctcctcccctcggctgacgcaataaatccgattttaaattaaaatttaaatgaagaaattcgcaaatatccatttaaagagcacataaacttcaaatggccataacttggccatttgaactcggaattggaccgttcaagtctctaatttttccttaagaagtcaagaacccatttttgtgctttgtttctgcttgttatatggagtttattagagtaaaagccttttattttccattggtcgtgtagacgctgcagcttcggaagatccgctcttcgtggaagttgaagccggcgtttgggaaagcgagcaaggcaagtcacatcatctttgaacatattgaatcccagtttataaaattatgttgatttaaattattgcattatcgctttatttaaattcccgcgttatcactgttttatttagccatgcctatttacctttgttacgaccttattattgttgttattgttattatttccttgttcaccctagaataaacaaaaccccaactagtggacactctactcatggtatcactagtatgattttaggtagatgcttcgcttttaattaggtaacattaggcggttttacaactctagactttgggaatgttcgtatcacctggacactatggaatggtttggttattgtgaaattggcttcacaccgctccttctattcaaaatccccaaaatggttttaggctgggctcgaggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggatggagatggaagaagtcgggggtcgatggacatctctaggacaaatgaaggctacacgagctgcggcccggtagtcgagatgtcatggcacagggccggtgtcctgctgctaggggttcagtcctgcctgcctgtcccgggggttccggccgtaggtgggattgggtcggtactcttgtctatggctaggatgggttggaaactatgtcacgtctttcgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggcctttggttaaggcaggttcgtgtgggttcacggccttgattaataattgtatagttctagaatcgtgtttacaaaatagctttgagcaactaatgtctttaaatgctgtttactgcaaccctaaccctttatagtataactcctttgtactcccttgcatttattctgcacttgtgggtgtgtcttgttgagtacggtggttgtactcagtcttgctcaatttttcccaaacccagaagaggagttcctggaggatgaaggctttggtgtctagctcgtgcctgccgtcaagtgcttatggtcgtcgccctagtcttccgctgtttctcgtttgtcttcgtgtgtgctgggccttcgctgcccatgtaataaattaactatttacgcttccgcttgttaaactctgaattgtatcaacttttggtgtaccttgcctcctgggacaaggattaatgcacgcacgtaaggaacgcccgttgggttatttccggtcgtgacaatatgagagaagtgagaaacaccacagccccattctttgtgctcttgcacaaggaggtcctactttcaactaacgatttaccttcatcgctgcctagtgttgttcttgatctcttacaggacttcgaagatgtttttcccgatgagataccagctggacttcctccactccgtggaattgagcatcaaattgatttggtaccaggtgcttctcttccaaatcgtccagcctaccgcaccaatcctgcagagacaaaggaaattcagcgacaggtaaaagagcttttggacaaagggtatgttcgtgaatccttatcaccatgtgctgttcccgttcttttagttccaaagaaagatggctcttggcgcatgtgtgttgattgtcgtgctctcaatgctataactgttcgatatcgccatcccattccacgacttgatgacatgttagatgaattgagtggttccatcattttcaccaagattgatttgcgtagtggctatcatcaaatccgcatgaaacttggtgatgaatggaaaacagcgtttaaaactaaaattggtctctatgaatggcttgtgatgccatttggcttgacaaatgctccttcaacttttatgcgcttaatgaaccatgttttacgagctttcattggcaagtttgtagttgtttattttgatgatattctgatctatagcaaatcatttgatgaacatcttgatcatatccgtcaagtacttgctgttttgagggaagagaaattgtatggcaacattgctaagtgcaccttttgcacagaccgtgttgttttccttggctttgttgtttccgcagatggtattcaggttgatgaagagaaggttaaagcaataaaggattggcctacaccggtaaatgtgagccaagttcgaagctttcatggtcttgcaagtttctataggcgttttgtcaaaaatttcagcaccctcgctgcaccccttaacaatctcacaaagaaggatgttccattcacgtggggccatgaccaagaccaagcatttcacacactgaaaacaaagctttgtgaagcaccgctgctacaacttcctgattttggtaagacatttgagatcgaatgtgatgcaagtggtattggcataggaggtgtactgctgcaagaaggtaaacctgttgcctacttttctgaaaagctaaatggtccacatctgaattactcggtttatgacaaagagctttatgccttagttcgcgttttggaagtttggcaacattacttgttccctaaagaatttgtaattcattctgatcatgaagctttgaaatatcttaaaagccaaggcaagctgaaccgtcgacatgctaaatggattgaattcattgaaacatttccctatgttgtccaacataagcgtggtaaagataacattgttgccgatgccttgtctagaagatgtgcattgattacacaactagatacgaaagtgcttggtttggaatccattaaaacactttatgctgttgatgctgattttaacgaacctttctctcgttgcattgatggaaaaggttgggataaatattatgtgcatgatggcttcttgtttcggactaacaaaatatgcattccagcttgttcgattcgtcaagtccttttgcaggaagcacatgccggtggactggctggtcattttggtgtcaaaaagacattggacatgccctctgatcatttcttttggccacatatgcgacgtgatgtccagcggcacgttgggtgctgcatcgtttgcttgaaagctaagtcccgcctcaatccccatggtttatatactccattacctattccacatgtaccttgggaagatatatctatggactttgttctggggttacctcggtctcagagggggagggattctatttttgttgttgtagatcgcttttctaaaatggcacattttatcccatgtcataagagcgatgatgcttcacacgttgctgatttgtttttcagggagatcgttcgtttacatggagttccaaagactattgtttcagaccgggatacaaaatttctcagctacttttggaagacattgtgggctaagcttggcacaaagttgttattttcaaccacttgtcatccacaaacggatggacaaacagaagttgtcaaccgtaccttgtcaaccatgttgcgtgctgtgttgaaaaagaatttgaagctatgggaagactgccttccacatgttgaatttgcttataacagggcagtccattctacaacaaactcttgtccatttgaaattgtttatgggtttataccgcatactcccatggatcttttgcctttaccattacaggaacaagttaacttggatgctacgaaaagatcagactttatcaagcggttacatgcggagacaagaaagaatattgagaagaaatcagcacaatatgcaaagcaagcaaacaaaggtaagaagaaggttacattccagccaggagatcttgtatggttgcatctatgcaaggatcgctttccccaacagtgtaagagtaagttatcccctaggggtgatggtccgttcaaggttctccaacagataaatgataatgcttacaaacttgagctgccacctgaatattccaatgtgagtaccacattcaatgtcaaggacttgcttccatttcctggtgagcctgagtcgaggacgactccttcccaagagggggaggctaatgaagacattcctagcattcactcatctccaaatgaagctacacttgatatagctggtccaattacaaggagtagagctaaacaattggagaaggaaattcattctcaggtgaacgctaaccttatgcttaataatcagattacattgaatgaacctatgcttttgagtacttgtttcaatgttcttaggaatgatggagtgcacgaacaagcatgggatgatgatggattctgcccgccaaatatatgcaaggaacctggacgtgcatgagagaggaaagaccattcagctaccatgaatatcagccattgaagtgcaagcaaataattcgggagttaggaatgcatgcaaccagcaactgggttgctgtccacacacgctccagcatgcatgcagagaataccaaccagccaggtgtcctactaggcttggtttttaataaaagtagtgctgcaacttcccactacatgttctcaattattttccaccaagctgaaactccactagtgctatatatccctgtaatggatgacgtgaacagtaactcgtgattgcaatttcagaataccaactcttggaattcttgttccagcgtgagtcttgagaggcttgcaaacttgttctttcgattcctgagggagttgtagaacgccgaactgtggttcacccagtttgtgccttcacgtctatacggcgtaattgcgtgggctgttcgtcggtacgtggaagggtgattgtctcggtagttcgtcgcgtggacagcctcgcggtgcattgcctcttcaccaggtcacgcaacgacaatttatcaagttcgcagatcctacgagaagatcgggccacaacaacttgctacacatgctgcatagacgtgtgcatatcactagtgtttccgcttgcatggccggcctatcatgccgccgttgttgggcgtctacatcctcaccgaacggccgcctcgtccaccgccgactggtgtttccgcttgcacagcaggcctattatgccgccgttgttgggcgtctccgtcttcaccgaccggccgccttccccgccgccactggtgtcctcgcctgcacgactggcctattatgtcgtcgttgctgggcgtctacgtcatcatcgatcggccgcctcgtctgccgccgactggtgtcctcgcctgcacgaccggcctattatgccgccgttggtgggcgtctccgtcttcaccgaccggccgccttcgccgcagccgactggtgtcctcgcctgcacgacaggcctattatgccgtcgttgctgggcgtctatgtcttcaccgaccggccgcctcgtctgccgccgactggtgtctccgcctgcacggctggcctattatgccgccgttgttgggcgtctacgtcttgaccgaccggccgcctcgtctgccgccgactagtgtctccgcctgcacggctggcctattatgccgccgttgttgcgcgtctacgtcttcaccgaccggccgcctcgtccgccgccgactggtgtttccgcctgcacggctggcctattatgccgccgttgttggccgtctacgtcttcaccgaccggccgcctcgtctgcggccgactggtgtcttcgcctgcatggctggcctattatgccgccgttgttaggcgtctacgtcttcaccgaccggccgcctcgtccgccgccgactgatgtttctgcctgcacggctagcctattatgctgccattgttgggcatctacgtcttcaccgaccggccgcctcgtccgctgccgactggtgtttgcgcctgcacggctggcctattatgccactgttgttgggcgtctatgtcttcaccgaccggccgcttggtctgccgccgactggtgtctccgcctgcacggctggcctattatgccgccgttgttgggcgtctacgtcttcaccgaccggccgcctcgtccgccgccgactggtgtgtccgcctacacggctggcctattatgccgccgttgttgggcgtctacgtcttcaccgaccggccgcctcatccgccgccgactggtgtcaccacctgcacggctggcctgttatgacgccaactgatgctatcttcttcacggctggctacatcgccgtcaccgctaataggcgtcagcatcttcaacacaagctgcctacgtctgctgaccgactggtttcttcacttccatggctgcatgattctctaccactactgatggacatcatcgtcttccatcgccgactggttatgccgctgccgactggtgcttttatcttcacaactgcacgtcttcactaccggtttgcttctgttgccaccgactcgtgttcacttcatcacggcaatgcaactttgtcatcatggtagagtgacttcatctttattatcttcggcaccggcaaactctattgctgctacttcgcaagttttgctactgcaccaaccacgacatctttgtgaacctcgacatctcgtgatgcagcaacgggggttcccgatctttcgatgagaggaggataaacttcgatttggggaaggatacgacgttggcggtccgactacaactaccacaggggtgctgcgccttagcaaccggtacaccgactccacgttgttgctgttcttgccgtgccaagaacaaccttgaacctgcaagcaatcgaagaacaagcaagaacaagttgacaaggaaacagctcacggcacttgtcaaatgatcaaacttaaacaaaccaaaatggggttctgaatacaagtatccgggtggtctagccgacacacgcgagtacaaggaagtagctgcagctaaacttatatcaaaacaaaacccaaagtgcaaaatggtggctgctaggagtttatataggtggaggaatgaccacgagaggaggtgggagcaaaccctaggttttgtggacccctaatgggctgtaatgatacaaggcccaagcccaagtttctgatgtaaagaactattttcgtcattctgagcagcctgggtcaaagttgatggtgaggccacacatagctgaaagtagacgacgagatctttccaacaagtactcatttgccccgtttgtcctccggagtgaagagcattgacttcatcaaatcagcgctgctagtgctgcttgcgatttggttcctctcccatattcctaacaacaagtagatcacaacaaccatttagtagcacccaattctgagaagaacttgtatgattagctaggaatgactttacctgataattaagttcacgagctcgagctctagtcattggtccttgctgtgcaataggcgtggttgtatcgttggaagggatgtcctcatcatctcggcatgcgatgccgtgttattttactacaacaagtggctctccaatattcaggatttctacttggacatcttcaacgcatatcttcaatcaagcaatgactactcgatgacaagaagttacagttctcgactctatgttcagttgtttcccaactaaccaaagagtcgggggctacacaaatacaagactctcaaaattcgacaagctgaagtaatcaattaatcagccaacgagtcaattccaggagtcattatcttcgtcttcgttttagagcagagttatcaaccaatcagctcagtttcgacgagttggacaacatcatctattttcctccaagtgaagcatctgcaacagctataccaccaatttgatggattattgtcactgacatcatcaccagcacctctgcttcatcggccctgacatcaactctgttgctaatggatgactatgtcttcgccggcttattatttcactttcacggttactatcgactggatcaccgacatcgttatcttcatcaacatcctatcaagcctcttcaacatagcccactctactgctattgatgggcaacttcgtcattatacttgatcatctatgattgctgcttatcatcattactgtcggttgcgtttgtcgtcgccgactattttcttcatcttcataattggtggatttcgtcatcgcttttgatgcgtatctacatcttcaccgtcggctagctttcgtcaccaccgaccgatatactcgccttcatggatggcttattatgtcaccactaatgggcatcttcatctacttcaccagctgcatcgtctgtcaccgactgattattttgctgctatggctacacaactttatcgctggacgccttcatattcattgctggctgacctgactgttgccgactggtttcttcacctccacggctatgcaacttcatcacttttgattggtatcactatcttcactactaccaatatttttgccacttctggtgggcaatattatctctatattggtcgtcttgtctctatgccaactacgccagctactatcaatggaccattgtaactacgacagaaggacaagctatatgatcaggggcttactatctcaaacacaagtatcataccttcaatttggacttgttccggatacatgcaacatgaattcatgatcatgggtctattttctatgctcaaagactggactatttattattccccgtaagggttatcaaccgaatacttgcgccagtcgggattcaattattatatattttgcagtatctcataagggataatcactcagatcagaagctattcatatgagctacacttggtctatatcacccagaagatttattactcgggagcatattacatgcgtcatactttaaagggtgtcgaaggcatattttttggcctaggcctaatatgtctgcagcccatattttcaggtgtggcctgtcacgttcttttagggacttaggcactttttgcttaggccaaagtgcgcgtgatctagtgcccaataccttaaaatccttttataccgcagttactcaactttttaggagttggtacaatgcatcttaaaatgtgtcaaacagtaaagctttatatagctgccccggtgacttttttatatagtcatggcgctgtttgggtttatcaagcaattgattggatacaatatcattgctttttgccacgtaagtgtgcatttttattgaccaatattatggcttaggctgattatatattttggtcattttccggacgattgataaatccttatgagtttatttactcggattttataccacatatgccatatatttccaggtgtggtgaaaccatgtgtcttttagggactcaagcacatctgttaaagcagtgtgcacatggtgtatgcccaatactttggaaatttatttattcacaacatacaagcttctttatagctgttttgctatgtgtattcaatgatgtagtcagctttaggttgcacacatcatattttacaaagcagtcggtatatcactcggatcatgttattcagggattcacaccgcatatgccatatattaatattaagtcacttggttgactacaattatcaaaaccactcagttggtgcatctattaggtacatctattcgatgcacctgactttatttttcagccctccataatcttcatatttggtaaaagtactcgggagatcatggcgaagatgattgaagcactcggctttggagtaatctagttcgagagaagattatctttccgactgtgaaggtctcaggggctactgtggagattatgggtaccccatacccacacggcatggttagccgactagtcataggggatagcttatatatatggaatatgtaaccgatcatgtcttgggtattacgtttccttttatattatggagcggcctaaagtcttgatttgataatattgtaaaatagatttaggaaaccgataccgtattggttaaggtttctatcttgtaatcctgccccccatcctatataaggtgagcaggaggccctctagggggcatgacacaaactgatagtcagatcaatatacacccggcggattcaaatccccaaacaggagtagagtattacctctcatcgagagggcctgaatgtcacgcccggaaattcactagtaatttccgaacttatttgtgcataaaatcctcgtccaggaatcagccgaggtacacaaactgacaatttaatatacaaatccatcataataataacgttacacacttacaaaagaaaagaaaacagcagcggaattacggtctagagaagctccggctccactcccacaggcagctcaactggggtataagccaaacgtcttctccttctggatcctttttcttcaactgaggttgattgattattgcaagaataagcatatgacatactgcacaagccacacagcaaatatgcaagtgcacaaggataccaaaggatggcataatataggctcatttgcaaaagcagcatttagcaaaacatttaagaggagtaaaacagtggagtaattaatcagaaattttaatcaacactgaacagcacacccatgctgcacaggcccaaccatcctgaacaaccatacccggctgtacagatctaactccaaaccaggagctaagcaaattattaccagatataacatccataattattgtgagaggtgtgagactaatcacgaaaaacattgctcaacccgcccataaccgcgggcacggctattcgaatagttttactctggccagaggtgtaccactgtacccacaagacacaaccccacatcatgtcaccatgtgcctcaataccaccacggtacctcggaaaggagttgtgacaataccccttgcacaacataatccattacagcgcacctttcctggatcataatcacccccttataaacaaggcatggactccccagcgacccccgtggacttctcgccacttctcagtctggcgcactataatgaatcacgctacacaaaagataaagccgttgcccacgctggcttgtggttggcacgataaatgtttcacaacagtagctcgcgaaccggtccttaattgtcatgagcacgactctcaaaaccatgtgctcacaacccaccattatcaagttttagttggcaagtaattaattaaccaatcacgattaaccatcgtgaactatcattaagccatccttaaataatagtgagtcataagttatcccaatagtgtgctaatgtttctaagcatggctaagcaatcataactaatatctagctgaaccaatatataaagcccaactagtcaagttataataacccaaggtatcaaggaataaagtaatcaatgcaaattggccataacaaaggaataagttcacaccacccggtgacattcgaaaataaatgcacagctgaaataaatagagaatttaaatataggatcaacatgctcaaaggattgtgtttaggatctgtgtgacttgccttgcaataatcgatcttcaattaatcttcttgaatacttccggtgcactcacgaaccttcgcaacgacggaaacgacaagctaacacgcaaaacgaagaaaaagactaataaaaaccaaataaacagtacatataaagtaaacaaacatgtagatcctgattttagatgaatttagcaacttgaaccactcaaaaccgagttacgatgatttagttatgaatttccgaagatttaatctattagaaaaacaggaaaaagaaaaaaacgatgatgacgtcatgatgatgacctcatcaatggccggaccaagatggcgacctcgccggagatttgatggtcggcctgcgactttggaggacatgaacacgtagaggacgacgagacgaacccaacggtacccaccctcgaaccaaacgacgaacgacgacggccggcgacgaggtctagcggcggcgcagcttcggtcgacggcggcgacggggctgcggtggtaggcggcttcggggagatagcggccgagcttgcccacacctcggcgcaccttacggcgatgacggcgaccggcgacgacgacggaggcggcggcgcgacgcgaatggagctcggccggcgacgacggcggggtggagcacgtggcggcggcgctacgaggcacgggagaccacgggagagggggcaaacgaaagaggaggactagggggtcctatttatagccttggattgaagagatcggactcctcccgcaagaaatcgatccgggaaatcaaaaactcggttttggagataaactcgaaaacgagttcgattcggacaagatactcaacgatttgctccgatttttgggggtaaagatagaggaggataagaggaatatttcccctcaactaaattttagaaaaacacaaggggaaaggtcagatttggaggagaaaaaccgagccaaatcggtctcagttcggctgctagaggtagaagataaacagtgtcgagggaggcaaattagacttttcgtcttgggctggctgaaaacaaagcaaagaaagaaagagaagggggaagctcggctgggccgacttgggctgcacggccgtgcagacaaaagagggagatgggctggaaagggcccaagactaggaagaggattattattacttttccaattaaattaatcaatgaaatgatctttgaattgttaaaaatacttcctatgctcaaataattccaagaaaaatcttgaacatacttgtacacccaaagtatttaaaaatattaaaaacagaccatttaatgattaatttaatatgtgggtaattactgaaatgctctttgtatgattaaaaattaagaattgagctccgaaacatctgagaaaatttcagagagtgtaattaatcatggagaatttaatgaaaattaaatccatccatgctttatatttaggaaattttatttcccacatttaacttcacttgtaaattaatgaacatttaatataaattctaataataatttattaaataatttataaatcctgaaacaaaaatcaggatgtgacactgaacctgtctaaatcctttgtctccacatccatccacttttaggtctcgtgcgctacccccttttctatattgccgaaaatttgtttcgacaccgattgggacttgggatagcaaattcggcaagtggtcgccgaattgggaaggaccgttccaaattcataaagtagtgtctaaaggggcttacatgttgcaaggactcgatggagaagtctatggaagagcattgaatggcaaatacttgaagaaatattatccaagtgtttgggttaattcatgatcggctgatgttgccgatacatgatagccgatgtatttgcatcgcctcgagatgaccgatattgcccttagttgtttttctattgtaatcggttgtggtttgccgatttacaatggccgatattattatatcacccttagttgtttttctactgtaatcggttgtggtttgccgatgtacaatggccgatattgttatatcgcccttagttatttttctatcgtaatcggttgtggtttgccgatgtacaaatggccgatatcattgtgtcgcccttagtcgttcttttaattttatcaatgcttttgacattgtaaaattagggggcacatatatggaaaattgcaaatttttgagcaaaatatggagttaaattgaatcggcatgacagttattgagataagttacataaagagttagaggtccttagccgattacaaaaatttctaagacctattacataggatgtcactgagacaaatatcgctggatagccgaaatagctctttgcctaatttgctctacttcttcaatggctttggtgtcttgagcatcggttccaaggatgattttcaaagacttggttagatcagcaacattcttgatagccgatttgagtcttaccttctgttcttcgatagattttgggagatcagctagctttttatgttccatgtccagttcagcatcacattcttcaagttgtgccaagagctcaatcttgcgagcttcgagccgatcaatattggacctaatcggaccctcagatagctgatcaagtttggccttttcttcatgaacaagctgccgattggtttggattgtagcttcgatatcttcacgctcccgacgttcggctagtcttagcttggctttttccaacttgaattgatgctgctcgagataaatagctagagtaaggatatcggctagctcatctgggattagagcttggatctcatgtagccgagtcctaattggcacacagtttaccaccaagttatccagtgattatgcttccagccgatgagagatgtctttgagggttttcttcacatcatcggacaggggaactaaaggtttgctggtggtatcttcttctatttcttcgtcaagataatctttaatattgaaagaaaaaagattgactaaagcctacaaaagagaaatttgaagatagttagatattaaataaatatagccgatctaggatttggtgttcgaaaggatacttactgggatagcaggagcagttggttgtatttcctcctcaatatgatgactccccacagccgatggagttcggtcacttgacgattgctgtacagaaggagaaggaggtggaggaggctgtaaaaagggacaagtgttatatagaatcggctgagatcaactagtaaaagaattgagaatatcttactggtggagccggtttgagaattgttgctgctggtttctttttctcggcagctttcttcttctgcgactatagaatcagtgggtaatcggctataagtaaataaatagaaagaattgaaagaagttggttacccttgaaaaatgagctggagcagaaggaatcggaggagtttgcttgggcgaagccgatggtgtttcctcagtgtcacttacattagctgcagcctagtcaacatcctcgccaatttcttcttcatccagagcttgctcgatggatggatccaaggcaggcagctgttgacagaaaacacgaggcctgggagatcggcttaactccagtgcaggtccaaaactcaccttcgggtgtgttagcgtgccagttgatttgatcctgcaattaataagaaatagagacaaagaaaccgcagttaaatctataaatgatagccgatcggctaggtgccgatgacatatcatttatctttgagccgatgtcatatgtgaatcgatcggcggttgtaaatagacaataaagaactaaatctattcgatcagctgtagatattaacaacatatagttcctatatcaatatatacttaaatcaagtgattggggtagatcggttgccatgccgagacagtataaatcacttagattgaaatatatattaataacagccttatatatgtttaaagcatagctgatcagatagatctagcatgtatcggctaatactccgatactactctatatcaggatattgaaacaagtataatgtatcaaacaaaagcttaatatacttaaatgcaaataagatcttgacataaaggacagatttaacatatcgctgaagcatatagagcaaatacaattaaatcaggtaagatcagctgaaactccgacgctaccctaatcggcgaccagaaggcaggctagagattgatattctaagcacgacttaatagatcaaactcaactgatgcagcattaagtatgaaaagaggaacaatatctagacaatcaagccgctggaagtttcatagagtggtagatatcttatataatctaggtcaacgtcactatttaatccaatcggttgccttctgttgacagatgttagccgattataggttagatgacgatattgtcgaagattatgtaagatatacgataatttgacgaattacatagacaagattagagtatcataaagatggaagcactaatcccgaggacagaatccatcataacaagttttacctcttgttgaagatcgaaactgatgcagctcaacttgaaagcaagaactcatcgaaataaaactaaagcaacaaggtggtgatgcgccgagattgtattgaacgtgtgtgttcttcaagttacatagggctcgggtctatttatacccgagaattacaagatatgtccataacggacacgactatgatctctaacaaactctaagataccataagtctttgcagcagacttttgcccaagcatatctataaggaaattacataaaatatcctaattaatagatacaattgccttctcaaacctctatccatgtgtggcaatcatcttgaagtgcctcaattcaacccgacgtcatacatcaagttgtattgtcggaatcgactgcatcggcttacctagtccgactcagacctagccgatcctaatcgtagccgatctggactccagccgattcctgctctgttttcgaactcgatctctgccttcgacttcacttcgatctaatcttctttcccgatgccgatattaccaattttggatgttaacacatgccccccaagtctagaatatttggtaatgtttcggatttgctgtaaatcgactctgagcaagtttcgcactttgccgttttccgaccgttactgccgtgctttaaatactaaccgttaccctcgagaagtctcacacagtcctcctccgttttcaccgctgaaaccaactttgttctctctctctctctctccggcgatctccccgacgtacaaagcaatccccaggcgatttcgttcctgatcaaatctccacctgcggcgatgtcgtcttgtaatgccctagaaaaaaaatagaataccgtagaggatatattggaagttcctaaggttttggtgtttgaaattagaagaaaaacaaaaggtatatgctagctaggctagcttttggccagcccaaggcccagctgccccctggacatcctcaaaacactaggagatcccctccccacctccccctagccgtcttttggtacccctgggcgcccacctctccctctggtcgacctccccatgggtgccctactgcagacctaggaagaagaagggaagaagaagaaagggaaagaaggaagcggagggaattgagatgaagaaggaaatgaggggttttggttgccgctgcccatggaggcctaggtatctaatacatgatcctttccccctgttttggttttctattagggtttagatcaagtgttggaagcgagtaagtttgggatcaaccgatttattcctcaactgggtttttttgctgatctgccaccctacgtagttctgccttggctgccttttcggccaacataatgggatttcctgtgaaaagtctctatacaaaagttgtagataacgtgtagatctatcttctgaccaaatggcatgagtttatatcaagtggtttaggaggtatcaatttctgaatttggctgtctgaatatcgatgcatttttctgtagtccaggtttagagggattttagaggatcttaatgatggaatcagagaatcttgtgtttacagaagttgtagcatatgttttgatatacctcctacataaaaattgttagctttcatcttgtagtttgttgtcagtgctcttttgaatggttgttgcacagttttctggtctgcacttctctgttttgtgccatgttttaggcccgctaaatggaagaattcaaatttgttctgtagatgtcagaaatgatatattttgctgtgttatgtgatgtagaattggaggtatcgaattgttaatctatgctgcttttatcggaagattatcggtgatttgctttatgttgtttggggtgggatcccagcgtaggaagcgtatgtgtgattcttgaatgattatgcatgttgtttgagtctgagccggtgtttattctaggtgatgccacttcggaatgcaactagagttcatctcatcatcggtgaaggcaagtaaacgtagcagtggtttgctacaactttgacttgttatttgattctacctccacgttgaaagtatatatcatcaaccaagattattatatgttacaccgaggattttcctatctgaatcatacttattgtttttacgctgtttatggttatactttatgctcttggttataataaccttatactgatctcaatcgaaggaatgtcgttctgttgttatactctggaattcatactgcatttgcatgacatgcattgcatttgaagttatgtcgtgaacctatggttgcgactgtaccggtatagcatcgtatattgccgtaatatgatgcagcttcacgccttgttgggtgtgaagccaggagtacatatcattgcattgcatatgcacatattgtaggatgttatgagaattatcgatcgatgatatctttgagaagtgttttcttctctgggatttgtgagtatatggatctgattggtgacgctatgaggttttagtccttggatattgaacttgtctttatgtgaatcataacttggtatttaattagttatataataaacatgtggtttaaatagcttgttaaagccgtttgcttgctgagtttattctcaccccccttagtcttttcaggtacttgctgtgacatgtttgtatgaagggatgggattagctacacagtcacacgacatgatctcacttagacatgagtattgtaatatgctgataagattacttgtgtttatatataatgggctaattaattactagagttgttgaccattggtaaactacttttttcaagcctatccctacatgtcagtcaattgttgtatcataactttaatctatatgttgctgcttccgcgacgttttcttgtctaaggtagttgttgccgaaatttgattgttttggcacttatgtatggttgtttagtggcatctcaggattatgaggttttctggggtgttacacgtcttccaccagcccttctattgtgccatcggccgagtacgctgaggtaagttctcactggctagatcccttttcctcgcatcaaatcgatttctccttttctcatcatgttttctgcttcccgattcttttggatttgcagcacctttccaacctagtcgcgattaccagcctttcgcacaagaaccactattttcttggcccaatcggcaatcttgacccctctgatttcatcatcggtgaaaccaacatgatcccctttggactagccaaccctaacctgggtcactggaagaataccttcaagtcttggccatctctcgaaaaacctactcctgataagagctggaccacctggtaccaacgcgtatcggctagtaagaaagttcactcggatgagattgagatcagccaagcgctcgctctcacgatagccaattctgctaaggatgaacctatgatggctgccgccacctatttctggtccaacaccatcaataccttcttattcaaccaagggccgatgactccaactttgatcgacatcatcatgattactggattagatgtaacttcatcagctaaccctatgagtatgaacaccaagaaccaatttgacttcaagaccaaaagcataggtggctggtctggctatgtggcggcatatatgggccaaggatctgttacccctcgagagcatgtagctttcttgctcatgtggctggaaaagtttctcttctgtggatccagttgtggccctataaccaactggcaatttgtagccgaagccttagaatcaaagaaaagatttccattgggcaaaatccttctcggctatctgtaccaaatgttgaacaatgcatcggctaaaatagccgtcggctcaatagtcggagcaggtggaccattgtggctgctacaaacttggttaaacctgatagtcatgaaggttgtcaatcggccctatgtgacaagataaattcccattgccagagccgattgtagaagacgacggagaagagcgcacccatcgcagatgcatgtcatatggagaatatgcatccacaccaaccgatgctgaagcaaagctatcggctgagctgctcaaggaatggttctgtagcttctacgaaggttttatgaaagatgcacggatcaggtttccttatgaagactcagcagaccttgaacttccatcagactttagatttgaagacattaatcatgaaaaattccaaaaatccagagaagttcttatagctgcaatcagcccatgcatccttcctgtcggcattcaccaagggagaaacatccaagtctcctacgagttttatcacccaatgagctcggccaaacaacttggattgggccaactcccaatcggcttattctttgccgacaagattcagtaccgaggacaaatcacatccactctaatgatggatcggctacttaacctactaggaccccctctaggcagcattgataatattgagttggcaggatttagaagcaaaaactttgacagatggtggggtgaatggaagttgcatctatttcatcaattggcttcaatgtatttgacagatctattccctgacgtcataccccaggtaaactttgtcattactaaattgcataatcggttagccgattcattacatgactaatcttttgctcctattttgcagacaacagagtcctccccttcacatcaaagtaacagtggcaaaaacattgaatatgctccaggtctaattccgaatggaggtggactatctccccccattatcggctaccatgcccccaagacttcaactctccttcacggcctaaccagggatccagccgatgcaggcaagaaaaggaaaaccagatcatcggccgtgagtaccttggccttagctccaaagaaaaagaccaaattcaagaaaactcaaccgactgataagccgactgatgatttgcccgccttggatccatctattgtacaagctttaaatgaagaggaaattggtgaagatgttgaccaggctgtagccgaaatgagtgacacagaaagaacaccatcggcttcacccaagcaaacgcctccaactccttctgcccccgttcattttacaagagtaagtatctctctttgacttcttctgaaattacttccctcttcggctaattactcatagactttgtggttgcagaaaaagaaaactgctgtgaagaaaaagccagcagcaacgattgtcaagtcagccccaccagtaagatgtctttaattcttttacttaatcaaactcaacctgctctatataacacttgtctattctacagcctcctcctccttctccttctgtacagcaattgtcaagtgaccagactgcatcagctgtgtggtgtcatcacatcgaggaggaagaacaaccagctgctcctgctatcccagtaagttttcctttgtctcaacaattagatcggctacattttacccagctcttactctttccgaaattgtctctgttggttctagccggtctcttctcttttgacatcagagattaccttgatgaggcagaagaagacacttcaagcaaagctctagctcccctatctgatgatgtgagaagaacacttgaagatatctctcatcggctagaagcctcttctttagatagtttggtagttgactgtgggtcaattaggacacggctacatgaagttcaagctctgattcccgaagatttggccgatgtccgaactccagccgcttatctcgagcaacatcagttcaagcgggaaaaagccaagctaagactagccgaacgccgtgagcgcaaagagattgaggccacaattcaagctaatcggcagcttgtgcgtgaagagaagaccaaacttgatcagctatctgaaggtctgatcaaatccaatattgatcggctcgaagctcacaagattgagctcttggcgcaacttgaagaatgcaatgccgagctagatatggaacacaaaaagctagccgatctcccaaaatcaattgaagaacaaagggcaaggctcaaatcggctatcaagaatgttgctgacctaaccaagtccctgaaagtcatctgtggaactgatgcacaagatgcccaagctattgaagaagtagaacaaattaggcaaagggctattttggctatccagtgatacttgtctcaataacttttgtgtgataggacttagaaatctttgtaatcagctaagatactctagtactttactgtcttgacaatcctttgtgccgattaatatgacttcaaaattcgctcaaaaaatttgcattttgatatatatgtgcccccctaattttataatgtcaaaagcattgataaaattataaaaacaactaagggcgatataacaatatcggccattgtacatcggcaaacctcaaccgattacaacatgaaaaaacaacgaaaggcaatataactatatcggccatctcaaggcgatggaaacacatcggctatcatgcatcggcaacactagccgatcatgcgttaacccaaacacttgggtaatatttgttcaagtacttgccattgagcgcccgtccatagacttcaccatcaagcccttgcaacatatatgctcccttagacacaaccttataaatttggaacggtccttcccaattcggcgaccacttgccgaatttactatcacgagtcccaattggtaaaatcaattttcatacaagttcaccttccgaaaaatcttttggcaccactttcttattgtattgccgagcaacatgttccttatccttggtaatctttgcaggtgctcgcaatcgtgactgaacatgatcctccctctcatcggccataaggttgtaatactcatcagctgttaaatcagtttgtaactccgttcttcgagagccgattctaacttcccacggcaaaacagcctcatgcccataaacaagtttgtaaggagggacttggatcgatccatgacaagccatcctataagaccacaacgcttcagccaaccgagtatgccattgccgaggataatcagaaattttctgcttaatcaatttgatcaaacttttattagatgcctcggcttgcccattagcttgtgcataataaggtgaagaattcaataatttgatacccatgctatcggcaaactgaacaaactcgtcggacacgaagattgaaccctgatcagttgtaatagcttgaggaataccaaatcggtagattatatgttcttcaacgaattgaattgcatctctagaatcaactttcttcaaaggaatcgcctccacccacttgatgaaataatcagtcgtcaccaatataaacttatgtcctttacttgatggtgggtttctcataccgatcatatcaattccccaacctctgaatggccatggcttaataataagattcatagccaacgtcggcgctcgctaaattgccctaaacttctgacaatcttgacaccgcttataatatctgaaacaatcctccagcattgtcggccaaaaataccctgcacgccgaagtaaccacttcatcttatgagccgattgatgagtgccacaaattctttcatgaacttcgccgactgcaactttaacctgatcggcactcaaacacttaagtaatactccatcaatcgttcgataataaagctcatcatccaacagtgtatattttaatgccttatatcttaatttcctagaagccgattaagatggattatgcaaatactgatgcacatcatacctccaatcatcggctgtcattgctgcaacttcaaccttaacatctttgatcatcgacttataccccgatgccccttgggccaaatcgttagcttcaatattttgttctcgagacacatgcttcaaagtaaccgaccgaaattccttcatcaattcttgtcacttcttattataaaccattaacgtatcattcttacattcatattctcctgccaattgactgattaccagtaaagaatcccccatgatttcaatagcatcggcttcaacttccttgagtaattgcaaccctttgagcactgcctcatactcagcttgattattagtcacatacggtttaatagtataagcaaactcgaaacatgcccccctaggggaaagtataactaggccgataccacaaccatgagtacacaccgatccatcaaagaataaagtccatggcactaattcaaccgagtcgattgaatcatcacggtgttccacaataaaatcggctatagcttgtcccttaattgccttcggcgactcataccgaagatcaaactcggttaatgaaaatatccactttccaacccttcctttcaatattggagccgataacatgtatttgacaacgtcggccttgcatataacagtacactcgttggatagtagataatgcctcaaccctgtacacgaaaaatacagacacaagcataacttctccacaggggaatatctagtttcagcatccaagagccgacgactgagataaaatacaactcgttcttttccatccaactcctgaatcaagactgagccgattgacttctcaccggccgacagatacaatctaaaaggtatcccttgctgtggaggaatcaaaacaggaggagagttgagatattctttgatattatctaaagctttctgttgttctgccccccaagtaaattgctgatcggccttcaatctcaacaatggtgtaaaaggttctaactttccagataaattagaaataaaccttcgaacaaaattaatcttgccgatcatctcctgcaattcggtcttgttttccgggggctgaatcttcttgatcgcattagcattaacactcctttgagtcacctcaatccccctctcatgaacaagaaatcccaaaaactggccagccgatacaccaaaagcacattttgtcggattcatcttcaggccatattttctggttctctcgaaaactttcctcaaatcggctatatggtcctcaacttctttagacttaacaaccacatcattgatgtagacttcaaccaaccagccgattagatcatgatatatgtaattcatggctctttgatatgtagccccagcactcttcaagccgaaagtcatgacaacccattcaaataagccgattgcaccagggcatctaaaagctgtcttatgaatatcttcttcagccacaaagatttgattatatcctgcgttaccatccataaaactcaaaattttgttccctgacgcagcatcaaccagctgatcgactactggcattaggtattcatccttcggtgtggctttatttagatctcggaaatcaatgcacaccctgaccttgccattcttcttaataactggaactatactagaaacccattcagcgtatcggcaaggacgaataaaaccagcatcatacaatcgtttaattttagctttgacatgttcaagcatatcggcttgataggtaaccgatgttctacaatcgatcggctgagtcctggcatctcaaaatactcccaagcgaagcagtctctaaactctttcaagagctctatcagcttagttctaaattctggagataagttcttactaatatatgtcggtcttggccgatcgctaggacctatatctatttcttccaaatcatcagccgacatgaaaccttgaccttgcttgtcatcgagatcatctaccgtatccttagtgtagacatttgaaccctccacgacgccctcaaaataatagcttgggttctccatcttcaattggctgtatatcagaatcagacacttttagaaaatctccatcccaaacttttccagataaacaatcaaggtcatccatctcccaaagagctaaatcggcactggcaacattaactgacctgtcggctggaacgatctctatcttgtcgccttgccactgaatcaaacattgatgcatagttgaaggaatgcaacaattggcgtgaatccaatcccttccaagcaacaagctgtaagaacccttcccatcgatgacaaaaaacgaggtaggaatagtcttactgccgactgtcagctccacatttagaacacctttggtctccgatggattaccaccaaagtctttgagcaccatatttgtcttgatgagatcttcagcatatctacccaacttcctgaacatagcaaaaggcatcaaatttaccgcggccccaccatcaaccatcattttagacatcggcttccattgacatagccgtttatatacaatggtttaagatgctgattctctgtcccctcaggtttctcaaacactgcctgttccggtgacagaaccaacttagctgattcctcttccacctcgtcgacatcgggttgatcgatcccgaattcggctagcaaggtaaagaccatgttaaccggtgcagtcacaacactcttcccttttgccaacctctttgcctcatcggctgcaacattatcggctacaggaacctgatttttaacatgccactcctgccttggctttgctttcttcagccgatgattaatttcttgttcaacctcctgaaggtgctccctgttcctcaatctctgaacccttctcttctgattcttcgtgaaaatactagaaggacaccattgattcttcctgattacattgtcctcttggccatgatcttgatttactggacccaatctttgatgaacagaaactcttgtctgccttagccgattgcacccagggcagttttcaatagatggcaacctcataccttcattccagcagaatctagagaactcacaaccccaatgaggatcaaaaccatcatcgtattcttcatgatgcttctcctgctgcttgtcatacttcctctgatatttgttgataatcttagccgaattcacctgaaaaccccttgcacgggccctatcggctgtttggccagctgtatgcaccatattaacaggaaaagggttaccatcgaccttcatcggctttttggaatcatcaaacctaatcttgcatccctcaatggccacctgaatctgctgtctaaaaaccttgcaatcgttagtagaatgggacccagaattatgccatttgcaatacctctttttgcctaattcctcatccgatgggattgtatgaccagcaggaatttgaatttgcttctctcggagtagcagatcaaagatcttgtcagctttagtaatatcaaaatcatacttctcctcatttccagaactttttacccattgacacggtatgacctttttactcctcacccattcggctgcagctatttcagaatcgtcctcgtcatcatccgacccatacatgtaaggacaaacatgattaaccttcttagagcttttcctgacttccacagacctatgctcatgcaaggttaccttctgtatcagatgtgacaagctatcaaagtcttcagacgagaatttctctctaatcggagcaatcataccctaaaaggccagatcagctaactgggcatcagttaaactcaagctgaagcatttgttcctcatctccctgaatctctgaatatactcgtgcacaggttcatcatgccgctgcttaatcgccatcaagtcagataatttcatctcatgaaccccactgtagaaatagctgtggaattgcttctccaaatcggcccaactattgatcgacccatatggcaaagaggaaaaccaagtaaaagccaatctagacaaagataaccggaacaacataaccttcagagcatctacagccgatgcttcaccacactgagctaagaatcggctaatgtgctcataagttgacacaccatcttgtcccgaaaatttggagaaatctgggactttgaaccgattgggaagaggaactctctcaaaccactcagggtaaggctgccgatacaagcttccagtctcttttggtttaagcccaaactgttccctcattacgtcagcaatcacatcggcccacggtcgtttctgagctgctccctgcgactgttgttgcatgggctcgaactaaccgtattgagatgcaaactgaggttgagccagtccccctggctgatattgggcttgcggggaaggagcctgatattgataattcaagttgcccccttggtaattatgaaggttcggctggatattacgtactaagtgttaaggaacaacttgaggcattactgtgccatccggctgtacgtggtgaacaagtgttctgggacaacttgatttaaaaattgttgtacaggctgaccactaggcgttgcaaacccggccgatgcgctcattgaaccttggtgctgaatcggctgaaccatctgctgtcttaatggcgtctgctgaatcggttgtagaggctgttgctgagctggttgcatgacctattgttggattggttgcacagcctgttgaattgggagtgtttgttgaattggctgctgctgtattggatcaacaacaggttgaggtggcagaaacgtggcagcaacctgatcttgggccagccgattcgcaacctacccactatgctgtggccgctctctcactaacaactgagggttcaccggctggcctggcaccaccgctgacagagcaagtagggtagttgatgccgacgtcatcggctgagctgttggtgcaacggagggaaccgcctgaatagatggctgaacatcggtgatcaaagaccgataatttggaaagacacctccttgcaaataaaccgggcctgcagcctgatgctcagctattgaaccatcggctattgacttcatcatgtttgataaggtattgactaacaccccggactgattgatcaaagcatgatgcagagcgtagtcaacccggtcttgggaattattgaaaaaatcttgtgccgcgtcactattctgattaagatgtcctccctgcaacccctgagcaccatcaccttaaactccatgcactccgtgatcttgcactccatggactccttgagaattgtcgccttgatttcctaaagaaccgtcggtagcacctttgtcactcggttgagccgagccgtctcgagcttgtttcccatctccatccttagaagaactggtcccaggatcatcagcaaccacttttattttgtacttctgaacaagtgtccccttgcgggtctgcatgaatgagttcaagaactgatcccgtgcttgctgcaacattgcttcaaactctttcttctgctcaggtgtgaatttttctggatcgattggcacgatgtttccttcattgacgtcagtcaataataacttctgcatcttttccttaacagagccagggctagctggggatgctgatggtggtggtttctcggccatgaggaagaattgttggctgacttcttaaaggtcccactggacgtgccaaaagcgtgttgactgaaaacatgaggcctgcgagatctgcttaactccagtgcaggtccaaaactcgccttcgggtgtgttagcgtgccagttgatttgatcctgcaatcaacaagaaatagagacaaagaaaccgcggttaaatctacaaatgatagctgatcggctaggtgccgatgacatatcatttatctttgagccgatgtcatatgtgaatcgatcggcggttgtaaatagacaataaagaactaaatctattcaatcggctgtagatattaacaacatatagttcctatatcaatatatacttaaatcaagtgattgggatagatcggttgccatgccgagacagtataaatcacttagattgaaatatatattaataacagccttatatatgtttatagcatggccgatcagatagatctagcgtgtatcggctaatactccaatactactctatatcaggatattgaaacaagtataatgtatcaaacaaaagcctaatatacttaaatgcaaataagatcttgacataaaggacagatttaacatatcgctgaagcatatagagcaaatacaattaaatcaggtaagatcggctgaaactccgacactacccaaattggcgaccagaaggcaggctagagattgatattctaagcatgacttaatagatcaaactcaactgatgcagcattaagtatgaaaagaagaacaatatctagacaatcaagccgctggaaatttcatagagtggtagatatcttatataatctaggtcaacgtcactatttaacctaattggctaccttctgttgacagatgttagccgattgtaggttagatgacgatattgtcaaagattatgtaagatatacgataacttgacgaattacatagacaagattagagtatcataaagatggaagcactaatcccgcggacactatccatcataacatgttttacctcttgttgaagatcgaaaccgatgcagctcaacctgaaagcaagaactcatcgaaataaaactaaagcaaaaaggtggcgatgcgccgagattgtattgaacgtgtgtattcttcaagttacatagggctcgggtctatttatacccgagaattacaagatatgtccataacggacacgactattatctctaacaaactctaagataccataagtctttgcggcaaatttttgcccaagcatatctctaagaaaattacataaaatatcctaattaatagatacaattgccttctcaggactctatccatgtgcggcaatcatcttgaagtgcctcaattcaacccgacgtcatacatcaagttgtattatcggaatcggctgcatcggcttacctaatccgactcagagccaggcgatcctaatcgtagccgatctggactccagccgattcctgctctattttcgaacacgatctccgcctttgacttcacttcgatctaatcttctttcccgatgccgatattaccaattttggttgttaacagcaggtcatcagtcgacttaattttcttggatttggcctttttctttggagctagagccaatgcgtccacagccgatgacctagtttttcttttcttgcctgcatcggttggttccctgatcttttcttgcctgcatcggttggttccctgattaggccttggaggagagttaaactcttgggggcatgatagccgatgacagggggagatggtccacctccattgggaatcaaacctggggcatattcaatgtccctgccactgttgctttgacgtggaggggaagagtcgattgtctgcagaataggaacaaaagattagtcaagtaatgaatcggctgacaataacttagattaaataatctaagttaatagatctgtcatgtacatcgaggccgattggtgaaataggtgtagcttccattcaccccaccatctgtcaaagtttctgctcttgaatcctgccaactcaatgttttcaatactgcccagagggggttcttggaggttaagcagccgacccatcatcaaagttgatgagatttctcctcggcactggatcttatcggcaaagaataagccgattgggagttgacccagtccaagttatctagctgagctcattgggtgataaaattcataagagacttgaatgtttcttccctaatgaatgccgacaggaaggatgcatggactgattgcagctgtgaaaacttccctggctttttggtatctttcatgattaatgtcctcaaacataaattctgatgggagatcaaggtctactgagtcctcatagggataccagactcgggtatctttctgaaagccctcataaaaactgcaaaaccaatccttgagcaattcagccaatagttttgctccggcatcggttggtgtggatgcatattctccatatgacatgcatttgcgatgattatgttcctctccatcatcgtctacagtcggttccaacctcggaaattcagcttctgtcatagatggccgattgacaactttcatgaccattagatttagccaggtctgcagcagccaccatggtccacctgccccaactactgagccgacgactatcttggccgatgcattattcaacatttggtatagatagccaaggaggattttgcccaaacgaaattgtttctttgattctaggacttcggctacaaattaccaattggttatagggccacaactgcattcgcagagaagaaacttttccagccacatgagtaaaaaggccacatgctctcgaggagtaacagatccttggcccatatatggtgccacataaccagaccaaccacctatgcttttggtcctgaagtcaaattggttcttggtgttcatgctcatagggttagccgatgaagttacatctaatccggtgatcatggtgatatcgatcaaagttggagtcatcagcccttggttgaacagaaaggcattgatggtgttggaccagaaataggtggtggccgtcatcagaggttcatccttagcggaattggctatggtaagggcaagcgcttggtcgatccagatctcgtcccagtgaactttcttaatagccgataaacgcttgtaccatgtggtccaactcttctcaggggtggttttctcgagagatggccaagacttaaaagcattcttccagtgacctagattagggttagctaatctaaagggattctgttggcttcaccgatgatcaaatcagtggggtcaaggttgccgattggaccaagaaagtaatggatttcatgcaacaagctaggaatcgcaactagattggagaggtgctgcaaatccaaaagaatcgagaagaagaaaacaagatgaggaaaggggaaatcaatccgatgcgagaaaaggagatctagccgatgaaaactcacctcagcgtactcagctgttggcgcggtagatgggctgacggagcatgacattaccacaggtggagatttgaccggagatggaaccactttggaatcgccttttgcgtagaaggaatcaccggagagagagagagggcaaagtttgcttcagcggtgaaaacggaagaggacggtgtgagatttctcgacggtaacggttagtatttaaagcacgggaataacggtcggaacacggtaaagtgcgaaacttgctcggagtcgatatacagcaaatccgaaacattaccaaatattccggacttgggggcatgtgttaacaactaaatttagcaatatcagcatcggagatgaggattagatcgaggtggaatcgaagacgaagatcgattcgggaacagagtaagaatcggctggagtccaaatcggctacgatcaggatcggttggatccgagtcagactaggtaagccgatacagccgattccgacaatacgacttagtgtacgacatcgggttgagttgatatgcttgaagatggttgccgcgcatggatagagtcctgagaaggcaattgtatctattaattaggatattttatgtaatttccttagagatatgtttagggcaaaagtctgtcgtaaagacttatggtatcttagagtttgttagagataagagtcgtgtccgatatggacatagtttgtaatttttgggtataaatagaccccgaaccccatgtaatcaattaacacacacgttcaatacaatttcggcgcatcgccacccttttgctttatttttatttcgacgaggtcttgctttcgggttgagctgcatcggtttcgatcttcaacaagaggtaaaacttgttatgacagcttgcgttctcgggattagtgcttccatctttatgatactctaatcttgtttatgtaattcgtcgagttatcatatatcttacataatcgccggcaatattgttgtttaacctattatcggctaacatctatcggtagagggcagctgattaggttaaacatcgaggttgacttagattatataggatatccaccactctatgaaacttccagcagcttgattgtctagatattgttcttcttttcatacttaatgatgtatcagttgagtttgatctattaagtcgtgcttagaatatcaatctctagcctgccttctggttgccaattagggtagtatcggggtttcagccgatcttatctgatttaactttatttactctatacgcttcattgatatgttaaatctgccctttatgttaagatcttgtcgcatttaagtatattagacttttgtttgatatattctacttgttttaaaatcttagtatagagtggtatcggagtattagccggtacatgctagatctatctgatcggctatgctatgaacatatatagtcttgttattaatatatatttcgatttaagtgattcatactgtctcagcatggcgaccgatctatcccaatcacttgatttaagtatatatcgatataaggagtatatattgttgatatctgcagccgatcgagtagatctagttctttcttacttatttatgactgccgatcgatacataaatgacatcggcccaaagataaatgatatgtcatcggcatttagccgatcggctatcgtttataggtttaactgcggtttctttgtatctatttctcgttgattacaggatcaaatcaactagcacgctagcatacccaaaggcgagtttggacctgcactggagttaagcagatctcccaggcctcgtgttttccatcaactcctacccgcgaacccccctacccctctcaccatcccccgtcacccccaccacctacccaccagtgtcaccactcgccacccatgcccatccacctctcacaacccacaagatgtaccccataaccgccaccgccaggacgcctttttttattctgaccacaacttatcgagaataattcatttactgaaatcgtagagacgcacacgcctcaattagtaacgcgtttactaggccaacagttctattgccgcagcccatgatcggtcaaaacggaaacggctgaaacaaatcgccgcaaaaggggcagtttctgttttagtctctctcctttatcctcaccgtcaaccgtccacggtcatttcccactttccacgctctcctccccgtctccgtcgactccacccctcgccgatttcgccgcaatcccttcaccgggtacggcggcacgcactcccctcacccacattctagttgccgacgaccgcggcggccgcatcgaggaagtccaccgtgccatcggcggcgcctagccgcggccgaggcggaaagcaccccgacggcggcacctagccgcgaccaaggcggccaccaccccggcgaccctcattggtacgcgcgactgaggaatcaacacacgcacaccagagctacactgattttagcaaaggttagtacaagcatctacactacctgtcatacacatccatttctccgatctaatccaatacccattgttcagctacattttttaagatgaagcggaagggaaaaatgccagagaaggttaggagagtcaagttcatggggtcgcaataagaatgcaagattgtgctcgatcaatcctagccgagtgagggcccaactacccgctccaagcgagctcgtgcagacggaggaagtcaacaaggaaccgccaaaaaacgtggccgcaagaaccagtaggatagagccctgaaggacgctgcacttgttgaggtgaggcacactctattctttctcaaaaaccctaaccctttattccctttgtttggttgctgtccatttatttctgcgtgtgtggttgtcgtcttatatgattgggattgatgtagggaccatggtactaccaaatctttctgtttttgtcctattcataaatccgacaggagctttatgttctgtgacccaccatatttttcccccacttgatctaaatcatgggtaatgcttttcatataattaagggttaggattaaaggtaagaggcagaatgcacggttacgatttagggctgtcttttggtgtgtgggaattcatttacccaacacattagccaaacagggcaatagtgtaggaacatactcagtgttagtaaatgcattactctcatcagtgttagtaaatgcattactctcagtgttagtaattgcttaccagaggtgagatttgaatactagtacaactagactttgaaatcaaatcagggtactgacacatgttcccaacaagctagtagtgagactgaaaactatagcaaaaaatgattacagatgatcccattgtcgatgctatcgaggctcctccattcgcttagttatcatgtgaaagaaaattcatccctataaccactttagttattcaattttatgtcctaaatgctaaaccatatttgtattgcagctgctagcgacaaagcaatctgtctttacacgctgtagcccgaagtttgcacacgatgcatgtcgtgcgttgtcgccgatacaccgacaagctttggcagcgcttggtctgggtgagcttgcaaagatgactctcaacggcttggagcagcctgacctcacctgctggctaatggatcgcaaagacccaaaatcgatgaccattgacatatttgagaataagaagatagtcataactccatggaaggttaaaattgtcttgggggtcccattgggaggggattcattcactggtggagaaaccatctttggtcggtcggccgaaatccacaatagtcccggatacttttataaaccgggactaaagatgatctttattcctggttggtggctacaacgggcatatgtgatctttaatcccggttggtaacacaaactgggactaaagatcatctttagtcctggttgtagagatgtcagacgttgtcagggcccccgggattaccaaccaggactaaagatccccccctttatatatgccttcttcctcctccagcccgagagcaagcttcaaaatttctcaaagaaagaggggagatcatgccaaaattttttgtgaaatttttttagtgattatatacaaatcggaggtgtctagaacgttagtaacttcatcctccaatgttttttggttgttatattacttttggagctacgtttcacacatttttttttgtctccaaaactttgttgtaagtttatcagacagaaaatttgtgtggggaagaagaatatatagaaattttattctcatagttttaaatatgatgaaaattaatcttaaaaaatagaaaacaaactaaattgaaaattaagagaagtacaacattaatattagtttagaacttcaaaaattgttaataagaattgcttgtcgaatgagtttttaattattttatcattactgtttgactgtcattattgtacgaaaatttatttatgtacgatttttttttatttcatgtagatggatcggcaatggatgtacgctgaccggcggtccaaagagtttatcgagggcgtgcattatttttcgagagtggccaaagctaacaagcgtaacggttttatttgttatccatgcaataagtgtaagaaccagaaggagtattctgcatccaggactgttcatttccacctgtttgagtcggggttcatgccaagctataattgttggacatcccacggtgagcaaggggttgaaatggaagaagatgaagcggaggacgagaacattcctgactgggctcagtacgctggatttgaaggaaatcaaacgggcgaggtggacagggatgctggcgataaaaacgctgcggatgatcttggtcagatgttgcaggacgcaaaaggaggactgtgaaagtgaaaaggaggcccataaattggagcggatgttagaggaccatagaacgtcgttgtacccaggttgcgagtaggggcacaaaaagttggatatcattctggagttcttgcaatggaaggcaaaaaatggtgttagtgacaaggtatttggcgatttattgaaactcgtcaagaacattcttccggagggaaacaaattgcccgagacaacgtacgaggctaagaagatagtctgccctctaggactggaagttcagaagattcacgcatgtccaaatgattgtatcccatatcgcggtgaggagtaccagaacctagaaacatgcgctgtttgcaaagcactacgatacaagattagacgagaggatccaggtaaagttgacgagcagccaacaaagaagagaattcctgctaaggtgatgtggtatttccctaatggaaaaagtacgaattacccccccgaactatgacgacagtttgaattacacccctaaaccacaaaaccagacattttataccctgaactatctataccggactaataacccacctcaacccaatccaaagtggtatcgtcctacgtggcgtccacgtggcaatccagtcagcaattttttttaaaaaatggtggggtccacctgtcatactctaacacatctctcttccctcttctctcaatctctctctgtcactgtcttaaatgtcattggtggccggcgatgggtgcgcggccagcacggtcggcgcagcgcttggcgcggcaaacagcgagcgcggcgggtggcgggcgtggcgggggtgcggctggcggcgagcgcgggggcgggcgcggatggcgagcgcggcgggtggcgtgcgttgcggngtgcaccggngcgtggtgggggccgttcatccctctagtgtggccggggtgccgccggccgtggtggacaggtggccgtcacgcgtgaatggacccgtgccacccctgttttagcgcggccttattcttacgtttatcagtgtccttcacctgtgtctgtataattatcgtgatatattctcgttccattcgcagtgctctcgtcctttcttgttctagaacccacacggctactctttctctcactctcgattgacacgtgca

SEQ ID NO: 68197 - DNA, 7306 bp, Oryza sativa
ccgtgctcacggcgaggagctcctctcctccctccttccctatgtcccgcacggctgccgctccctgcgctcgccatcgccttcggccgccgccgccggcctgtgcgccgttcgccaccgcctcccgcgccgtcgcttgccgttgccggcgctcgcgcgccgccaccggtcaccgccggtgaccgcgcgtgtcgccaccggccgccatggccgccggtcagctttgaagccgagccgagccgtgcctagccgcctccccccggccgtccgatcgcctttgaggccgatccggaccgtcggtcccgtggaccggcggtggaccacccgcgtggtcctggtccacggtagaccggccaccttgtgccgctgccagtggggcccacttgcccgagccccctctccctccccttgtgcgctgacaagcggggcccacctgtcggcgcagccgcccccccttggatgacgtcagccctgggtattattgcgcaataaattgattaaggacttttctttattaataaaaacacagtttatcttctaaaattcataagtaattcatccgagctccgtttaagtccattcaagtctcagtaaattcataaaaatgcaaagaatccattaaaaatggttttgtttcctgtttcagtagtcttatagcatgttttgcttgtgtgctttgtttgtcgcgtagatttcggccgtttcgtcgatctgcggtttctcgaagacgttgctatggtctcatcagtgcaagagcaaggcaagtcatgcattacaattgatcatattgtacccaatttacaaatgtcccgcatttctattaaatgttgcattcttttacaatgtcatgtgggatgggtcctattactcagccatatattgtttaccatatgccattgataactgggggtatcaaaatgattagatgttgatttaggaaatgcttagccatgcttagctcaactagtacacaaaaaaggatcacattattacatagactttgtctattagcatagttttggattggtgccaccgcagtggtgttagttaattaaaatacactgaatggtgggctgtgggtgcatggttttgctggtcgcacccatggcagttaaggaccggttcacgggaaaccctgggagacttaccgtgcttaccacaagcgggagtgggtaactgcttgatctaaagtatagctcgaccctttcctaggcaccggtggcgagggtgggcgtgatggagttgggtcggctggggtgtccggttgtccagctgccggattcaccgtggcgcaagaggggaccgcccactgccttttgaggggtagggtgcaaccttagcgtggtgtggatggttaggggagggttatgtggagggtcttgttacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcaccctagtttagcttaatgaactggtgtagttcaggtggttggttgggcctgttgcaacgtggtgtagcgttggacagtgattggttaatattgattaattactacagctgttttactgctttcaactactggttttaaatgctagctttgtgcaaaagaacccctagcctcctttggttatatcttgcatcatacctcctcttcctgtatgacttgctgagtacagtgggtagtactcagtcttactctcttctcccccgcaccagagctgaaggtctttctagttggagctgtcttgttgaagttggttttgtcgctgccgtcaaggattgcctgtggagtggagtcgccccgctgctgaagtcaagcttcccggtttagctcgcttttatcctttccgctgcatttgtaatctttatatttttgtaagacgtggatctgtatgtcaacaattgtcgtttgtgtaccctggctggtcctggatagggatttaatgcacattcagtttagaaattctggttcgtgaatttctgggcgtgacatggccgatgtgggaacaaagtcgtccatcaatggcaataaaaacaccagccatagaagcagcttgaggcgactgacgttgaaagtgaagacgcccatcaatggcggcataataagccagccgtctaggcagaaacaccagtcggcggcaacgaaggcgagccggcggtgaaaatgcagacgcccatcaacggtggcataataggccagccgtgcatgcggaaacaccagtcgacggcggcgaaggcaggccggcggtgaagtcatagacgcccaacaacagcggcataataggccagccgtacaggcggaaacaccagtcggcgacggcgaaggccagccggtcggtgaagatgtggacgcccatgaacagtggtgtgaccaaccaaccgtataggcgaggacaccagtcggcggcgacggaggcaggccagcggtgaagtcgtagacgcccaacaacgctggcataataggccagccgtgcaggcggaaacaccagtcgacggcggcgaaggccagccggtcggtgaagatgtagacgcccatgaacggtggtatgaccaaccaaccgtataggcgaggacaccagtcggcggcgacggaggcaggccggcggtgaagtcgtagacgcccaacagcggcggcataataggccagccgtgcaggcggaaacaccagtcggcggcggcaaaggccagccggtcagtgatggagtacatgcgatgatacatgcaaagacaagaaattgcacatcaacctgtggttagatatttgtaaaaagaaaataatttatataataactaatagatccaaacacatggtttgatttgtgcttgatgaagaggcttgcatgaccaacaacggtggtgtgaccatccaaccgtgaaagtgaggaaaaccagtcggcggcgacgaggctgccggtcggtgaagatcaagacgaccgtcagcaacggcataccatgccagccgtggggacgaagacaccagttggcaacagtagtgccgcggtattacatgtaaacatcagaaaataccaagagattaatatgatatttagagatcaatataataaatgatgctagattagaagggaaaaactctggtgatgtcaggattctaatgcccgcaagcaaccagaaactccgcagaactcggcgaccatgtgcacgacgatcgaaacgcggctgacgacagcaacaaacgcggccgacgcggggatgaggtcgccgcctagcagtatggagccagccggccggtgagcacgttgcccccggcggtacatgcaaaacaaacaacagaaattgattagcaccgtagagaacagatgcctatatacatatatacttgctataggcatgcatatatttgtgatgcaaggtctgtttgcatgctcctgtaatccagtcatgcaatgatcgttggcagtgcatgcattagattggtcagaaccaatttgtacgcttgctctggccattgtgtggtcgtagcatgcaccgtcgacatgtaggccaggtgtccgtgtcgtgtcgatgggcggcgaacagcgtgaggacgacgatggcttcgaccagtggtcccgccgataaccagcaaacaccccagccggcagtacatgtaaccgaggggaaaacatatcagagaatcaactgtgattatagatcaatctgataataatatattgaaacgacaaaccaattgatgttttgggtcgttgaactcgttgagattaatctcaactcttcttttggaattgattccatcgcgcttgtcgatggaaaactcgacacaacccctacctggcgcgccaactgtcgaaacatgaattcggcaataataaaaggggtagcggacgagacctaaaagtggatggatgcggagacaaaggatttagacatgttcaggccctctctctcgatgagaggtaatacgctacttctgtttggggattttaatccgcagggggtattatagatctgacgagatctagttgtctcatgccccctagagggcctcctgcccaccttatataggatggggggcaggattacaagatagaaaccttaaccaatacggtatcggtttcctaaatctattttacaatattatcaaatcaggactttaggccgctccataatataaaaggaaacgtaatacccaagtcatgatctgtacatattccacagatataagctatctcctatgactagtcgataaccatgccgtgtgggtattgggtacccataatctccacaagtctttatctctcctcaaatttctgtgtttttcctgtggtccaatcaaacggtcattcctatgttttttctgtgttttgcaattctctgttttacacttatattcctgtcagaattctatatttttcctatttctccgttttttcattcctgtgattcaaagagacccttaaattttggctgatcccatgattagtattctggtgctgcgttgttccgaatctcaaagcggcactcacgtgcgaagcaagggccaaaagcccaaaaccttctagaacgaaccgggtcgtctcctccaaaacccagcaagccaacaacctcagtggagctcacccttatcccccccagctccagaaccttctcctctctcctctctcgctcgctcgcttctcgcggttgtcgtcggcggtagcgagctcatggcgtcggtgcagctgtccgccggcccgcgggtgtcagtgtcaccggcggcggcgctggtggcgatgccttcggtcgccgccgccgcatcgagggggcgccgcgggtaccgggggctcgtcgtgagggccgccacggtcgtgtcgcccaaggtgaggcacagctgcaccccactcttattcgggagacctgtgacgtctatggtgttttgggtttctgtgcgtgcgttgctactgcttgcgaggtgcgatctggtgcctggatttggttcacagtgtggaagcgctctcaaagctcgcggtggcgcttgaagggattaggagatcatttcgttttgttttcaattgcagagcaattatcgtactggattggctggttatatcaaagacgcaaactaatttgttaacagatccaaaaataattgatgatgttctagtttcctccacatgtttgcggtgtcggtggtctgtgtatgcgtcttaaggaaccttagaatctatctatgcaaagttgacactgcctgactgccatactgttccagcaatgaacagatctgttagtaatgtttccacctaatcacagccaattcccacactcagcttaaagtttgagtctgaatttcaaattttatggtgatattaagacatgctgtttttgcaaagctggttcacaatagctgaattgctgttttggcatgtgatgctagtttatggtgatgtcttacatgtgtaaagctcctgctgtctatttggttcatcagctttattactttgcagctacatggagtggtggaccttgcgccaccagtttcattttatttcattctgtagcatatttttctcccctcaaaactgtttaggattaagttttgagcatgtaatgtgcgattccttgttcctttacctaagcagatggacttatgtcaaatttgcagtatacttctatcaaacccttgggagatagggtgcttgtgaagatcaagacctctgatgataaaactgttggaggaatattacttccaacatcagttcagtcaaaaccgcaaggaggacaagttgtagcagttggagaggggagaagcatgggcagcgacagcatagagatcagtgttccagtatgtgcttttatgttcaactagttttgctagtactcacagacacctgctagccatttatttaaaagaaactgttgcatggtgagataactattaaaacatccacgggacctgtaagagcaacaaggcaaatttagccaagtggtgcgtcattattctacttaaatttattctcgaaccatgaacacctttttgaagataattacccttatgctatctcaactatttctttttcctgaaactactagttttttgttgatacggttaccctaatcagactacttattaaatttgctggtcataaataatatataacctggttacaggttggtgcacaagttgtctactctaaatatgctggcacagagttggaattcgatgggtctgaccatctcattttgaaagaagatgacatcattggtattctcgacacagatgatgtgaaagatctgaagccactgaatgaccgtgttctcattaaggtctgtttaccaaaagctaatatagagccatgttttatcaccaagtgaattgttattgctcttttcctattttgcacaagttgcatctgcaaatcctggtccattccatactgaaactgcatccaaaagttgcatagactataggcttcatatctgaacaatgttcatgaatggcataaatggcagcacctgtcacattatttactccagtaaaactaggggaagaaatatattccttgggtcataaccttgatgacgtgtccttacatttgtgctttccagtctctacagggagtccagaacacttacgctcttcatggaagagattgaatccaaacctttggcaacatttcttgcaaccaatccaaatcttgtactaaatttgtctcctattggtaacaaactgaatatccctaccaaatactacctccgttttaagttataagactttctagcattgcccacattcatatatatgttaatgaatctatatatatatgtgtgtgcctagattcattaatatatatatagattcattaacatatatatgaatgtgggtaaggccagaaagtcttataatatgaaacggaggaagtaattagtagtgtcaaattcaaacttgcctaggttttggcaaccaaagaattggtagggtaaagaactaaccctacgatatattattccattctgccttcctgagttcaattcatctgcttaattctgagccaagcttctggcataatgtccgatcagtgaggttgtgcacatctcctaattgatttgtgctggtctgtcttatcgtttttcaatgggtctcttgtgttccagtctggaaacttcacaggttgatattagaccataaccattctagagtttcttttgattatgctcttgattgaatttcaatagcatgtgccgttgctttttgtttgatgctgcatattct

SEQ ID NO: 68198 - DNA, 692 bp, Oryza sativa
tagtcccggttggtgtactaaccgggactaaagatcaaatatgcccgttaccctttttaaccggaactaaagatcatctttagccctggtttttattgcatccgggactattgtggaattcgaccgaccgacgaaagatggtttctccaccggtgtttcaaccgttgcggatggcataccctaagctagtccaaaagtacatagtatatatagctgaagatgaaagtccctggctagttgcttgtatatatgctgaagtaagaagtgaactgtcggtttgccctccaaataaatctagctagcacacctcgagattcccaattaagtcaatcagtaataataaataattatgaacccctaattaagaccaataagaaaaaccaaacacaggaggaaggaacggagcaattaaatataagagtgaaagcgacagggcaccggagcgtggcagttgcgtaaattactccaaccctttctctccatgcatctcacctccacagcgacccaccacccttctttctgccatgccttacatttacatacatacccctcctctcaggctctcactcgcgctgcatgccacactgcttcttcttcttctctctctctagctagctagctagcttctctgtaggctgtagctgcggtggcaatggcggcggcaaggttgtgggtggttgcagtggcggtgg

SEQ ID NO: 68199 - DNA, 734 bp, Oryza sativa
tatcaagctcactccctatttttcccatacctaattgcatgattgatttgtgggcccttgcatacgcacttatcagtcatcactcatcatgaacacaaatcacagaggatccatcatccacgattaggttccccatccttctctggaaaaaaaaatatgatactcattaattaattgagccatcctggacagatcatattatttgtcaatggagactcaacgtctattttgtcatatggacagatcatatttcacaattacaagaataccatcttagtctgaacacaaaaatgcatgccctcagtattatttgctttcggatttcggtgttgatgaagttcaaagataattaatccaattttctactactctttaatttgtgcttttgaaccaattaatgaagtttacagccagtgtttacaaattttgttattttcatgctccacgtgatccgtccatttgtaatacaattaaataataatcacgatgattaattaaataataaccacgatgatgaattaattgaaatgaatgaaaataaaattgcatgcaggcgacggggtcggcgccggggacgacggggtacgtgaacatcacgtcgcacaagggcgggaagatcgacttcatctcggaggacgcggacgagagcgcgaagccgtcgaggtacgtgaagtcggtgaaggagatcccctacgacatctccgtgctccaggtgagctccggggctgcaggaa

SEQ ID NO: 68200 - DNA, 611 bp, Oryza sativa
tggacaccatatcggttagaaacagagattcatattgatcaagttgatgaggtcgatggccgatacagccgatacgtacggtttaacttgggctcggtataggcctagattggaatgattgtcattgccaattaaagatagagctcgattaaggcaattgtatctattaattaggatatttaagtcggttttcgttagatttggtaagaggccaccatatatggtcttgtttgtattttatctttagaaaggtttgagtcatgtccataatggactaagtctgtacttggggtataaatatgaaccccgtacaactataatacgagagacaatccaatacaacttcagcacatcgctaccctttttgttcttattttcggcgagttttctcaacaagaggtaacccgtctcaatggcttgtgctatcggggctattatgtcattttagatgttctagttcttttatcatgaccatctattatcatatgtcttcgttaatctagccttagtatctcaatttagcctatcggctggttctcgctttagggttcctgccggtatcgtctaaattgccttactagattagcttagctaaggcatcgggctgcagg

SEQ ID NO: 68201 - DNA, 600 bp, Oryza sativa
ttcctgcagcccggtgcgacaggcccaaccatccacctatactatccaatttcaatagactaaactagggtgagactaatcacggtgaatctggttgaccgcccataaccgcgggcatggctattcgaatagttttactctgattagaggtgtacaactgtacccacaagacatagccccacgacacatttccgtgtgccgacatgccaccacgacataccggaaagaggccgtgacaggacccttcgcataaccccctataaccaagcacaccacacctcaggtttcacccccagtcctcgcaaggtagcgggcagtccctctcgtgcctaggtgaatccggaagcgacagaggccgtcgcagggcccgccccgctccatcacgcccacccttgcctggatgcgtcagctagaggaaagctacactacaagcccagccgttgcccaggctggcttgtggtaagtacgataagttcttccagggcatcccgcgaaccggtccttaactgccaagggtgcgatcagcaaaaccatgcacccacagcccaccatgtgattcattttaattaaccaacaccaaagcggtggtactaaaccaac

SEQ ID NO: 68202 - DNA, 1656 bp, Oryza sativa
attcctgcagcccgaatcttgcgatcctactctccgttgaggagctccaaagagctgggtctcaattaaccccttgcctcacttgtgcaaaaacccctgaggaaatccacagccttcaaccccaaacacccctaggcaaatttctagaattgagtgaccaccaagatccaactcaacctacttctagaaatccaccacaagtgtgggttgctctacttggaaagcctctagaatctcagcacaagaacttcaccaacttacctcgttccctttcggaggagaggaaatccttcacaaacttacccgggacatccacaatatgcaacggattctcgcgggcgacacctaaccatctaggagatcatctccaagagtaataagcaccgagatgacagcccacgagatattccaagtgctcacccaagatcctagtcttcacacatctccaaatcttcttctctccctctcaatctctctttctcacaagaattaggctctagattgagtggagaagacaagaaacacttgggagaggctagcaatagctctaggtttgaaaaatgaaagtggaatggccaaggaacgagctggaatcgagctgtatatgtatgacggctaggtaacgtcatctagccgttactcacaaatttgaactggaaactagacaggaagttccggacctgaaagaccggaacttccggactacacttaggaaaatctttttcacaagaccggaacttccggacctggaagacaggaagttccggacttgcatttttggacagatggagtatttgcaaaaatgactcctagggaaacttgacacttggttcacactaagagcacttgatatatctcagagcatcacctggaacccctcttaatagtatagtttttcctaaaaactcgatttcaaaagataaactatcctatgcccttctcgagttccggtccgctttgattttgtacttttttgggggtctccaagcatccatcttccacaccttagactaatgcacctgaaagtcactcaatgaactcattagtcccttaaccacatttgtcattaatcaccaaaacccactagggggattaatgcactttcacctacatcccgaagaagctcctcctggcccgcgtggcgtccatctcgatccactccccctctccccacgtaggacatgggcttgataggcggcggcgttgggcgggagccagagccggtgttagaggagaagcggaggagcgagaggagacgatgcggctgggggtggtggcggctagagtgggagaggaggaggcggaggtgagccatgcgatggcggggcgtggcggcggctggctttgggcaggccggcgccgccagccgacggggcgaggccgagcggcggggagttggcggcagcagtgtcgacgtggcctgctcgccggagcgctgcttcgccctcgcgtccctccgcgtcggcgtgcaacgagctgcacgaggatgcgaggaggtcggcgatggcgaactccctgggcgcatcgcggcggtggagggcggcgaccacatctgtcgcgccgtggcggcgctcatccgaccgtccttccaccaccagcgccgccgcgctgccttccgccctcacccaagccacctctccgccatgtccgtcgccg

SEQ ID NO: 68203 - DNA, 1374 bp, Oryza sativa
gtcaaaacatcttatacggagggagcaacaaagatgcatgtgcgttacaacaggtaaagacaatttcacgattgataaaaactctaccaatttaaacgacaaaccgaaacaagacaaacaaaaccatggcaaaacaaagtcagaaatcatatataagtattgagcacactagcttcatgcatcatcatatgaaggatccttcatgtacactttcccatagcctcacaaattgatcgggtggctattctattatttgacacgtgtattttgctatacctcattgaccgaagattgtaattttgattattcaattagtgaaattattttactgtaaatggaaagtatttgcaaagtaataaacttgccgcatacacaccttaaacaattataatttcaaaagaaaaatatttatgagaagagaaattcggaagagaaaagaaaaatgagaaaatagacgagattgaaaggatcggaagagaattaggatgattgggagaaaaaagaaaaatggaaagagaaaaagatgccgatcgagggaggggctagtgcggcgccaagtgggggtgaggatgaggatgaggtgacgagatggtgtggactggttaggttgggctggtataatatttattctagactcacctcgaatcagaaatgtcgaccaataatcaaatcaaatacggaaaatgtatggaaatttcggacggaaatgtttttatttttttataacttagggataaggaaagaaacagagacgtagtagggattaggcgattgaacagtagtgaaaaaaaaaagaaaagaggaaatatctgctggccaaaatcattgtgtcctcgcctgagggtgtccccatcccatcccgtcggctgggcgtggaggtggagtcccgtgtcgcgagttcggccgccgctgccctgcgccgatctccatccccgtcggttgtcctgctgcttccgccgcatcctggtgagtatccatcctctttctcgttcatctctacccacccacttttttccttgaatttccctgcgttaattctagcttctcttccagatctggaagcttcttttctctcaattttgatcaccttacaaataacagtttgtttgttcccccaaaaaaatttacatcacagtataccatgtcccacgttagatccgtccatgggtagatgatgttgctatgttctccgatttgtgtgcaatagcgtataaaattcccttcaatgttccttcatccatgcgcaggaagaaattaaccgaaccattttagtgagatattgcgtagtttcgatgaagtttttgctgtactgtgcggggatttgtttgcagtgctatttgggttgcgcgaaccaacagcttccgggctgcagga

SEQ ID NO: 68204 - DNA, 19822 bp, Oryza sativa
gccaagaaggttagaactgctttgtattgtttattcagcatttcgccatcagtagtcatatcatgactagtcgacttttgaaaatttgttagtcagaactgttgtgtgttgtttgttcaaaatttctttagtttgtattttgcaagtggacactattctcagatttgccagcagttaatccctgtggatttaataatgctgtcaaatagttttttatagaggcgcttttcaaggagtcacctagtaacattagatgttcttaatttgttgtatgggtccatcgtttcttatgatatacgcagtgccttcaagtgtggtgtagacgtgtagttactcttgggttatgtagaacagggtgtgtttgtttaccagaaatgacacaccaagtacatgactggagatgctatgaaacatattattaactttgatagaactgggaagtgcaatcttgccagttacagtaatcattgtctatctcacatggtttaaaagcatttctttcaagacatattatacatgtatatgtctaccagtgtaccacacaatatggaaacatggagaaaataggacattgtactataacatatctgataccttggttcaattttcattttggactcttgtaccatttaaaagatgtccacaaagtttcattactgttcaaaagacatccctggccgaaacaacccgatttttcatgagcagactgtttttctaattattattaaagttggtcaatgtggacactgactgtgggatggagagtgatgggtggcttaacagtatatggagttgagccaaattccatgaaagtaaattttattgaaaccactgtttgcaattgaaaactctgttgttttggcctgagagattcctttgaatggttttgcaagttaaggggtatgttttaaaaagtactacctccatcccagaatataagcatttttagagttggacacggttattaaggaagtaggtaaaagtgaatgatggagggctgtgattggttgagtagtggaggtaggtgggaaaagtgaatggtggagggttgtgattggttggaaaaagaatgttggtgaagaagttgttatattttgggacaaatgttgagggctaaaagttgttatattttgggacggagggagtatgaattaggatggaaattaaactgtgacaggaggtcagatacatagaatggattttctcaagcagacataacttataactaggttgctaagagcagactttgccttttggaaaaaaaactgaatattttgagttgctggtcaatttctttaaaattgggtgttttggctgccaaaatatattcaagaatatacctgagtgagatgttttttgtgttcagctctgtttgcataccagttcaaactgactcttatagttgtaaggtttattttggtcatttactttttctccttggtgctttcctttaggaagaaagcgatagagtgaaagccgaagttgctgctgctgcacaggcatctgcaatgctgtttgaacatacaagcttctctcccagtagtgggccacatggcgattttatgttctctctggatgactttgaaggtaaataaactcatttatgaacagacctgattttgcatattcagactttctattggggcaaaacacatacttgttagtgctcctaatccacattctgaagcattcacatgtttgcaattgtgcttttagttctctgcatgttgcatcctgtatggttggttgccctgcctcacttcatatgtgtgtatatattttccatttaagctcttggaaacaatgctggaccctccacgagtccaccagccagcgaaagaaagcttttctccgatgttgcacggcttggctttgcgtctgcccaagactcgcctcctataagagttgaatctggggatttgactggcaaaagtgaaagcacgggggaacaaggtatggtgacacacgatgcacctttggacgctggcacttaccagtgtgcggcagtgcccatttttcttctagtgaaatcctggcataactaaactgttttctatgcagggccagccgcaacacccgcattatcctttgccagcatcatttcctccactagagcgtcagacaatagcctggacacgcacaaaccaaatgtagtcgggaagaaaggcaagaaacccaccaaagtgctcttgtccactggcggtggccgccgatactgaaggaagagtgacactggaatggaagcagttgccagttggctgtttcctataagcagtgtgtatagtgcataacctggacttcacatctgtaacactcccaagtcccaagtagcagctttttctcccatgtggtttgatctaaatcgcctgactgttttagaaggtttttactgtgtatctacatcctgacccatgctaagggagtaagggtgactgccctgtcgcaaaatgagaagagctatgtaaaatttgataaataatgatgctaaggatcatgcgcaatactttgctcaatgtacgtcgacgagttgatccgtcataggctgatacagcctgctgtttaaatcgtgagatgctctgagtcatattttcaaaatcacggttacggggcatatatataaattataaaatacacaatatagaaggaaggaaaagcagaaatgcatggtttaatgcaataagtttcaaatgggatggaatgtcaaactttaagtaacttatgatgatatttatactaggagtattggcaatgtatggactaaatattgaaaaagtagcagaaattaatttctttgtttaaaaagcaacggaaatatgtgttcgatagggtaaagctaatgggcgatcgatcgctccaggtgatcgaccccatcccccctatatggctcctctccccttcttctcttcgtactacaccataaatctttttaaaaataaaaaaacagttagaaaaatttatgtatagaaatactatatatataaaaaatatttgaattcaaatttaaatttgaatcgggtattttgacttataaactttgggttaataaactttagatgtatagaaaataatatatataaaaattatttgaattcaaattcaaatttgaataggatatataaacttttgacttataaactttggctctctaaactttagatgtatagaaaatactatatataaaaaatatttgaattcaaatcaaatttgaatcggatgtataaacttttgacttataaactttgggtctctaaactttaggtgtatagaaatactatatatataaaaaatttgaattcaaattcaaatttgaatcgggtatataaatttttgacttataaactttagatatatagaaaatactatatataaaaaaaatttgaattgaaattcaaatttgaatcggataaataaacttttgacttataaactttgggtctctaaactttaggtgtataaactttagatgtgtaaacttgaggtgtataaattttagatgtataaatttactaaaaatagcaaagtaatacggtaccaaaaaagaaaaccacgttgaggaggagggggtgtcgccctgatcgcccttagcgatcaatcgcccattagcttttccatgttcgatatgcattcgagagtatcccgatacgcatttgtgtttgatacgatatctgatatggatatgcttgtttttagaagtatcgttttctctttttttctgtaataacaaattaaaatggttgtaaatttgtaattgctcttttattttttgaaaggcagcatccaatattggacatgactacacagcgctactacttcatctatgagaaatcctatccacctatacttcaaataaaaatttctcttaaactactcatccgatctacgatccgattacaccgtcgtgttcgtaattaaatctttgtagaaagatctcacatgattatattctgatgaaaaattgtaaattacatttataatatatcaaaattacttttagatttcactaaatcacttcttagatatatttttttagataatggaataaatatcccggcctttactcaaaagagctacagccaattattacatagacatataaaagtaaatttaataaagcctaaaagtaatttatatatattatagaagtaacttataataaaaagaaagtaactttaatatatgctttttttttcataggacgtgactacacaactagtggcagccgctccatctaatgtcttcttttaacttgaaaaatacaatagtgtgagtcttttttaacttcttcagattcgtgtactctagttgatgcctggactatgcacagatagccgggattcgggttgtcgaatctctgggcgtgacaagttggtatcagagccgatcttgaccgtaggacaaaccaaacggaaagcccatagagccctatgaaattctcttattcccctggaaatctcttcttccctccttttcaagtggtccagtgagtccaaataaatgagtttgttttcaagtttctgaatttcatcaaaaaaatatttttctttgtgccttttgattttttttaaaaaaaatgttttcggcatttcaaaaagaaaaataatattttcggaaaaaaattcttggcaaaaaaaaggaaaaggttttggcagaaaaaaagggaagggtttcggtttaaaaagaaagggagagtttcgtttttaaaaaaaaaattgggccaaaaatagtattttttaaaaaaatatttatattgcttcagtatttttgatttcagtttagtgccttttctttctttttgtttccagttttaatgccagcatctcgtttctgatcggagtcagttttgttccttctatcttttctttagatggccgattctccctgtactcaccatggtgaaggcatggaaggatttgttgcggagcttgcaaatatgacatttgttgccggttacattgaagctccatagtacacagttattgagcccctcaatggagagttgccatatagagttcgcttggaagttcgtggtattttgggcactcttctgattaatacggtggttgagacttctgaggaacagcagagcatgcttgcctggaagccacttatttggtggtggcggcggccggcgggcggtggggaggaggcgtgacggtggctgatctgacgaggacaacggcgacgacgaggacgacggctgcggcggctttgaggttagggaggaggcgtggcgatggcggatctgacgaggacgatggtgatggcgacaaggttagggttcggtttttttttatttttttttggttttttatttttgcgtgcgggcgatataagcacccgcacgcgaaaatcagattttcgcatgagggtgcgccacccgcacgcaaaaaatagcgattttcgcagacaactgggtgcgtgcggttcgcccactcgcacgtgaaaacccttttccaccgcacgaaaaaatccttttcgtagttgtgatttgtttacatgaataggtatgtgaattattggctagcaaaggattgtcgaggtccttttactattattttttcaaatggaaaattgtgctaagatagtctttcaccaatggacctggcactgatttggttttttgacaagttatcttgcccatgtgatagagttttacgttaacttaattaagataactaacccacaggagtccactctatcccaagcctaccatttagttgttgtccttcgaagaatttcgttcttagattatacacacacgtttactgtggatatgatacactgaaatactcttgggtgaaggctacaacggtatttgtgcgcttatagattattccgtggtcataataaataccaacagtgaggcgcggcggcggcggatacaacggtggggaggggcagcggctgccctaccccgcgcggcggcagtggggaggcacagtggcggtggatctggctctggctccggcgacgggagcgggcggacccagccgccgctaggcccctatgcccccacaacgacgacgaggagggcaggttaggtttcgccatttttgggttttaatttttttggatttttatttttgcgagcgggcgacataagcacccgcacgtaaaaagtcggattttcgcgtgaacgattttcacagaccatttggtgcatgtggatcgccctgccatccgtgaaaattgggattggaccgtatggaaaaacctgttatgtagcggtgataaatgaaagttgttgcacaatttttttgtaataatgaaaacttattaataaattatgagttaataatgacttttcgtgtttttttacggggtccttttcgtgttttctgtgcactaactttatcttccttccatagaaacaaacactgccttagtcgattctatcgaaatatacggaggtagtacgtacgtactccctccatcccaaaatatttgacaccgttgacttttttaaatatgtttgaccgtttattttatttaaaaaaatcaagtaattattaattcttttcctatcatttgatttattgttaaatatacttttatgtatacatatagttttacatatttcacaaaagtttttgaataagacgaatggtcaaacatatttaaaaaaatcaatgacgtcaaacatttagggaaggaggtagtacgtgggaggaggaaaacgtcgatcccatgcacaaccgtgtggggagggtcgcatttgcccgtccacttgaatcaacagggcccaaaaaaatcgaccgatctccgctaccaccactaccactactagtagcagggttggtccgagatcgatgcagcatatctgttccagagacagctacggccctacaaaacaatctccccctttccggagttccatcaatcatcatcatggtcgtcgtcgtcattgggcgtgagagaaaccaccagagatcagcaaagcgagcaagcaacaacggccatgtcccatgttacccacgtaggagtactaccacgcatctgcattggaatctagcagagcgtacaccgcaacaacgagaacgagaacaaattaagctatatgctagatcaaaaaaaggaggaggaggaaagagatacatacatcgatccagtacgtgatgatgatgcaagatagacagatagatagatagatagatagatgcacgaacacgagctaggcgcagccatccaaaagattttcgcggtacaccacgcgtgcgtgcatgcatggacaagcgtgcaagcaaccaagcgaaacgaagcaacgcaagcgcgtgcatgcatgccggagaggagaggacagagacaagctacatggtaataagagattctccatgctcctttctttctaaaataaacgaacataatacgtagtgtgacatcatcgatcccttcacatattgatcatcatataatactaaaaaatttaaattgatcattatataaccagtgccctttggtttgacgtgcaacagtattgtatttaggagaaagtctaaattacacctctaaactattaggtgagtacgaattacacctagatccgaaaaccagacattttttaccctcaactattaatatcaagtgaagaactctcctaacttaatctagagtggttttggtcctacatgacagtctaggtagcattttttaagaaatcggtgggatccatctgttagagaggggtgaaacggagagaatctgataggtggattccgcatattgtttttaaataaaatgctgacttgactaccaactaagatcataaccactccggattaagttagaggttcttcatccgatattaataattgagcatgaaagatgtctgatttcagatcttgggataattcatactcacccaatgttaagtgatgcgatttatgcatgcatgcaaattaagcatgcatgtatgcatgcacgcatttagaggttgttaagctttcattttttccatcacaacttaattacattaaataaaatatgtgatatcgagtagtgaacatgtgagacaatctcacatatctagtcaacttcagcctgatatgtgcctgtcaaattatatgaaggcgacgaccagatgtgttacacattcagaagacttaacaaattttgctaaaactctctacaacgtttcaaatgttctcaactcacattggttttcatgaaaaaacttatatatatgatgatcaatatagaataaaaaaaagtattaactcgcatgcgtcccagctcgatccatccatctcgtctgatgttgcaacagtggtgtacatgcatgcatgctagtaggtcaaagacatcagaggccactgaccgtgcttgctctcaggctctcagcttcttcttcctccacacacacacacacacacactctctctctctctctctacacagttacactgtacataacactgcatgttttctataattttattgccacattttgctgctaagctaatgccattttccaagagacaaattcagctagttgtgatggagtttttgaaatggtcaggttgattcaaggaaggagagagagaaagagagaggaggagggagggacaaggggggaacctttcctcggtttggcagaagaggaatctgcgcaggagatggtggcccaagagccgggccgggccagtggtttggtttgagctccgctagctgcatcagccagcagggacaacatgcaacaccaaaacacaccatacgagagagagcgatatgtagagagagagagagagagagtggccatggtagtaggttgatgttacctttccccctagcatcattcatcgatccccccctctctctcccccttggctgcagcagaaagctttcatcatttgcacctttcaaccccttcatgcttatacttttcttcctttggtcgtacaccacattatcacagttttccttcttcttttatcttaaacaaaaagaagatcaaggctggttcattcattaaaaaaatattattgtcttctatagcatcctcaatgcaacattgataaggaacacacaattacttatatagactcggtatacacatgtgaaacaggttccataggccttcggactatcgtagcatagaataccattcatgaataccaggaagctaggcatggttaattaaaactttcaccttgatcgctctcgacctctcgttgttttggaagcatatctcattattacagtatcattacttcactaaaaaggaagcggacaagccgtcaattactcatagcctaatacgcatacttacacgccagtgaatccagcgcacgaaaacaaaacctctctcacggcccccagatttacataggcgccggaaaaaccatcggcgcatatcacgacgctcccacccccacccgccagcaccatatcagccgtaggaagtgcaccagaaaccacccgataccttgggcaagcatacaagacgtaggaagtgaaccagaaaccgcccgataccctgggcaggcatcggcgtccgtccgttaatcccagcgcatactatgttggcacacagttggcactcgtccagacagactgttcctccaattccctccaccccctcctaaaccaaaccaaagaaccctataaaccaaaaccaaaaccaaaaaaccaccccaaaaacacccaagattggcagcagcaggagcaacaatggcagtatatataacagtggctccaaccaggcaccaccaccacctccacctccaccactgtagcctcacgcgtcatacgctgcctacgctacccccggggggccacgcgcaccaccaccaccaccgcggcatcggcagccgctgcggcagcaacagcaaaagcaaattcctttctcctcctccttctcctcctcctcctcctcctcctccttcttcttcttcttcttcttcttcctcgccgtccgtttggttcttgttggagagggggaggggtgggggggtggggtgttggtggtggtagtggacttgacgactgccccgaacatcgagatgatcgcctcgtcgctgcgcaactgctccctcaacggcgggggaggaggaggaggagggcggcgcagggggaggcgcgcggcggcgacggaggggagcgacgacagcgagggggtcaccgtcgagctcaactccgaggtcgccctgccctaccactgggagcagtgcctcgacatccgggtacgtctactactactcgcccatctcttcttccacacatgcatccatacatgcatacgccgcgtttccttttcttccccgatcgattcttccgacgtcggcgacggtggccgccggcgccccgccctttgtccaatcatttggagacataaatggatagcagtttccgaggtaggtgggtgtggtttggtttgggctcgattgggatcaatcatttgatcattaatggcgaaagcgggcgctcgaactggagagagagacgagacgagacgacccgtccgcgctgattttttttttcttcttcctcctcttctctttctgctcctcgtctcccttctctcttcttgttcttgttcttggatccttgcttcatctgcgattcctctcttcgtctatgcaaatattttttttatttatctctgttttttttcttcggttcttatcttcgtttggttggggattcgatcatcttcagagagattcaggccgttctttttaacacagggatgacaaaagttcagaaaagaaacctcggaaaagatggtactatttttttctttttttttgttgatgatatcaaggctcttcaaatctccacaccttctctggtctctgatctaagcgcgcattcagatctgtgttgcattctaaatttctgacacatccctgtagatccattcctttttgctctgtctctatctgaaactctagatttcgctatagatttcttctggaccacaatgctctgtttttttggtcctgggttctaatctaatcgcagagctttgttaaacaccagatgattctcacctctgggaaatcttcagttccattgtgacaaagtgtctccctttctttttcatccctgctagtactttgaacagacgaatgaatgcctaccccaatgaagattcatgcgtattaatcaccaaaatggagtgttcatctccaccttgtctccagcaacagagtagacaaaaatgctcttcttatggttatttcagtagccttttctgaagatactactgcaatacatttatgtgctttttaagtagaacagctttcctgcagattagagtttttttttttttacaaaggatgaaatgagaatttggtggtggtgttcttcattgccaaccttgccctgtgatttgcaaacaaacaagaggacaaagagagcagcattcattacaccatttgatccagattttttttctttcccctgttctgctgtactttgttatgggcatcagttattaataggttctcaaccttgtttcacggaagcaactgaatgccaccgcattaattgttcttgcagactgtcaccaaaatgtacttgtagattttccccacccaaacttctccatgcatcatgcacatttactcaccacattcttgaaacagcatttcgccatttgcaagattaacttaatctgtaccactagctgtctagttcaagcgcatttcctttattgttattatttttagatgaattttgatgtgtagttcatgacttcatgtgaatttgtgtgaaatgtgctttgtgattggctttgctgatgcagacggggcaagtttactacatcaactgggaggacggcacccggacgaccatcgatccgcgctcgtcgtcggcgtactcgccgtcgccggcgtcgcggtccgcgtcgtcctcctcccgccgctgctcgcgcgcgcggggccgcggcggcggaggcggcgccgccgccgcggcgtcgaccaccacgtcgtcggggtacacctccgtgtcgtccgtgggcgcggtcaccgcggcggcggcggcgtggcgctcgcacgacagcagcgggcacggctacggctacggctacggctacggcagctatggctacggctacggctacgacggccgcgacggcgacgacgaggagagcagcagcagcagtagcagcagcagcagcagcagcagcagcgccagcagcagccggggctccgccgtgtcgtccacgctctcgtcgttctcccccaccgacgagtcggcctccggcgccggcagcggctacgccgtcggcgacaacggcgcccacgtcctcgtcaccgccggctgccgggcttgcttcatgtacttcatggtgaggaagaccgccgacgtgtgccccaagtgcggcagctccggcctcctccacctcagccgcaacggctacgtgtgagcctccgccgccgccgccgtcgcccgcgccgccgctcgccgccgccgagttccgcaattcactaattgtaggggggccttctcgcaattgtgcatgctctgttagagagaacttccaaagggaaaaaaaatattgagagagagagagagaagagtttttggcgagaaggtccccaagtttcgccattattacctacattgcactccaatgtatgggaggagacccatctctagaattcttgttttccttccattgtttcttggttgtctcctctcttttttttttctttttcttttttctttttctgttccagtttgtgagactaaccccctttttcccccttcacatttccctttaccttttcaaggatgaacatttgtaaccctgatttccattcttgagctagctggagctggggtcatgcaacaactagttactaattagtgcattaaaaccatctgcaggttcttgtctggattagcagctgttgagtatagagcttgctttggaagttggcagggtgtgatgtgggtgccaagtaaagtgccaactgcatactgctggctggctggagctgtggctcgtggctttgattttggtagagagcatatattgatgatgcatcatggtgtgtgatctactactacttctatgtgatgtgctgctgccctgtttgcttctgcttgtgtgatattcttctggtgtgtgccttggaagcaagtgcatgtgtgtgtgtatatatgaattatatatatatatatatatatatatatatatatgtgtgtgtgtgtgtgtgtgtgtgtgtgtgtgtgtgtgtgtgtacacaaaccgtggtctatgctggctggcctgacgctggttttgttgtttagcatcctccttccccattgtgcccatccgtattctgacgcctgcacctgtcatgcatgttcccacaagaacaaaagagaaaaagaaaagaaagaaagaagaaatccttgtgaagaggttaaaggggataagggagagagagatttggtagttggattcttgttcttccaagagagaattaaattcctcttgctttcttactactatgatagtatgagcatatagtattttcctagttaggttcacgtgatgcagtttgtgcttagcaccattctagcctagctataagcactactgggactggaatgtttgtcttggtgttgtttatcctattcctgtggtttatgtctctagttacccacacttaatcatacttcttttttgtctcttggtagagatagttgccagttgccaccccatgcattgctctggggttggaggcagcatgtgcttcagtttagttgctaaaacaacaaggaccacttgcaaattggatactgcaaattggacattgcattttaatgagacagccgattctagaagaagctaccacactggtttaaattccctttcccctgctctgggtcctttaggtctatgaccatttttctctttggcctatattagtacaattatgctgaatagattgtaatagccttcccttcagaactgcgtaaccagtctatttgacaggtggacccacttacacataccacctcacttatacttccatcatcgcttcgtataaaaggatcaacccgggagtcatatggttgaagggatgaattctaatatgtcggttccactcttactaaactagcaaggtgatagtaaacatacgcacatagttatcataagtcacacatgctaaattctaattagaccaggatgctatgtagttgtccattcttctttttaagtttacaaactaggaatcttcgtttacctaggatcccttgttgtcaatggcagtggaagatagattacaatggacttagagcagatacaatagcaagctattaaccagctataaacatattttaatgagataaacgatgagagagaagagcagcgggctacagattcgtagccagctgcaacacggactccaagacgcaatgtgtatatgacaggtgggactatatattaatagtatagtaagcaactattgtatgaattggctattagtttagctataaataaattgaagatagtagtgagcgagcgagcaaaagctctagttgaaactaagtgagcgagcaaaagctagttgtatctgcagcgtgccagggtggctagctaggcagatacaaattggtcgtgtacagtgcagaatgtttttggctcgatttgtggagatcgcgacggtttggcaagtgcgataggggttctgcgtatggtggtcatggtctgatgaagtctcgtccttagatccgtacgtgtcggccgcttcatgtattttcaagttggctataccttaaaagttgatcatttaattaagcatgtttctctgctgccgagtaaggttttctaacataagagagaccacccaagagtcttggagataacctaatacgctattactttggttaattacctaattagttacatgattatatatatgtaaactagaaaaaatatctgtgtgttgcaacggataaaaacatttttgaatcgtatacattatactctttttgggccaaaagattatttcttcgttctatttttatcccagcctagcccgctacctctctcagcttggcgtgcgtctctttgacctagcccacgagtaaagctgtaggcccggctcgcatagccgactgtcgtctttaacaatagataaaaacattttcgatcactatacattatagcaactcatatagccgactgctgtcgtcaaagctcgaaagagtgtgatgctagaactgatcctccccatcaaagcccggaagagtgtgatgctagaactgatctcctatcaaatcgcatcgaatctttattgatcttctaaaattggttaagggtttgtgatgcacttattctactcttctgtttttatcaaaatctgagcgaatccataaaactcttaaatagagattagatctggtaaattaaagcggaattgaaaggaaaaattatgggaaaaataatgagggagtccggtaaattaaagcggcattgaaaggaaaaattatggagaaaataataagagagtagtgaggaatcgatttttactatcaattgaaggagagaatgcggagaccgatcgacatggcggtggagatgacgagaacaaacggcgaaaaagaaaaaaaaacagaacgttaaaagagaaaaaaacaacgggtgaaaaaaaaggaaaaaagaagcgaagaaaaaaaatggaggaacggtaaaaaggaaaaaaaagatgaaaataaaaaaaaagtgacggacaaaaaaacagaaaccttacgtattttaacaatatactagaaaaaatgcccgtgcgttgcaacgggtaaaaacatttttagattgctatatattttcctatttggttttggacaaaaactcatttctttccttccttgtcaagtggagctgtaggtccccgattctccccatcaaatctggtcaaatcccccacatcaaatccagtcgaatctttctcgatcttccaaattggtagagagtttttgatacactagttctcctctttccatttttattgaaatcgaagcgacaaaactcgagataaaaaggtgatttttaaatagagattaaattcagtaaattaaagcggagttaaaaggaaaaatcatgaggaaaatggtgaaggagtagggggattgatgtttggcaatcaattggaggagagaacgcatggggaggtagattgacatggcggcgacgttagtgttcggccccgcgacgaaaaaaacatggcacaaatccttatcgcgtgtggaaaaatacaactaaaaaaacagcaatgaagaaaaacatatgaaaaaacccggaaaaaaggcctagaaaaaaagtaaaaagccgatggaaaaagagcagaaaaaagacggacaaaaaaagacgaaaaaaacagaaaaaaaaagaaaaaagaaaaagggtgaaaaaggacggaaagaaaaaaaagccggtgatttttaaatagagattaaattcagtgaattacagcggagttaaaagggaaaatcatgaggaaaatggtgagggagtaggggggattgatgtttggcaatcaattggaggagggaacgcatgggaagatagatcaacatggcggcgacgttagtgttcgccccgtgatgaaaaaaacatggcacaaatccttaccgcgtgcggaaaaatacaactaaaaaacagcaacgaagaaaaacatatgaaaataaccggaaaaaaggcccagaaaaaaaattaaaaagcacatggaaaaagagcagaaaaaaagacggacaaaaaaaagactaaaaaacagaaaaaagaaaaaagaaaaagggtgaaaaaggactgagaaaaaaaagtccaataggctgttttcttgctggtttttttccgtccgatcggtttttttatccgattggtttattcgcacgcggttttcttccccagtttttttttgcatgtggttattttgcacgctttttttttccgccggataaaggaaaacggacgaaaaaaatttgcaaaaaaggacgaaaaagaaaaaaaagacggacggaattttttttacgaaaccttacgtattttttaattaggtaatataaatatagatatagaagtattgttcgaggaggccatgctactagccgtccctgtctccgcaactgacgtctctgtttgatcggtataacctacaataatcttaattttaatagtcgaatatgtgtactgagctatagactttagaaaatctagccttttctagttcaatccaacagaatttgtggcatggttttggtcattttggagaacaagcaacttaggtgaaaactctcaatgacctacaccagttaattagatccatcgacggcatcgacttaagcggctttttttcaccgggaaagaccgaaggagaccatccgaatatattaaaaaggaaaaaaattacaacaatcgacagacactatcgaagtcagaagtgcaccaaagtgcatgactaagaaccacgtgctaaccacacaaacacaacccaccgagagaggaacctagcaccaaaagacctccgctatacgtggccgatcgccactaggcctacgacaaaacaacaaagacgagactctaaaacgatgcccccacagagatcacgacatcaaagacgccgccatcacctcgagaaactcgccaaggaagagatgaatcctcgacagtgccctagagggggttacaacacccgaaggcgtagccattgccggcccggtgaactactagacatggctttcgcctggaacccctgcaacctttcttgaagttcgtcgcccatccactcaaaaaccaccacactggcagcacgaggcctccaccgcaccgtattaagcggcctttttctgtttgaagaatttgctttggagaaacttttgatctgcgatggtgaaatatcttagccgtgccctcgttaacgaaagaagtataaacaacttttatcatcatcatcgagtccaaacaatgttgctccaaattgttactttggtcttttgctccttgtcttaatttacatttagcaaatgccgatgtaattgtacatcatagttggtgttataggccagaattataccatgatttcttaaaaacagtcgattggacatcatttcgcaattttcagaagatgtttaattagtttgcttcctcggaagttttctgaaggggaaagccaattcaaaaaccaatatagccaaattcttttcacataggacattggctaaaaacatactccttcagtaacaaaaacatgccattttgaacatgtatggttcatgtaaaattcgaaaaacttcaaatacaaatattttttaatgctagctagtaatagatttattaaaatcgcagaggttaaggcctgattttaaatataaatatcttcattaatgctagttctagtattggatttgttaaaatcgtagaggttaaggtctgatcgaggaagtctttataaaagcacgctgtgaaagaatgtatcgtagatttgtatttaaaaataaattcttaacatcactcctaccatatcgaagactacatcaaaagtcctaaaatatacccacttcgttctgaaatataagattttttgggttatttagcaaacaataatatttaggtcaaaaaattcttacttttaattgtcaattttttaattttgaattaattagattttctttccaagcatctgattaaatttacatgcattgaaacatagaaatcgcatcagtgcatgaataccgttaaaacgaaggtttgtattgtgatcagaggggcaagtttcaactttcaactttcaaattaagtttctgaaaaaaaaaagagaagaactttcaactttcaaggatgactggcctgccagccaggccaggccatgcacactcgagggtaagaatggtcaaagcttgaggtagctagctagaggattaatacgccacagaagcagaggtaataaccaacagagccgtggatttttcactgtttttaagacctggagcaaacggacaaagcccacgtatagcaaggcagcaaactcagcatagtagctgaaatcactcgcggacaagcctgaaaccatacaaaaaaaaaatgcagccaaggaatgcaacaaacgcatgggatcaaaatgggcatactttttagaagcctgtggcatcccctagcaaagtacagctaaaaatcctgcaagcaaacaaagcagctcgtaggcaggagatagagaggagatccatccgccatcgttctatatatactcagccggtcccgtgtcttccccatccccaagttattaattgcatcctgtcattctcttttcacctttggacaaacacataatgagatataaatatatatttatatagttttgaatgggaagaatgttgcgaaagcatattagaaactaatatattgttaggctcgcattttcctcaggaccgatatcgatccagagtagaagtacatgcgcacgtgagtatacggtcgatggttgtatatctgtaccacgtaaggccaaacctctaattttgtttagatgtatgttaaaattattagatattttttctcgtgaatagggcatggaggagtataattaagctcgtgtgctacatatatcttccgattttgatacaagcttacaaaatgcctcttgtccgctaattttatcccatttgtttctttgtgccaagggaaacaaaagtcgaggggaaccacacagtggcacacacatatcctacaaaagtgacacatcgatgtgagaaacacccagagtagagaggggacgtacccgttcgtaccacacacacacgcacattggaagctagctacagcaagagagaagatgcgcaagacatgcaactaaaagatttgtgaccagaattcacaaacaacaggggg

SEQ ID NO: 68205 - DNA, 549 bp, Oryza sativa
agtaataacagacatggcataagaaatagaatgatctaacatgtgattctgcagtgaaagatgaagtaatatgcataaaaaaataatccttacaagcaactgattgcgaagaagctctgactttgcttcctgttataaagaaagaaaaaacataaagctttatgactgtaatagtatgccgtcaaggtagaacatttggaagaaaatataaaaggtgctcaagacctgttcgccgagggcttttcttagtttattgattagggttattctagccatgttgacactttcaagttgctcaatgcactgcttaaggactgtttcctgcccttgaaggtcagaaatcaacgatgatccttgctgaatacctatgaaataaaaaaggagtaaggtgcgcatgttttgatcaagaatcgaagtgaaaggctgaaagcattatagtgtcaaagcatcatttcttcatatctggtctccaactttgtaaatacagaaagtcagggtacaggtttccgattagagtgaaatgcatggtcggtccttaaaattgagcag

SEQ ID NO: 68206 - DNA, 589 bp, Oryza sativa
caggattgcacctgtggttgctgcatgaaaccgtgggttggtaacttggtatgccggagggcagaatcgggaattaacaggacttaattaatcgatgattattaattaatagtgactctagtctagttgatcagatcaatgtatatatccatatacatgttgagaattaattagcaatagtaggtggagtaagaaggaagggtgagattcgatctggggttttgtgtacattgtactatgtggcaatgagggcaagaacgtgtactgtatatagctttgcagcctgtagttgtagactgtaaagacgcgaggtatacatacgcgtacgcggtacggcggcttatgttgcgaatgcggggcgtcgggagatgccacgtagagatgccaggtacccgttcctccagggcaccaccaggcaccagcaggctgcatcgtgattcgtgaagcacaggaggccacgcacggcggaggtaggcggccggagtagtagctggccagccgccgtcagatcagcttcgtcaacaaaatataatggatgcttgtccggcctgcaatcggccactgcatgcctgatgcatgcatcgtgcag

SEQ ID NO: 68207 - DNA, 1066 bp, Oryza sativa
aaagttaagtccccggatccaaacaccaccttagtccctaactaaactttagtccctctcacaaaaaaattagtccctaactaaactttagtccctctcacaaaagcaaaagtccctcccatagggactaaattttttgtgagagggactaaagtttagtccctccttgccaaacaccaccttagggacttcaattttacaggcttacacagactccaacagatgataacttcattacagtaatttatcaacaattatttgttccccttgtttgctaatgagtaaagtccatcaccggtccctaaacttgtaccgttgtgtcatcccggtccctaaactcgcaaactgaccgttcaggtcctcaaacttgttcgactatgtcatcccggtccctaaacttgcagatcactcatttaggtcctccaacttgttcggttgtgtcaccccggtccctaaacttggatttgaatatcatctgggtcaaataggatggtctaaagactttatatttaaaaataattcataactttttcatatgaattctaatgaagacaaactttatatcaaacttgtagccctcgacgcgatctacaactttgtagttgaattttttttatttaaagtcattttttgtcccaaaatgtaattttaaaattaaaatttcaaaatctataaacatgcaacaatattttgggaccctaaacagttttaattcaaaaacttttcaactacaaagttgtaggtcgcgtcgagagctacaattttgatataaagtttgtcttcagagttcacatgaaaaagttatgaattattttttgatataaagtttttagaccgtcctgtttagggaccggggtgacacaactgaataagttggaggacctaaacgagtgatctacaagtttagagactaggatgacacagtcgaacaagtttgaggacttgaacggtcgatttgcgagtttagggaccgggatgatacagcggtacaagtttaaggaccggtgatggactttactctttgctaatcattgtagtgtactagagtctctaaggaagccatcag

SEQ ID NO: 68208 - DNA, 768 bp, Oryza sativa
gccagtttctctctgttttttttttgtgaaatttgactgtttctcatatttgatagttcaatcaataaatttagtcacgatagataataaagcttagtgaatacaatcgacttacatggaagcgctttctaattaatacaaaaaatcatgtaaaactcacattgtgcaagggcttggtgaaataataggataaggggtatatatacaatagagtaaagtccatcaccggtccctaaacttgtactgctgtgtcatcctggtccctaaactcgtaaatcgaccgttcaggttctcaaacttgttcgactgtgtcatcccggttcctaaacttgcagatcactcgtttaggtcctccaacttgttcagttgtgtcaccccggtccctaaacttggatttgaatatcatctgggtcaaataggacagtctaaagactttatatttaaaaataattcataacttgttcatatgaactctaatgaagacaaactttatatcaaacttgtagccctcgacgcgatctacaactttgtagttgaattttttttattttaagtcatttttttgtcccaaaatataattttaaaattaaaatttaaaaatctataaacatgcaacaatattttgggaccctaaacagttttaattcaaaaacttttcaactacaaagttgtaggtcacatcgagggctccaattttgatataaagtttgtcttcattagagttcacatgaaaaagttatgaattattttttatataaagtttttaga

SEQ ID NO: 68209 - DNA, 558 bp, Oryza sativa
cctgatcgttgctttgtgactttgtgaagtgtctgggttcacaatggtgagtgggggaactgaattagaagggctctagcccttttccctctgaaatcttaccattctgtgaaccctcctactgggcttggggatcttcatttttgcagaagtcgtgactgtaacgctgggtgtggtggctcacacctgtaatcccagcactttgggaggcggaggtgggcagatcacctgaggtcaggagttcgagatcagcctggccaacatggtgaaaccccatctctcctaaaaatacaaaaattagccaggcatgatggcaggcacctgtaaccccagctactcaggaggctgaggaagaagaatcacttgaacctgtaatttctataaaatgacaattttgcccttttgatgaacatagaaatttatgaattacattattgaaaatgtaaaagtttgtcatatgagactattatagttatgagtttgttgtgcgatacattatttatgacaaaaattatttttagataatgaaacaaaaaatatgtatttaatttatttttt

SEQ ID NO: 68210 - DNA, 5826 bp, Oryza sativa
ccgcttagctgtagcaagtggcaagtagcaacccttatctctgtctgcgcataatttctcaagaattctcaatccacatttgtacagcaatgactgttgaaactcgattttatttttcttccaaagcaaacacttgcggataaatagtcccatcggtttgtctgtagccgtaacgtttattagcgacaacaaattatgtgcgaaaaacttttatatacaacctccttataatagatgacgccgttgatttttaatatttgttttattctaaaatttatttaattataatttattttgttgtgagttgttttatcattcaaagtactttaaacatgaattatatcttatatatttgcataaattttttgaatgaaacgaatgctcaaacatatgttttaaagttaacggtatcatctattaaaagacggagggtgtaagtgtttttaacgacttaaaagtcaaatataaaaaataatcaacaataaaaaaccattaaaaacaactctaacaatctagatttaaaacttaggccccctttgattcaaaggcaaattcataggaattttagaggattttattcctataggaatttttcctagaaagccctttgaatcaaaggaataaacactatggaatcctatgaaattgctatggaatgcctcttcccatacaagttttggaggaattttgaacctcatggaagaaatccgaagaaatcctttgagtctcgtcgaaacatgaattcggcaataataaaaggggtagtgcacgagacctaaaagtggatggatgcagagacaaaggattagacaggttcaggccctctcgatgagaggtaataccctattcctgtttgaggattttaatccgccgggtgtattatagatctgacgagatctagttgtctcatgccccctagagggcctcctgcccaccttatataggatgtggggcaggattacaagatagaaaccttaaccaatacggtatcggtttcctaaatctattttacaatattatcaaatcaggactttaggccgctccataatataaaaggaaacgtaatacccaagtcatgatctgttacatattctacagatataagctatcccctatgactagtcgataaccatgccgtgtgggtatggggtacccataatctccatagtagcccctgagaccttcacagtcggaaagataatcttctctcgaactagattactccaaagccgagtgcttcaatcatcttcgccatgatctcccgagtacttttaccaaatatgaagactgtggagggctgaaaaataaagtcaggtgcatcgaatagatgcacctaataggtgtagcccccgactatgtggttagctgaacaaactaagcatatagtcaaggaataaataatccaaccaactgagtggtttttgacaattatagtcaaccaggtgacttgataccaatatatagcatatgcggtatgaatccccgaataatatgatccaggtgatataccgactgctttggagaatatgatgcgtgcaacctaaagttgacaacatctttgaaaattcacatagcaaaatagctataaagaagagcttgatgttgtgaataaagaaattttcaaagtattgggcatacaccatgcgcacactgctttaacagatgtgcttaagtccctaaaagacatatggtttcaccacacctggaaatatatggcatatgtggtgtaacatccgagtaaataaactcataaggatttatcaaccgtctggaaaatgaccaaaatatataatcagcctaagccataatattggtcaataaaaatgcacacttacgtggcaaaaaacaatgatattgtatttaatcaatcgctttataaacccaaacaatgccttgactatatataaaaaagcagtgaggcagctatgaaaaacttcactgttgggcaccttttaaaatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcggcaccctttaaaggatgacgcatgtaacatgctcccgagtaataaatcttccgggtgatatagaccaagtgtagctcatatgaatagcttatggtctgagtgattatcccttatgggatactccaaaatagatataataattgaatcccgactggcgcaagtattcggttgatagcccttacggggaataataaatagtccagtctttgagcatagaaaaatagactcatgactatgaatccatattgaatgtatccggaacaagtccaaattggagatataatcctcacgcttgagttgatgagcccctgagcatatagcttgtccttctgtcatagtcaaaattgtccattggcaatagctgatgcagtcgatatgaaagcaagatgactaatatggagatgaacccatcaaagctgatgaagatgttgatggtggtaaagacaatgataccaatcaaaggtgatgaagtcgcatagccgtggatgcgaagaaaccagtcggcagcagacaagtcagccagcagtgaagatgaaggtgtccaacaacagcgacaaaatcgtgcagccatggtggcgaaataatcagtcggtgacagacgagccaatagtcggtgacgatgagaacaagccaatgatgaagatgtagacgcgcatcaacgacgatggcgaaatcctccaatcatgaaaatacaggaaacaatcgacgacaacaaatgcaaccggtggtaatgacgattggcagcaatagagatgatcaaatatgatgacgaagttgcccatcaatagcagtgtagcagccaatgataacgatgaagccctctattggcagttgcatagtaggcccaccgtgaagatgaaataacaagtcggtgataacaaaagcaaccgaaggcgaagacgtagtcaccccttagcaacggtggagacgtcagggccgatgaagcagaggtgttggtgatgatgtcagtgataataatccatcaaactgttgagaagatatcaaagctcgagtaatttccttgatgcgaagattgatgcaacgccctttgatttgtaaagatggcaatagaacttggtgctatagctgttgcagatgcttcacttggaggaaagtagatgttgttgaccaactcgtcgaatctgagttgattggttgataactctaaactcccggacatgtagattaaatctcaaacttgagaaatttggagtagattgtggcggcatgaagaagccaaaattgtcggtgtaataattggagtcgctgaaattaaatgtcggttctgaagcgaagatgaagataatgactccccgagttgactcgttgattgattgattgcttcatcttgacataaagcttgtcgaattttgagagtcttttatttgtgtagcccccgactctttggttagttgagaaacaactgaacatagagtcgagaactgtagcttgtcgtcgagtggccatcacttgagtgaagatacatgttgaagatgtccgagtagaaatcggtgccgaagacaatgaagatgaagtagctccaccatggtaacaaagttgcatagccgtgatgaagtgaacacgagtcggcggcaacggaagcaaaccggtagcgaagacgcgtagttgtgaagataaaaacatcagtcggcggcgacttaaccagtcgacgacggaagacgatgacgtccatcaatagtggtagcggtataaaccagacgtagaggcgagtgcactagtcagctgcagacgagatgaccgacggtgaagacgataaggccaatcaacactagcaaaatcatgcagccatggaagtgaagaaaccagtcggcagcagatgtagcagcttgtgttgaagatgatgacgcttattagcgatggcggcgacgtggccagccgtgaagacgatagcgccaattggcgtcatacgaagcggccggtcggtgaagatgtagacgtccaacaacggcagcataataggtcagtcgtgcagcggagacaccagtcggcggcggacaaggcggccggttggtgaaggtgtagacgcccaacaacagcggcatagtaggccagccgtgcaagcggagacaccagttggcggcggcgaaggcaagccggtcggtgaagacgtagatgcccaacaacggcggtgtgaccacctgaccgtataagcgaggataccagtcggcggtggacaaggcggccggttggtgaaggtgtagacgcccaacaacaacggtgtgaccacccaaccgtataggcgaggacaccagtcagcggcgatgacaacaagccgatggtgatgttctgactgatccattcctagagcgtaagagataagcttatagccatgaatcccttttatgcatatctggatctggatcctacagaacaaacatataggatgagtagtatctgatgtaaatacagtacttgagaaaaattcaagtattttaaaatatttataaatatgtatttctcctcttgtcaattttgatttccccgagcagatgactctgtacgtttaaacactctgtccgactagttatagccctcaagcatcgggagtcggcttaggcacttcccaaacatgcatatgagtgacatgagttcgtcatttatggaacaaagtttcacgaatcagaatttactactcgggtacttttacaattgttaagagtagaaaataaattatcttttctctatgcttttgatttcttctgagtaatacttagcaccttgcgtcactcggtccatccaacgagcctccgcgtggtaggaatcggcccaaaggcaactatttattggcaaaccaaacggaaagcatagtaagatggaactccatgactcgataggcacttttgtactcagattatgtcgcaggcaatcaagataaatattttataaaaattgtttaaaaaatatgatataacatctgtagcccccgactcactagtcaacggtgaaccagttgacatagtgaggcagaggaaaaagaaaatatcataaaaagaaaattaatgatgacttagctttctggtctttcccttggtgacagccgaggtggcctgtcacaccctgaagtttcccccccctttttcttgttttaaaaattggttaaataaattgcccgaagaaattatcttaattaacctagagctaaatccctaattaataaatgcatttaataatcgaattcggcatggtggaattttttttgagttccccatgctccaatgcagtaacaagatttttagtggaattttcagagccttggaaataattttaaccaattaaaattgagcaagtgctatatttttaatcccatgaaaatcctttttctccttttcttttcttttccctcctttttctttgttgggccgtcggcccatccctctcccgcggcccctcctccttgtgggccggcccaagccgcccctccctcctctctcgggacgccgacaggtgggccccacctgtcggtcgtctcccacctccggccgttggagccgaagctccaaccgctgccgccgaaaccgccgcgccaccgcctcctccgctcctcccgcgcccacgccgcgccgctcccgcgtcctccccacgtcgccgccctctcccccgcatctcccggcccgcatgtgcgctcgcaaggggcgggattcgaatttgaatcccccattct

SEQ ID NO: 68211 - DNA, 4014 bp, Oryza sativa
tttatccaaagtcaatgcgacgccaggaggcgacagacacgagcgcgcatcgacctggcactggcacaccacaggacaggagcccaggaagctacctataccttgctagcttggcgtcttggcgaaacacccccttgttggatcaatctgctgtgctggtggtgagtcagagttaagagttctaaaaaaaaaaagagagtcaaagttaagagatcgaccaagtcgctaaacaaatgcaggataagacgagcacctcagcatgagccgtcgtcctaatttgcaatcacctgcatttcatcttctactactatcagatccaaccaaacaagcaagggcatcagatattcagatcagtatatcgatcaggggcaatggacaatgcgctgatgcatgtgattccacttagtcatgcgagttaaccaaccggccgtgtgcgcaataatggattaaacaagtactagtaacaggagatttgtggcctagttgcctgaatttatgcgtgacgcgtctcccattattggactacttgacgatgatttattgttaagttgacgtgtaaaattattactgtaaactgccttttctgtaatctttatcagtcgatctctgtctctctctccgtcctgccgtacgtggtttcagaaaaaaaggaaggttgttgttgctatgctggatatacaggattagtcatgaaatgaaggggagttgcaagtgttgatcaattagtgtgtcgaaccaaatcaaccatgtcatcagcagttcttgtcttctaaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctctgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggcctaaagaattttcctcgttaattaatcaaattaattaacccggctgtacttagtcgagtgttagcccaagccattctcagccagctagtcctttttctcctttttttttttcaaaataaatagtgctgtttgtacgtgctatggctgttttgaggaataagctgctattaattcacgtcttttatatgaaatgaactcgtgattctatttccaagagatattgcgttctcgcgcgtgttgatctgacagcagcattgacccctcagtataatgcagtttttttatataaagaatcggatgcaactaccaacaatggacaattggacataatcactaaactaaaggaggatcactcctgctaccacatggacaataaacaaattaaaacggcactgaaataccgaattcagctacacacgaaagaagaaaatatctactctagtagcaacttgcaagctttaattccttctcccttaattaacccttcccctttatatatatatatatatatatatatatatatatatatatatatatatatatatatatatatatataaactgaaacttgcaatctcctctgcacatattctcagggttcagcctaaataaaaccgagaaaagaaggtgctcctttgtgctctcgtgatgaatctgtcgtgtccatcacgtatagcaggaataaaccaatcgtcttatcctttaacccgtcgtggaacagaatcacgatttcttctttattggacaaacagaatcgcatacgaagtgacgacgaaaagcggaaccaccagaacgatcgatgcatccgcatgatgtggctgatacgaatgatatcacttgacacactcgaccaacggctagctaggcagcgagcggcgatcgacgagcgcgcgcaagcaacggcacagacgcacgcacgcgttgcgcgggcggatgctgcaggagttcgctgcagattgggcgggcgaagccgtggtaaaagctagtactacccaccagctgttccaaaccatctggacgacaccacttgtcaagttgtattgccacgatggcggctttgaacgattgcacgtacgcgaacgcacaacgtcgactcgggctctgttagttttcacgtaaaaacttttcactatgtgacattgaatgtttagacacatgcatagagtattcaatataaaaaagacataattacatagattgtgtgtaaattgcgagacggattttttaagcctaattgctccatgatttgacaatgtggtgctacagtaaacatttgctaatgatggattaattagacttaataaatttatctcgcagtttacagacggaatctataatttattttattattagtctatatttaatacttcaaatatatgttcatatatctgatgtgacacgtcaaaaattttcacctaacatctgtatgaacacagaacacagcctcggtcaaagagaaaaaacgaggcacggagggtaaaaaaggaaaaggggaaaaatcgtggcagaaaggacaggtgaaaaaacggaaacagcgctgtcctgatgtgttcgttcgttggttcgttctcgtagttgtagcagcagagggaagcgtctgtctgcgtcgggtgcgtgcctttggaccggaatatcctggaggataaaccatccgatccgcggggacggtggcagcaaattggcaaatgcgcgcgatggctggccatggcgaacgcatccccaccccgaatattccccattcccgcttccttcctttctccaacgacccacacccaacactcgatccctttccccttcccccgccttgttataaattaggctcggctcccgcttcctcgcgtcgcgtcgcgtcgcgtcacgtctcgttgttgcattgcattgcgcccacgatcctcctatacgcgcgcagctaggacatcctccgaatataatggcccagctcaaggccgcgcgcgtcgccgacgtccccatggcgctcgacgtcctcgccgccggcgcccccgccacctccgccatcctcggtacgtacggattattcaatattcattgcgtggcgtcgagacaccgtgccgcggcggcgttagttatttccttggttatgcagcagaggtggacgcggcgggtgctcggagcgccgcggcgggcggcggcggcggcggcggggggcagaggttcgcggtgatcgggcaccgcgggaaggggatgaacgcgctggcgtcgcccgaccggcggatgcaggaggtgaaggagaactcgctcaggtcgttcaacgaggccgcccgattccccgtcgactacgtcgagttcgacgtccaggtaacgaaaaaaaattcttcatcatccgtccatccatgtccatccatccgtcatagcggtaacctgggtggggttgagctgctcgtgctaaatttgggggtccccgtgggcgttcgagacgaaaaagcgagaccaatcaaggaaaaggaaaggaagagaggcagatggggagatgggttcacgttcacctgggtgatgggacgggtcgccggcttcctctcctcgatggcgacgcgtcagcgccatggagggcagaggagtgggggcgccgcgtagcgtagcgagcgctcgccgccgcccgcgggcgaaacagaagagccaacggtgtggcgacgcgtcgcggtgagctgctgttccgattcgcggtgtcacacgtaagccccacgcgcccgcccgttctcgctcgccttcttgggaaatacgaatcgatcgacataataattgcccttcttggagaaactgaaacgcgaatcgaaaatctcaccggcacgattaat

SEQ ID NO: 68212 - DNA, 547 bp, Oryza sativa
ttgaacggaatatacaaataaaacataaccagaccatactacaagtcactcctatgaaaacttctttttactaaatattaatttgcactataagtcatctattgatatgcatataaaatatgcatataaaaacagtatatactacaaattaactgtatatgcacattgttgtaaattgcagcttggcatggcgagcgcattagaaacgttgtgtggacaatcatatggcgccaagcaatatcacatgttgggcatctatctacaacgctcatggctagttctcttctgttaggcagtcatccttctcccggtctatatcttcacaactccactcctgattgctctcggtcaagatcctgagatctctgccgtcgctggcaccatctctctatggtacatccccataatgttctcttacatatgggcattcacgctccaaatgtacctacaagcgcagagcaagaacatgattgtcacttaccttgccttcctcaatcttgggattcacctcttcttgtcatggctcctaacagtcaagttccaactt

SEQ ID NO: 68213 - DNA, 3555 bp, Oryza sativa
tccgcgaagggagcgtcgtgggtggcagtggtgatggtagagctggagaggggaaggtcgtggaagatgagaagcagagtcgacgctcgctggcgaagacgccgcggacggcggcgcggcagcacggatccagcggcggatcttggcctcgaggacttcccactcgagccgctgcacgtcgccgatgctgagcttctcaacgccgaggcggcggagcgcggagtcgacggccggcttgcggacggaggcgtacacctggacgcactcgcggccgtagccggcgacggccatgcgggagcgatggcgtggaggtcggagatggcgtccgcggggaggagatcgatttctcggatgctgcgcagcgagcggtagctgctgcggcggccgacggaggacgcacggagtcgtcttcgtccgcagccgccgcttcctcggcgacgtccgcggagttggtccggtcgctgcacatggagagcgaggtgaggtcggcgagcgcctcgatctccaggtcgagggcgcgcgacgacagcacgtggcggaactcgtcctccagccgcgccatcgcgacctggacggcgttggacgccgcccctccgccgccgctagccgacgaggtgcggcgcgggctcccgaccgtggccggggacggcggcgccagccgccgtaggtcatccacagcccggaggaaccgctccgcctccacccggtcaccgccgccatcgaacagcatctgctcgtccccgcccccgcccccgtaggacgccgacgccgtggagtcccacctcatcaccaccctctccgccgcctccagctccgccgccgcagcggtggatccatccatcatgcttcaccccccaactcccaacacacccacgccgcagcacaacacctccacactcccgccggtacggcgcggggaggagagccttaagccggcggcggcggcgaggcgaggaggcgagagggcgctgtgcagtggccgcttcgagcggccgctcgttttatcgaattcgctttttgtctcgggtattttccccttgttgctttgctcctttgggcttcctcgcaccactaattatccaattagtgcgcggattagtagcaaagctgtggaagcggagactttttatcacctcccaacaaaataaaatacactctaaataaaataaataaataaataaattataaatgccgacggcaactgattggtggggcccacatatctgtccccaccggccagtgagtccacgactccacgtcgtctttttcctttcccgaatggatggctgcctcgtgggcccggctagtcagtggcggtaatcctgtaccgacgtgactcgtcacgcctatggtcaattttcgtcattagtatgcatgaacggcggtgtgctactgttttggtgttaatcttttttgagacagtttatgaagcaacattatgcataaattaaagcaggtaagcacggctgacagctcatccagtcggttcttgactggactgcacaacagcagcagagagcacagagaagaggacagcatttccggtatgtctgacagcaaccaactagcaatgcaacctatcggctaatcatcgattaatcatgtacttctatcaggttagacaagaaagagaattacctcctgtgtttttaatagatttcttcattaactttttattacacgtttagttatttatccaattaaaaagtatgtagttataatttattttgttgtgaattagtgtatccctcaaagtattttaagtatattttatatcttatatatttatataggaattttaaataagatgaatagttaaacatgtcgttaactcatctactattaaaaacgatgcgagtaattcatataacagcggatgagagagatcacgatggtcaggctacctgaaaacggtgcatgcgtgtcttcttcggtaagccaagatctttactgcattcttcttcagtcctggaatcatcttttctgaaaatgttttttatcatcttcttctccttttcaatccgttgctgtcttttgtggggttctttcctaggaaaggtgttagttgttcagcctcctttcaagaagctatggaccatactacacgactgcatgatgctggtgatggtgatgatgctacgagagatcttgccttttttgtgctaactgtaacgatttcctttcaggtcagtttcagatataggaagtgataagtacttacgttagaggatttcatcagtggtaaattttgcaggatgtggtaataagcagcgctgaatgagtacagtgagtttttcaggctacaaggcatctctgaattttaacttcaaatggtatcgttcttttcactatcgtagtaataaagtaaagaaaaagaaaagcatgtgagacagtgatgtgaccatggtaaacttcaaacgagttaatttgttcgtcaatgagaataaagtaacctgggttagttgagatcttattacaagattcgaaagcgagttacatgactttctgaatggcaccaaggcaggagaccagttcatttgtttgtcctgtcagtttgtgaagtgtgaacgaatgcaaggacacaacggaataagcaggcacgcaatgtctaatggaccgaattcatttggtagcagaaggatgacactacagttcagcaatcatcctgcaaaagcatagctgtttccgcagacgattcatgcataatgcattcgtgtcccttccctgaacgaccaacagattgagctgtgtgtgtatgacaagcgggccccactcatctgatggctttgtttgtgtgtgtttggtctagtttcagcttcatatatgatggaattattataaactaaatcagaaccaaacgcaaagctcattgtgacttgtgaggtttaatcgaataataatccagattcctctctaaccacaattcttagggataagataaagccaggaaacaggagacatctaggattataaatttacaataagttgaaaccaaaccggcaacttgacagcagtgatgccactggaaaaccggcaaagcatcgattagctttccaagtggtggtggactaccgttctttgcagggaactgaaatacgttagtacgttacgagtaattgtcaacagccacatgcctacgccgctacgcgggattttctaatgttttgttctgcacgatgaacactagtagactagattcgtgtttttttttctcgtttttcttaatctagtactccctctgtactcataaaagaagtcgttttggacaacaacacggtctccaaaacataatttttacttcttatttttataaaaatatttattgaaagtgatatatgtatacttttatgaaaatatttttcaagacaaatctatttatataatttttacattttcaaacttaataacttgagagttatttatgatttatattcctaagatttgatttaaacattgtcctaaacgatttcctttacaagtagggagggaatacttcagcagcaggtaattattggtagtaataatttaccatgcaacatatatgggccgcacgta

SEQ ID NO: 68214 - DNA, 775 bp, Oryza sativa
agggcgaattcgagctcggtacccgtttcctgtattgtgtaaggagtattctgaaagatgttcctgagactatggtggctgtaaaatactgagagtgttccatcatactccctatataccaaaaagaatccaaccctagagataaatctggacatacactatatacagatttaacctcaggattaggttttttatgggacaaaggaagtaactttaagtagtgaaaaagtttggcaatcattcttggtttgataagaatcttaagcacatcagattttgcatttgggatgcaaaataatagatgaggacttactctagacattaatcattttcagggtcagggcatttgaattagcctgatgatcaacataagaaaatctgcatgagatgaacagaatgtactcgacaaagaactgggctcttcctgggaatacatctgttttgttattttgatattaacactagcctggagtttgtacttgtgaagagaagccagggagttgatatacgaacttatcatttaaagatgcactgttcatttggtccttgtttaccgaacattctgcagtaagcttcttttaccagggacttgattgatttgctcgagaaaatcaaccaagaattgctatgcttataagaccatgaatttgatcgttcgacaaactcaagtgttttacgagtgccaggcacatcttttggtcgaagaatacaactcggaaaattgatttgcagtcggcatatcgttcaattcaacatgcagtctcgcagttggcat

SEQ ID NO: 68215 - DNA, 849 bp, Oryza sativa
ctgatatttcgaacagtgatatatgtgatatcctgaggggatatgccatacagccgaggtaaactgcttgaattgtcactttgagattagcacatttttccttatttaggggaaaagtggcatccagcacgggtccaataatttgatcgatatgccctgtacttttttcttcaattgtagaaaccccgggatgagaagtactaggattggttctcataattaaaaaaaaaggaatttatcgaaaattttcttttattctgttgaataatgccaaatcaacaaaaaaaatatccaaaaatccaacaaaagtcaaaaggaaatgaattagttaattcaataagagagaaaaggggtccagcacttgatttcattgcccaaacgaatcacattcaatcgtttactcattccatgagtccgtcgaaggcaaaccaccagaaccaagaaatgggagggatggggttaaaggatttgaattatttaacctcctagcgagacaagcgtggagaatgctgcaagaacaagaaagtttgagtgcaagggtgcgaaatgtatttccctgatgaagacttcctaagagcagacgtgacttcccgtcgggcgcccgatgggagccgattaaaatcgggcgctgatgtcagcatgacgtcagcgcccgatttacgtgcaaaaactattttaaactgatttttctcttaaactacttatctaaataatgatccgattgcaccattaaattcgtagcaattaaatcttcaaaacaagaccacacatggatatattccgacgaaattttttttagcttattattgaattatttttaaatgttgcacgatgttccactaggtatat

SEQ ID NO: 68216 - DNA, 49425 bp, Oryza sativa
tatatgtagcacacgagcttaattatactcctccatgccctattcacgagaaaaaatatctaataattttaacatacatctaaacaaaattagaggtttggccttacgtggtacagatatacaaccatcgaccgtatactcacgtgcgcatgtacttctactctggatcgatatcggtcctgaggaaaatgcgagcctaacaatatattagtttctaatatgctttcgcaacattcttcccattcaaaactatataaatatatatttatatctcattatgtgtttgtccaaaggtgaaaagagaatgacaggatgcaattaataacttggggatggggaagacacgggaccggctgagtatatatagaacgatggcggatggatctcctctctatctcctgcctacgagctgctttgtttgcttgcaggatttttagctgtactttgctaggggatgccacaggcttctaaaaagtatgcccattttgttcccatgcgtttgttgcattccttggctgcattttttttttgtatggtttcaggcttgtccgcgagtgatttcagctactatgctgagtttgctgccttgctatacgtgggctttgtccgtttgctccaggtcttaaaaacagtgaaaaatccacggctctgttggttattacctctgcttctgtggcgtattaatcctctagctagctacctcaagctttgaccattcttaccctcgagtgtgcatggcctggcctggctggcaggccagtcatccttgaaagttgaaagttcttctcttttttttttcagaaacttaatttgaaagttgaaagttgaaacttgcccctctgatcacaatacaaaccttcgttttaacggtattcatgcactgatgcgatttctatgtttcaatgcatgtaaatttaatcagatgcttggaaagaaaatctaattaattcaaaattaaaaaattgacaattaaagtaagaattttttgacctaatattattgtttgctaaataacccaaaaatccttatatttcagaacgaagtgggtatattttaggacttttgatgtagtcttcgatattgtaggagtgatgttaagaatttatttttaaatacaaatctacgatacattctttcacagcgtgcttttataaagacttcctcgatcagaccttaacctctacgattttaacaaatccaatactagaactagcattaatgaagatatttatatttaaaatcaggccttaacctctgcgattttaataaatctattactagctagcattaaaaaatatttgtatttgaagtttttcgaattttacatgaaccatacatgttcaaaatggcatgtttttgttactgaaggagtatgtttttagccaatgtcctatgtgaaaagaatttggctatattggtttttgaattggctttccccttcagaaaacttccgaggaagcaaactaattaaacatcttctgaaaattgcgaaatgatgtccaatcgactgtttttaagaaatcatggtataattctggcctataacaccaactatgatgtacaattacatcggcatttgctaaatgtaaattaagacaaggagcaaaagaccaaagtaacaatttggagcaacattgtttggactcgatgatgatgataaaagttgtttatacttctttcgttaacgagggcacggctaagatatttcaccatcgcagatcaaaagtttctccaaagcaaattcttcaaacagaaaaaggccgcttaatacggtgcggtggaggcctcgtgctgccagtgtggtggtttttgagtggatgggcgacgaacttcaagaaaggttgcaggggttccaggcgaaagccatgtctagtagttcaccgggccggcaatggctacgccttcgggtgttgtaaccccctctagggcactgtcgaggattcatctcttccttggcgagtttctcgaggtgatggcggcgtctttgatgtcgtgatctctgtgggggcatcgttttagagtctcgtctttgttgttttgtcgtaggcctagtggcgatcggccacgtatagcggaggtcttttggtgctaggttcctctctcggtgggttgtgtttgtgtggttagcacgtggttcttagtcatgcactttggtgcacttctgacttcgatagtgtctgtcgattgttgtaatttttttcctttttaatatattcggatggtctccttcggtctttcccggtgaaaaaaagccgcttaagtcgatgccgtcgatggatctaattaactggtgtaggtcattgagagttttcacctaagttgcttgttctccaaaatgaccaaaaccatgccacaaattctgttggattgaactagaaaaggctagattttctaaagtctatagctcagtacacatattcgactattaaaattaagattattgtaggttataccgatcaaacagagacgtcagttgcggagacagggacggctagtagcatggcctcctcgaacaatacttctatatctatatttatattacctaattaaaaaatacgtaaggtttcgtaaaaaaaattccgtccgtcttttttttctttttcgtccttttttgcaaatttttttcgtccgttttcctttatccggcggaaaaaaaaagcgtgcaaaataaccacatgcaaaaaaaaactggggaagaaaaccgcgtgcgaataaaccaatcggataaaaaaaccgatcggacggaaaaaaaccagcaagaaaacagcctattggacttttttttctcagtcctttttcaccctttttcttttttcttttttctgttttttagtcttttttttgtccgtctttttttctgctctttttccatgtgctttttaattttttttctgggccttttttccggttattttcatatgtttttcttcgttgctgttttttagttgtatttttccgcacgcggtaaggatttgtgccatgtttttttcatcacggggcgaacactaacgtcgccgccatgttgatctatcttcccatgcgttccctcctccaattgattgccaaacatcaatcccccctactccctcaccattttcctcatgattttcccttttaactccgctgtaattcactgaatttaatctctatttaaaaatcaccggcttttttttctttccgtcctttttcaccctttttcttttttctttttttttctgtttttttcgtctttttttgtccgtcttttttctgctctttttccatcggctttttactttttttctaggccttttttccgggttttttcatatgtttttcttcattgctgtttttttagttgtatttttccacacgcgataaggatttgtgccatgtttttttcgtcgcggggccgaacactaacgtcgccgccatgtcaatctacctccccatgcgttctctcctccaattgattgccaaacatcaatccccctactccttcaccattttcctcatgatttttccttttaactccgctttaatttactgaatttaatctctatttaaaaatcacctttttatctcgagttttgtcgcttcgatttcaataaaaatggaaagaggagaactagtgtatcaaaaactctctaccaatttggaagatcgagaaagattcgactggatttgatgtgggggatttgaccagatttgatggggagaatcggggacctacagctccacttgacaaggaaggaaagaaatgagtttttgtccaaaaccaaataggaaaatatatagcaatctaaaaatgtttttacccgttgcaacgcacgggcattttttctagtatattgttaaaatacgtaaggtttctgtttttttgtccgtcactttttttttattttcatcttttttttcctttttaccgttcctccattttttttcttcgcttcttttttccttttttttcacccgttgtttttttctcttttaacgttctgtttttttttctttttcgccgtttgttctcgtcatctccaccgccatgtcgatcggtctccgcattctctccttcaattgatagtaaaaatcgattcctcactactctcttattattttctccataatttttcctttcaatgccgctttaatttaccggactccctcattatttttcccataatttttcctttcaattccgctttaatttaccagatctaatctctatttaagagttttatggattcgctcagattttgataaaaacagaagagtagaataagtgcatcacaaacccttaaccaattttagaagatcaataaagattcgatgcgatttgataggagatcagttctagcatcacactcttccgggctttgatggggaggatcagttctagcatcacactctttcgagctttgacgacagcagtcggctatatgagttgctataatgtatagtgatcgaaaatgtttttatctattgttaaagacgacagtcggctatgcgagccgggcctacagctttactcgtgggctaggtcaaagagacgcacgccaagctgagagaggtagcgggctaggctgggataaaaatagaacgaagaaataatcttttggcccaaaaagagtataatgtatacgattcaaaaatgtttttatccgttgcaacacacagatattttttctagtttacatatatataatcatgtaactaattaggtaattaaccaaagtaatagcgtattaggttatctccaagactcttgggtggtctctcttatgttagaaaaccttactcggcagcagagaaacatgcttaattaaatgatcaacttttaaggtatagccaacttgaaaatacatgaagcggccgacacgtacggatctaaggacgagacttcatcagaccatgaccaccatacgcagaacccctatcgcacttgccaaaccgtcgcgatctccacaaatcgagccaaaaacattctgcactgtacacgaccaatttgtatctgcctagctagccaccctggcacgctgcagatacaactagcttttgctcgctcacttagtttcaactagagcttttgctcgctcgctcactactatcttcaatttatttatagctaaactaatagccaattcatacaatagttgcttactatactattaatatatagtcccacctgtcatatacacattgcgtcttggagtccgtgttgcagctggctacgaatctgtagcccgctgctcttctctctcatcgtttatctcattaaaatatgtttatagctggttaatagcttgctattgtatctgctctaagtccattgtaatctatcttccactgccattgacaacaagggatcctaggtaaacgaagattcctagtttgtaaacttaaaaagaagaatggacaactacatagcatcctggtctaattagaatttagcatgtgtgacttatgataactatgtgcgtatgtttactatcaccttgctagtttagtaagagtggaaccgacatattagaattcatcccttcaaccatatgactcccgggttgatccttttatacgaagcgatgatggaagtataagtgaggtggtatgtgtaagtgggtccacctgtcaaatagactggttacgcagttctgaagggaaggctattacaatctattcagcataattgtactaatataggccaaagagaaaaatggtcatagacctaaaggacccagagcaggggaaagggaatttaaaccagtgtggtagcttcttctagaatcggctgtctcattaaaatgcaatgtccaatttgcagtatccaatttgcaagtggtccttgttgttttagcaactaaactgaagcacatgctgcctccaaccccagagcaatgcatggggtggcaactggcaactatctctaccaagagacaaaaaagaagtatgattaagtgtgggtaactagagacataaaccacaggaataggataaacaacaccaagacaaacattccagtcccagtagtgcttatagctaggctagaatggtgctaagcacaaactgcatcacgtgaacctaactaggaaaatactatatgctcatactatcatagtagtaagaaagcaagaggaatttaattctctcttggaagaacaagaatccaactaccaaatctctctctcccttatcccctttaacctcttcacaaggatttcttctttctttcttttctttttctcttttgttcttgtgggaacatgcatgacaggtgcaggcgtcagaatacggatgggcacaatggggaaggaggatgctaaacaacaaaaccagcgtcaggccagccagcatagaccacggtttgtgtacacacacacacacacacacacacacacacacacacacacacatatatatatatatatatatatatatatatatatatatatatatatatatatatatatatatatatatatatatatatataattcatatatacacacacacatgcacttgcttccaaggcacacaccagaagaatatcacacaagcagaagcaaacagggcagcagcacatcacatagaagtagtagtagatcacacaccatgatgcatcatcaatatatgctctctaccaaaatcaaagccacgagccacagctccagccagccagcagtatgcagttggcactttacttggcacccacatcacaccctgccaacttccaaagcaagctctatactcaacagctgctaatccagacaagaacctgcagatggttttaatgcactaattagtaactagttgttgcatgaccccagctccagctagctcaagaatggaaatcagggttacaaatgttcatccttgaaaaggtaaagggaaatgtgaagggggaaaaagggggttagtctcacaaactggaacagaaaaagaaaaaagaaaaagaaaaaaaaaagagaggagacaaccaagaaacaatggaaggaaaacaagaattctagagatgggtctcctcccatacattggagtgcaatgtaggtaataatggcgaaacttggggaccttctcgccaaaaactcttctctctctctctctcaatattttttttccctttggaagttctctctaacagagcatgcacaattgcgagaaggcccccctacaattagtgaattgcggaactcggcggcggcgagcggcggcgcggggacggcggcggcggcggaggctcagacgtagccgttgcggctgaggtggaggaggccggagctgccgcacttggggcacacgtcggcggtcttcggcaccatgaagtacatgaagcaagcccggcagccggcggcgacgaggacgtgggcgccgttgtcgccgacggcgtagccgctgccggcgccggaggccgactcgtcggtgggggagaacgacgagagcgtggacgacacggcggagccccggctgctgctggcgctgctgctgctgctgctgctgctgctactgctgctgctgctctcctcgtcgtcgccgtcgcggccgtcgtagccgtagccgtagccatagctgccgtagccgtagccgtagccgtagccgtgcccgctgctgtcgtgcgagcgccacgccgccgccgccgcggtgaccgcgcccacggacgacacggaggtgtaccccgacgacgtggtggtcgacgccgcggcggcggcgccgcctccgccgccgcggccccgcgcgcgcgagcagcggcgggaggaggacgacgcggaccgcgacgccggcgacggcgagtacgccgacgacgagcgcggatcgatggtcgtccgggtgccgtcctcccagttgatgtagtaaacttgccccgtctgcatcagcaaagccaatcacaaagcacatttcacacaaattcacatgaagtcatgaactacacatcaaaattcatctaaaaataataacaataaaggaaatgcgcttgaactagacagctagtggtacagattaagttaatcttgcaaatggcgaaatgctgtttcaagaatgtggtgagtaaatgtgcatgatgcatggagaagtttgggtggggaaaatctacaagtacattttggtgacagtctgcaagaacaattaatgcggtggcattcagttgcttccgtgaaacaaggttgagaacctattaataactgatgcccataacaaagtacagcagaacaggggaaagaaaaaaaatctggatcaaatggtgtaatgaatgctgctctctttgtcctcttgtttgtttgcaaatcacagggcaaggttggcaatgaagaacaccaccaccaaattctcatttcatcctttgtaaaaaaaaaaaaactctaatctgcaggaaagctgttctacttaaaaagcacataaatgtattgcagtagtatcttcagaaaaggctactgaaataaccataagaagagcatttttgtctactctgttgctggagacaaggtggagatgaacactccattttggtgattaatacgcatgaatcttcattggggtaggcattcattcgtctgttcaaagtactagcagggatgaaaaagaaagggagacactttgtcacaatggaactgaagatttcccagaggtgagaatcatctggtgtttaacaaagctctgcgattagattagaacccaggaccaaaaaaacagagcattgtggtccagaagaaatctatagcgaaatctagagtttcagatagagacagagcaaaaaggaatggatctacagggatgtgtcagaaatttagaatgcaacacagatctgaatgcgcgcttagatcagagaccagagaaggtgtggagatttgaagagccttgatatcatcaacaaaaaaaaagaaaaaaatagtaccatcttttccgaggtttcttttctgaacttttgtcatccctgtgttaaaaagaacggcctgaatctctctgaagatgatcgaatccccaaccaaacgaagataagaaccgaagaaaaaaaacagagataaataaaaaaaatatttgcatagacgaagagaggaatcgcagatgaagcaaggatccaagaacaagaacaagaagagagaagggagacgaggagcagaaagagaagaggaggaagaagaaaaaaaaaatcagcgcggacgggtcgtctcgtctcgtctctctctccagttcgagcgcccgctttcgccattaatgatcaaatgattgatcccaatcgagcccaaaccaaaccacacccacctacctcggaaactgctatccatttatgtctccaaatgattggacaaagggcggcgcgccgccgcccaccgccgccgccgccgcaagaatcgatcggggaagaaaaggaaacgcggcgtatgcatgtatggatgcatgtgtggaagaagagatgggcgagtagtagtagacgtacccggatgtcgaggcactgctcccagtggtagggcagggcgacctcggagttgagctcgacggtgaccccctcgctgtcgtcgctcccctccgccgccgccgcgcgcctccccctgcgccgccctcctcctcctcctcccccgccgttgagggagcagttgcgcagcgacgaggcgatcatctcgatgttcggggcagtcatcaagtccaccaccaccaccaccaccccacccccccacccctccccctctccaacaagaaccaaacggacggcgaggaagaagaagaagaagaagaagaaggaggaggaggaggaggaggaggagaaggaggaggagaaaggaatttgcttttgctgttgctgccgcagcggctgccgatgccgcggtggtggtggtggtgcgcgtggccccccgggggtagcgtaggcagcgtatgacgcgtgaggctacagtggtggaggtggaggtggtggtggtgcctggttggagccactgttatatatactgccattgttgctcctgctgctgccaatcttgggtgtttttggggtggttttttggttttggttttggtttatagggttctttggtttggtttaggagggggtggagggaattggaggaacagtctgtctggacgagtgccaactgtgtgccaacatagtatgcgctgggattaacggacggacgccgatgcctgcccagggtatcgggcggtttctggttcacttcctacgtcttgtatgcttgcccaaggtatcgggtggtttctggtgcacttcctacggctgatatggtgctggcgggtgggggtgggagcgtcgtgatatgcgccgatggtttttccggcgcctatgtaaatctgggggccgtgagagaggttttgttttcgtgcgctggattcactggcgtgtaagtatgcgtattaggctatgagtaattgacggcttgtccgcttcctttttagtgaagtaatgatactgtaataatgagatatgcttccaaaacaacgagaggtcgagagcgatcaaggtgaaagttttaattaaccatgcctagcttcctggtattcatgaatggtattctatgctacgatagtccgaaggcctatggaacctgtttcacatgtgtataccgagtctatataagtaattgtgtgttccttatcaatgttgcattgaggatgctatagaagacaataatatttttttaatgaatgaaccagccttgatcttctttttgtttaagataaaagaagaaggaaaactgtgataatgtggtgtacgaccaaaggaagaaaagtataagcatgaaggggttgaaaggtgcaaatgatgaaagctttctgctgcagccaagggggagagagagggggggatcgatgaatgatgctagggggaaaggtaacatcaacctactaccatggccactctctctctctctctctctacatatcgctctctctcgtatggtgtgttttggtgttgcatgttgtccctgctggctgatgcagctagcggagctcaaaccaaaccactggcccggcccggctcttgggccaccatctcctgcgcagattcctcttctgccaaaccgaggaaaggttccccccttgtccctccctcctcctctctctttctctctctccttccttgaatcaacctgaccatttcaaaaactccatcacaactagctgaatttgtctcttggaaaatggcattagcttagcagcaaaatgtggcaataaaattatagaaaacatgcagtgttatgtacagtgtaactgtgtagagagagagagagagagtgtgtgtgtgtgtgtgtgtggaggaagaagaagctgagagcctgagagcaagcacggtcagtggcctctgatgtctttgacctactagcatgcatgcatgtacaccactgttgcaacatcagacgagatggatggatcgagctgggacgcatgcgagttaatacttttttttattctatattgatcatcatatatataagttttttcatgaaaaccaatgtgagttgagaacatttgaaacgttgtagagagttttagcaaaatttgttaagtcttctgaatgtgtaacacatctggtcgtcgccttcatataatttgacaggcacatatcaggctgaagttgactagatatgtgagattgtctcacatgttcactactcgatatcacatattttatttaatgtaattaagttgtgatggaaaaaatgaaagcttaacaacctctaaatgcgtgcatgcatacatgcatgcttaatttgcatgcatgcataaatcgcatcacttaacattgggtgagtatgaattatcccaagatctgaaatcagacatctttcatgctcaattattaatatcggatgaagaacctctaacttaatccggagtggttatgatcttagttggtagtcaagtcagcattttatttaaaaacaatatgcggaatccacctatcagattctctccgtttcacccctctctaacagatggatcccaccgatttcttaaaaaatgctacctagactgtcatgtaggaccaaaaccactctagattaagttaggagagttcttcacttgatattaatagttgagggtaaaaaatgtctggttttcggatctaggtgtaattcgtactcacctaatagtttagaggtgtaatttagactttctcctaaatacaatactgttgcacgtcaaaccaaagggcactggttatataatgatcaatttaaattttttagtattatatgatgatcaatatgtgaagggatcgatgatgtcacactacgtattatgttcgtttattttagaaagaaaggagcatggagaatctcttattaccatgtagcttgtctctgtcctctcctctccggcatgcatgcacgcgcttgcgttgcttcgtttcgcttggttgcttgcacgcttgtccatgcatgcacgcacgcgtggtgtaccgcgaaaatcttttggatggctgcgcctagctcgtgttcgtgcatctatctatctatctatctatctgtctatcttgcatcatcatcacgtactggatcgatgtatgtatctctttcctcctcctcctttttttgatctagcatatagcttaatttgttctcgttctcgttgttgcggtgtacgctctgctagattccaatgcagatgcgtggtagtactcctacgtgggtaacatgggacatggccgttgttgcttgctcgctttgctgatctctggtggtttctctcacgcccaatgacgacgacgaccatgatgatgattgatggaactccggaaagggggagattgttttgtagggccgtagctgtctctggaacagatatgctgcatcgatctcggaccaaccctgctactagtagtggtagtggtggtagcggagatcggtcgatttttttgggccctgttgattcaagtggacgggcaaatgcgaccctccccacacggttgtgcatgggatcgacgttttcctcctcccacgtactacctccttccctaaatgtttgacgtcattgatttttttaaatatgtttgaccattcgtcttattcaaaaacttttgtgaaatatgtaaaactatatgtatacataaaagtatatttaacaataaatcaaatgataggaaaagaattaataattacttgatttttttaaataaaataaacggtcaaacatatttaaaaaagtcaacggtgtcaaatattttgggatggagggagtacgtacgtactacctccgtatatttcgatagaatcgactaaggcagtgtttgtttctatggaaggaagataaagttagtgcacagaaaacacgaaaaggaccccgtaaaaaaacacgaaaagtcattattaactcataatttattaataagttttcattattacaaaaaaattgtgcaacaactttcatttatcaccgctacataacaggtttttccatacggtccaatcccaattttcacggatggcagggcgatccacatgcaccaaatggtctgtgaaaatcgttcacgcgaaaatccgactttttacgtgcgggtgcttatgtcgcccgctcgcaaaaataaaaatccaaaaaaattaaaacccaaaaatggcgaaacctaacctgccctcctcgtcgtcgttgtgggggcataggggcctagcggcggctgggtccgcccgctcccgtcgccggagccagagccagatccaccgccactgtgcctccccactgccgccgcgcggggtagggcagccgctgcccctccccaccgttgtatccgccgccgccgcgcctcactgttggtatttattatgaccacggaataatctataagcgcacaaataccgttgtagccttcacccaagagtatttcagtgtatcatatccacagtaaacgtgtgtgtataatctaagaacgaaattcttcgaaggacaacaactaaatggtaggcttgggatagagtggactcctgtgggttagttatcttaattaagttaacgtaaaactctatcacatgggcaagataacttgtcaaaaaaccaaatcagtgccaggtccattggtgaaagactatcttagcacaattttccatttgaaaaaataatagtaaaaggacctcgacaatcctttgctagccaataattcacatacctattcatgtaaacaaatcacaactacgaaaaggattttttcgtgcggtggaaaagggttttcacgtgcgagtgggcgaaccgcacgcacccagttgtctgcgaaaatcgctattttttgcgtgcgggtggcgcaccctcatgcgaaaatctgattttcgcgtgcgggtgcttatatcgcccgcacgcaaaaataaaaaaccaaaaaaaaataaaaaaaaaccgaaccctaaccttgtcgccatcaccatcgtcctcgtcagatccgccatcgccacgcctcctccctaacctcaaagccgccgcagccgtcgtcctcgtcgtcgccgttgtcctcgtcagatcagccaccgtcacgcctcctccccaccgcccgccggccgccgccaccaccaaataagtggcttccaggcaagcatgctctgctgttcctcagaagtctcaaccaccgtattaatcagaagagtgcccaaaataccacgaacttccaagcgaactctatatggcaactctccattgaggggctcaataactgtgtactatggagcttcaatgtaaccggcaacaaatgtcatatttgcaagctccgcaacaaatccttccatgccttcaccatggtgagtacagggagaatcggccatctaaagaaaagatagaaggaacaaaactgactccgatcagaaacgagatgctggcattaaaactggaaacaaaaagaaagaaaaggcactaaactgaaatcaaaaatactgaagcaatataaatatttttttaaaaaatactatttttggcccaattttttttttaaaaacgaaactctccctttctttttaaaccgaaacccttccctttttttctgccaaaaccttttccttttttttgccaagaatttttttccgaaaatattatttttctttttgaaatgccgaaaacattttttttaaaaaaaatcaaaaggcacaaagaaaaatatttttttgatgaaattcagaaacttgaaaacaaactcatttatttggactcactggaccacttgaaaaggagggaagaagagatttccaggggaataagagaatttcatagggctctatgggctttccgtttggtttgtcctacggtcaagatcggctctgataccaacttgtcacgcccagagattcgacaacccgaatcccggctatctgtgcatagtccaggcatcaactagagtacacgaatctgaagaagttaaaaaagactcacactattgtatttttcaagttaaaagaagacattagatggagcggctgccactagttgtgtagtcacgtcctatgaaaaaaaaagcatatattaaagttactttctttttattataagttacttctataatatatataaattacttttaggctttattaaatttacttttatatgtctatgtaataattggctgtagctcttttgagtaaaggccgggatatttattccattatctaaaaaaatatatctaagaagtgatttagtgaaatctaaaagtaattttgatatattataaatgtaatttacaatttttcatcagaatataatcatgtgagatctttctacaaagatttaattacgaacacgacggtgtaatcggatcgtagatcggatgagtagtttaagagaaatttttatttgaagtataggtggataggatttctcatagatgaagtagtagcgctgtgtagtcatgtccaatattggatgctgcctttcaaaaaataaaagagcaattacaaatttacaaccattttaatttgttattacagaaaaaaagagaaaacgatacttctaaaaacaagcatatccatatcagatatcgtatcaaacacaaatgcgtatcgggatactctcgaatgcatatcgaacatggaaaagctaatgggcgattgatcgctaagggcgatcagggcgacaccccctcctcctcaacgtggttttcttttttggtaccgtattactttgctatttttagtaaatttatacatctaaaatttatacacctcaagtttacacatctaaagtttatacacctaaagtttagagacccaaagtttataagtcaaaagtttatttatccgattcaaatttgaatttcaattcaaattttttttatatatagtattttctatatatctaaagtttataagtcaaaaatttatatacccgattcaaatttgaatttgaattcaaattttttatatatatagtatttctatacacctaaagtttagagacccaaagtttataagtcaaaagtttatacatccgattcaaatttgatttgaattcaaatattttttatatatagtattttctatacatctaaagtttagagagccaaagtttataagtcaaaagtttatatatcctattcaaatttgaatttgaattcaaataatttttatatatattattttctatacatctaaagtttattaacccaaagtttataagtcaaaatacccgattcaaatttaaatttgaattcaaatattttttatatatatagtatttctatacataaatttttctaactgtttttttatttttaaaaagatttatggtgtagtacgaagagaagaaggggagaggagccatataggggggatggggtcgatcacctggagcgatcgatcgcccattagctttaccctatcgaacacatatttccgttgctttttaaacaaagaaattaatttctgctactttttcaatatttagtccatacattgccaatactcctagtataaatatcatcataagttacttaaagtttgacattccatcccatttgaaacttattgcattaaaccatgcatttctgcttttccttccttctatattgtgtattttataatttatatatatgccccgtaaccgtgattttgaaaatatgactcagagcatctcacgatttaaacagcaggctgtatcagcctatgacggatcaactcgtcgacgtacattgagcaaagtattgcgcatgatccttagcatcattatttatcaaattttacatagctcttctcattttgcgacagggcagtcacccttactcccttagcatgggtcaggatgtagatacacagtaaaaaccttctaaaacagtcaggcgatttagatcaaaccacatgggagaaaaagctgctacttgggacttgggagtgttacagatgtgaagtccaggttatgcactatacacactgcttataggaaacagccaactggcaactgcttccattccagtgtcactcttccttcagtatcggcggccaccgccagtggacaagagcactttggtgggtttcttgcctttcttcccgactacatttggtttgtgcgtgtccaggctattgtctgacgctctagtggaggaaatgatgctggcaaaggataatgcgggtgttgcggctggccctgcatagaaaacagtttagttatgccaggatttcactagaagaaaaatgggcactgccgcacactggtaagtgccagcgtccaaaggtgcatcgtgtgtcaccataccttgttcccccgtgctttcacttttgccagtcaaatccccagattcaactcttagaggaggcgagtcttgggcagacgcaaagccaagccgtgcaacatcggagaaaagctttctttcgctggctggtggactcgtggagggtccagcattgtttccaagagcttaaatggaaaatatatacacacatatgaagtgaggcagggcaaccaaccatacaggatgaaacatgcagagaactaaaagcacaattgcaaacatgtgaatgcttcagaatgtggattaggagcactaacaagtatgtgttttgccccaatagaaagtctgaatatgcaaaatcaggtctgttcataaatgagtttatttaccttcaaagtcatccagagagaacataaaatcgccatgtggcccactactgggagagaagcttgtatgttcaaacagcattgcagatgcctgtgcagcagcagcaacttcggctttcactctatcgctttcttcctaaaggaaagcaccaaggagaaaaagtaaatgaccaaaataaaccttacaactataagagtcagtttgaactggtatgcaaacagagctgaacacaaaaaacatctcactcaggtatattcttgaatatattttggcagccaaaacacccaattttaaagaaattgaccagcaactcaaaatattcagttttttttccaaaaggcaaagtctgctcttagcaacctagttataagttatgtctgcttgagaaaatccattctatgtatctgacctcctgtcacagtttaatttccatcctaattcatactccctccgtcccaaaatataacaacttttagccctcaacatttgtcccaaaatataacaacttcttcaccaacattctttttccaaccaatcacaaccctccaccattcacttttcccacctacctccactactcaaccaatcacagccctccatcattcacttttacctacttccttaataaccgtgtccaactctaaaaatgcttatattctgggatggaggtagtactttttaaaacataccccttaacttgcaaaaccattcaaaggaatctctcaggccaaaacaacagagttttcaattgcaaacagtggtttcaataaaatttactttcatggaatttggctcaactccatatactgttaagccacccatcactctccatcccacagtcagtgtccacattgaccaactttaataataattagaaaaacagtctgctcatgaaaaatcgggttgtttcggccagggatgtcttttgaacagtaatgaaactttgtggacatcttttaaatggtacaagagtccaaaatgaaaattgaaccaaggtatcagatatgttatagtacaatgtcctattttctccatgtttccatattgtgtggtacactggtagacatatacatgtataatatgtcttgaaagaaatgcttttaaaccatgtgagatagacaatgattactgtaactggcaagattgcacttcccagttctatcaaagttaataatatgtttcatagcatctccagtcatgtacttggtgtgtcatttctggtaaacaaacacaccctgttctacataacccaagagtaactacacgtctacaccacacttgaaggcactgcgtatatcataagaaacgatggacccatacaacaaattaagaacatctaatgttactaggtgactccttgaaaagcgcctctataaaaaactatttgacagcattattaaatccacagggattaactgctggcaaatctgagaatagtgtccacttgcaaaatacaaactaaagaaattttgaacaaacaacacacaacagttctgactaacaaattttcaaaagtcgactagtcatgatatgactactgatggcgaaatgctgaataaacaatacaaagcagttctaaccttcttggcagttcgtttcctctgtttctctcgcttcttgatttcatccatgaatggagctaatgagctaggaggcagcatatcacccaggtcaatttcacagaactgcgtagttcatagatgacagagcgtaagaacaagcttgtaagtaaaagttagttatccacaactggtttacctggaacgttgttgtcaatgagaagtgacttagataacgatagcgctttcttgtagcttcggattgtgttacagtttctagctccaagatttttccatgtattctgcgtgcaagtaagctggataagtatcaagcaaacaccacgagcaacaaccagatacaaaaaaaaaggagaagagataagcactccaaccagaatgtagtatctcatgcacacaagaaatacattgctcgagcaaattgagtaaaattggttatcagatcaaactaaacaaattatctctgcttacatagtgaaaaatccaattttccataatcataatcaggatgcaatctacccaatactaatacaatacacaaaataatgtgtcaatatgagagcgatgacttttaaggtgtaaacaaacactataccttggtgggagcatatcagaacttccataatggtttataaggcatttcatgtttagcggatgaagaattaggtgttggccatcagatacctgcaacaagatttgacatatcaaaactctgagaatgaaaaaccatgtgcacaaggtaaacaatcacagccagacatacttcagacctggtaaaaattataagtatcattctcatttgaatctatgggagccatacatctctcttctgttttcgatggcattcctttattaaagattttatttgattcaggtgaaatacagagctccgaaacaccagcaatcatatcttcatctgatagaggagatagcttgtgttcactgttctggcgtgaagattgtgcattattagggttccttgatttggaactagttacaggtgagaagctgtcttttaggggagggctgacactaaaatttctgtactcactccaatatttcatccgttcttctagctgctccaaagcggtagaaacgtatggaagtttctccaagtcatccacaaggcctaaatctgccatatgcaaccaattaacaagatctgtttttgcctctctaacagaaagttccacatcagacgtcaaaatgaacttggagaatgcactgcaaggatcttcgtctatagtagattcatcagtgaggttcttaatagaaggagtgagtgaattttttgagcggctcaaaagtgtaaatgtcacattgtcaccaacatgaaaatgctggacttgagtaatatagattgtatacaactcctttgttgagatcatcatgaaacacagtgggcacttcttccagctttcacctttgtaatcttcttttcccataagtaaataacgtaaaatgcatggaaagcaatatatatgaccacatgatgtaatctgtgggcacaatgggctctccaagcaaatagggcattgcacctcacaagggctataatatcttacacatacaatatcttcccactggagcatcttatctggatccattaattctatttcatagcttccagtatccaacacaacaaacttaaaatttgcttgtaggaacaaatctttgttgtatggtctgatcttcctctgtcttcttgtaggatatgttctggggcctctaggctgtggccgagaaattggatcatagtggaaattcagcagataattggcatttacagactgattctttctagcagtcacctgagtaccattcccactagaatttgtagtggatagatcaatcttcagggattccatcaattcaggtctctgaggagttgcctggcctgaggtgccattattggctgaaaaacctgaattcccatgttcagaagagtggcattcagaaaaattgccaacttcttgggtatatgaatcatcattctcttctctagagattctgaatccaactacctggacatattccagattcataagaaaattgaatgtaagtttcataaaaaatcaagagcaacatacacaaatgtttatcgaaaaactgaaatctgatttgaattacgttatgtaaacattttaccttttgggaagtatcaacatattctctgatagctggaaccaccgagactgcaaagtatgagttgcgttgtaaaaattactttccaaatgggtatattggaaactagtaaggcaacacttcaataatatttatgaaaaaaaaataccaatcaatggatatttttattagcaaaatgatgtaatcaatgagcatgctcatagcagacattgtcaacactcaacagtgaatttgagaatcaattgaactaatgaagaacacaaaatggcttctaagggaacagaacttggttgagactgcaacatgctatgtcaaatggggtcactatcttcatgaccccattgttatttccactatttatactagatagcataacgttcatatggaatcactaactcctgaaaaaacataatcccccgctcgctttaattgagccttccccacttttgaaggatagctaagtaagttgtaaggcatcaattgtccaatatggtagtgcctacctgagaccaaaatgtctttacaaagaaatgcatgctctacagcaaagtaatgaatctaaattccatgagacgtaaccattaatccgcatcggcagcactcgatagtaactgaccaattataagcttaaaaacattgatccacatgaatccacacgagaattggtccaattggattacaattaaccaagccaaagctcacctaagcacggatacagaaatctgtaacccacgaaacacgaattaacctagaaatcacagaccaacactcaatttaccaaaaaggtattagagtttctacacaaagcttgggctcaactctacaacctgcaaaattaacaggtaaaaagcttcccacaatcctcgtccccccaaccaacccagtccagctatctagatcagtagatctgcaagccccgccgataatcccctatcgtttcaatcgacgtttagccgtggaagggggaagagggagggagctcgcgggaagcgagaactcaccggagctcgggccgccgctcccgccggcggctgagggcggtgagacgggagccgtaggggagcgtcggccgcggcggcgcggtggggcggagctgttgccatggcggggtccggggctagggttggaagggcgcggcgcgagcggctgggatcctctggtggattcggaaggggagatggacatcaactccgcgcgggagctcggtgttgggtcaaacggcggctcgtctggtcggcggcgaggtggcgggcggcggtggcggcggcgacgccgacgcggtcacggtggcgcggcctttatacggtggtggttggggaagcagacacgacgaggacgcgcatggcttggctggaccaagtccacgtgagccgcaaacgtggaggattatagtattatactggtcggaaaagcaggtgggtcccacatgtaagtgtgacggaatctgtgagccgagtccatggaagctgtgggagggcttatggaggaggcgaatatgcggttgagttcgctggcgttgccgaaccgatgcgacggagctctccacgtgaggatgacgtgtgggcccagtgacccacgcatatggacccagcttatggaatggatgggctggacctttgcttgaagaaattagtatattttgcttctcctaactactgccctttgtccaataacacccctcaacaataaaatcggtacattacatcctccaactttaacaaccggtgcaaatcaatatttttagtagtttgcaaagtggtttttactgacatgataggttgatcgtgcttagactcactaagtcagcatgggctactgtaggacccatgtgtcaacgcccactcttcttgtcctctctctttctttctccaaaccaagccaacaagcccctccgagcacgtccacttgtgagtccgtccaacatctagctccgagaggctatgatgcaacaggaggttgatgatcgaggacggagatcacaacggcatgggagctcaacaacgcgctcattgcaccatccccaagtcggtgctctctccctcatctcctgcgctacgcacacaaggagctcgaagctcctagcgaccacctcccaacggtcggacaaggggctttgggaggaggtcaacagaccgaggacgaaggtcatagcggcacgggaactcgaggagacgctcgccgcaccatccccaagccgatgctctctcccctatctcctccgccatgtgcgtgaggagcttaaagcttccagcaaccacctcctagcagctagacgaggggctttgggaggttggtagactggggatagaggttgtggtggcacgagagctcaaggaggcgctcacctcactatctctctttcatcacttccctctttccacttgggacctagggagggaggcggtggcgaggtggagctgaggaaggcagtcctcccgaagtagtcaaggaagcccaacgagaggagacgactggtggaaaagagtcctatctctccaaggatagtggagacatagaagtctgggcggagcaggcaaaggccttaggcggcaacaggagctcggcgaggcatctcgccaaggaatgttgtgcatgtgcggcgccaatgcatcttggtgcatccatggtgccgcgggcgctagttgatgctaccgagaagaccacctcactcgcctcgccgccacccgagaaggtcgcgatgctctactacagcgacgaggccaccctctactccgctagcgacagtcgcgtccacctcgccaataggctcgcaagcaagcaccaccactcccttttctctccacctccctcgattccgcgaaccagaggaattcctcgatggcggcgaggagggcgagggtggcgacctcggcggcaacggcaaggggcgtggcgagggtggcccgtgccacaacacgttgggcggaggtaagtgccaccgctgcgtcgtccgcggagagctcatcgaggtggcactagggttgaaagcagacgattgaggaaagagacgacgaagaggcgttgtggtcaaaagtagccacggctacagtgccaaaggaattgggtggcagcaagggtgatgcctggtggcggctgtggcatgaccatggtggtgcaagctcgccggagtcgttggctaaggagtgtagaagaagaggaggaaggaggatgatccgacatgtgggacccactgtcattttttttttctgtttaaaatgccacctaagcaccatgtaggataaaaccatctacaaaaacatccagggagtcgatttgtaatagttttcgaagatggggaaggcgctatatccggttttggggaaagaccaagagatgagggagtcagaacagacttcttccttgctagaatagatcccggtggagagtggaggacgtgttaagctaggcctttgctaggacatttggcccattttcataaattcaagtaaaaacgaatgaaccaattccatttcttacatcaaacaggaaaaaagactcatacaagatgagaaaaatatcccaaagttaaacggcgattcttatttagcacatttgcgttcgcagtgcacattttcttttcctaaaaaacattcatctgaaaacattcgtccgaaaaactttcatctggaaacgtttgcctgaaatacttttataaaataacttttgcgttggtaatgcaacttcactaaagcagataaacattgctacgattcagatcgtcaagatgccagtaacaaccttacctttcctccctataaattacagtacaaaacaaaggcaacatctcaaatcaataacggtttctgaccgaacttcagaaccgggggtttacaaaagaatcgaattgccaattaatgatccctaagccaatctgtacaatatccccataaaaatgtcaccttctcctctctctcccctgctgtaaattatttcacactctacgtgactccgaacaacctgaattcctacgcttaattagcgttacatataggagtactagtatcttattcatatactgtatatgcctggctatagcttgtcggcgatccggccgagcgcgtcggcgagccggccgagcacgacggcgaggctggccgcctggtctcgccgctgctcccggtcgagccggctgttggcgttctgcgcctccagctgcgccgccaccatccggctgctccgatccaggatctccaccagcttgctctgcagctcgccgccgcggcggccgtcgtcctcctcctcctcgtcgtcgtcggctcgccgccgcttctgcccaccctgctgctgctgcgtcgtcggcggcggcggcggtggcgtgcctctcgatgcggcctgctgctccggctgcttgtctttcgacgtgcctgtgaaaaaagaagaatagtcgctgattggttagtagtgttacgatacttccagctcagatcagctgttcgtcacgttactttcggagaagattgtgtcgtctgatcatgcaactactaattaccaagtcttttcaactcttcgccggcaaaaaaaaaaaatggaagcttttttttttcaactgtactacacatcgagatgctaatgaaaactgcagatttgctcgtggaaataaaccaaaaaaaaaaagcaaacggattcgtttgctgctactacgattgatgacatattgacatgacactgaggaagtaccacgacgcgtatgatgaaacgataattaattaaatctgcaggcatcatcatctgcacagtacaatgcacatgaatatttcgtatctgcaaagaaataggttaccgatctaaaccatctcctttcatttgtcaaaacaaggcaaaggacacaggaattcacgcctcttcccagctctaaagattggccgggaaaacgtatttatctctcatctctctcattttatgtgtgtcatctaaatagtcattaaaaaaattaaaataaattgacaagattaatatgaaatatatcactccacatacatgtaagttaaaatttaatttttagtagacgtgcattgcaacgggtaaatactattttaattttattattgttatatcttttagttaaggtgaaatatactgtaagaacccgtttggatatatatattattttagaaaatcatgagctgcaattaggagtctgatcgtctcaagttagcatgcgagtttttaaagaaatctcttatacaattccttctgtatttacaaaaacaaacgaacttaaaaaccgacttaaatacggctttgtatttccaaaaagaacaaacttaaaaaccgactcacactcggataacgtaccaaagtaccgacaaaaacatcttcaatttgtataatagtataggcaagttataacaaaaaaagctgcgaatatacgataactattttcagtttaattcattttttttgcaacttatagaagttgaatttggcttttgcatgcttatgaagtgatgtatttcatagcaatctatgttgaggtgacatgcaagtaagtagaggatatccccttaagagatgaaaattcatatctagaggcaatgctgctactactacgtacaaccgtttggcaatgctactaatcttcaggtgtactcgatttgaagcactaaactaaggtattagttttgaatcagaatcatatcaaactgacccattttattcgaacattgcaaatttgaaatcctaaatgccgtgcgctaggaaggaaccgaaagccgtgttcgatatcaaggactgccaatacagagaaagcttcgagggacatggtaaccaccgaatcaattcagtttttggtgggttgccacttccatcacaccacaggggtgagtaaactctagttttggtttcaatggcccccacacggccatatatagctcaatcagttcatcatgcgaaagcagagtttgcattgcgttgcaacaattggttggacagagatgtagtttttgccccgaggagcccactgtttagcactagttgggctagtggctaacatgatggacaatctaggaaggtgaacagtgcaagtacaattgacaatttggatttcctttttcttttggtcttactgtgtgggttgaatttggatttaaattttaggataatacatatatattgtgcaaatgccattaaacattttcaaatttttccgtaacaaattacatgtgatttgaaagaatgacggggcaaacctctcttacgggataaaaaaggtttcccattctaggaagcatctgacagtttactagtaaaaccatttgctgataatcctgaaatttcattgctaagtgacatggtgaaagagatgcatcaagtgcatttgcaggctgcagctacctcctgccacccaaactgataatcataacatgcatcactaatctaaatcgcaattttttcgcctttttgtctacggactatgctgatcaagtcaatggaacagtaacttatttctttttcccttgtgcaacactagcaacaaatctggaaacaaggcagcaaaaggagagagctcgatcgagaaaagatgatgtaaaatgaagtgaaatccgattacctcctttctctgttcttctctggaaaaagaaatcacgaggaaaaaaaaagcaacatgaatcgatgaacctaccaaacgaaccatctctaccagaacgaacacgaaccagaaacaagaaagacaccaggcaaatcattcaaaccctcaccccaaaatttcaatatgaggacgcacagactaaatttgagcactggaagctcaaaattttgcggcaattcaagtcgtcaacgcaaagaggacacgctgaacaatctgtgcgatgggaaccggaaagattcccacctttttcgcgtcctatgaacagcgtaaacacagattcgtcgctcaaaagctaggttttgtagcaaattatttcccgagtttaccgccgaaaagtgctaagagttcgaattcatcgaggaggaggaggaggaagaggggcgagaactctgcttttatcgccaaaagatattgcaattttagcagcaaaaaaaggaaagaaagtcaaagggcagctcaccggatatcggcaaggcgatcaccgctcgaggcggcgcctgtgccgtcgcagcgacggcggcggcggtcgccggcggcgcctcgtcgtcgtcctcctcctcctcgtcgtcggagaacagcgactcttccgcggcggggcggccactgtcgaacaccgtctcctcggctcgggctcgcgtcttccccgtctcctcctcctcctccacctccacctccacctccgccgccgcgcgcgcgggctcctcttcccccgccgcggcattacctcctccggagggggagacgagggtgccgcgcccccggccgtcgagtatgtcgtacacctcccggtcgaagaaccccgggagccggcgctcccgccgcgcgtcgttccgcatggcccagaacgacggctcccgcggcggcgccgccgccgccgccgcgcgctcccactccttgatcttcttgtagtccccggcgaggttgctccaccgcttcctgcactgcacggcgcccctctccacgccgtgccgccggcagtactccgccaccgccgcccacttgggctccagcgccgccaccgccgcctcccccccagagccccccgccgccgccgccgcagcagcagcagccgccgccgcggcgcggcccctcccgccgcgcccgccccctcggccctccaccatgcgcttcccctcgatcagcaccagtatctcctgccgcgtccaccgcggcagcctcggcgcgcggccggacggcgtggcggctgccgcggccgcggccgccgcggcggggtcgccggcggtggacatgcgcggcgcgtgtgcctttctttttttttttttgtggcggaagttgacgtgacggcgtgaggcgggtggtgtaacggagagataacggcgaggaggggaggggacgcgtggggaagaagggaagggggagagagagagagagagagagagagagagcaaagagggcatgaaggaaggagggaagaggggttgtgtcttaagagaagggattaggaggattttggaggggttgttttagttattagacactcatcatgtggaggagatgagacatttatgtagtacactagtactaaattgtaatcaagcatccaagcccaaatgcccaaacttggttttattagggatatattttaaaatgaccatccataatttttttatacaaaaaaggtattgttcttctcatggcattttcattctcctaaacttggtattattagggacactttttaaaatggagagatggtaattttgattgtattctaaatttatgtgatggatttattctttattctcaacatgtgagttgtttacaaaagtagaattccttttgaacatcgacatgaacgaatcaggagactacaatagcttacatggaaaataaaatcatttatgaatgtccttatctttatgtctaaatgtttgatgacaatattgcttaggtgggaagccaataaggagcttttcaattaaaaggattagtaagggaggagggtcatgtgtattgttcaacagccatgggcttagaacaatgttggtatatccgtgtaggaatggatggcttaattaagtgatcaacttaggatattaattgccatagttgcagtcttagccacttccataagctagcttaaagaaaaaaaatgtcctggagggagagagttagttggggcttaaccagaggaatcggtgctaaataccaaatgcccatgatgcctcatatctccatgatgtaacaagcaaaaggtgttttggggttttggaattggagaaacctttggataacaatggtggacattgcaaggagtggtgctgccttaaggaggtggattaatttattgtgtgattaggacttgtgattagagcacaacaataccctgccaggctcctaccgtctctgtcaatctttgtgatgggataaaaatttcttttcttatctttattccacaccaaggggtttaatttggcccattttatttttttagtcaaaaaaaatgtacaggagtatttgatttgtctgtgtgctagacacgtgtctaccggaggtggaattatatgggaggccaattgctaaaccacatcaactagtggttagcactaaccctcttgaattagtgcttaaccttgcccctaatggctaaagttcacaaaaaaggatgaccacgttaggatgctgctactaagagaataagatgccagacttaattattcttaattaattgttcttttgtgaaaattgaaaaaaaaaataaagatgtaaggaaccagtgtatagaacatgtactatctgcataaatgccatgatgatgatatggttttgctcaaaattgtgtataggtgtgcatcatatatatatggtgctataagcaggttggacctcacctaatagagttgtataattagggctccagtattggtttagctgtccctgacctggccctttaaatttgaggaggtccatttccatgccatatggcatttgaattgacctcacctactgccaagttcctgtcaacatggttgtaaacaactacactgcttgtattttggtacatgtatgatgtatcctctagctttcccctatattattattgcagcttgtagaacacatcttaattagcactgcgatgagaatatggagagaagccccatgattgaatttcccttttcgatgcatgtcatgcaatagttagccgtttcagagagttagcttcgcactgataattagagagatcaattaattagtggaccaaatctagctaattcttgcactaagagccaaaaagaacatcattagggggccctttcgaacgcgaaaatttttcatgcttttgtactaataatgaaaattacacataattctgtgagagagttcttagaaaagagaaacttagaaaaaaaaatcctaaatagtaacagagttcttgatctcggaaaaaaaaagatatcttttctcctgtcactgtggagacactgtttgactttgattggggagattttataataattcccagtacggcaacaaaatcctgagaaaaaaaaggagagaagtaaataaaacggcggcaaatcaaaaggttgtgggagatttgggcatgatcctaagaggatatcgcccatagagagagagagagagagaggtcccaaaacgagaggcgtggctcttccattgttccatgcacctcgcttgcttgcttgctcgctcgctcgctcgagcctcctgtaactttcagtgtcaacttccccttttctgtgtgaccaaatgggcctctcccatccatctctcctgccctttcagccactacaagaggctacgcatcctgcaacccatttacacatatacatatatactccatccgtcccataaaaaaccagcctagtaccgaatgtgacgtatcctaatactacgaatctagatatacatatgtttagattcatcgtactataatatatgcaaatatatatatgttacctctggtttcgaatgtatgtaactgttggccagtacaacaaaaattttaactgtgaacatcaataaacattaaatggttatacgtcatgacacatggaagttttatggctattttgtttattttttttaaacaaaccaacgttatataaaaagaaaaaaggtatattttttctttaattatatgtgtccatgagatgagacgatgacctcttcttcctctagctggatgctgatgtttccattgcgatgtgccctagctatgtgtgggggagggaagggagggcagttagtagctttgcaagctagctgatgggtggataggtcatggtgatggcaactgctttcattagaaatgaaatgaaagaaagaaatcaagaaagaaagaaatcgaggatgaaagatattgagatagggcaagatgaggtgtgacaggtgcctctcttgttggtgccttgccatcctatcccatgttgacgactcatcatcgatctcgatcttgtgtccgttttgactttgttttcctcctttttctcctccttttgcatatgtataatccactgcaaaattaaaatatagctgtgtgtatatattagcatatgcgcacgtgacgtgacgacgtctggtttttctctattccttccttgatgttgttgtcacgttaattttaataatttaatggttcttggtgtacttcctgatacctctaaattcttttgttggtttttattatatctgcgtttgtgcggtaacttcttgaccgcaaaacaaaattgaagttatccaaaatctcgaaaatttttaaaacacaaccatacggatgaaaacatactgatactgattggaattgaacccgacagtaattctgaaaacattaaactatatataaaaaaagcacgtatctaactgtcgaaactagatttcggcaataataaaagggggtggctatcaagctggaaaagtgtatgggtttggagacaaaagatttatacaggttcaggccttcttataaaagaagtaataccctactcctgtccggggatgaatccgccgagtgtattattgattgtatgatttagagaaaatcaacatctgcccctagaggcgcccggaccccccttatatatgggaaggagtccgggttacaaaagataatcaatatccctaacggaatacacagatatagattaaatacagccgtgaccgactaagtctcaaggtgtttccttgttgtacaagtcaagaaacaaacccgagatacaaataagatattctatacatattcggtatcctatatccagcccaaatagtatcgccgtgtagatatgggatatccataatctccacagtagcccccgagacctttgcagtcaaccatcgtagccttctcaaagatagcaatccgagtgcttcagattattcatgccaaggcccaccgagtagcgaagacgaagactgtaaagggcgaaaagataaagaatatggtgcatcgaatagatgcacctaattaggtgtagcccccaactatgtgattagttaacaaactaaacatatagttgagaacaatataataacacaatcatgcattagatggcaaaagcatacgcgtcgcctaaagaggcattctagccgactgctttttagccataataaaaagaatccgagtggtttacactcgaaaaggttcacgaatgaacacactggacaggcatccgaatataaaactataaagattacccaccaaatattataaaaattatggtaacaaaaagactaatagcctaggctatgtcaagttaccacaataaaaataggtatataacataccaaggaaatgactatgataaaaacaagtcattccaagttaacccaaacagcttttgtagcctaaaaaagcttacaaaaacagcataacgcttttctgcagggcaccttttaatttgcattgcaataactccaaagaattatatgaccgcataaaaaggattttgtcagcattgggcaacactattgtgtgcataaatattgccaaagcaaaatatgcctaagtccctaaggaacacaatgggccacgctgttaaaagtattgggctgaggtactgttcaggcctaggcccatttgcacctccgatacccttaacaaaaaatccgagatccaagcgacgcttcgtcttccccgccggaacgctcgccattttccccactccttgctacagtaaagagctgcgccggcgaactagggttcatcaatccgtccaaatccaccttcgaaaagtgattaaaaatccttcccgtgatccaccgcctcaattcctcacctctcccaagccatccatcaaatcaaatcagcgcattcgggtaaaatcgatggcggaggagaaagaaagctttgaaggccaatgggcgccatccgacgtaacggaagagaacttgaaggagatggtggcgcacggcgttctcccagccaaggagatcatcgggtggcggccagcgtgcggtgaggcttttccgacccctgatacacatgagatcgtagtcttctcgcatttcttctatggcggcttcgctcttccgacctcgaaatttttccgcgggatcttgaacttttatggaatcagcttgcatcacctaaacccaaattccatagtgcatatcgccaatttcgtccatgtttgtgaagcctttttgggaatcaagcctcactttgccctgtttcgccggatcttcttcctcaaaccccaaccgaacaagagcaaaccgtgcgtagtcgggggggggcaggattccagctaaggggaactctgagccaaaaatacttctctatgcccttcaagacttcaaacaaagggtggcatgcaaactggttctacgttcagaatcctgagcctgctcttcccgggtactcttgtcttcctccggtgtaccaagatacctggaactcccttccaatcggagatgaagcagtccaagccttggagttgatggaccgcatgttaaaactcaaagaacaaggtttgcaaggagagcagattactcggcatttcatcaaatgccgactggcgccaattaaagaaagatcccgtacagcttttgagttcgacggcaagcatgatcctaaccgtgaagaacctgactctctggatttcaaaatcatgaaggagagaatgtataaaatcttctcaaatgccattgtcgttagctactcacaccagctgccagttgtgccatataatgcattcaatccgcctccgcaggtatgtatctgaaatcttcaacttatgaccaaaatagtatcttgtcttcatgttgaattaactaaccatggaggcatcttattcaggaatatgtattgatgaaatccgatcccccaattgctcagcgacgatctcctcgccagcacaccattcagggaagtggagggccgacaatcatgtcagacccacaacctcaaacctccaaaccggctgggcagacaggtcctcgcaagagaaagctggtgcttgatgacgacgagggcgatgacagcaacaaatctggggacaagggcacgcccaacaaactcccgaagcataccatgcccaggaaaaaactggctggccgtcaaatgccaaagattagaacatcttccaggtataaacctctcgataccattttgtttcggcatgcttcccttatagaaattatgctaaatatcgaaagggcactttgcaggaaaccgtccgatatagatccaaccggaaaagatcctgatccggctgtgacagaacaaaatatatccaaggacgctgagccgactgctgaaagccagccgactgccgaaagccggccgactggcgcccatgcttcggatgacaaggccaatccgagtgaccagccgccgactggaaaccagtcggcaacaactgaaactgcaacaacccgagagcccccaactggaaaccagtcggatgtaggtcctgatcaagaaatccctgaagttgaagcgcaagcgacatcttctcaaggaccagaggctggaaatgactcggtggttggctctccagataaagaacaaggatcatctcgcgctcagccaggcacatcctcaggtaactcatcttctcaagtgatatcgttctgaataactccagcttgctcgtctaatgtcttggaaatacatcaggaacactaggcgatgacgaagaaacaattcctcgcataaaggcggctgatgactcccgtccccctatcttactcaaatggtgggacgagaactctcaagtttccggcattgttataaatcgccaaaaagaagatgaggaagtgtgccagctgaagaaagcacttggagaagccactcgcattgtgaatgtaaatcttccgggtgactgcctttaataactttgttttcttgttagcaaaactaatccatgaaccaccgtgcagagaatccatcttcgtaatgaggccaagactgcaaccttagaaaagctggttccacatttgggaactcttgaagccgttagggaacagctacacgaggccaaggagtatgccaagaaaacggagaaggaattaagggaacgaattgcacagctccaggactccaacttcgagctgagtggttcatcaaaaggtaatctctagatctgtcccatttatactgtcatagctggatcctcaaacatttggatttcaaacagcgcaagccaccagaatggcccagatggagaaacagattgaagccttgaaaagagacaaggtagaactggctgcgaaaagggactcagccttgaaggaggttgaaggtactgccaactgacaatttgaactgtcctctctttaatgcagcagattcttattataaatgtattttgtagaccgtaaaatcaaatcgcaagctcagtttgatgtcctggttggtaagatcaagaagcttgaaggagcaagagacgaagtcgccaatgtcgctacaccactcgtccaagctatgttccttaataacagtggtccgagtgcacttgacgcaaccgaaatctttgacaagttaagagttgcaccggatgtatacttcaagaacatcaagaaagctggaagcatgggagctagcatggcattagcgatgaccaaatccttgtacccaagaattgaaatcgacaccattgatggatttgcagatgggacaagcgaagaagctgctcttgatcttatcaacaatgctcaaaatgcggctgacaagattgcaagcgatgtggtagatcaattccgcaacaacaaccttcagccgagcaacgataactctgatgatgaaaggactgattctgactgagtatgattgtaacaaatggaggcataatttgtactatactggtgtatttatgctgtgcttgatagttctagccaagtctttgatttcttaaaagtttttatcaagctttgttgagcctaaaacccaaataagctattaaaaactttcagtcctcgcaaactaagtagaaaaaaccaaacaaggcaatgatagaccaagtaagcaaattaaattgataaaaaatcacactccattattataatgatagcccccgactgacaacttcaagaagaaaacttgatgttgacagtcaagatagggaagtacaatgataaacttaagcgtagaaacgacgaagatgctcaatgttccaagagttgtcgacaagagtaccgtcttcgcgcttgagtcgataagaccctggccgggtgacttcagagataataaatggcccttcccatagaggagataacttgtgccgatctcgtgtagtttgaattttcctcaaaaccaggtcaccgactaaaaaggcacgagatcgaacattgcgattatgatagcgccgcaacccttgtaaatatcgagccgaccgaatcaaagctgcttcgcgggcttcttccaatcggtgcaagtcatccactcggtcctcttcgtagcgttcttcacggaaatttcgaaagcgcaaagactcgaattcaacttcactcggcaacattgcttctgccccatagacaaggaaaaaaggtgactggcctgtggcccgactgggtgtagttcgcaaagaccaaagtactgatggcagctgttgcacccatttgccggcatagggttttagccggtcaaaaacacgcgctttaatcccttgaagtatcatgccattggctcgctccacctgtccattgctcatggggtgtgccactgaagcgtagcaaatcttaattacaaagtcttcacaaaagtctttaaaaactccgccagtgaattgtgtgccattatcggtgatgatccgattgggcactccaaatctatgcacaatgctgatgaagaagtctcgagcattgtccgctgtgattgtgacaaccggtttagcttcgatccacttggagaatttatcaatggccacaaagagatgcgtgtaaccgccgactgcctttttaaacgggccaaccatgtcgagcccccaaaccgcaaacggccaagacagcgggattgtttgcaactcttgagctggtagatgaatttgtctggcgaaaaattggcaaccttcgcacgtgcgcacaattttgtcggcgtcggacactgcagtaggccagaaaaaaccctgccggtaagctttgccgacaatggtgcgtgcagcagcatggtttccgcatatcccagaatgtatgtcttttagcaattgtctcccttcctctaaagatacgcagcgttgcagaattcctgaagggcttttcttgtataactcggcttcatgcaaaacataaagtttgctccgccttgaaatccgctcggcttcatctttgtcttgggggagttcttgagaagtcaaaaatcgtatgaggggctctcgccagtcggcttcaaccatagctacgtcatgagtgtccgcatcttgagtagtatctttatgaggtacggtcggtgtataaaggtgttcgacgaaaacatctgagggcgccgcctcacgcttggatccaaaattggcaagtctgtcggcggcttcattgttgtgtcgaagaacgtgactgagctcgagtccatcaaatttgtcttccaatttgcgtacctcttgtcgatatgccatcatgttgtcgtcaaggcaggaccactctttcataacttggttaacaaccagctgtgaatcgcctcgaactattaaacgctttatccctagggaaattgcaatccgtagcccatgaaggagggcttcatactcggcgacgttgtgggacgccgaaaaatgtatccagagcacatagctcaatctttctccagttggggaaatcaaaaccactcctgctccagtgcccgaaagtcgtttggatccgtcaaaatgcatggtccagtgctccatgttctccgcgggggtatcctcctggcactcggtccattcggcgacaaaatcagctaacgcttgggacttgattgaaattcggggcttgaatgatatgtccaaagacatcaactccaaagcccacttagcaatacgtccgtttgcttcgcggttgtgcagtatatcaccgagtggaaatgatgtaaccaccgttaccgagtgaccttgaaagtagtgagatagcttcctggtagtaattagaataccatataacagcttctgaacctgagggtacctcgttttggagtcggctaggacctcgctgacaaaataaatcggtcgctggactttttggacatggccttcttcctcgcgctcaacgaccaaaactgtgctcacaacctgggaggtggctgatacatacagcaacaacggctcctgcgggtgtggtgaggctaagactggtggctcggtgaggagtttcttgaaatcttcgaaggccttctgtgcttcgggtccccactggaagttatctgttttcttcagtagcttgaagaagggcatcccccgctcgccaagtcttgaaacaaatcggctgagcgccgccatgcatccagtcagcttctgaacatctttctgggtacttggcggtttcatgttgaggatagcagtaactttctccgggttggcttggatgcccctatgagacaccataaagccaagcagcttccctgacggtactccgaaggtgcacttttcagggttcaatttcatcctgaaagcacggatgctcgcaaaggtttcttctagatccgagatcaaatcatccttttgcttggtcttgacgactacatcatccacataggcttcaacgttgcgaccgatctgcgttgagaagcatctctggatcatgcgttgataagttgctcctgcgttttttaatccgaacggcatggtgacgtagcagtatgccccaaagggcgtgatgaatgaagtcttcaagcagtcggattccttcagtcggatctgatgataccccgagtagcaatccaaaaaactgagaagctcacagccggcggtcgagtcgactacctggtcaatgcgaggcaacccaaagggatctttgggacaagacttgttgaggtcggtataatcgacacacatgcgccattgccctgttttcttccgaactagaaccgggtttgccagccagtcgggatgaaggacttctttgatgaagcctgctgctaacagcttggttaattcctccttgatcgcgtccttcctgtcttgtgcgaatcggcggagtcgttgtttgataggcttggcatcttctttgacatgtaaggagtgctcaatcacctctctaggaataccgggcatatccgaaggtttccacgcgaagatatctttattattctgaagaaaggtgatgagcgcgctttcctatttacaatctaactcggcgcctattacagcggttttagtaggatcagagggatctaggggaatctttttagtcttggcttcgctttctccactttttgaagtcttggtggcaggtatttctccttcgctcgccgtggctgcagccagtcggatatcctctcgggcagacgccatctcgcgagtttgggccatgtcgcaactctccttgtcgcatgtgacggcttgcttgatgtcgctccgtagggataggactccacggggaccaggcatcttcatcatcatgtaagtgtagtgcgggacggccatgaacttggctaacgccgggcgtccgagtatggcatggtatgctgtctcgaaatcggcgacttcaaagctgatattctctgtgcggaaattttcccgagtgccaaaagtgactgggagggtgatctggccgagtggagttgcggataatcctggaattactccgtgaaaaggcgcattgcttggttttagctcggagcgaggaatctgcatatcatccaaggtcttggcgaagaggatattgagtgcactgccaccatcaatgagggttctgtgaagcttgacattacggaccactgggtctagtaccagggggtaccgccccgggtggaccactcggtcaggatgatccgagcggtcaaacttgattgcaatctctgaccatcgaagatactggggcgtgtcgggctgaacagcattgatctcccgttcagtcaacttctgcttccgtttagactcataagccagggggccgccaaagatatggttgagctccttgcggtgatcttgaaaacctgccggggtgtcaccgtcgtccttcttccttgacgtgctttgttcttcgtcagaattcttccgtgcagtcttggtgtattgatccgcgaattgcttgtagatgaaacaatctttggccacgtggttggagttaggatggtgcgggcattgggagttcatgatcttgtcgaacgtgttgacgcgcgaacgctgtcgagaagagtgactggcggttgcaacaagttccgcaggcttacgcttgcggtccttatgattgttacatccacctcctcccgtagccggcgtacccttgttttgcttccaactcggacccgactgctttgatgcggtgacagcgtcttcagctttggcgtactcgttggctttttcaaacatgagcttgactgtcctgggaggcttgcgcccgaacttgccgaccaattcttcgtggcgaatccctttggtgaatgcggcgatgatgacgtcgtcggtgatgtcggagatcttgttacgttgttcagaaaatcgccggatgtaatctcgaagggattctccggacttctgaatgacgttgtaaagatcatattgtgtgccgggacgctcgaaggtgccttggaagttggcgatgaagtggtcgcgtagttcggcccaagatccaattgtaccacggggcaatccatggagccaagatcgggcggaatccgctaaagccactggtaaatagttcgccatggccttgttgtctcctcctgctgcgcggattgcgagaccgtagacggtaagccacgattcggggttagtggtgccgtcatacttctctattccagtcggtttgaagccggctggccaatccactcgacgcaggtcgtcggtgaaggcatcttgttggccgatgagatcacgcgctcggcgccctgcttccaaagctcgctgacgtcgatcctcagcctccttcgcggtccgctcacggtcctgctgctcacgccgtagccgttcttgttcttgtgcctgatgctcctcctccagtcggcgacgttcttcggtctcccgggcttggcgttgctcctccgtctcattattggccatgaaaacgccaaagtagagaggggtatagttgtcatctaggcttccgtcgaagtcgtcgaagtcgttgaagtcgttgtagcgagaactaaattcgtcgtactccacgatgtcagtaggacgtgagtcgacggtgggagagctgttgtagtcatctagctgatccgtcgaaaccgtgccgagtggttggaggatgacgccgacttccctgaagctaggcgaaatcggtgttaaggccgacttccgcctaggcctacgggatgaagacgctgtcgtggtagagacggccgctaaatcgtcggggagcttcatcaggactggtgggtaagccccatcatcttgatctggtgtcgttggagaagatgcgatctcggtcgagtggtttgaagccgactcggttgagatggtcttgaagtagctttcagccgcgttcgggaatccgaacgggaccgaaatccggttctctcccgactggtttgactccgagtctaggagagagatcttgccgaagttgttggtgatgaagtcgaggctgccgaaccgaaacgtctgcccgggtgggaagacgaggtcgtcgatgccggagacggaacccattgcactgatcggcgaaaagcttgacgctacccctacctggcgcgccaactgtcgaaactagatttcggcaataataaaagggggtggctatcaagctggaaaagtgtatgggtttggagacaaaagatttatacaggttcaggccttcttataaaagaagtaataccctactcctgtccggggatgaatccgccgagtgtattattgattgtatgatttagagaaaatcaacatctgcccctagaggcgcccggaccccccttatatatgggaaggagtccgggttacaaaagataatcaatatccctaacggaatacacagatatagattaaatacagccgtgaccgactaagtctcaaggtgtttccttgttgtacaagtcaagaaacaaacccgagatacaaataagatattctatacatattcggtatcctatatccagcccaaatagtatcgccgtgtagatatgggatatccataatctccacactaacttaatatgactatattatataatgatataaatttaaagttacactatgtaaattacaaaatattacccctttagccatatactcaaattagggatttggttgagtagttgatggaccactaaagtatgggccaaatagtaacatgaaccacagatactgggtatttagaaatacagtaactattgtattgtagaaatagtaatatccataaaaaagtaaagacaatgaaatggttggtacaacagttccgtttctatatttctttaccatttatattttcattctgtttggttaatattttcatataattcttttggcaagagttaattgaaatccaccacaattttgatagggtagctagggacggaaaatatatatgttgctcgatttgataggaaaatttgtgttatgagcatatgaacattgattgatgttctttttttgttcagagaattaaactaaccctacatctgcatgcttcactagagaatattcttcgactctaaacttgaattttctcatttttcgttagtatatggttttttgcaaaagttttttttctaaatagaagttgtttaaaaaacttaaataatttttttaagtttataattattaatacttgattaatgtgctaatgagttttctcgttttgcgtgcgctaaaattctatccccaaatgaggtgatcgaatagagctttcaaataaaatctctcatggtccctcaataaaaaaaagggtgaaacttgccggtaaaacgaatttgaaaatctccagtaaaccactcacctcatcacctacctctgttaatttctgttttgtttggcttgtctttccaatggagaaaaaaaactaaacgaaagacaaaattgtaggatcgaaagacaagaactaagccaaccagagggggggtgaatggttggtatacccaaaaaccgaaaacttttagcgaaaataaaagttaccctcgaaatcgacggaagtcggtctgaccgagatttatctgccggtctgaccgaagcgtagccgccggtctgaccggtgttgatcttccggttggaccgccctggaatccctgtcgcgcctgttgtcaccgccggtctgaccgcaggtcacccgccggtctgaccgccgcgatgccgccggtctgaccgtcggtgtgtcgccggttagaccgccgaaacccggcgaaacacaaatcgaagaactctaaaagtggatgacgactttatcaagtcatgtgttgcaataaaaagaagataaacccatctataatataacaagcatgcattaaagtataaccatgaaccaaagattttacaattaagcttgaatcaacaatcaaaattcatgatttcatatgatttataatgcaacatcttaacaagcacataggttgaagaataaacactaaacacatatacctattgcatttatcactctttctcaaataacctttagcacaaaataaccaagagaatttttttaaccttttcttttcttgagcctttttgctcatatttttctcttttattacgggtacgtccctatcgtcaagactgtttccagggattcggctccaattattttgctcacatcgaatacgtcctcgtcgtcaagaccgtttccaaggattcggtattcatttttttcatattttttattctctttttcacaatgagcaattaaagctatttgaggaataacaattcaataaagcatatatatagagcatttataaatcaaaccatatgctagcatcaacattgcatattttcttaattcaagtagaatttaaatgtcatgcatcatctcccttaaaagcaaaatctaaatctcatgaaaagactagaatacatacaagctatgctagagacaaataaaccttcaaagtattgctagcatgcacaagaaaataccatatgcataaacaaagctctcttttctcaatttttctcattgtcatattattgcttgataaaaccatgaggtacaaactccccctcaaaccatgccaaaaggatgaattatgcccaattcaccatgaagaaaagcaaagcgattagaatccaaaggtttagtgaaaatattagcaatttgcaactttgtgtccaaaaactgcaattcaacatctctcttcttaacatgatccctcaaaaagtgaaaacgaatatcaatgtgctttgtgcgtgagtgttgaacaagattcttagcaatgttaatagcactagtattatcacaaaagagaggtactttctcaaaagtaagaccataatctttcaaagtggataaaagccaaagaatctgtgaacaacaactagcagcagcaacatattcagattcagcagttgattgagcaacactagattgtttcctagaagaccatgcaatcaatgatgtaccaagaaaatgacatgttccactagtacttttcctatcaattctacaaccaccaaaatcagcatcgaaatatccacttaagtatatagaagatgaagtagaataccaaattccaaactcaagtgtatgattcaaatacctcattattcgcttgaccgcttgacgatgtgaagcacgaggagaagcttgaaagcgtgcacacaaacacacaacaaattgtatatctggcctagaagcagttagatacaacaaagatccaatcatacttctatattccttttgatcaacagcttcaccatcttcatcaggatccaacatagctgtataaccaattggtgttgaaattggcttgcaattctccatcttgaaccgtctcaaaagatcctttgtatacttcatttgatgcacaaaagtaccttgaggtgtttgcttaatttgcaatcccaaaaaagtacgataactcacacatcatgctcatctcaaattccttgcgcatagtctcagcaaaatctacaaccaaagcgtgagtcgaaaaaccaaaaatgatatcatccacataaatctgaacaaaaagttgattatcaccatgcttaaaaacaaaaagtgttttgtcaacctttcccattataaaacctttcgcaagcaaaaagttcttaagactatcataccatgctctaggagcttgtttcaaaccatacaaagctttagacaatttaaaaatatggttggaaaaatcaggattttcaaaacctggcgattgtttgacataaacttcctcctgtataaaaccatttagaaaagcacttttcacatccatttgatacaatttaaaaccttttgaagcagcaaaagccaacaaaagtctaattgcctcaattctagcaacaggagcaaaagtttcatcaaaatccaaaccctcaacttgagtaaaaccttgagcaacaagtctagctttatttctcacaatcaaaccatcctcattttgtttatttctgaaaacacacttggttccaataatattatgtccagaaggtggttcaactaaagtccaaactttgtttctctcaaaattttcaagttcttcatgaatggcgttaatccacgattcatcggttaatgcatgtgacacatctttgggttcaaaagaagcaacaaatgcagaatttgcacaaacatcatgagtcgttaccttagaccttgtagtccgctcacctatattaccaatgatttgttccggcggatgtcgtcgttgaatgtgcaaaggagcatctcgaacaacatcaacagaaccctcagccgacgaccctggccggtctgcccgcacctcctgtgccggtctgaccggaggtgtgacggtggtctgaccggcctggcgcccggtctgaccagccgagccgacctcctcgtcgtcgttgtcgtcgctctcgtcttaaaaaatatgaccatcctcctcctgaacctgtgacagtgtacctgcaatatcgggtctagtacctggactagcctcatcaaaagaaacttcgcaagtctcaacaattttgtttgtctccaaaataagtacacgatagccacgagtgtgtgcggggtaaccaagaaataattcatcggtagaacgtgcctcaaacttatccaaatttccagatttcaagacaaagcatttgcaaccaaaaacacgcacatgtgaaactttgggttaatgtccaaatcgaagttcataagaagtttttccaagttttgatttcaagaaaacccgatttgaaatataacaagcagtgttaatcgcctcagcccaaaattttctaggagttttatactcatccaacatcgttctagccatctcaaccaaaacacgatttttcctttcaacaacatcgttttgttgaggaacacgaggagaagaaaattcatgttcaagacctctttcattgcaaaattattcaaaagaagcatttttaaactcaccaccattatcacttcgaattcttttcaaagaaccaagaaattcaagatccaatcgaagaaacaaaccacgaaagtgttgaaaagcttcgtccttagttgccataaggaaaacccaagaatatcgagaaaaatcgtcaacaataaccaacacataccactttcctccaactgattgcactctagctggaccaacagtgtccatgtgtaatagctgtcccggtgcatccgtcatcacagaaacaataggagcatgtgaagaagcaaccatcttagcatgacgacacggtgtacaaaccaaatgaagatctttcttaagtttaggcaaaccacgaacaagatccaaaccacttaacctagtgagatgatcaaaaccaacatgtccaagtctacgatgccaaaacatcacatctttatcaaacttagcaaccaaacatgttatcacaggtgaaccaggattttcaaaatcagctttaaacactcttccatagcgagaaatattcaacacagaatcaccacaagaatcaaaaactttacttccagttttcttaaagtgaacctcaaaattttcatcaacaatttgtgaaaccgaaagcaaattgtactttaagtcctcaaccaaagctacattctttaattcaaatttttcatttaccttaaccaaacctatagcgagaacgacacttgtagaagcatcaccaaagataatcgattcagtcttggatgccttcttgagtaaggagaaccaatttttatcaccggtcatgtgccgcgaacaaccggaatccacgatccacacgttctccttccttgccaccaaagcctacacacaagcagaagtcgaagcctcagtactggggttagatgataataaaaatttaggaatccagtactgaaacacacgaccagaagatccaataagcatatatccacgtgcaaaatcaattttagaattttcagaaaaattcctccgaggccggtctgaccgaagtacagtggccggtctgaccacttctgtaccaccggtctgaccggtgcccgggatgaatgaccctaatttt

SEQ ID NO: 68217 - DNA, 10672 bp, Oryza sativa
  unsure (1)..(10672): unsure at all n locations
gtgtgccgatagaatcgccttattatanggcgaattcnagctcggtacccagtactatgagtgatgaaacaactcgtaacaaaataaattataattacgtaaattttttgaataagacgaatggtcaaacatgtgaggagagagtcaacggcgtcatctattaaaaaacggaggtagtatttaataaaactaaaatatgaaaaaaagtttaactcttttgatggagggagtatataagatcaggtgaactaacgttgaggagcaaagttgattgtggtaaaagaaaggcagaaagcgttattagactccctaaagacgaacgataagcccttcgcaaagacgacggcatgcatatggtatgatattagattataaacagttctagtggcgcacagcctcgttgtcacccgtcgcgcggcgcggtgacgaagcagagtgcgagaacaagccagcaaagaaccgcgggaaggaaaaaacaaatcgtaatgacggcatacaccgtaatgatgaataacacccacatcgtgaggagcatctcatgggagttggccaagacgaaggtggcactgctcattaacgccatcgccagaaagtgcgtcggcacatgattattgatggcatgcataccggaggatttattcaccagcaggagcgtgaccagaattgtgagcgccatcgcgaaagtgaccgtgttgcaggcgacgtacaccaatgctatcacagtttggtacttggtgaggacttggagaaggagcagaggtgatggtcgacggagccggagcagcactggttttgcttcggtaggaacggagttgcactaaccagtcggtcggcggctgcagcgccgcctggaaggccatttgtacgaagagcgcggcaaccatcatcatccacccgcgccggcctgtccctcatgtactcgtcaaagctgcgggagcgtcgcatgttgttagtgtcgcccggtgcagtgctgccactattggattgaacaccgtcaccctccctgtgctgaacattaacggggttccctccaggagagccgtccatggtgttgttgttatccgtgtcgatgttctgcgcacaccgaaccatgcatacaatgtttgagaaaattaattaattgcaggtcaaaaaaaaaagtttttaagaggaagagactgaacctgaacagaatcgacattcactatagcctcatcggcggcgactggctcgttggcattggttgcatgttgatatatatctctgcagtctcagacacaggcgctgccgcactgctgtattttttttagataggtcaccggaggggagagattccccacctaaaagccgcactgctgtattgtgaactgtaatctatactaacctcactccatcttatatagcgtacgtactacgtagacatttcctctgaagtgttcgcctcgtgatagtctgctctgctatagatctcacacaaatagctccaggtctgaatttttgcgcttccaagtagatcactctgccttatggattcgtctccattaatctagataattcttattataatccaaaatgccatatatttttctaaacattattgaccgtattaaataatagaagatgctacgacccaattgttacaacaaatagaaaagaaatacgtgaaatatagagcaagcaaactccaccttttgaaaccatgtaagagatacgagtagacgagcaaacttacaacagtggccgattctgcacaagtagaagcatatgaagccctattctcgtttctccgacagaacaggcaatcgacgcctatccagacaccaaaaccgatgtcatcactaatattatcatcgacaacccgagaaacaaataaacttaattagtttatcaggttttaatttcatagagaacctcgtgaacaacttacccattaacaaagagaaaagaaaacgaaggattggaacaaactaactccattatcatcattgaaacacaagccctatactatttaatagatatttcgaaaatgccacatattggacataattgaaagggaaaaaaatcatgcactattgatggaacaccagaataatatgaatagacatccatatccatatagattagggatgcaaatgtggcgagtaagcggttttttttcgcttataattatagttaattttattctttttaattttgtactaacaaataggaaatggaaaaaatattctctgagacagggccatgagtccgactccatgagggcccgctgtagatttttgccacgtgggtgatgagcacgaatcttggaatagtttcatcttcttcctcttttccccttacctccttccgtattctcgtccttctgagtgctcctggcggacaatttcatcgggtttttctgtaaacttgctgaggaatgattgtcgaaactagatttcggcaataataaaagggggtggctatcaagctcggaaagtgtatgggtttggagacaaaagatttatacaggttcaggccttcttataaaagaagtaataccctactcctgtccggggatgaatccgccgagtgtattattgattgtatgattcgggaaaaatcagcatctacccctagaggcgcccggaccccccttataaatgggaaggagtccggattacaaaagataatctatattcctaacggaatatgaagatataggtaaaatacagtcgtaaccgactaagtctcagggtgtttccttgatatacaagttaagaaacaaacccgagatacagataagatattctatctacattaagtatccggtacccaatccaaataccgtcgccgtgtagatatgggatacccataatctccacagtagcccccgagtcctttgcagtcgaccatcatagccttctcaaagatgataatccgagcacttcaaactcttcaagccaaaacctgccgagtggactgtaaagggcgaaaagataaagaatatggtgcatcgaatagatgcacctaattaggtgtagcccccaactatgtgattagttagcaaactaaacatatagttgaaaggcaaaataataacacaattgtgcattatatgacaaaagcatacgcggcgcctaaataggcatgctagccgactgctttttagccacaataaaagaaatccgagtggtttacactctaaaaggttcacgaatgaacacactcgacaggcatccgaatataaaaactctaaagattacccatcaagtattataaagattatggtaataaataagtcgaatagcctaggccatgactatttaccatgaaaacaggcatataacacgccaaggaaatgactataataaaaacaagtcattcctagttaacccaaacagcttttgtagcctaaaaaagcttgcaaaaatagcataacgcctttctgtcgggtacctttttaatttgcattgcagtaattccaaagaattatatgaccgcataaaaatgatttgatcagcattgggcaacactgttgtgcgcataatattgccaaagcaaaatatgcctaagtccctaaggaacacaatgggccacgctgttaaaagtattgggctgaagtactgttcaggcctaggcccattagcacctccgatacccttaactgaaaaatcctatatccaagcgacgcttcgtcttccccgccggaactctcgccattttccccattccctgctacagtgcaaagctgcgccggcgaactagggttcacaactccggccaaatccacctccgaaaagtgcatcaaaatccttcccgtgatccacagcctcaatccctcacctctcccaagccatccctcaaatcaaatcaacgcattttagtgaaaccaatggcggaagagagagaaagcttcgaaggccaatgggcgtcatccgacgtaacggaggagaatcttaaggagatggtggcgcacggcgttctccctgccaaggagatcatcgggtggcgaccagcgcacggtgaggctttcccgtctccggatactcatgagattgtggtcttctcgcatttcttctacggcggcttcgctcttccgacctcaaaatttttccgcgggatcttgaatttctatggaatcagcttgcatcacctaaacccgaattccatagtgcatatcgccaattttgtccatgcttgtgaagcctttttggggatcaaacctcactttgccctattccgccggatcttcttcctcaagccccaaccaaacaagaacaaaccatgtgtagtcgggggggcaggattccaactaaggggaactctgagtcaaaaatatttctcgatgcccttcaagacttcgaacaaaggatggcatgcaaactggttctatgtccagaatcccgagcctgctcttcccgggtactcttgtcttcctccagtgtaccaagatacttggaactctcttccaatcggagatgaagcagtacaagccttggagttgttggatcgtatgttaaatcttaaagaacaaggcttacagggagaacagatcactcggcatttcatcaaatgccgactagcgccaatcaaggaaagatctcgcacggcattcgagttcgacggcaagtatgatcctaaccgtgaagaatcagactctctggatttcagaatcatgaaggagaggatgtataaaatcttctcaaatgcaatcgtcgtcagctactcacaccagctgccagtcgtgccatataatgcattcaatccgcctccgcaggtatgtatcggaaatcttcaaaccatgatcagaacataattttgtcttcatgctgaattgactaactatggaagcatcttgttcaggaatatgcactgatgaagtcagatccaccagtcactcagcgccggtctcctcgccaacacactgctcagggaggtagagggccaacgatcagaccagatccgcaacctcagacctccaaatcaactggtcagacgggtcctcgcaagaggaaactggtgcttgatgacgatgaaggcgacgatgataaatctggggataagggctcgcctaataaacccccaaagcgcaccatgcccaggaaaaaactggccggccgcgcaatgctaaaaattagaacatcttccaggtataagacctctcggtatgatttcactttggtaagctctctcatgaaaatgatgctaaattctgaaagaatactttgcaggaaaccatctgatatagatccatctggaaaagaccccgatccagccatggcagagcaaaatatatccaaagaccccgagccaactgccgaaagccagccgactgccaaaagccagccgaccggcgcccatgcttcgggtgaccaggccaatccgagtgaccagccgccgactggaaaccagtcggcaacaactgaagcagcaacaactcaagagcccccgactggaaaccagtcggacgcaggccctgatcaagaaatccctgaagtagaagcgcagacgacagcttcccaagggccagaagctggtaatgactcgatagctggatctccaggcaaagaacaaagatcacctcacgctcagctaggtacatcttcaggttagttgtcttctcatacaacggcgatttaaataacctcagtgtatccgtctaatgtcttggaaacacatcaggaccatcaggtgatgacggagaagaaatccctcgcataaaggcgaccgacgactctcgtcctcctatcttgatcaaatggtgggacgagaactcacaagctgccggcatagtcataaaccgtcaaaaagaagatgaagaagtgtgccagctgaagaaagcgctcggagaagccactcgtattgtaaatgtaagtcttccgagtgacggccttcagtaactttgttttctttttagcagaactgaaccatgatccatcatgcagagaatccatcttcgcaatgaggccaagactacaactttggaaaagctggttcctcatttgggaactctagaagcagttagggaccagctgcatgaggctaaggagtgcgccaaaaagacagagaaagagttaagggaccgaatcgcccagctccaggatgcaaacttcgagctaagtggttcatcaaaaggtaatcatctagatctgttccattgatttatactgtcataattgcatcctcaaatatttggatttcaaacagcgcaagccaccagaatggctcagatggaaaaacagattgaagccttgaaaaaagacaaagcaggactggctgcagaaagggactcagccttgaaagaagttgaaggtactgccggctgatgatctgaactttcctctttttaatgcagtagagtctgattattataaatgtgttctgtagaccgtaaaatcaagtctcaagctcagtttgacgtcctggttggtaagatcaagaggcttgaaggagcaagagatgaagtcgccaatgtcgctacaccactcatccaagccatgttcctcaataacagtggtccgagtacactcgacgcaaccgaaatatttgacaagctgagtgttgctccggaagtatatttcaagaatatcaagaaagctggaagtatgggagctggcatggccttggcgatgacaaaatccttgtacccgagaattgaagtcgacaccattgatggatttgcagacgggacaagtgaagaagctgcccttgatcttatcagcagtgcgcaaaatgcggctgacaaaattgcgagtgatgttgtagagcaatttcgcaacaacgacctccaaccgagtaatgaagactctgatgatgaaaggactgattctgactgagtttgaatgtgatacatggaggctcaatttgtacaatactggtgtatttatgctgtgcttgatgattcttgcgaagtttttgatttcttaaaagtttttgctaagctttattgagcctaaaacccaaagaagctattaaaaactttcagtcctcgcaaactaagtagaaaaaccaaacaaggcaatgataaaccaagtaagcaaactgaattgataaaaatcacactccattattatgatgatagcccccgactgacaacttcaaggagaaaacttgatgtttgacagtcaaaatagggaaatacaatgataaagttaaacgtagaaacgacgaagatgttcaatgttccaagagttgtcgacgagagtgccgtcttcgcgcttgagtcgatatgaacctggccgggtaacttcagagataataaatggcccttcccatagaggagataacttgtgccgatctcgtgtggtttgaattttccgtaaaaccaggtcgccgactagaaaggcacgagatcgaacattgcgattatgataacgtcgcaacccttgtaagtaccgagctgactgaatcaaagctgcttcgcggacctcttccagtcggtgcaagtcgtccactcggtcttcttcatagcgttcttcacggaaattacggaagcgcaaagattcgaactcgacttcactcggcaacattgcctctgccccgtagacaaggaaaaaaggtgactggccggtggcccgactgggagtagttcgtaaggaccagagtaccgatggcagttgttgcacccatttgccggcatagggttttagccggtcaaagacacgcgctttaatcccttgaagtatcatgccattagctcgctccacctgtccattgctcattgggtgtgctactgaggcatagcaaatcttgattccaaagtcttcacaaaagtctttgaaaactccgccggtgaattgtgtgccattatcggtgatgatccgattgggtactccgaatctgtggacaatgttgatgaagaaatcgcgagcattatctgctgtaatcgtgacaacaggcttagcttcgatccacttggaaaatttgtcaatggccacgaagaggtgcgtgtaaccgccgactgcctttttaaactggccaaccatgtcgagcccccaaacgcgaaacggccaagacagcgggatagtctgcaactcttgagctggtagatgaatttgtctggcaaaaaattggcaaccttcacatgtgcgcacaattttgtcggcgtcggacactgcagtaggccagaaaaaaccctgccggtaagctttgccaacaatggtgcgcgctgcagcatggtttccgcatatcccagaatgtatgtctttcagcaattgtctcccttcctctaaagatacgcagcgttgcagaattcctgaagggcttctcttgtatagctcggattcatgcataacataaagtttgctccgccttgaaatccgctcggcctcatctttgtcttgagggagttcttgagaagtcaaaaatcatatgaggggctctcgccagtcggcttcaaccatagctatgtcatgagtgtccgcaacttgagtagcatctttgtgaggtactgtcggggaataaaggtgttcgacgaaaaacatcagatggcgctgcctcgcgcttggatccaaagttcgcaagtctatcggcagcttcattgttgtgtcgaagaacatggctgagctcaagtccatcgaacttatcctccagtttgcgtacctcttgtcgatatgccatcatgttgtcgtcaatgcaggaccactctttcataacttggttaacaaccagctgtgaatcacctcgaacaattagacgctttatccctagggaaattgcaatccgtagcccatggaggagggcctcatactcggcgacattgtgggacgccgaaaaatgtatccaaagtacatagcttaatctttctccagttggggagatcaaaaccactcctgctccagtgcccgaaagtcgtttggatccgtcaaaatgcatggtccaatgctctattttctccacgggggtatcctcttggcactcggtccactcggcgacgaaatcagctaacgcttgagacttgattgaagtgcggggcttgaatgatatgtccaaagacatcaactccaaagcccacttagcaatccgcccatttgcttcgcggttgtgcaatacatcgccgagtggaaatgatgtgaccaccgttaccgagtgaccttgaaagtaatgagatagcttcctggtagtaattagaataccatataacagcttctgaacctgagggtacctcgttttggagtcggccaggacctcgctgacgaagtagattggtcgctgaactttctggacatggccttcttcctcacgctcgacaaccaggactgtgctcacgacctgggaggtggctgatacgtacagcaacaacggctcctgcgggtgtggtgaagctaagaccggtggcttggtgaggagttgtttgaaatcttcgaaggccctctgtgcttcgggtccccattggaaattatctgttttcttcagtagcttgaagaagggcatcccccgctcgccaagtcttgaaacgaatcggctgagcgccgccatgcatccagtcagcttctgaacatctttctgggtgcttggcggtttcatgttgaggatagcagtaactttctccgggttggcttggatgcccctatgagacaccataaaaccaagcagcttccctgacggtactccgaaggtgcacttttcagggtttaatttcatcctgaaagcgcggatgctcgcgaaggtttcttctagatccgaaattagatcatccttttgcttggtcttgacgactacgtcatccacataggcttcaacgttgcggccgatctgtgttgagaagcatctctggatcatgcgttgataggttgctcctgcgttctttagtccaaacggcatggtgacgtagcagtatgccccaaaaggcgtgatgaatgaagtcttcaagcagtcggattccttcagtcggatctgatgataccccgagtagcaatccagaaaactgagaagctcgcagctggcggttgagtcaactacctggtcaatgcgaggcaacccgaaaggatcttttgggcaagatttgttgaggtcggtgtaatcgacacacatgcgccattgccctgtctttttcctaaccaggactgggtttgccagccagtcgggatgaaggacttctttgatgaagcctgctgctaacagcttggttaactcctccttgatcgcgtccttcctgtcttgtgcaaatcggcggagtcgttgtttaataggcttggcgtcttctttgacatgtaaggagtgctcaatcacctctctgggaataccgggcatatccgaaggtttccacgcaaagatatctttattattttgaagaaaggtgatgagcgcgctttcctatttacaatctaactcggcgcctattacagcagttttggtaagatcagaaggatctaagggaatctttttagtctcggcttcggtttcccccctttttgaaatcttggcggcgggcacttctccttcgctcaccgtggttgcagccagtcggattttctctcgggcagatgccatctcgcgggtttgggccatgtcgcaactctccttgtcgcatgtgacagcttgcttgatgtcactccgtagggttaggactcctcggggaccaggcatcttcatcatcatgtatgtgtagtgcgggacggccatgaacttggctaacgccgggcgtccgagtatggcatggtatgctgtctcaaaatcggcaacttcaaagctgatattctctgtgcggaagttt

SEQ ID NO: 68218 - DNA, 2305 bp, Oryza sativa
ataggaacagatgatggcaccacaacaggtgcagcattgagcggttgttgagcaccagcctgaaaaacacagaaggtgcatccaatgagaatatacaggaaggatattaacttcttatacatctcaaacaatactgaaacaattgagcatgttcttatcagtaaatcagcagagacactgaacaggtacttccaaagttcatcatcaatgcaaggaaaagatctaatggctagttggctcctaatgttggatcaagttttcctaataaagcaggaggcagtattgccatagctgcattactctcttaatcaaggctaaaaatccacctagtaaccagtagtatcgctcatgtcaaccaacaatacaagcttatcccttgaaagtattgtgcaacttgaacaaattggacaaaagcactaacgatcaatctatcaacagaaacatttcgtaagaacagaactaaccctcctggactcctgataaaaacccttcactcccatatatttactaaagaattggcagattattcaccaacataataccatataaactacagaaatgtgactaagatgtaatctatccagttaataagttatccaaaacaaaataaagcaatcatttcttagataattcttgacttcatcactagaaaagaaaaatatggagacagtagcaacacttacattgggcaccagaccactccgggaatctccatttacagcgccatggtttgagttatccttatcacccttacccctctcatcgccatgcttcccattcgcatcggcgtcctcaaacctccgtcgctcccgcctcggcctctcctccttcggcggaggcggctccacggaagccctcgcccgcttccccccttccgggtcggactcgttgccaccaccctcgtggcccttccgcttccgcgaagaaggcggcggtgcctctcggtcggccgagtcccggcgctccacggagtccctgggagcgcggctcgacgaccgctcccgcttcgcggcgggcggcgggggggactccgacggggagagggaccgccgcccgccgtcgcgatggtggccgtggcggcgggagcggctctcctcctcgtcgtcgcggtggtggcggcggcggccgccgtcgtcgtcgtcgtcgccgccgccgccgcgcttgtggcggcggtggtcgtcgtcggcgtcgtggcggcggcggtggtggtcgtcgcgggagcggtggtggcggtcgtcgtcgtcgcgggggcggcgggaggagcggtcgcgatccatggaggcggggaggagggagagggagaggcggagacgatgggattagggtttgcgtcgaggtggctactatgggagattgggaggggcgaaaagcccagcgagattgggatctgcgggcgtggccgatcactttacatatgcttaagagcaagtttaagattacagctaactattccaaatcatctgtaatcaatttaatagtcaatttatataatagttaccgataaatatatactacactattaatatctggtctcacctatcatacacacaatatgtcttaaaatccatgctcatgctgtagctatagcccgctgctcatctctctcttcttctaacttcttaatatgtgtttatagcttgtttatagtctgctattatacatgctctaagcaggctttagaactgacaaagagtgacagactcgataatttctatttcttttgctgtatttattgactataatttcttaaccaaggatagcatttaatcttttggattaccaacataaaaggcatttttattcatacaatttgattatataacatttataccatataattattaatgttccagtttttccacttatagttttggacatcgataattcacacgattttaccattttttttatttctaatatcctaaaaaaatggttactcttggattcaaatttattccacaaagattatcatgccatatttaaatttctttccgttctaccctcaaacatcctcccctctcaaccatttctcacattctactatcaacaatcatttcctctcaaccaggagtaaatcatttaacgcattgcatttttttcatgaaccttaatctttgcttttaagagaaacctagaataacaatctcttaagaaaggtgatagtagcaataaaattattgaaaatataatgctaactttcgaaaaccggaagaagaaagcaggaagaagggaaggggtagagaaggagagagaaaaagaaaaataaaagaaaagaaatattccttgacatgtaggtcctagagtg

SEQ ID NO: 68219 - DNA, 5951 bp, Oryza sativa
cctttggtggatggggaggagcagtcgtcctatgaccccatgggggaaaagttgaagatgatgagcggcaagattatttcggaggagcagcgtctagtggagttggagttggagttggaagatgaagaggaggtggaagatgaggagttggccgagctgataacggcgcgagacttccgtgtcagctgggaacatcgctttacccctcgctattccttcaacgacaccagtaagtaataaatcctcctccgccccgccgttttattctgcttccgtttctttctttacttcaacgcaatcaagattatttctgcgaatctatctatcatgtttcgtatcaccattatatactggagtatataccactatctatttgtgctccaattctggttgttccaagtgtcttgttttattttgggttaagagattgccaggctaaatacctgtgtttgtgtgtcctcaactatatatgcaacacatttagcatgtgaaacaagtgctaggttttcctaattacactctataaaccatcacagtacaaatcctgttaatcacaacaggatactagaaagattaaatttgaaccagatccgatagattatctgacgtggtgccaactaattatgtttcatatatatattgggccgcaaaagcatgttaaataatctgagccaatttgtcttttttttccccttcatctagcacaatgaattctgacagaattaaagtggaatatcaattagttgctgattccctacttattggagcaataatccctaattttgtatgtttgtttatcttcttttttttttttcaaagtagcaggcaggagatctgctagctaaatacattagaagaagcaacaaatagagtctagtttagtacatactaaataggatatctacagcgccaagaatagcaacttgcatatcaaaatccgcattagagggtatcagcactaaacgctaagggtagctcgtttacgtcttgtatcaccaagaaaaccaccttgttcttgggttggtcctggaagaccctcatgtttctttcaagccggatattccaccacgtaacaagcaaagctcccaatactccctttctgttttcacatggtgtcattgcacttgacttgttccaccaatctgatagacaagtgtaggttgagttcattgctgtgatctgtagtttttagcgaatcatttcctacactttggtcgtgaaggaatattccttagcaagatgattggtgtcctcgaaaaagctttagtgcagagagtacaaatctcattacatggccaatgtcttttaagcaaatttttggttgctagtaccttgtggtgtaacaatagccaaccaaataattggtgctttggttcgttgtttgctttccagaggctggtaaaatttgagtatgacacacttccagtgaattgtgcaagatacgcgctttttgccatatatgatgtcattttttatccctggctgcagtttaaccccagctaatagatctgcaatccaaactagttcattgatttcttcaattgttgttaggggccttagcaggaaatctgttgtcagatatttcaactagaatagagttgtttgttctctttgctagtttgaacagacctggcaccagatccttttttctcccattctgaatccaagtaaatttcataaaactacaggtattttgcacaatttatcacaaaactacatatttaagagcttgtttcacaaaactacagatttaatgtctctgtttatcacaaaactacaggtactttgtataatctatcataaaactatatatttaagaacttgtttcacaaaactatagatttattgtattcgtttatcacagaactacacatttagtgtcttcatttatcataaaactacggatttagtgtctccattattacaaaactacatattttgacaatgctaatacctgtagttttgtgataatgaagacactaaacttgtagttttgtgataaatgaatatattaaatctgtagttttgtgaaataaattcttaaatatgtagttttgtgaaatattgtgcaaagtgcatgtagttttgtgataaatgaatatattgaatttgtagttttatgaaacaagctcttaaatagatcatgcaaagtatatgtggttttatgaaatttactcatccaattatcgttccagaaggtagctttactcccgtcacccaacgtgatggtagctgccgccgcaaaaggttctttgttgattgtatcacaaggaacctccatttggcgaagggccctggcgaactcctgcagctccaaaaatgggtccacccaaatttcttggtttggctggcatacagtcgcccaatttaccaaactgtgtccaggggtgatattttctgggtcttaccctttccacaaaaaggctctcctaattctgtcaattttcttgatcaaccatttttgtacgtagaactgtgagatggtatgttgggattgagctcagagcagtcttgatatgttgttcatcttactcctcattctcatcaaggttaatgtctagtactccatatatgtgcttatccacattgtcacatcaatcatttaactaaaacttggatttttgagtcaaaaatgggacacaacaatagcatccacaatgctattatttgataataaatattactgctacttgactgcagcaaccgtatgtcccatgcgctatacggagggacctatcccaagatatgcttgctgtggtgataccttgcagatcttctctctccaagtgaaagaagcaaaaggtggtcttgactggccgctgcatgtgtatggcttggttgccaccagggactctgtagatcaaaggcgcaaccttcttttcaggtgcacaagggataattgtcaaattctcactccacaggtatctatcttgtaatttccttatacctttattgttttctcatttttcttttgcagcttgaagtgctcaacctatcatactagtagattactactgttctgtacacttgtttgtataaatatgttgtctttttggagttattagtgcattcataggctggctgcacctaaactgtcaattgaaggcatgtttgcaattttttttccttaccactcttttttcacataattcattggtaaaaactaaaaactgaggatttgtttagttcccaaattttttttcccaaaaacgtcacatcgaatctttggatatatgcatggagcattaaatatagataaaaaaaactaattgcacggtttgcacggaaatcgcgagacgaatcttgtgagcctaattaatccatgattagccataagtgctacagtaacccacatgtgctaatgacggattaattaggcttaataaattcgtctcgcggtttctaggcgagttatgaaattagttttgtcattcatgtccgaaccccttccgacatccggtcaaacgtccaatgtgacacctaaaaattttcttttcgcgaactaaacacactgtgagttgatagaattggcaccactatgacctatacctatactccttttgaaataatccactcgtggtgttggcattgaatctgctgtgtcaactcttcctaccacagttttctataaatcaacctgtgatgatagttaatattatcaacagccaaacatagcagtattgccacatgtataaccaagatgagcactcactgttgcaaataaatgaatagcatattgcatgcaaaacataaattaggtttgtttattttaggcaatattatggcatactttcttttattggtagcaaagctattgcatttaccttgtctatggaaatagaagttttgtgatggaccgtctttaacatgggctcgtaggaaataactgcatggattggttgcatactggatccttattatacggagggaaccaagttttagtaataatcaattggttgtgatgcctgcaggattcacacctgctgttaacaggcccatctcgtgcagttgtggtaattgatccagtaacgtttgaagttgaactaaaggtaaaaggaaaaacagaggctgaggataaggtgttgagcctaagggtctttatgcaccacactgtgcatgctccgcagatgtttgtccagcaaacatggggagcttgagttgacatgtgctggacttgtagagcagttgaggccacaatggtgagtatccaagttagagaggggtcatggccagatcatatacgagggttggtcgtttgtcgtacgggcagcgtagagggaggggattttgtgctgcttgattctggagatggaagaatgcctattaacagctacgatggtggcattgagctttcaaggcgtcgtcgcacaacctcaatgtcgtcgttgcaagaggcagtgctgttttcaagcctcgccgtgccgggagtactagtcttgtatgggaccttgggttttgtaaggtggaagctactgtttgttggtcgctccacgcgaccttgaggcaaatgctctcgggcatgccttgatccatactaatcactttagcttgttttgatttttgagttaacgtacagctcggctgcatatgcttgcgtaattgtgtttttggcgtcatggtctgctcaaccccagccgtgttcaggactagtaccatgtaacatatatatgcttcaatgtcagaatccaacctttttaactttctgctgttttcttaatgaaggttagctgcctattcacttcactgaacgtacatgaagcgcagcagcagtttattaaccaaacacgtatagttagccagcagctacgttgaatcaaacaacagatcgaagaggaatcatccgttccgttccaccgccaaatccaatgtcatccaatcacttcaatttgcatctctcacatcaccatctcttacccttattcagaccgcaacacccttacatatatagcgtcaagtaatggaagcaaccacatacatacatcgttgcatacacatgcaggcctgcaggctgcagctaatccaatcccgaccaagaagcaaccggttcaattcattaacaccaattaacatatggatggatgcaatcagcaagatgcaaaatgaacaagatattttccccacaagcatctgggactggaagggacatgacatgcccacccttgttatcgtcaaatatcaatcttgacattatatcaagccttcatcttcaagttccactatttcgcaaaggaaaaaatatgaattacccccctaaactatcgtcgtcggccgaagttccctctgaaccaaaaaatcagacatcactcaccctaaacttttaataccggacgaattacccccctcgacccaatccggagcagttttgtcctacgtggcgcacacgtggcaacccagtcagcatttctttttttaaacacggtggggcctgcttgtcattctctcacctcgttttcctcttcccctcctacccctctccctctcgtgtcgttaggagagcggtgggcggtggctcgtcgtcaggagcggccgtgcggccggtcggcgcacacggcggcgggcgtgcgagggcgggcgaaagacgcgcgagactgggaggtgggcggccgcgcacggcggcgcgcgagcgcgggcggcgggcgcgcgccacgacgaacgagtgcggctggttggctccggtcgacaacgtgcgcggtggggcaagcggcggcgggcgcggttccggtcggggatgggtgcagcagggagggacaactggtcggcggcgagcgacgagcggtgacgggcgtggaggggtgcctccactcggctacgggcgcggctgggcgaacggcggcgggcgcgtctccgccgactgtgggcacaacactagttggcagcgagcggcaacgggcgcggctgggtggccctggtcggcggcgggtggcgctccaggcgacggcggggagggaccg

SEQ ID NO: 68220 - DNA, 32210 bp, Oryza sativa
ccgccctcgtgcacccgccgcccacacttgtccgccgccgtgtgcgccgaccggccgcgcggccgctcctgatgacgagccaccgcccaccgctcgcctgacgacacgagagagagacagagagaggggtaggaggggaagaggaaaaggaggtgagagacaatgacaagtaggcccaaccatgtttaaaaaaaaagaaatgctgactaggttgccacgtatacgccacgtaggacaaaactgctccggattgggtcggggggggggggtaattcgtccggtattaaaagtttagggtgagtgacgtctggtttttgggtttagagggaaaattcagccgacggcgatagttcaggggggtaattcgtactttttcctttcgcaaaatcaaatatcatcccctcatactgagataaaaacagtaagtatgaggggaacttttagaggttaattaaagcacatttatacaaacaagtgtacagagcagtgaattgcctactggaattgtgcacacattatcgtcccctcgtactgagataaaaacagtaagcatgaggggaatttttagaggttaattaaagcacatttatacaaacaagtgtacagagcagtgaattgcctactggaattgtgcacacattatcgtcccctcgtactgagataaaaacagtaagcatgaggggaatttttagaggttaattaaaatacaaaccacctcattccaaatatgtgaatgcaccatggcaggttgcccatttcatatttgaatgaaaccataaggattactagataaaaactctatccaaatatatgccttaagatagacaacaacatgtgaataactcaggtagcaattagatacgatgatgcttgtagatcaactattattctaaggtaaaaatatagtacagacgattattgcatcacagaatagctactaaatactaaagctcctacacaaagcattgtgaatgctcaaccaaaaaatacatggagcacaaatacttcagcaccatcctctaaatgattcattcatataagctattagccaggtttatggtcatgtgacaaggaaggaatacctggtcttctcggttttaacttgtagttagaccatatgcatgttgatatgatcagcatgcagttattagatgaaagaacagcagcctggctacaatttctaaatcattacaacaataggtgaaaagaagtaaactgcaagatagagtatataggttatacaatcgtagatagaggaagaactctagtacaagagcaaagcctgatgtacaattatgagataggggatttctctagaattattatgaagccaatcagaagatagggacacccaattactcaattaaatgatgcaacctaatagcatacagatgcagtaagtaataataaatgtaagatgagctagtaagatgcactcatcaatgaaagtagtggtagaattgagaagcatcctcaagaagaaaagtgtagtaacactagcaatcaatcccaaagagacaaattttgcgagcccaagtaattaattagcaacaaatgtttgaaagaaggtaagaagaaacagtaagggaaccataaacttgcactagggtatattgcttcacaaatcagttcaaatttgaatggaaccataaggattagtggaaaagaactctatccaaacatgcattaagatagataacacaacttgtgaattactacaaattagcattcagatgtactagcagcaatagatgaggttgcaagaggagtagtagtagaattgagaagcatcttcagtaacagtaactacactgtaacaatcaaaattcccaagaggcacattttgcaagcacaagtaggagtaattagccacaattgttcgtctgaaacaaggtaaacaagagtaaagttgaactagggtagggtacaattggttggcagatctagcaagaactcagcaagcagatccatatccctactactccactaagcttaggtttgtctttcttcatacacaaaaaaaaacatgtcatctgatccgatccgatccgatccgatctgatctgatgagagagaaagtaggggaacaagagaaagggggatggatcaggcggaggcggaggcggcggtgcgggagcggtagagcttgccgaagacgtggagggcagtgacgaagcctatgaagcagagcgacatgacgagcaccatggtgggcgagaggcggaggccgggcgcctcgtcggtgtagaatcgcagcatgttgctcccgccgccaccggagaagcccccggagccgccggcggtggaggcgcggcggcggcgcatgccggcggccgcagcggccgtgccgcgggggccaacggtggcagggcgggcggccccggcggcggcgccgacggaggactgggactgggaggaggagcgagccatggcgattcgggtggaagacagggagacgagacgacgaatagtctactctctgggcttgggtttggatctcacatgatatactagtactgtacatacacccgcccgcccatataggtgtccaaacgggcggcacggcccggcccggcacgggcacggttccggcacggcccgtttcggcacggcccgttaggcacggctgatgaaacgggccgtgccgtgccggcccacgtgccgagccgccggcccaagcacggcccgtggatggccgggccgtgcccgtgccggcacggcacgcccgcggcccacgggccgttcggggcacggcggcccgtgaaggcaggccgccagcccgccagcctgcagtgcacagtgtttttttttaaaaaaaaagcaaaggaaatgtataaggaaaaaaaattaaaaatggaaataaaatgtttaaaaaaaagtaatgatttactaatgttaaaaaatgaaaaaatggtatttaaaaaatggaaataaaagttttttaaaaaagtaatgatttgctaatgttaaaaaaaagaaaaaatggtatttttttgttgtgttgaaaaatttaaaaatatagattgtgattcattattttgaaataatttaaagataaatccacacttgcgaaaatattgcaaaagaatttgttaaaaatagtaatgacctttattgatgtttatatcattacaggatacaatgatacatgctgcctcgttaaaaactttgtcatgtaaaaactcataggggaaaatgagaaaatcatgacaaagaaaagagtacagctcaaaggtcagaactacttctaacaaaattctactggggttggtctggatccaggtagagttgctcgaactgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaagatatgttatcttgtggtcattccaccacccgaggacgttgaaatcttgtgcttcatggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctctgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaagagcatacaacataggtatatttttccaatatttcaaatatttttgtttcatgtgaaagacaggttcagttagaacgtcatcattttcgtattctttaaataaagtagcaatttcaagaaggttgtgcaaaattatattagcagttggataataaacttgtgacaaagttagagtacaatcataaaaagtttctagaaattggtaaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagctttcacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacactaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgtgtaccgtaccgtctgggtttaccataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagctttgccacacaccggaggttctcgatctcttcgagccggtgtgtgtcgaaacacttccgctcgcggttccggaaaatccttccgaagctgtctccgcctgaaccggtacctcctcaacgacagccgtatgaaccggtacctcctccacagatggtggagttggagccgatccggaggtaccgtcaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaactgcgagctcttcaaacctctgcgatcaaactgttgaactacgaaactaattttgatttttgacaaaatttgagcaaattttgtcaaaatcaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttgaacggtcaaatagccgttagtgccacgtggcgccttcccattcgaccgccgcccgccctgtccgcgcctgacgggccgccggcgtgccgtgccgtgccggcccgctacagtagccgtgccgtgccgtgccggcccgcgggctcggccagcggcccaagcacggcacggctactcgtgccgtgccggcacggcccgttactgtagcaggccgtgccgggccgtgcctgctacaggttcggccgtgccccgggccgcccgtttggcccggcccatttggccacctctacccgcccacatctctctctctgttttttttttcctcttcctgttggggcatgtaatgtaaccattcccacgaaacaagtagtaatccatcataactaagcagatgatgttgacgactactcttttccgggtaatacaaatccaccttagatttgcggtactaacagagtcatctaaaccaatgaatttagaaaaatatctatcttctaccctataattcatcaactacctcttacatccttcatacttcattcatcatcatcagatccaacggacgaaaatcatctctctcaaatccagtggctcccatttctcccaccttcttcccgggaatatcgcgcatcaataccatgccgccgccctctacaccgtgcgttcaacccgccacgaagaccgcccctccttcccagcgaatcttcatgttgcgtgttgccatgggtcgtccccgccacgaagaccgactcctcttcgtcggcatcgttggcgcgaaggtctccgcctcgggcaacccaccggcatcgtcgtccggccaacggtacctccgcggcaccaaagtccattcctcatggatacatcgaggacggacatgactgacgacacaacagtcgcaaccgttgctcaaggttgctactgttctcctcttgcacccatcttcattgttgactgaacctgaatggacggtaaccttcttctcgccctctgcattgcaggtctgattaagctctagtctccttcacttttaccttcccacttgtttctgccttccggtattctttgttttccactagcgtgtgatacatgagtgcaaggtgctcgatgaaaggtcggcaaggagtccactactaggagatcaatgcttgtggggggcaatgcagttggatctgctggcacaaagtggcacaggttagtgcctgctcccacatggcttgcaattggcattgatatctagatttttcagctctttagaaacaccatccaactcgctggagatgtgctgataggcgagctttctgggagaaacaatgtgtgcattatactgaactccattcaccagatcaacatatatataggctgcgttcttttctcagttcaacagtgattacggaaaacggagcgatccattagcacatgattaattaagtatctgctattcttttttaaaaaaatggactaatatgatttttttaagtaactttcgtatagaaactttttacagaaaaatgcaccgtttagtagtttgaaaagcgtgctaacggaaaacgaggactagaactgagaaaagaacgcagccttagtggtataaatttagtccttttttatgtgttaataccttggttcatcttcatgtctgtaagcaatgttggcaattcagcattttttgagagaaatgatatcatattgaaaggtccacgagttcagcattttctgtaagtgtctgtttaactcatatgcatgttgcaggggttccacgaggacgctaacgaccgtgtgatttattagtggaaaaaatgcttcagcccaaattggtctactgttttcagtcaatgtgaaaggaagcttaatgatatcaatgtatatatgggagtttagaggagttttgggtttgaggagcactctgtttcttcactttagtctctctcttccagcctatttatgattggagaactcttattgcaggaattgtcatttaaaaagagaagggtttgtcaaactaattcctttttgctacagctttcagtactgtccattaaatctgatgtgcttctaattaatcttatacacaatatgccaaaatttcagcattttaaacactgttgctttcatttgcagaacaataattggttaataaaactaacactatatttccattaccagctggtctgatgagtggtaattaattagttgggtgttgcaaatatacaggtagagagatagcagaaaggtatgccaatcagagatcttgtgggaattctcatctgtactatctctctacctgcatagattatattggagtattgcataatctcacaaaaatgatgggtcttcagaaggaattctagagatatttttgaaggaattctagagataagtctacgtgtgttgaaaattggggagtttggcacaaggatggaagaagatgggaacatctaaaattggggagtttggcacaaggatggaagaagatgggaacatctgtactatggtagtatggtctatgtgagattatgcaatacttcaatataagaatgggagaagatgtgaactctggttctctgaattatttaagtcaccagcaataacattacgacgaagtagtacagcaagattttaggcattggctaaccttttctgatccatgcaatggtgatggaaaaatcatagttgcaagccaagaattaactggacaatatgaagatacatatatgaaatttgtgatttttctttgtatagagagtctttttaatggataacctcgctctgcatcttactctgccactgaggccactacccatcttaagaggatatgattttaatctgcgttgtgcaggtatagatgcatgtacatttctcaaaaaaaacatattttagttaaaatacttggcatggatagcatatttacaatccgttagccatgtttttgttaaaactcttcatatatatttttaattcgtttttaattggttatctcctcttttcatcaaacgtgagcatttcaagagattattacgactattaagcaggaaaagtcctgattgaaaggaaacttgctgtcattatatctttttatatgcacatttaatactatttttatcatttatggatgtctaataaaatagcttcagatgttggcaaaccttccacgccaatttagtctaaaatttgattaccatgcacacacatatgttgtcgcacacatatatcgccattaataaatatcaccgtagcgttagcatggacacaatactagttaaaattggttagtggagccaatttaaaaatcaaaccaacctctaagctgatttaaatcgatctcaaggtaaacacccatcttatcgacgaattataaggtttataagacaaacctgtaaaaagcaccgcattctcgtagtgaaggcggataatttattatgcaaatcgataaagatggacagactaatgctacgtaaaagataaaatagaaacatggctgaaatgaaaaggtgaaagaacaattcgattgattgtgtaggggttgtggtggtggttgaggtgttagaatcaaatcagccttagctcttataaagggatcttatctccgcgtggcattctccacgtcctattaggtttagagatccaataggacttaataaaccttgaacccaaacgaggaaccctgagaaccaacaaatcaaactcggagtcgaactatatcggtttgaccagccctaggctgttgatctcctctcctttcttttcccttctttgtcttccccttggtctctctctctctctcttaagaaatggacggcacaagtagccgatcaaagcaggactagacagcggcgaccagatgccgatgaagaaatccaaaggaagaagcagctccccgaaggaatccttctaactaccacctatctacctcccgcttttgttcggacaaggcgaatttcctaagattcatccaccgcggatacactaagcgttcttcccattggtaaatctgattcttgcaaatcaacatcagacttagaagcttcatggggtctggtctcgccatttggcaatttaagccaaacaaaatacagggcctgtttggcacagctccagctccagctccaccctcctagagctggagctcagccaaacagtttcagctccactaaaactgggagtggagctgggtggagctctctcacaaaatgaactagagttgtggagctgggtttaggcagctccacaactccactccagacccaactcctgaagctaaatttaggagttggagctataccaaacaggcccacagtacagaggttataaccaatacaaaagcaagcgcgaactagtcagaaattagaatggagaagtagacacagaagaagaggttgttgggacagtatcgatagccgagcggcgagtatggggagtcctacgtatctcggggatgtagggggaagcgggtgctacatgtggttgggcagccatggcaaattaaaggcccgagatcgacgagctgccaatggcggccagttaggaagaagatgggttcaagcgatggcggttcacctaggtggaatcgatcaaatgactaaggatttggggactagggatggaggaggcgattgaggtgaaagggctcaccgggatttaggtgagcagttgtggagtcgagccatggcgcccaggaaggggaggccgccgcgagcaatgagaaaggtggcgccggtggtgcggactggagaaacctcaccgttgtgctgctccataaaaatggttgtgacattttggaacagaagtagcagatatttttgtatataactaataactctggtcataacaattttatgttcttgtccaggtgcatcatgcatggaagagggtcggcgcggctgacagggaaggaacaacggagaggagatcgaccagctggctccctactcggcgtggtggcctgctcccgcgtcatcgtcgccgctgccgccggaccttctcctctccctccttgcaccaccgaccttctcccgacccactggcctcctccccactcgccagccagcctgcgcagagaggtgagagagaggaggatgggagagaagaggggaaagaaagaaggtattggcgtggacaccctgacatgtggggcctgtgtgggtcccatgctgcctcagctgccatgtcggacaaaaccagggtaaaaaccacctaaggatctaaagggaacggttttgtaaattgaggggtgccatatatctggtttcatggttaggggacgattttgtaactcgatgacaaattgagggaccttcggtgtacttttttccgaaagaagaagggaacgactagctaatatgggcctggaaatgatggatcgaaagaggcccattaattaattagtacaacaccgaacgaaaagaagcgaacaaatgcatgcgaagttgcaacaaagaagagaagggaagtagccgttaaacggcagtagctagctagttgagaagaggtggttttgataatgaaatgtatatatagcgtagtagctgtagcttatatagggagttggcacgtacgcctaggtctagctagctagcgatcacaccaggatccaacacaaactgaacaagatccacgacacaaaagatcgatcgatcgatccatcgaaaatggcgaagcgcggaagcaaaaagaagaccaccgcttccacccgtgctctccctcttctccgacgatcggcaggcgagacggggacggccgagagcaaggaggagaccggcgcggcgtctccgatcaagaacgcgatcaagaacgcggcggctggcgagatggcggaggaggagaagttggccggcgcggcgtctcctctcctccgactccgatcagcccggggagaaacggggacggccatcaagaacgcggcggcggctggcgagatgggggaggaggaaacggcggcgatggggatcacaagaactcgcggggatcaagaaacaccaagaaagaaaaagggaagaagctggtaaaagaggcgatcaagaaacaccaagaagcgaggaaggcgaaggagatcggcggcgcgcgtggcaggaaggagagcaaggccatggatgacggcgcggcggcgctgcgaaggaaagcgcgagagatcaccaaggaagaggaggatgacgaacgtttgcgcggggagatggtgtcccgggttcgagcacggattcgtaagcagcaaccagacgaggtaactaataaaatcatccttttcgatttatttttaatttgatacgaattaattaatgacgatgaatcaatgatgcatatgcactgatccatcgatccatcgggagtattaactgtttgcttcttgtcaataatgagtagtatatatggatatgatatcatgcattagctaatttccacctattgaattagctacttaattagcttgcattatagatatgttaataatttctatctactactcattttaattaggttgcattttatatagatatgttcttaatttcgtttaatttctttccgctagctttctccgatcacgtacgtactactgctactgcatgcattaccattttaggagtactagctagctactagtagtattataatattggtgcgtcaatcaattactagctcgatctgcactagtaatacttaatcaattagtgtcgtctcctcgcctcgttcgctctattatacatggatgcatgcgtactatactcacaaacgtaggcatgaatattaaattaactcgctgcatgcagtagccagtagttgcatgtagcattttaaattccaactctcgatgaatgaatgaaattaagaaataatgaatgaatgcagagtaagttggatgcgttctccattggcgtcaacgctaatgtgcgatcgtaccacaagctaatgatgaagagatacaggcgcatgaaacgtatctgttgcatgacgctggccggggcgccggtgacacctccgaccacccggcggcgatcgccagacctcaagatgttaccacgttccacattgtgggcgtcgtcgacacagatggtgctcgtgttcgtctgctcttcagggacagcgacctatactttgttgctttcaaaactggttcttgctggttcagattcaacgatgaacacataccaacattcctcacgcccactgtacctatagcttacacctcgggctacatgaacatgtgagtagtacctctcactcgcctgcctctagctagtatatactactgctatccacattattcaatatatatatgatgacgcattgcatttgcatctctctctctctctctctctctctcttaatgcttgcattctggatacacacacacacactactgcatatgatgatcgacttcactcacagctgacagtttcttcatttttgcatggcacagtgcgcaagttcgggttggatatcactgtctttatgatatcttcaatgtaatctcaagatacacccctgagtcggcacaagagaagaccaatgagaggcaacggatacttcagtgtgcagctctcatgttgagtgagtcacaaaggtttggccacgtccagctactggtaaagagacagatccacaaaatgatgagtaaaaagattactgccaaacagaacaagaaaatacacagttggggttccatagcacgctactgcatatcccacgaatgcaaagaagacgtcctgcatcatttaagcacattgatcgttctgttcaaccccgatcaaaacaagtatgagaattacaaaatagttggcagaagaaaattgctatctcgagcagctgcagcagcagcagaagcagcagcaagagcagcagaagcagcagcacgaccatcgcaagcagcagcagcagaagcagaagaagaggaagaggatgatgatgatgatgaggatgaatacccatggcaatgccaaacaagagcaggacaggagctcctgattctcctctacgacaaaagattgcgtacccaaggccatcaggagcggaggacatagggtccgactgcctccaccgcttcaagctgaagacgagaccaacaagcagaagatgatgattaagaaaaagaatacccaccaccctgcagttccatcatcgtctgataatgtggaagatctccctactgtttcagcgccaccagttactccaatggtggtaacacagcagaagaaccacaagaaaactcaggctgaggaggttgatgaaaagaaaaaccaagagaatccaaacacagatgccactattggcgctccatctggaggtgaaaaccatcagaatcgttcattgatcagctgtgacgggattaacctgtatgaatctgatttggacagtctacgcggcccacattgggtgacagatgcaatcctgggctatgccttggccaaattttcaagagcttactcagatgatggcctactcctggtgcaaccaacgaacgcagcattgctgaacaataaacactatgttgctgccgaggccgaccacttgctacttgctagtcgtcgcctggtcctcataccagtaaatgataatctggatttcaaccaagctggtgatgggaaacactggagcctcttagtcatccacaagaccagtaacgatggtgttatccagttcatccaccatgacagtgtgcgttcaggggataactcatacaatctgcatgctgctcaaaagcttgcaaatgttctgcggggagtgctgcccactgctggagatgttattaacgctgaaacgccccagcagactaatggaaatgattgcgccatacatgttctggctgctgtacaggtcatatgcagatggtggagagccaatgccaacaagagtggcccagctgattggatcaggaaattggacaaaagaatcagtgaaggcaacattacacagatgagggcctccctcctgcaggacattgaaagagactgtcaaaagaagaaatcgaaagatcaatgagctacaatgaaatcctttaacgtgaatctttgcaaacatgcatgaatcgtgtcaatttgtttggtaatatcactacatactgcagagtgcacaattaaaatgtgtgtactacgacagtgagcttatgttaccttcaagttgatttgatatcacatctgcatattcatctctcctggtcttctgatccatgactaagaaaactgttcattagttgcagttgcatttggaattaatttcactagtaagctcatactttgtattttgccaacatggactgcataggaagtttgaatggtttcagaccttgcatgacctttgcctacctgaatgtgattatcgtttggaatggcttacctggagattgaccgagtagttagttactggctgcacactcaaacaataaataaatcaattgcaggaatgcaaaaataccatgggcagccacaagcacaacttatttgtatgctacaagaacaaacagcatgcagaaggaggattagagaggagagaaggtatgtggcgtttggaaagaggcgaatttccgaagtggaaaaagcaatcagctgcgctaatcccacagaaacataatcctaaacctaacattgtctagtgtgaaatttgagacaagagcaacccaccaaatctatgtccatccgtatcgacacataactcgttgggccaggtatgatcatggtgtggtcggtgagggagagggcggagatcgaggaggctgagcgcgccttggtcgcggccatcggtgatctgccttgccgctccagcgccaccatccccatccccctgcccagctcagctcaatgcggctcctcctcccctgctttatgtgggttgggatgggctgttttatgtggcctcttgttattaactagcaagagacacgcgctacgctgcgtgtggacatggatagaatccaaatgagctcatgacatacaacacatacaaattctgttcaagatattagtagttttaatgtacagtatacacgctgtaaaaaattgttacaatccaaaataagcatgacaggcaattgtagatataaacgggcgcccaaacgtctgtttgtttcttccctgatatattgacaattttgaaagagaataataagatattgatggggcacacaacccaaatttttgtcaaatgcagaaacagggcctagctaaagggataataaacctatgtgctttcagataaacttcatatatactgggtggagtgcaacaaaaattctaagaaagtaatgtagcttggatggcaaaggaactaaatcaaaatagaattgtttcaacgatttacgattccactgaactaacacaacatacatctttacatgccttacctgcaaacacaaaatatcagtcattccatagcattttttccgtactattcttaaaagttaatattttattaactctatcacacacacatatataacattaggacaaaatgaactaaaaaacatggcagtataactgcttcagatgttaggacatggttacccatggaagatctggtggtaggcctttaaaaataaaaatatttcatgagataaactgcactaaaatgggagtctctaaggacatggtagtaattagttgtatggtgagtacattgctatgagagaaatcatatacacaattcatacatgactactaaaatgtgagaaccaaaaaataatgtttgctgaggcaatgacaggctctagtacatccttgtgcactataccttgctaaataaaggatttcctgcaagaggaatccttaagttgcaactttgagattctgtttgagaaaaccaggagggcagatgcactgaaggaatgagcatagtagcccaaatacaggcttgaatagatttatccttcaccctactgcattccctaaaagaaaaagaagtatgacattagtgttttctcaaaagtaaagtgacagatgtacatgaatagggattgttttttttttaaaaaagcatccatatatatatgcattggccatgtttttaaaatgtgatacaatagaagcaggccaaacataacatgtaagaaaatcaaccatggaatcatcgtagcatgtggataagtaccacaggcaggaatcatcttcccgtaaatcgaaagaagcgaactttaatcaacaatgtagcccgtaatagggtgtgctatcaatcctatgtgtaagccttcgtgcatgcttagtgcacagtccagtcaagaaagagtgaactaatctattgcggaactgcggactgtagaagcacaatcaagttgtatgaacttgaggacagtaagcttccttgctaaaatgcataatggacgatttgtttctgtgctgtatcaaggcgattaggagaaagcattaaaattaaatggcagtcattgaattatagttcatctcatccttggtaacaaatttattagcaagcagactactaatgcgtgtctctgggtcgtccccccggtcgacgccgtctcgttccgttcgcaagccgtcccctcgctggaccgcgcgtcccccgctccttttcgcccgggcgccggtggaagaaacccgttgtgtgggtatgggtgcttgaggcgacgacccccagagtgaagatttcctcttccacccctctcagtctcgacccccagagtgatgagattccggcggcggcggcggcgaggagagggagaggcgagaggtggcggcgagagggagagggaggtgcggcgggagagtcggagagagaggcggggtcgacggcgcctgcataccagatctgggacggctggaaggtcggcgacggcggcggggcggacaggtcggcgatggcggcacggcggggaggtcggagtcggcggcggggcagagcaccagatctggcgacgaccccgccgacgaccggcgacggagatgactcggcgacgaccccgcgacagcaacgggcggagggagcgccgggccgttctccccgcctcctccgccgccgccgcgcccgccaccgccagcgccgccaccgagtctcacgggagagagagggtgagaggcgtcgagccggcggaggtgtcgaggcggcgctggcggtctcctccacgcgggagtaattgagagagggggaaaagagagggggagggagtatagtaaaatatctatgtgggttttttggtttctactaggggcgcgtctgatgcgcgagtgttcgcgtagcgcgaacgagaaacaacaatcaaaagcggtcgcttgacttcgccatacgccactattccgctggttccacgcatcacgtgtccccgcgggactcatctattgcaagcctcgatactactctccataatcgtaattaagcaccatccttaactaacgttttaattagggaaattaatgatttactattaagatttctttaaagaagaaacataactttatattttttaccataaattattccaattaatatctatccaaacactatttcttttaattttctttgcatggactaaatgcctacagaaattcttaaaaactttctaccagtaaactttacacgagaattaaaactctttactctcaaactttatactcgaaaactttatggacataaacttgatactcggaaactttatacacataaactttatactcagaaactttatactcaatttttttatattggaataaatatatttattttgtaaatcatgacttctaaaggacacaactcgtagtatactccctccgtcccataaaaaaccaacctattactggatgtgacacatcctagtaccatgaatctaaatattcctatgtccggaattcgttgtactgtaatatgtcacatccaatcctagattccttttttttatggagggagtatctagtattgaagcaaaaaattaaagcaataaaaataagtcagcaagcagaaactatatcgcacatatatagtgtaaatgcaagaagactaaatgagtttatcacataaaaacatcccgtgtggatcccactctagtaccaagaggcggcaaatatagtggttatagtgacctgagtagtaccctaaggtcctgagtttaaatctgccgtttcgctactaggggtatcctccattgttaagggggtttcctagatagtaccctcagttagtgagggtactctaagagtatccctgattggtgatgccctaagcccatcaccaatgcagctctccaacccgtgtccctagctaatgccgtcccattttgacgccgcggcgtgccccagcagaatagcgtcccccagcagagggacgcgtctctaccagcgcctggactgggggatcgatccgggagacgcgctgggtcgggagtagcccaaggacactgctccatcccctggtttttccccttccaccctcgtccccttccaccagcgacggcatggctccgcggcggcggcgaccctcctcgtcgctcttgcggccgccggcgacgggagagagagtgacgagtggtaggagagaggtgaccgtcggcggcgagggagagagggagacgagcagcggagaggatgccgacgacgacctagagacctccgccggtgccgcgccgccgcggcctcctcctcgatgcggcgcagccggggctgctccatcgggacgacctagagaccttcgccggcgccgatctagccgcgagggggccaaatccgggcacgacggcgccggatctgccgcctccagctgccgccggtgccgaaacccacgcgcggctctctgacggcggggcgaggccggcgcgaggcggggaggactgcgacgtccaccgcaacccacgcacggctctccatccgccacctcgacccgcacgacgctctccgtcagcggcgacaaagggcggtggcaaggagagatggcgggagagagaggatgagggagagagcggcgacgggtgagagagggagagagaggggagcagctgccgccaccgccgccgccggcctgcatccaccgtcggagtccggcgacggcgacggcacgagaagcggaggggaggagaagagacgggcggagacgagcctaccgatggagtaaaggggaatttaactatttgctactattgcatttggcacttatccaaatgcccctcttatatttgctcctttttttgctcttcttaggtgatggcttcttaacaatttaccacttttgcctacgtggcgtaccaccatggcttgcaaacccaaaaaagtagtgtgggacccacaagtcagcctctcttcccttcacttcatcttcctcctcgctcatcctccagctcgccgacggggaggagccccctcctagtccgagcccggtgccggcaagctcccacgcgcatgcctccctccgcgagctccctccctacgtccctccaagcccagcgccggcaagttccctccgtgctcggcgtcctgtgaccctctcctcggcagcggggaccatgaggcgtagctccggtgggcgaggaccattaagatgtacgcggccttctcctggcacaccggcttgtcggaccaattgagcacatcggcggccctcggggtaaagtgcggcgagcgcgcggtccgctgccgtggcccgcgggcgtgtcgcccacggtggcgacgagcgatggtgtcagcaccgcagacaacagctgcgacgcgttcgccggcacgatggagaggttcaggagtgcgcgcaggccattgttcgttagctccatcggcgaggagagggacgtcgggcatggtgggaacttgccggcgccgcgcctggagggaggtagggagggagcttgcggagggaggcgtgcgcatgggagctcatcggcgtcgggcttggagggaggcggggagggatgctggactgggagggggctcctccccgtcggtgaactggaggaggaagatgaagtgaagggaagagaggctgacttgtgggtctcacactgcttttttggggttacaagccacgtggcacgccacgtaggcaaaagtggcaaattgttaagaagccatcacccaagaagggcaaaaaaaaaaagagcaaatataagaggggcatttggataagtgccaaatgcaatagtggcaaatagttaaattccccatggagtaaatgagggagagaaagagagggggagggagaagagaggggtaatattgtaaaatacctacgtgggctttttgggctagggacactcgttgggctactatcgttgggctactagtggtatccttgattgcgaggggagtttcccaaagggtgctctcagttagtgaggacacccatagagtgtccctgattgtagatgctctaagttaagcttgcattagcttatagtgaggacaaaactccacgcctgggtcagcctgacaacatatgcgctagaatgtgtaaagataatggcaaggttgaaaggcaatatattcaggatatgacaagaaagctgaatattctttgagtgatggcagtggaactgaaaattataggaacatgagagaaccattaggaataagaaaggggacccggcggcggagatgccactggtgatctggaatgcttgttgctcctcgtcgtcgaaccatctccaccgacgcaaccggcctagagcacgtcaccgccgcctcctccgcctctagatccactcggtcgtcggcaccacctcgccactcgtcgaccactgactccaccgcccggccacccgccggcccgttgccctacgccgaccccgtccacgctggtgcacggggtactcgtcccgccggtctcgccgccccctctgcctggagcacgccttcacgccgtcggccggcccgtcgccctacgcctctccaccaccgtctccgcgttgcttccgcccgacctctgctccaaaccaacgctgggtccccttccgatctggaggccgtcctcgacccttcgcctcggcgcgccgccggcctggacgatggggccccgcctcctgccgtccgtcgggatgccgcgtggacgcctatctctctcagctcactcatatactcccttcgtactcgtggttagctcttcattgtaaatatatggtccacctgtcagtctcagagattttcttggttcctgtgcctaagctggttgtaagtgctcatctctctcctctcctctctcatctaaatatatggtccacatgtctgtctcacaaattttcttggttcatgtgcctaagctggttgtaagtgctcatctctctcctctcatctctcatccacctcagcatttagccttcttatagtcctctattatacttgctctaatagctattaatcagacgctaatcgcaatgttaatctaacttgtaatttacgtagttagattagatgatccaacaattagaaaacttctgtgtacacttttctatgtagatgtaagaaagaaacaactggtgctttttatattagtatagagatagatatagattatattataggaacaattgcttatttcacctcgttttgaactctaactaccaatttcatactacttttttgttgtttatttatttgaccctccttttcaaaaaggcacactttactacaggacactatgatttcgtggttttacccgtaggacactgtccaaactcacttttatgggaaaacactcccataaacgtggtaatttgccaatggacaccgctccgattaaaataatgatttccggttgaggaggagagagaaatcacataaaatgtcaaaaatgcccttgggcccacatgacagctctccatctctctttctccctcctttcactcttctccctgtcacggcttgctcaacggtggcggcaacgtccggagcacgcgcgacctactcggcgatggtggaggaggcagcgtggcttgctcgggtgcaaccaccgtgacgaagccgctggagtggctagctcgggcgacgccggcggtgaacgagccaccgagcaaggccatggatgccgccaagcaaggccatccggcggccaggggcagcacgtgtgtcaccttgtcatccctatcaacctcatcggacaccgcagacgtgacgtcgaccccctcgggggactccatctgcgccaccgcgctgtcgtggacctgcattgacgggactccatctgcgccatcgcgccgtcgtggacatgcattgatgacatcctagacgccgcacgttcgagcacttttgcgtgcataccggcggccgcgccgtgctggaggaggtgcagcgaagcctcagcctcggcgacgtccgaagcacgcgcagcctactcggcgacggtggaggaggcaacgtggcttgctcgggcgctactgccgtgacgaagccgctgaagtggcttgctcgggcgacgccggcggcgaacgagccaccgagcaaggccatggacgccgccgagcaaggccattcggtagctaggggcagcacgtgcatcaccttgtcatccctatccacctcattggacaccgcagacgtgacgtcgaccccctcgggagactccatctacgccgtcgtggacctgcattgacgggactccatctacgccgtcgtgccgtcgcggacatgcattgacaacatcccggacgccgcacgttcgagcacttttgtgtgcatgccggcggccgtgccgtgctggaggaggtgcagcgaagcctcagcctcggcgacaacgacatggagccgagcaagtgcacgcttgtcagggttatggataccacatacccaatagtaattgactaagctcagcggggcccaccacataccaagtcttatacggaaacaaacctcatatatagaaggagttccggataaggaaggataaatagagttctatatggaaatgacaaggactactcggattgtatccatatttatctccctagtcttacttggacaagggggcatctatgggtataaatacaagcccccctaggaggagaggggatacgccactgttgacgaccaaatttggtaatctaaggatcagagatgaagaagaaatcgagaagaaattgagatggagatcgtcccagaaatagagtgaggatcggctgaagtccgaatcggctacggctaagatcggcagagttcgagtcggacggggttagccgattgagccgaatgtgacaatatgacgcagcatatgttgtcggtttaggttgatgtgcttcatgatgatgtccgcgcatggatagagtcctgagaaggcaattttatctattaattaggatattttatgtaaattccttagagatatgtttgggcaaaagtctgctgcaaagacttatggtatcttagagtttgttagagataagagtcgtgtccgatatggacatatcttgtaattctcgggtataaatagatccaaaccccatgtaatcgatagaacacacgtttaatacaatctcggcgcatcgccaccctttttactttcgttttgtttcgatgagttcttgctttcgggttgagctgcatcggtttcgatcttcaacaagaggtaaaactcgttatggcggcttgcgttctcgggattagtgcttacatctttatgacactctactcttgtttatgtaattcgtcaagttatcatatatcttacataatcttcgataacatcgttatctaacctacaatcggctaacatcgttatcttggactctatttttgacagacatagatttgaacagcttggttgacatgttttcaactcaggaaatagatagtctcatctccattattccagctgacaaagcaccagggccggatggtttcaatggattcttcatgaaaaagtgttggcatatcatagctcaggactattatagactggcagctcatttccatgttggaaatgttgatttggaaatccttaatagctctttcataaccctggttccaaagactgttaatgatttcagacccatttcccttatgggtatctaaaaatcttaattaaattgctagccgacagacttcaagggataattcttaaactgttgagtgataaccaatatggtttcatcaaaggaaaaaccatacaagattgacttgcctggtcttttgaagttagactttgaaaaagcctttgataccattgagcattctgcaattatttcagttatgtagcatatgggttttcctccaaaatggattgagtgggtacagatggttttctctactgcttcttctgctgtgttattgaatggggtgccagggaattctttcaaatgcagaagaggagtcagacaaggggatcctctctcacctctgctttttgtgttggggggagagctgttgcaaagagtaatcaacaaagcttttcatcaaggccttctgtcaaaaccaattaatgaaagcagtggggatggtttcccaatcattcagtatgctgatgataccttgatcttgttaaaagcatctcagaaagaagtcttctgtttcaaggctattttgaatatgtttgctcaatccacaggcctcaaggttaactataataaatcaagtctgtacccacttaatatgcctcaggacaaagctgtcttactatctggcattttgggatgtaagatcggttctcttccattcacttatttggggctacctttgggaaccaccaggcctagagtggtagactttgctccgttggtagacagggttgaaaggaggctgacagcaagctccatttttttacctcaaggaggaagattaactttgatcaactcagtcctgtcttctatcccaacctactacatgtcctcattgcagctaccagttactgtcatcaaggccattgacacagctcgtaagaattgtctgtggagagggaataacccttcttctacaaggaaatctctagcttcctgggatagggtgtgcatgcctaaggagaaaggaggcttaggagtgatcaatctgagagttcaaaacacagcccttcttctaaagcatatggtcaagttctataatggtgctgatttaccatgggtgaaattaatctcacaatcatattatgagtataaagttccacacttgatgatgaataagggttctttttggtggagggacatcacatctcttgcagacatattcagggggatagcaaaatgcgaaatcaggacaggaagaactgcccttttctagaatgatttatggaatgatgattttaagtgcaccagctaccccaatctctttgctgtgactatgtatatgtctgattcagtcaaggccatgtgttcaagacccttagaagactcttttgcactacccctctcagatgaggcttattcggaattcttgcagcttcagggggttctggacagtttgactttacaatcagggatgggggatgcttggaattttatctgggactcagataagtacacagctaagaaattctataagctaaattattctgcattgcaactccccaggcccatgatttggctatggaaaacaaaatgtgtcatgaagatcaaagtctttgcctggctaatgttctgtgataggctcaatacaagagatatgctggatagaagatattgtgccaaagaagatgatgatctcacgtgtgttttgtgcaatgcgaattgtagagagacaaggctacacctcttcttcttatgtcctttcagcatcaggtgttggcaatacctgggaattgagtggaataataatttggagtttttcccaatgatatccctagcaagaatcaaatttgctcagaagggtttcctggaaattttctttttggcagcttggcacatttggaagcaaaggaatggcttcatatttcagaacattcagccctccttccagacatggagatctctttttgtcaaagaagttcttctgcatatgtgcagaatgaatgatcctttaaagcaaactgtttttaattgggtacaaaccttatagtctttctgtgtgacccgcatgtaatctctgtaaccttgtaaatattttctttatttataaaattacactgttgggcaaagccctagcagttttcctggtaaaaaaaaacatatgctaatagagggcagccgaataggctaaataacgacatttgcttagattatataggatatctaccactctaggaatcgtccagtgacttgattgtctagatattgttcttcttttcatacttaatactgcatcagttgagtttgatctattaagtcgtgcttagaatttcaatctctagcctgccttctggttgccgattagggtagcatcggggtttcagccgatcttacctgatttaactacatctattttatacacctgattgacatgttaaatctgcgctttatagtaagatcttgtcgcatttaagtatattagtcttttgtttagtatattttacttgctttaatatcttaatatagagtagtatcggagtattagccgatacatgctagatctatataatcggctatgctataaacgtatatagtcttgttattaatatatattttgattggagtgatttatactgtctcggcatgacgaccgatctatcccaatcacttgatttaattatatatcgacataaggactatatgtcgttaatatctacatccgatcaagtagatttagttctttcttacttattaatgattgccgatcgatgcatatatgacatcggctcaaagataaatgatatgtcgtcggcacctagctgatcggctatcgtttatggatttaaccacggtttctttgtccttgtttcttgttgattgcaggatcaaatcaactggcacgctagcatacccgaaggcgagttttggacctgcattggagttaagtagatctctcaggcctcgtgtttttacatcaacaatcaacggcggcgacggcccgatgctgggcaaatctaagccgtctgatctaatggatggctccaatcgtccctgcgccggatgatgcgccgaccgagagagaggggcaaaaccttagctcccaaatcgttctctcccgatcccattgccgattagggtagtatcggggtttcagacgatcttacctgatttaactacatttatcttatatgccttattgacatgttgaatccgccctttatactaagatcttgacgcatttaagtatattaggctttcgtttggtattttttacttgctgtgatatcttaatatagagtggtatcggagtattagccgatacacgctagatctatctgatcggctatgctataaacacatatagtctcattattaatatatatttcgatctaagtgatttatactgtctcggcatggcgaccgatctatcccaatcacttgatttaagtatatatcgacataaggactatatgtcgttaatatctacagccgatcgagtagatttagttctttcttacttattaatgattgccgatcgatgcatatatgacatcggctcaaagataaataatatgtcatcggcacctagccaatcggctatcgtttatggatttaaccacagtttctttgtcctcgtttcttgttgattgcaggatcaaatcaactggcacgatagcatacccgaaggcgagttttggacctgcactggagttaagcagatctcccaggcctcgtgtttttacgtcaacacgcttttggcacgcccggtgggacagatcagaagtcagaatcacaacagcaattttcctcatggccgagaaaccgccagcatcgccgtcttcggctggtaaagatggttctgctaagtcgaagttcccgaggcttggtctatctgagattaatgatgacaacatcgtacccgtcactccggataagttgacacctgagcagcagatggatcttgaggcaatgatggagcaagcacggaaccaattcttgaactcattcatggagacccgaaagggaacgcttgttcagaaatataaagtaaaggtaattgctgatgttcctaggacaggttcttccaaagatggagaagtaaagcaagcttcagatgatgcagctcaaacaagtgataaaggtgctgcagatgactctcagggggttcaaggtgatggctctcaaggggttcaaggtgttggctcttagggggttcaaggtgatggttctcagggatttcaaggtgggaatcttaatcaggatggcaatacggcacaaggatttttcaataacttctaagatcatgtcgactatgctatgcaacacgctttgatcaaccaatctggagtgctagtcaatactttgtcaaatatggtgaagtcgattgttgatggcacaatagctgaataccaggctacaggaccggtttatttgccaggaggtgttttcccgaattatcggcccttaatcaccgataatcagccagctgttaagtcagttcctctcaatgcaccatcggctcagccgacggcaccagtatcagctcctgcacctgctgtaccatcatcggcaccaggtcaattagttaatcctcagttgttggtgagagaacagccacaacatagtggacagaatgtgaatcggctaactcaagaccaagttgcagttatgttcttaccacctcagcctactgctgacccaatacaacaacagccgattcaacagacaccaccaagccagcaggctttgcagtcaacgcaacagacgccaccaaggcagctggttgtgcaaccgatccagcaaacgccattaaggcagcaggttgttcaactgattcagcagcaaggtgtgataaatgcatcggctgggtttgcaacatcggacaatcagataaggcagcatactgcgaatcaagttgtcccagagcatttggttcatcatgtacggccagaccaaacggtgatgcctcaagttgttcctaagcatttggtgcgcaatattcagccaaactttcaaaattaccagggggcaatttgaattatcagtatcagtctccttcaccgcaagttcaatatcaacagggaggaccggctcaatcccagtttgtttctcaatacaatcaattcgagcccatgccacaacaagctcaaggagtgcctcagcaacgaccatgggctgatatgattgcagatgtaatgagagacagtttggactcaagccgaaggatgctgggaatatgtatcggcacccataccctgaatggtttgaaagggtacaattgcctaaccgatacaaaattccggatttttcaaaattctcggggtaggacagtgtttcgacttatgaacatgtcagccgattcttagctcaatgtggcgaggcatcggctactgacgccctgagggttcggttgtttcctttgtctttgtctggatcggcttttacttggttttcttctttgccatatggatcaattaacagttgggccgatttggagaagcaattccacagttatttttatagtggggttcaggagatgaaattgtccgatttgacggcaatcaagcaaaggcatgatgagcccgtgaaacattatattcagaggttcagggagatgaggaataagtgctacagcttgagcttgactgatgcccagttagccgatttggcttttcagggtatgatagctccgatcagagagaagttctcatctcaagactttgatagtttgtcacatcttgcacagaaggtaaccttgcatgaacagagatttgcagaagccaggaagaactttaaaaaggttaatcatgtttgtcattacatatatggatcggacgatgatgatgaggatgacaccaaaatagcggtagccgaatgggttagaagcaagaaagttataccatgccaatgggtgaagagttctggaaaagaagaaaggtatgactttgatattaccaagactgataagatttttgatttgctacttcgagagaaacagattcaacttcctgctggtcatacaattccatcggctgaagaattgggcaagaggaggtattgcaagtggcataattctgggtctcattctaccaatgattgcaaagttttcagacagcagatccagtcagctattgagggaggcaaaattaaatttgatgattccaagaggccgatgaaggttgatggcaatcattttcctgtcaatatggtgcacacatctggccgaacaaccgatggaggaagagctagaggctttcaggtgaattcggctaagattatcaataagtaccagaagaactacttcaagcaacatgagaggcgttataaggaagataatggtggttttgatcctcattgggaaaaaaagttctttagattttgctggaatgagggtatgaggctgccatctattgaagactgtcctgggtgtggtgatattgcggaaagttcaagacgatcgtataatagaagcaatcggctaaggcagactagggttcctgttcatcagaggttgggcccagtaaaccaggatcatgacaaaggagatgatgaggataggaagactcagtggtgttcttttggtatttttacaaagaatcaaaagagaagggttcagaagttgaggaatagagaacgctttcaggagttgagcaagagatcaaccatcggttgaagaagacgaagccaaaataggagtggcatgttaagagtcaagttcctgtagccgatgaagcaaagagactagctaaaggaaaaagtgttgtgactgtatcggttaacatggttttcacgttgtctgttgaatttggggtcaagcaagctgatgtcgatgaaattgaagaagaatcggctaagttacttttatcactagaacaagcagtcttcgagaagccggaaggaacagagaatcggcatcttaatccattgtatataaatggatatgtcaatgggaagccgatgtccaagatgatggtcgatggtggggctacagtaaatttgatgccttatgctatatttagaaaattgggcagaaacgttgaagatctcattaagacaaacatggtgctcaaagattttggtggcaatccatcggaaaccaaaggagttttaaatgtggagctgacagtcggcagcaaaactatccctacaacgttctttgtcatcgatgggaagggttcctacggattgttgcttggaaaggattggattcatgccaattgttgtattccttcaaccatgcatcaatgcttgatttagtggcaaggcgacaagattgaaatcgtgccagccgacaggtcagtcaacgttgccagtgccgatttagcgctttgggagatggatggtctcgattgcttatctggaaaagtttgggatggagattttctaaaagtgtccgattctgatatacagccgattgaagatggagaacccaagctattattttgagggcgtcgtggagggttcaaacgtctacaccaaggacacaatggatgatctcgatgacaaacagggacagggtttcatgtcggctgatgatttggaagaaattgatataggtccaggtgat

SEQ ID NO: 68221 - DNA, 576 bp, Oryza sativa
ggcgaattcgagctcggtacccatccaacggctgataccactccactgctcttctttataatttaatggtcaacttcagctcggaagccaaataaaataggagtagtataatgtggtgtacgtgtacctctgttactgacgagttcagcccaaaggccaccacttccagcgtggttaatctcctgcacaaataataataatacagatttcgataaggaaaaaagcaaagcatccgcaggagaataaatggaaaaagaagaaagaaatgaaaagaaacgagacgtagctagctagctagtcacctcgaagaacagaccgaacagagtgtccggcattcttcgagcgacagagtaatcgacatggagagacgccgtctccaacgtctcggcttcgcatctgctgccgccgccgacgaagaaaagaacgaggaagacgacgacgacgacaatggcttgccgggacagcatgctcctcgtcgccggcggccacactctcatcattctctctgcgaccacaatgatcaatggattgggtacgttgttacttgcgagagggaggcttgattattcgaggttg

SEQ ID NO: 68222 - DNA, 532 bp, Oryza sativa
tcggcacggccagcttcaacgacagcagcctctccacctcctccttccccagcctcctcaccaccttcttcctcttcttcccgtcctccttctcgcgcggccgatacgccagcaacacctcctcatgatcatcctctgtcgtcgtcgtcttcttcttcttcgccgccgacaccagctcgaaatggggccgccgcttctccccatcggcgcaccccctcatcatcgccatataaaatcaaaggtatttttgattattattctgtgatgaacaattagacattggagattattggttttgttatttggaatttattcacgaagtggttttggagatgattggattcacaggtaatcgcaggattttattatttcatgtgaccggtcagaccgggctgtgtatgccggtcagaccggcggtgatcgagcggtcggaccggccagcccacggtctgaccggccgacactgtgtcggtttcggtttcgggttgtttgtttggatatccgtgattatttcatgattatgacttctcga

SEQ ID NO: 68223 - DNA, 663 bp, Oryza sativa
  unsure (1)..(663): unsure at all n locations
gagggagaaaagaggaagggaagaagaaaaaagaagagggggaaagaagggagaaaaaaaagagaggagagggagganaagggaggagaggaggagaagaaggggggaaagaaaagaagagaaaggaaggagaaaaaagaggaaaggaaggggaaggaggggaaaaaanaannggnnnnannnnnannnanannnngnnnnnnntnnnaannannnnnnngnnnnnnnnnnnnnnnnnnngnnnnnggngtcatctattaaaaaacggaggtagtatttaataaaactaaaatatgaaaaaaagtttaactcttttgatggagggagtatataagatcaggtgaactaacgttgaggagcaaagttgattgtggtaaaagaaaggcagaaagcgttattagactccctaaagacgaacgataagcccttcgcaaagacgacggcatgcatatggtatgatattagattataaacagttctagtggcgcacagcctcgttgtcacccgtcgcgcggcgcggtgacgaagcagagtgcgagaacaagccagcaaagaaccgcgggaaggaaaaaacaaatcgtaatgacggcatacaccgtaatgatgaataacacccacatcgtgaggagcatctcatgggagttggccaagacgaaggtggca

SEQ ID NO: 68224 - DNA, 10456 bp, Oryza sativa
aaactgatgattgagaaaattaatatactaatggctaaactcatataaattacaaagctagaaaagcaacatattaattgaaacaaatctagatcttactaattagtggccagtgctaacatcaatgtacatttgccataggagacagacaggagtagtgcagtacacatgagcagagcacccgagcagcggcggatggcggtatcagtcaatcaactgaatgtggccatagaggaatcaaatagacagaaacggaggagagttcctgcgtgagagtattatggcataatacccccacaatcctaaagatgagatagtattgcattcgtatcatgaattcatggtatgcttaaaaatgttgtgaacctgaaaatttctatacgtacggatgtgatatgcattggagacggaggcggtgacttggtgaggcggagagagggcctgcaggtcctgggcctgcggcgccgcggaggttgctgccttgcgccgttgagcaatcgcatgagaacctgctggtagctgcagacatcggcgaggtgcgctgctgctactcgttgtattctggcgccgtctcgaagtattcagcggcctcgtccgattttcgtgttctaggaatcgcaaacgctgccaatcgcgctcgtcatgcgccggccatcgcgcttgtgctgctctatcggccgcagggggggagggtcgggggtaggtgggggccccatggttttgggggcccagtgcaccgcactgctcgaaccccctcagggccgggcctgctctctccgtcctaaaaaaaagacaaaccctggtttccgtgtccaacgtttgaccgtccatcttatttgaaaaaattataaaaaaaattaaaaagataagtcacgcataaagtattaatcatgttttatcatctaacaacaatgaaaatactaattataaaaaaaattcatataagacagacagtcaaacattggcataaaaatttagggtttgattttttttggacggagggaacatgtatatacatactacaagtgtatcggccattcacgcccccaacagattgtcacctcaacctggcctatagtactagtactccagtcgtcctagcccctgactcgagaatttgtcggcagatacatccattgatcattgccaccatcatcatcacattatttatttcgaataatcgttattacaaaactgtcataaaaagttttaaaataataccgctagaactatcgttcaagttacatcgttacaaaattaaaaataccagtgataaatttacaaatgtccctatttattttaatccatcttcacctcctctgtttttttttaaaaaaaaatctctatctccctttattgaaaaagggcacggtcggttcaaaatagcaactcctgccaggggttgaggtcggtcaaggacggccttcgtaaaaaatctaccgcggaaatagatttattaatttcaagttctccatcatttatatatatcgagatcgccctatacagtggattaaaaaaatctatagagcttaagagaaacatactagggtcctgtttgagaagttttattctaactctgtgttcttaaagtacctaaaaaaaatctaggaataacctagtaaccagaaactgattaaccccagcttctctatgttttctccaacttcttttcataattttcagctccctctaagtaggattaagctcaaaaagagagagtggtgccacgtgcttgcccttatgccacatatcgatgagcgtgagcttacgagactacccaggatagccgagagctagatatggtgccccctatattattaactactccctctgtctcatattagaagggattttgagtttttacttaaattgtttgaccactcgtcttatttaaaaaattttagaattattatttatttttttatttactttattatccaaagtactttaagcataacttttcgttttttatatttgtacaatttttttgaataagacgagtggtcaaacaatgcaagcagaaattcaaaatcccttataatatgggatggagggaatagatgatatccccccacaaaaaaaaactaggtgatatcccacgctttgctatgggattcacggatgagtataagttaaatattgtcgaaataatgaaagttgaaatgttgagaaaataatgtgaggaagatgatttgacacatacttgttgatctctgtaatataatattatagatgatatgtcatgtttgcatggaatttaaaataggctagaatagtaattgcaagtgagtgaagatgtgacatgtttgcatgggattttaaatgggctagaatagtaattgctagtgggtgatgatgtggtatgcttgcatgctgagttttagttttagtgggtaccaactatatagaaattaagtatagattgtatttgtttttcttgtacaaacaattaaacatacaattcctgcggtattaaatgtgtttgagatctcataaacttatggatacttttatcatccttgagaaggtatcgggaggtaccatattttatagtgtaaaattttggtacctctagctacgtactaagtaccttgagtaccaaaatttgtaatgtaaaatcttggtacctctagatactttcttaagaactataaaatttctctaaatttattaggttttgtaaacctattctaaatataaaatggtaaccgagattatacttcaaagacttttaaaagtcaaacaacaaagtattaaacgttacaaattaaatgcatacatgtgtgtatgttaatggaatgagatttgcttcagtctagtaaaaagtaactcgaggtatcggtatctgacactactaaattattttcgatcgttggatttaactgaataggccgatgggcattgttagatctaacgatcggaaacgatttgttatcatgagatatcaatacctcgagttactttttattagatccaagcaaattagataatggaattactgtaatatgatatggccacgagaggattgattatatatgttgttgctggttaggcaggcagcagtagatggctagttaattcgccactgatctgatgtgagtcgcgtgccagcgacgcttggcgtatatgcatcgtgttccctttgtccgttgctagtccacaccaccttgatacgagctctcctctgctgctttccccttgtatacttgctttgcccactggaataatatcgatcgtcttgcgctctgtgtaacatagtacttgtacctgcctgccaccatgtgacactgcgtgcttcatgtctccacccgtgtaaactcttcctgccaagatcgatctagatagtcactacctccgttccatgttatttgttcttttatattatttgtctttttgagttttttttgtttgtcaatgtttgatcattcgtcttatttaaaaaattttgaaattattatttattttgtttgtcaattgctttattatcaaaattactttacatatgacttatcttttttttaatatttgcactaatttttcaaataaaacgaatggtcaaatgttgcaaataaaaagtcaaaaatgtcacctattatgggacggagggagtagtagctactcttgtgcatcatatattaattgatcagttggggattggacaattaattagtcttaaatatgacttttaggacaactacctttccaatgtataaatattataatatttaggaatttctcgtactaattgttactagtagctagcaatagctatatactaggtgaaaccctgcgcattgctgcgggaatttagtatgataataataaaaaaaaataacgtgtaagatagctagataacatcagattaagtaaattaatgtggtttacgataatttaaatttaaatagtatgtagaatggtgattcaaacataaaaagtaaggtggtataactttatggaagaagaaaagtagggatatagtttggaccatagattaatcatctaaagactaaaaacaattgatgtgatataacttaattagaggagaaaaggagaaagataatttgtacaatagattaatcatttaagcactaagtaaggatgaactatataagtatataatatctaaaacataataaagatatacattgaaacattatgtgaattatgttggatgttaatttaacatatttgtatttgaaaatctcttaaattataaaaaactataaagatatagcatgtttgcatgatgtttaaatgtgatgattgttagtggatgatgatgtgacatcttgttagtggatgatgatgtgtcatctttacatgttaagcttaaggagttagtgggggataattttatagtaagataggatatgtatcatccatggcattgtaaataatattagtgtctgtttgggttagtgccctcgtaaaattttagtagtgcatgttagtgtctgtttgggttagtgccctcgtaaaattttagtagtgcaaaatcttagatatgttatggcactactaaaattattattgacttggacaaaagttgaccacaatccaaatatgtaccgtgctatattaaagttatcaaatgattcgtaggactaaatttggtatccaaccaagctatttcgcagtacataccaactatcaagttaattagcaccagctactatgagaggcttgtaaacaacccgtctatttaaaaaaatatataatgcatagtaaaatgttcttaataagtctatatatgcgtgtgtatattaattaatcataaccattagattaagctctggggcctagaatccagcaacaaatatatatgtaccaacccatgcaattaagctaaccatataattaaccttgtaagccacctgctatataaggttcagaaatttgttgtgatattttttgggtaccagtgatttatactccccataaaatcgttttttcttttaaaaaacggaacacatgcatttgctgcttcttcttttcgatctggaacctgccgtcgatcgatcgatgaagcatcatatctcatgatatccagtcacgaatgtaaaggttgccacacctgactggttcctttcattcgcgtgtatagcaaagtacaagctggtgatgatgctggtctgattagtggaccgaccgacctggaatgaatatatacgacctctcagattttccttcaaaaagacaaacgtgtcgctctagtacttagagatgatattcttgagatgcatgctcctctcactgtctgattgttagcttatttcgaaactccttaattttcaagcttatattttttcgggggtggccaaacaactatttctaccagttatgctttcgaaacctcgggagcggcgtcggacggtggggacggtggtggggagctgtgggtggttgccaccagttgggtgggagcagcatgtcgaggacagaggaagggcggcggtgggaaagcggagacggttgcgagtggcggagagcggacgtggcagggagcgaagacggcagccttcggcggttgccgacatggactgggtaaggtgggaggacctccctgacaacgtcctcctcggtgtcaccgcccgcatcccctactgtgctaactgtgtccgcatcgggcggagccgcgcccccaccgccctccttctacagctggatcagcggttgtcaccgccatgatgtgcatgccgaccgtgtgctccccctctgccctcgcgccgttacgccgccgcctcctccccctcagctgtgtgcacagcgccgctcgctttgcctccgctccatccttgcgcgctcccccctcatggcatgtcgcggccacggcgctgcccacgttgtctacatggcggccgcagaggcaagctctctcctcccccacccgcggccactgccgtccccaccaccattgccgccactcctcaccgccattgccgctctagccaggtgaaaagaaaggccgggggagagaaaaagagataagagagaggggggaggaggaggaagaagggaaggagagaggataacatgtgggctctacatatcagtggttaccacaatattctttttgtgaatgataaataagtcttgcacgtatgtttttgattttaatgccacataagcgtcacatcaacgccacgtggaatgaagacctggtcaataccgctaagtaggtgccacgtcagtgaaaccgccttctaaaaccactaagggagttaaaatgcaccagttttaatagttgggggtcaagatattcggtatatacgaatcagattcagccattactgaagggagtaaaagtaaacttattcccagttaagcccagtgcgtatctgccactgttcctttttgttttgaactccaattttattgggtctgaaattagtaggcctatgcataccattattatacgcgcgaaatgtcattttcgtcatagtactttgcaaatatttttgaaaatgaaactgctcctgagtttcttctgatatttccaaacctccctgcatttgttctcatcctcaggccctctaaataacaaaatgttgcatcacaacgatgactgcttgattaacaacatgctagtgtatggttatttagctttatttttccaagaactatgtttaagctttgcactatgtataaattttataccataatatgcaattatccacaccatattatcagctattcctacatctatctcaacggtcaccaattctagaaagaaaaattctccgatgatcgatgatcatacacccggtcgtgcccatggcctacgcccactggctgtcctctccgccatcgccacgctgtcgccgccaaaatccaccgacattgctcccgctcccgctcccaccactgccgccggcctcccgtacgcctgcagcaccagcaccgacgccgtcgtctggaagtccttggacgccagcaggtcgccgatgggccccagctccggtgactcgctccactccgccatgcccgccgtcagccctgaccccccgggcaccttcccgacgacgaacaggtccttgttccccatggcctccacgctctgtatctcccccaccatctcgctcgcgttgaacacgccgcgctccctgtactccaccgtcgcgccgccgccctcgttcgccctctccaggaagtcgcgcaggcacccctcgtcggccttccgctctttcagcgcgtcgaactcgctcgccgtgaagcttcctcccttctggacgaaccggagcaatgtcaggtcgatggtcgggttcctcaccatccgcgtcgccagcgccgccacctcccggtcgtcgctcccgccgaagaagagagccaccacgcggtacccgccacccggcaccgccgcgaggccacggtccacgaggatgcccaccgtgcacggcgagaagctctgcacgctgcagttgagcggctgtatcgccgggtgggacacctccaggccgccgtccaccgaccggtacttgtggaacgggagcaggatgagcgccgagtgctggttctccgcggcggaggtgatgtcctcgtgcatggaggcgtacggcgagacggcggccatggtgcgcgccgacacgcccaccgactgctcctcgtacgccatgaaggcgtgggagatgtgcttgaactgcatctccgtgtggctgcgcccgtggacggaggcgtcgtaggaggacgacgatggcgccgaggcgttgatgaggaggagcgcggggaggagcggcccacgaactcgatgaggtggagggcgaggacgcccacgggcgatcggctcgacggcgtcaccacgtcgaggagcgtcagtagcgcgggcacgtcgcgcggcacgtggacgcaggccagcacgcggagctccgattccgggtgagcccacgccaccgtgcgccgcttgtagaacacgagccgccgcgccggcttcaccaccatgcccaggaaagggctcaccatcgccgtgatcagcgctgacacgaacaccagcaccgtgaacgactggtcactcataatctacacaacacaagaagctacctacccttaattaatcacgacatgcaatgcactacatggcgatcgattaattaaaatggattacccctttgttccttgcaatgttgaggatgacgagctcgatgatccccttggtgttgagcaacagcccgatggacgtgccgtcaccgagcggcatgccgaacacaccggcgacgccgattgcggcgacgaccttcaagaccgcagcgaccatggcagcgaccatgagcaacacggcagaatgcatgttggtgatcttggcggtgtcggtgcggaggccgctgagggcgaagaagagcgggagcagagcgcccaccacgaagtcctccaccttcttcaccagcgccaccccgaccggcccgttgggcaccgcgagcccgaacacgaaggcgccgaatatggcgtgcgtgccccccgcgtccgccaccagcgccgccaccatgacgccgatcagaatccagcactcgcggtcctcgccgaccgcctccccctcggcggcgcgcctcgccagccgcaggagcatggggcggagcaggaggtagctggcgccgaagatgacgacgcccgacgtgagcgtccacgtggtctgcgtgatggtgcagcgcgagtggccgagcaccgtggcgacggtgaggccggtccaggcgaaggtgtcgttgatgagtgacgcagagagcgtgagctggccgacgtcggtgccggcaagcttcagctcggcgatgttgcgggcgaggacggcgaaggcggtggaggagaaggtggagccgaggaagatggggaaggagagcttgttgaggaacgtgtcacccttgtgtttgtcgtcagtgctgagcgcgacgtagccggtgagagcgccgacgaggaagggcgggagcgtgcagccaatggcgaagccgaagctacggatgccggcgcgggtgatggcggagacctcgatctcgacgccgacgatgaaggtgtagtagacgaggccgagaagggccatggactcaaggacgaagaggctacggacggggaagacgaggttggagaagtgagggaggtggccaaggacggaggggccaaggaggaagccggcgaggatctgggagatgtaggtggggagacggagaggagagaggaggagggtggcggcgcgggtggtggaggtgatgaggaggatctggaagaggaggagaggtatggagaagtcgagcggattgtcgcccgtccagacgccacccatggtgatcttgctcgggtagaagcacatcaggtgcgtcttgtccatcgacatcgtgtggttccatagctcctccagtgggtccgtcactgtatgcgctgccattgatgaattccttgtttggtatcaactccggcaatgggtggcgttcttaggtaaggtgaggtgaggggaggaggagtgataagatacatcgtcgatctctcatttgatgggagggaagggaaagaggagtgtgctatttttggatttttgcatgcagaggtttagatgggttgcatgcctatcaaaggacaacaatgggaggtaaaaggcaccactaaaaatcaaagtgtttatgtggttgcttttaaaaaaataatcttaacgaaagataacctcacatagagaaaatggaggggaatcttttactccaatatctttttttttactaccacgttgcatattttgcttggcgatgtgtcttctttgtcttcaatatccccctcctcacaatgcaaaatatattttggtgattggctggggagtgcctaggcccctccaaaaaagattttatttggagctagtgtgctatattggtcaatctggtgtttccgtaatgatatagtttttaaccataagaaattgtttaacattatgcatgttatctttatgtgttttaattggttccacacttggtgtatgatgttttcacatgaacaatagaatactatgtgcattggtgctatacacttggaattggtagccaatgagcttttattctagtttggatggcgtagtacctaattttgtgctagaatctatgtgattttgaaaaacgttatttcatttgcgtcgaggaggaagggcgggagcgtgcagctgatagtgaagccaaagttgaagctgcggatgccgacgtggatgatggtggggacctcgatcttgaagccgacgatgaaggtgtagtacacgaggtcgagaaaggccatgactcgaggatgaagaggttgcggatggggaagacaaggttggacaagtgagggaggtggccgaggactgagtcggcaaggatctggaagatgtaggtggggaggcggagaggggagaaaaggagggtggtggtgcgggtggtgtaggtgatgaggagcatttggaagaggaggagagagggatggagaagtcgagtggatttctactgtgcaggggtccttttgcagg

SEQ ID NO: 68225 - DNA, 36780 bp, Oryza sativa
  unsure (1)..(36780): unsure at all n locations
cgcgtnntattgttgacgtcgtcagaggtacacnagttcatcacgggggtgcggcgggcgtggtggagaggcgggcggcaggcgtgatggcgcccgtgccaccccgctgtaacgcccccccgctgaccccgtgttgccgtgcccccccccctgtcatggcgaagtgcggtgaattggcgagggtggaggcggaggttgtctccgcccttccgctccgagcccctggcggccgccgacaccacgcccgagctcctagtcgtcgtcttcaacctggggccgtcattctctctctctcacccctctctctttggccatcgggaggtcggcgccgccaccgcgcccgagctcctcgtcgttgtcttcaacctagggctgtcggtctctctctctcaaccctctctctcgggccgttgggaggtcggcgcgcacggcaccgccacctcgcccgagctcctcgtcatcatcttcaacatggggccgtcggtctctctctctctcacccctctctctcgggccgtcgggaggtcggcgcgcacggcggtaggtcgacttggccgtggccaccgccatcgccgccaccgcgcccgagctcgcagtcgtcgtcttcaaccaccaacctcatccgcccctctttggaggccgccggtcagtatccgtcgcccttctccttgctcggctctgccgacggcaccagagagagagaacgagggagagagagagacgaccgccgtctccaatgtcctcagcgccgtccgccacccgtctcgccctccccaccgcgtccgccgcgcggggcgcccaccgcgccctcccaggggaggactcgttgcccgccgcttgaacgcgctgatgaagcctagaggggggtgaataggctgtccctgaaatcttaaaaacaaatcgcagcggtaaaattcaaacagacccggaacttcctggtaaggaactcccgaacttccggcctgccaggcccggaacttccggtgttctaagacaggaacttccgggtaacaaaacagagatgaaattcaaatttcgaaacaggagactaagccaatcttcacaagatggtgcacaggtattctaagcagaggatatatcacagaatcatacacagaaacatcacagaaagagacaagagcgattttttcccgaagttcggatcttgcgatcctactctccgttgaggagctccaaagagctgggtctcgattaacccctttcctcacttgtgcaaaaaccccaaaggaaatccacagccttcaaccccaaacacccccaggcaaatttctagaattgagtgaccaccaagatccaactcaacctacttctagaaatccaccacaagtgtgggttgctctacttggaaagcctctagaatctcagcacaagaacttcactaacttacctagttccctttcggaggagaggaaatccttcagaaactttcccgggacatccacaatacgcaacggattttcgcgggcgacacctaaccatctaggagatcatctccaagagtaataagcaccgagatgacagcccacgagatattccaagtgctcaccctagatcctagtcttcacacatctccaaatcttcttctctccctctcaatctctctttctcacaagaattaggctctagattgagtggagaaggcaagaaacacttgggagaggctagcaatagctctaggtttgaaaagtaaaagtggaatagacaaggaacgagctggagacgtcatctagccgttactcacaaatttgaactggaaactagacaggaagttccggacctggaagaccggaacttccggacctggaagacaggaagttccggacttgtatttttggatagatggagtatttgcaaaaatgattcctagggaaacttgacacttggctcgcactaagagcacttgacatatctctgagcatcacctggaacccctcttaatagtacgggttttcctaaaaactcgattgcaacaaataaactatcctatgcacttctcgagttccggtccgcttgattttatacttttgagggcgactccaagcatccatcttccacaccttggactaatgcagctgaaagtcactcaatgaactcattagtcccttaactacatttgtcattaatcaccaaaacccactagggggattaatacactttcaatctccccctttttgctgattgatgacaacatggttaaagcttacaaaagattgatataaattttgttttaaatagttagaggtgaataaaactcccccttagtgtatgcatatggaagatatgagtgaaactcatatgcatatctataagggagcaactgaggagagtttcgttcatctctacccattcgtgggatgcaaataagcagtaaaagtagacatgatgtgcaaaagatgacatggaaagcactcaaaaaggataaaatcaacatcacatcaaaaacaataaataagacacacatagcataaatgaaaagcagaaaaataaagggcagctaagagcatctaacagacattacattcacacaaatagagaattagaacttgtccatgagttcttaagaataggggccaaaggattgccaggtccggaacttccggataaaataccaggaacttccggacaagctgacatgacaataaggcgagggagctgccaggtccggaacttctggataagaggatccggaacttccggattaaacagacagcaggcagtaagcatcaaaaacaaaattttgacccccttcgattccaattttctccccctttggcatcaaggcaccaaaaagagataaaatcacaagggaagaagagggtcaagcctcatcattatcgccatcagaaggaatgatctcggtgtcgccggagtgaggagagttgatgtcttgcccggcggcgtccactgcctcatcgggatctgtaggaacattcacggtaggggcatctgactcctcaccatcactgctctcctcggagtgagaggactcctcattgaagaaacgagaagtgccagagggaccctcaccactagcaatgtctcgagcagtctcatatgcagcaaaaggatcaacaaactcctcatcatcagaaatatcatagacatccttgcctgctgcaatcctcgagtagtccccaaacaatccttgggagcatccttctcatacataaaggtagtgctggtcggtgacagagcatcctataatatggacgcaaccctcgagtagtccccaaacaatccttgggagcatccttctcatacataaaggtagtgctggtcggtgacagagcatcctctacaaagatatgtggatgactcaggtcatcatcatctaaccccaaagctgcagcaaattgtgccatagaaaccctatactgctgcccctgaatggtccacttcacaaaatcaagccccttcttggtggtgccaaagaatgcagtggagtagagctgtccaatcacttcctcattccaggaatactgcaaggccaacaaatctgccacgtgcttgcgctcacacaccttgcgtacctcattgaagactatgttgttctttgaggacatgtactgccagtctagccacttcatctctaccactggatgagatcttcccatgatcacagagttataccaattaacctgcaccaaggtcctgaatctgtcatcctgagagtctgctggcagagtatcaggactaaccattctgtcgtttccacacttgagtagattcttcagatagttcactcttgggcgtttaggatcaggatcaacagcccttgtcttgtacagcctaaaaggattgcttttagaaccaggctcatcctcattgccaccattatctgactcagatgcagctggagagggagagcggggtgcgtcacgaatgacaatgctaccagccctcctggaatggatcggaatctgactcccactataaaaatctccaactttttctttgcccaatctccccctaggaccacgaaccggggttctcgagtcagcaggaacatcttgagaaagcttctgtctcttctcacgaggcataatgaccactgcaacaagaatcaacaggttggagtgcaatggttaaatgaaacagtagcagaatcaaggttactggttggcgggacagagaccggaagttctgggccaagaacaccggaacttccggcctgcaaaactgaagaacagaggatttaaccaggccagtgcatgtgacaaaatcctatagatcggcaatctacaaggtagcaggaacaattctatccaaaaggttttctccctaggttcacatatttagagatcggggcaaaaacatgatgaaccaaaagagaagatcaaaagtgctaccttgagagggaaaatcgcaaatcgatcgcgggatgaacctcctagccaccaatgtggttgattccacggagaggaatcgaatttccacagttggaatagaaaatcgcccagaggagcactgtagcggcggctagggtttgggaatcggggaggagaagaagtgaggagagagagatcaagctcgggctccccctgggtatttatacccccgacccccggaagttccggattgggatgaccggaacttccggcctgacaaaacagagggcagtcaggcccatgttcaaaggaatagatgagaattcaatgatttagaaatgaaaacctatggacataaagagacttatgatgtatatgaccagccaacaatcaacattacataacaatggtcaatataaatcacaagaagggataaaaaccaaattttcgcaataaaaacacacacaaaaattttcgcaaaatttcacaaaagagtttttggataatagagggaatgtttgagctttattcctggtatcaaaaccatcttctacacaagaagtgatctcaagacacaaaagctctttttttttatttacattttagtgacacatgtttggctatgaattagccaatcacccatcacctaatgatacgagagtctaagatattgagctcacttctaagctcgcaaaatcttttctcatctaaaggcttggtaaaaatgtctcctttagtctcatgatctctcaagaagtggtggcgaatgtctatgtgcttggttcttgagtgttggagaattgttggctattttgatggcactctcattatcacataggagtgggatcttgttgaagttgtagccaaagtcttttagggtttgtctcatccaaaggagttgggcacaacaagaaccggcggctacatattcggcttcggcggtggataaggcagtggaattttgcttcttagaggaccaagaaacaagggaccttacacccggcataatccgaatcggaatagcccaaaagctcaaagccacaacccttagaataacacaagccatgattaggagtgtgaactaaatatcttagaattctcttgacgacaatcaaatgacactctttaggctccacttgaaagcgagcacacatgcaaacactaagcatgatatccggacgagatgcacataagtaaagcaaagatcctatcatggagcgatataccttttggtccacacatttaccattatcatcgaggtctaggtggccattagtaggcatgggtgtcttgataggtttggcatcctccatcccaaacttcttgagtatgtctttcacgtacttggtttgagagatgaaggtgccctcttgtgcttgcttcacttgaagcccgaggaagaaggtcaacttgcccatcatagacatctcgaaccttttagtcatgatactactaaattcttcacaaaaagaggcattagtagaaccaaatattatgtcatcgacataaatttggcatatgtataaatcactcttaaattttttagtgaagagagtagtatccgcctttccaatttcaaagccatttttcaaaagaaaatctcggagacattcataccaagctctaggggcttgtttgagcccgtagagtgccttgtggagcttgtacacatggtttggcaactttggatcctcgaaccccggtggatgctccacatagactaactccgagataggtccattgagaaaggcactcttgacatccatttggaataacctgaaatcatggtgagcggcataggctaaaagaattctaattgactgaaggcgagcgacaggtgcgaaggtttcacaaaaatcgagaccctcgacttgggtgaacccttgcgcaactaaccgggcttttttccttacaaccaccccatgttcatcttgcatgttgcgaaagatccacttggtgccgatgacatcttgcttgggtctctccaccaaagtccacacttgattgcgagtgaagttattcaactcgtcttgcatagccatcacccaatccggatcaccaagcgcatcttccaccctagttggttccaaagaagagacaaacgagaagtgttgacaaaaacatgcgacacgagagcgagtagttaccccttttcttatgtcgccaggtatgttgtcgacgggattatctctttggacagtatgatgtatccttggatggtgcactggggaggacctaagcctgatcagaatgctctaaaatgccctcagcatcgatcccatccacttgtgccgttggcacgtcttcactgccactggtccggaggttccggactgtagaacccggaacttacgggcctggagatgtccggaggttccggtcaataggacccggaacttccggctcagctgacacaacacttgtagggctattggatgtcgatgacggaggttgatccctatcttcttggtcatcctgcgtctcgactggtcgtatgtctccaatagccttagtacctatagcttgatttggatccacaacccctacaacatgtacaacaacttgctctccttgggagccattagattcatcaaacgtcacatccctagtgacttcaacaataccggaggttttgttgaagacacgataggcatgtgcatttgattcatagccaagtaagaatccctcatccaccttaggtgagaacttagatgagcgaggcctcttacttaaaataaaacatttgctcccaaagacacgaaaatacgaaacatcaggcttcttaccactaaagagctcatatgaggttttctttaggatcttgtggaggtacaagcggttaatagcatgacatgcggtactcacagcttccgcccaaaagacatccgaagtcttgtactcatcaagcattgcccttgcggcttcaatgagtggtcggttcttcctctcaacaatgccgttttggggaggatcatagggggcggagaactcgtgcttgattccttcttcatcaagaaattcctccacttgagtgttcttaaactctcctccattgtcacttcgcaccctcttgatagtgagatcatagaggttttgggcttgcttttcgaagcgcttgaagacatcttgagcttcgcttttgtcatggagaaagtacacccaagtgaagcatgaaaaatcatcaacaatgacgaaaccatacttgttacctccaatgcttatgtaggccacgggcccaaataaatccatatgaagaagctagagtggtcttgttgtagtcatgatgttttttataggatgtgaactcccaacttgcttcccggcttggcaagcactacacacacgatctttctcaaaagaaaaattatatagacaaagaatgtgttccccttttagaacagatgccaaattcctcattccaacatgggctagcctacggtgccatagccaacccatagaggatttagcaatcaagcatgcctccggattcactctattcacgtcgaaatcaacgagatagagatcaccctttaacacacccggaatgctatggaagagtcatctcgcctaaaaatggtcacatccacatcggtaaacaagcaattaaatcctaacttacacaattgagacacggataataaattgtagcttaatgaattgacaaggaggacattagatagagattgattcttggaaatgacaatcttaccgagacccattacctttcctttaccatcatctccaaagacaatattttcacgacttccaccctcctcatcaagacttataaacatactcctctctcccgtcatatgattggtgcagccactgtccacaacccaacttgagccaccggagaagtatgcctacaaaagagatcaagcttgggatttaggaacccaaacttgtgtaagtttaggtcccttgatgttagtcaccaaagcctttggcacccacacacaagtgcggtactcatcattgtaattcccaataaaataagcaaccactttgccctctgaatttttggaaattacatatgaatcatagaaaagaccctctggccggaacttcctagcattataaccggaacttccggccagccccttccccctattagaagcccagaacttcctgacaaaatgtccagaacttcctgtcttacaaggcaggaacttccggtcattttgcccggaacttccgggtgtctgaccagtgagggggcaagtccggaacttgcttgtggagcttttccttctgttacaaacatcaagcattcttccccatttaccatcacacgcttagacacagggcttccaccagaaaacccgagcccgtatcaatccttgttaggatgagcggagatggtcttgtaaagggcatcttttgaatggtatgtcttcatgcatccatacttcactaatgtgcccaacctttcattctctttcttatgagcttgcatagcatcaacattagtagcatgagagttcaaatcaatattgtaacacctagcacaaccattgctagtagatgggttggaagaattagaaaccacatttggttgagaagtgctattccaaagagtgtcaaattgaacatcaagatctttatgacttttgtctaaactagcaaacttctcttgaagagtttcattgacatccctaaggctagctagagaaccattagccaaattaagctcattagctagttgttcatttttagcacattctttagctaggctctcgtctaaggcaaggtttcttttcttctcaagaataagtaatttttcatgccttttgagagattgttctttactatccaaagctctcattaacttagccaaatgttgcatagcgggtttgctaaagctctctttgattgcctctttcccttgtcatcatccttcctccctttgccatagtcactcttgcgaagaaagtgcttgaatctcttgacaataaaagtcatttcttcatcttcactttcttcacaacttgactcttcttcttgttttgccttcaaagctacttcttgatttttgatcatggcggcattcttcaccatttgcctcacttcacgagcttcctcttcttgcatctcatgagacacaattcttccaagaatgtcacttggggtgagcctcttgaaatctttcctttcccgtatcattgatacaagagtgggatttcttggaccaaaagcacggagaagtctcttgaccacaaagtgatttgtcatgtcctcactcccaagtcctttaatcttgttaacaaggatcatcatcctatcatacatctcttgtggtgtctccttgtcatccatcacaaatcttccaagccttccttccaataattcaatcttggcctcacgaacggcgggtgatccctcatgagccattgcaaagtatcccatatctcctttgcctcctcaagcccattgtcacaccctgatttttgtttcaggatttataaattatttaataaattattattagaatttatattaaatgttctttaatttacaagtgaagttaaatgtgggaaataaaatttcctaaatataaagcatggatggatttaatttttattaaattctccatgattaagtcaactctctggaattttctcagatgtttcggagctcaattcttaatttttaatcatacaaagagcatttcagtaattacccacatattaaattaatcattaaatggtctaattataattttgttaagtactttgagtgtccaagtattttcaggatttttcttgaaattatttgagcattggaagtatttttaataattcaaagatcatttaagtgattattttaattgggaaagtaataaaatcctcctcctcagcttgggccattttcagcccattccttcctttccttcctctctcttccgccggcccaacctgagccgcctcctctcctctcagctcagccggaaaagtctactttccctccctgcgctactgttcatcttccaactcaggcagagcccgagccagccgtgccgtgcacagtgccgccgcctcttccttccaaatctcgcctccccgttgctctttttctccaattttgttgaggggaaatattcctcttatcctcctctatctttacccccaaaaatcggagcaaatcgttgagtatcttatccgaatcgaactcgttttcgagtttatctccaaaaccgagtttttgatttcccggatcgatttcttgcgggaggagtccgatctcttcaatccaaggctataaataggaccccctagtcctcctctttcgtttgccccctctcccgtggtctcccgtgcctcgtagcgccgccgccacatgctccaccccgccgtcgtcgccggccgagctccatccgcgtcgcgccgccgcctccgtcgtccccgccggtcgccgtcatcgccgtgaggtgcgccgaggtgtgggcaagctcggccgctatctccccgaagccgccgaccaccgcagccccgtcgccgccgtcgaccgaagccgcgccgccgctagacctcgtcgccggccgtcgtcgttcgtcgtttggttcgagggtgggtaccgttgggttcgtctcgtcgtcctctacgtgttcatgtcctccaaagtcgcagccgaccatccaatctccggcgaggtcgccatcttggtccggccattgatgacgtcatcatcgtttttctttttcctgttttttctaatagattaaatcttcagaaattcataactaaatcatcgtaactcggttttgagtggttcaagttgctaaattcatctaaaatcatgatctacatgtttgtttactttatatgtactttttatttggtttttattagtctttttcttcgttttgcgtgttagcttgtcgtttccgtcgttgcgaaggttcgtgagtgcgtcggaagtgatcaagaagattacttgaagaccgattattgcaaggcaagtcacacagatcctaaacacaatcctttgagcatgttgatcctatatttaaattctctatttatttcaactgtgcatttattttcgaatgtcatcgggtggtgtgaacttattcctttgttatggccaatttgcattgattactttattccttgataccttgggttattataacttgactagttgggctttatatattggttcagctagatattagttatgattgcttaaccatgcttagaaacattagcacactattgggataacttatgactcactattatttaaggatggcttaatgatagttcacgatggttaatcgtgattggttaattaattacttgccaactaaaacttgataatggtgggttgtgagcacatggttttgagagtcgtgctcatgacaattaaggaccggttcgcgagctactgttgtgaaacatttatcgtgccaaccacaagccagcgtgggcaacggctttatcttttgtgtagcgtgattcattatagtgcgccagactgagaagtggcgagaagtccacgggggtcgctggggagtccatgccttgtttataagggggtgattatgatccaggaaaggtgcgctgtaatgggttatgttgtgcaaggggtattgtcacaactcctttccgaggtaccgtggtggtactgaggcacatggtgacatgatgtggagttgtgtcttgtgggtacaatggtacacctctggccagagtaaaactattcgaatagccgtgcccgcggttatgggcgggttgagcaatgcttttcgtgattagtctcacacctctcacaataattatggatgttaatacctgataataatttgcttagctcctggtttggagttagatctgtacagccggatatggttgttcaggatggttgggcctgtgcagcatgggtgtgctgttcagtgttgattaaaatttttaattaattactctactgttttactactcttaactctttgctaaatgctgctttcgcaaatgagtctatattatgccatcctttggtatccttgtgcacttgcatatttgctgtgtggcttgttgagtatgtcatatgctcattcttgcaataatcatcaaacctcagttgaagataaaggatccagaaggagaagacgtttggcttataccccagttgagttgcctatgggagtggagctgaagccatcgctagaccgttaattccgttgctgttttcttttctttgtaagtatgtaacgttattattaagatggatttgtatattaaattgtcagtttgtgtacctcggctgattcctggacgaggattttatgcacaaattagttcggaaattactagtgaatttccgggcgtgacacccatcaaccttgttgaacacctccggacttaaggcggagagaattgcattggaagcttaagcattgcggtggatgagttgctcttgctccgaagtgagcttcatgtcatcatagggtacatcaacacctgtacaaacaactttccaaatacttggatgcaaagagattagatgcaacttcatcttgtgcttccaagcggcgtaatgcgtcccatcaaattgaggagcacgcccggaaggcacggagacaaagttgtgagagggaatagtaagtttgctgtaatcaaaaggtatagtagctcccttgggtgatggagtttccttgctgctcactccatcttcatttccattttccccgttctttcaccctaagtccgacatcgtggatcactcaaagcagtgaagcttgaatcaagagcaccttgctctgataccaattgaacgtgctgatgaagcctagaggggggtgaataggctgtccctgaaaccttaaaaacaaatcgcagcggtaaaattcaaacagacctggaacttcctggtaaggaactccgaaacttccggcctgccaggcccggaacttccggtgttctaagacaggaacttccgggtaacaaaacagagatgaaattcaaattttgaaacagtagactaagccaatcttcacaagatggtgcacaggtattctaagcagaggatatatcacagaatcatacacagaaacatcacagaaagagacaagagcaattttttcccgaagttcggatcttgcgatcctactctccgttgaggagctccaaagagctgggtctcgattaacccctttcctcacttgtgcaaaaaccccaaaggaaatccacagccttcaaccccaaacacccctaggcaaatttctagaattgagtgaccaccaagatccaactcaacctacttctagaaatccaccacaagtgtgggttgctctacttggaaagcctctagaatctcagcacaagaacttcactaacttacctagttccctttcggaggagaggaaatccttcagaaactttcccgggaaatccgcaatatgcaacggattctcgcgggcgacacctaaccatctaggagatcatctccaagagtaataagcaccgtgatgacaacccacgagataattccaagtgctcacccaagatcctagtcttcacacatctccaaatcttcttctctccctctcaatctctctttctcacaagaattaggctctagattgagtggagaaggcaagaaacacttgggaggggctagcaatagctctaggtttgaaaagtaaaagtggaatagacaaggaacgagctagaaacgagctgtatatgtataacggctaggtgacgtcatctagccgttactcacaaatttgaactggaaactagacaggaagttccggacctagaagaccggaacttccggactacacttaggaaaaactttttcacaagaccggaacttccggacctggaagacaggaagttccggacttgcatttttggacagatggagtatttgcaaaaatgactcctagggaaacttgacacttggctcacactaagagcacttgacatatctctgagcatcacctggaacccctcttaatagtatggtttttcctaaaaactcgattgcaataaataaactatcctatgcacttctcgagttctggtccgcttgattttatacttttgagggggtctccaagcatccatcttccacaccttggactaatgcagctgaaagtcactcaatgaactcattagtcccttaactacatttgtcattaatcaccaaaacccactagggagattaatgcactttcaccgtttgcctgagccgagagagagagagagggacgacgatgacgacgtaggccgcatcctccaatgccctcctcggcgccgcccgtcgctcgccgtgccattcctgcactctgccgtcgccccccgcatgccgaccgcctgtccacgcgccactgccgccgcccactacccgtcgacacacgcctgagagagagaagggggagggtgaagagagataatgacaggtgggccctatattttcttttatttttttgttgattgaatttccacatcagcgacacgtgtatgccacgtaggagaaaaaccgcttaggaatgattcgggggggggggtaattcttccggtatcaatagttcgaggtgtaatatgtctgtttttgtggttcgggggagggggtaattcatactgccacagtagtttgggggggataattcgtactttttccttccctataataccacggctaaggcgtttgttcaggaacaagggaaatgctagaatgatgcgatggcacgctgaagaacgtcaacaggacgggatgctgagacaccccgccgatggttcgcagtggcgaaacattgacagaaattttaaagactttggaaaggacgcacgaaacatacggtttggtttaagtacggatgacatgaatccttttggagagatgagcagcggccatagaacttggcccgttacgatgtgtatctacaacctccccccttggctatgtatgaagaggaagtacataatgatgtcgattattattcgaggccccaagcaacctggtaacgacatcgatgtgtacctaagaccactggtcgaagatcttaaactgttgtggaaaaaggaaggtgtccccgtgtgggacgaggacaaacaggaggagtttaacctacgagcgctgatgttcgtaaccatcaacgattggcctgcacttagcaacctttccgggcagtccatcaaggggtacaaggcttgcactcactgtatggatgaaacagaaagtacgtatcttaagcactgtaggaaggttgtgtacatgggtcatcgtcgattccttgctgcaaaccacccggtacggaagaaaggcaaacactttgaacataaggtggaccaccgtacgaagcctaaacatcgcagcgggaaaacagtgtttgctatggttaaagatcttaaagtagtgtttggaaaggggccacgacgcaacgccaccgccgcgacacgccaccgccgcgccgcaatgccgccaccgcgccacgccgcagccgcgccgccacgccgccgctccactgccgccacgtgaacgtaacatgaacttaacgagaacgaacgtgaacaaacgtacgtggacagacgtgaacgaacgaacgtacgtgaacgaaacgtgaacttaacgagaacgcgaacgtgaacgaaacgtgaacttaacgagaacgcgaacggtaacaaacgtgaacgaaatgcgaacgtgaatgaacatgaacgaacgtgaatgaaacgcgaacgaacgtgaacgaaacgcgaatgaaacgtgaacgaacgtgaatgaaacgtgaacgaaacgtttaacgaacgtgaacgaaacgttaacgaaagtgaacgaaacgtgaatgaaacgtgaacgaacgtgaatgaaacatgaacggtcgccttatatgacactacgtgaaatacaatatatgttactttgcgtttagactaatacatttttttgtatgttgcagaaaagacgtcgtcgttgtcgtccctcaagcctgagtggtagctagccctcgaaggaattcgcaggcaagtgatgtaaatatatgattgttagatttttaatataatatcctacaggtccggaacttcctgtctagtctccagttcaaatttgtgagtaacagctagatgacgtcacctagccgttatacatatacagctcgtttccagctcgttctttggccattccactttcacttttcaaacctagagctgttgctagactctcacaagtgtttcttgccttctccactcaatctagagcctaattcttgtgagaaagagagattgagagggagagaagaagatctggagaggagtgaagactaggatcttggatgagctcttgggatatctcaagggctgtcatctcggtgcttattactcttggagatgatctcctagacggttaggtgttgcccgcgagaatccgttgaatattgtggatgtcccgggtaagtttgtgaaggatctcctctcctctgaaagggaacgaggtaagtgaatgaagttcttgtgctgagattctagaggttttccaagtagagcaacctacaattgtggtggatttctagaagtaggttgagttggatcttggtggacactcaattctagaaatttgcctaggagtgtttggggttgaaggctgtggatttcctctggggtttttgcacaagtgaggcaaggggttaatcgagacccagctccttggagcccctcaacggagagtaggatcgcaagatccgagcttcgggaaaaaatcgctcttgtctctttctgtggatgattctgtgatctatcgtctgcttagaatacctgtgcaccatcttgtgaagattggcttagtctcctatttcgaaatttgaatttcatctctgttctgttacccggaagttcctgtcctagaataccggaagttctgggcctggcaggccggaagtttcggagttccttaccaggaagttcccggtctgcttgaattttacagctgcgattggtttttaagtatccagagacagcctattcacccccccctctaggcttcatcagcgcgttcaattggtatcagagcagggtgctcttgattcaagcttcaccgctttgagtgatccacgatgtcggacttagtggaaaaaaacggggaaaatggaaatcaagatggagcgagcagcaagggaacttcaccacccaagggagctactataccttttgattacaacaaacttaccattccctctcacaacttcgtctccgtgccttccgggcgtgctcctcgatttgatgggacacattacgccgcttggaagcacaagatgaagttgcatctaatctctttgcatccaagtatttggaaagttgtttgtacaggtattgatgtacctcatgatgacatggagctcacttcggagcaagagcaactcatccaccgcaatgctcaagcttccaatgcaattctctccgcgttgagtccggaggagttcaacaaggttgatggacttgaggaggccaaggagatatgggatactttgcaattagctcatgagggatcacccgccgttcgtgaggccaagattgaattattggaaggaagggttggaagatttgtgatggatgacaaggagacaccacaagagatgtatgataggatgatgatccttgtcaacaagattaaaggacttgggagtgaggacatgacaaatcactttgttgtcaagagacttctccgtgcatttggtccaagaaatccctctcttgtatcaatgatacgggaaaggaaagacttcaagaggctcactccaagtgacattcttggaagaattgtgtctcatgagatgcaagaagaggaagctcgtcaagtgagccaaatagtgaagaatgtcgccatgatcaaaaatcaagaagtagctttgaaggcaaaacaagaagaagagtcaagttgtgaagaaagtgaagatgaagaaatggcttttattgtcaagagattcaagcactttcttcgcaagaggggctatggcaaagggaggaaggatgatgacaagggaaagaggcaatcaaagagagcttgcttcaattgtggcgaatatggccacttcattaacgattgtcccaagtgaaatgaagctaaggctaagggatgcaagaagaagccgaagcgtgctcatgtggcggaggcacacatggcggaggtgtggtactccggagatgaagaagattccgaggtcaagcccaagcctaagccaaaagacaaggttgaaggagaaggtggtgttgctaccgtcgccttcaagtcatcctcttcaagcaaggagcgtctcttcaacaacttgagtgatgacgatgacgactcctaccactactcatgttccatggcccaacgccgcaaggtgatggctcaaaagcccctctcacacctctcttgatgttgattctagtgatgaggaaagtgataatgaattagatgatgtgcttaagagctttagcaaacccgctatgcaacatttggctaagttaatgagagctttggatagtaaagaacaatcactcgaaaggcaagaagaattgtttattcttgagaagaaaagaaacattgccttagaggagagcctagctaaagaatgtgctaaaaatgaacaactagctaatgagcttaatttggctaatggttctctagctagccttagggatgtcaatgaaactcttcaagagaaatttgctaatttagacaaaagtcataaagatcttgaagttcaatttgacactctttggaatagctcttctcaaccaaatgtgttttctaattcttctaagccatctactagcaatggttgtgctaggtgttacaacattgatttgaactctaatgctactaatgttgatgctatgtaagctcttaagaaagagaatgagaggttgggcactttggtgaaatatggatgcatgaagacataccattcaaaggatgccatttacaagaccatcactgctcatcctaacaaggatggacacgggctcgggttttctagtggaagtcctgtgtctaagcgtgtgatggtaaatggaaaagaatgcttgatgtttgtgagagaaggtaaagctccacaagaaagtgaggtgacttgccccttcactagtcagacacccagaagttccaagcaaaatgaccggaagttcctgccctgtaagacagaaagttacggaccttttgtcaggaagttccgggcttctgataggccaaaggggatgaccggaagttctgggtaaaataccaggaagttccggccagagggtctttactatgattcatatgtaatttcaaaaaattcagagggcaaagtggttgcttattttattgggaattacaatgatgagtaccgcacttgtgtgtgggtgccatagacaaacatcaagggacccaaacttagacaagtttgggttcctaaatcccaagcttgatttattttgtagacatactcctccggtggctcaagttgggttgtggacagtggctgcaccaatcatatgacaggagagaggagtatgtttacaagtcttgatgaggagggtggaagtcgtgaaaatattgtctttggagatgatggtaagggaaaggtaatgggtctcggtaagattgccatttccaagaatcaatctctatctaatgtcctccttgtcaattcattaagctacaatttattatccgtgtttcaattgtataagttaggatttaattgcttgtttaccgatgtggatgtgaccgtttttaggcgagatgactcttccgtagcattcaagggtgtgttaaagggtgatctctatctcgttgatttcgacatagatagagtgaatccagaggcatgcttgattgctaaatcctctatgggttggctatggcaccgtaggctagcccatgttggaatgaggaatttggcatctcttctaaaaggggaacacattcttggtttatctaatgtttcttttgagaaggatcgtgtgtgtagtgcttgccaagccgggaagcaagttgggagtccgcatcctataaaaaacatcatgactacaacaagaccactcgagcttcttcatatggacttatttgggccagtggcctacataagcattggaggtaacaagtatggttttatcattgttgatgatttttcacgcttcacttgggtgtactttctccatgacaaaagcgaagctcaagatgtcttcaagcgcttcgcaaagcaagcccaaaacctctatgatctcactatcaagagggtgcgaagtgacaatggaggagagtttaagaacactcaagtggaggaatttcttgatgaagaaggaatcaagcacgagttctccgccccctatgatcctccccaaaatggcattgttgaaaggaagaaccgaaccctcattgaagccgcaagggcaatgattgatgagtacaagatttcggatgtcttttgggcataagccgtgagtaccgcatgtcatgccatcaaccgcttgtaccaccacaagattctaaagaaaacttcatatgagcttttgagtggtaagaaacctaatgtttcatattttcatgtctttgggagcaaatgctttattttgagtaagaggcctcgctcatctcagttctcacctaaggtggatgagggattcttacttggctatgaatcaaatgcacatgcctatcgtgtcttcaacaaaacctccggtattgttgaagtcactagggatgtgacatttgatgaatctaatggcttccaaggagagcaagttgttgtacatgttgtaggtgatgtggatccaagtcaagctataggtactaaggctattggagacatacgaccagtcaagacgcaggatgactaagaagatagggatcaacctccgtcatcgacatccaatagccctacaagtgctatgtctgctgagccggaagtttcgggtcctattgaccggaacctccggacatctccaggcccggaagttccaggttctacagtccggaacctccggaccagtggcagtgaagacgtgccaacggtgcaagtggatgggatcgatgctgcgagcactttagagcatactgatcaggctcaggtcccccctgtgcaccatccaaggatacatcacactgtccaaagagatcatcccgtcgacaacatacttagtgacataaaaaaaggggtaactactcgctctcgtgtcgcaagtttttgtcaacacttctcgtttgtctctcttctttggaaccaaccagggtggaagatgcgcttggtgatccggattgggtgatggctatgcaagaggagttgaataacttcactcgcaatcaagtgtgaactttggtggagagacccaagcaaaatgtcatcggcaccaagtggatctttcgcaacaagcaagatgaacatggggtgattgtaaggaacaaagcccggttagttgcgcaagggttcacccaagtcgagggtctcgattttggtgaaaccttcgcacctgtcgctcgccttgagtcaattaggattcttttagcctataccgctcaccatgatttcaggttattccaaatggatgtcaagagtgcctttctcaatggacctatctcggagttagtctatgtggagcaaccaccggggttcgaggatccaaagttgccaaaccatgtgtacaagctccacaaggcgctctatgggctcaaacaagcccctagagcttggtatgaatgtctccgagattttattttgaaaaatgtttttgaaattggaaaggcggatactactctcttcactaaaaaatttaagagtgatttattcatatccaaatttttgtcgatgacataatatttggttctactaatgcctctttttgtgaagaatttagtagtatcatgactaaaaggttcgagatgtctatgatgggcgagttgaccttcttcctcgggctacaagtgaagcaagcactagagggcaccttcatctctcaaaccaagtacgtgaaagacatactcaagaagtttgggatggaggatgccaaacctatcaagacgcccatgcctactaatggacacctagacctcgaccataatggtaaatgtgtagaccaaaaggtatatcgctccatgagaggatctttgctttacttatgtgcatctcgtcccgatatcatgcttagtgtttgcatgtgtgcctgttttcaagcggagcctaaagagtgtcatttgattgccgtcaagagaattctaagatatttagttcatactcctaatctttgcttgtggtatcctaagggttgtggctttgagcttttgggctattctgattcggattatgccaagtgtaaggttgatagaaaaagcacaactgggacttgccaatttcttgggcggtcccttgttttttggtcctccaagaagcaaaattcctttggataacaaactctaaaagacttttgctacaacttcaccaagatcccactcctatgtgacaatgagagtgccatcaacatagccaataatcccgttcaacactcaagaaccaagcacatagatattcgccaccacttcttgagagatcatgagactaaaggagacatttgccttacccatgtgagaaccgaaacccaattaaccgacatttttaccaagcctttagatgagaaaagattttgcgagcttaggagtgagctcaatatcttagactctcgtaacattaggtgatgggtggttggctaattcatagccaaacatgtatcactaaaatgtaaattaaaaaaaaagagcttttgtgtcttgagatcacttcttgtgtagaagatggccttgatactaggaataaagctcaaacattccctctcttatccaaaaatccttttgtgaaaatttgcgaaaatttcttgtgtgtgtttttattgcgaaaatttggtttttatcctcttcttgtgatgtatattgaccattgttatgtaatgttgattgttggctggtcatatgcatcataagtctctttatgtccataggtttctttttctaaatcgttgaattctcatctattcctttgaacttgggcctgactgccctttgttctgtcaggccggaagttccggtcatcccagtccggaacttccgggggtcggggatataaatacccagggagacccgagtctgttctctctctccttacttcttctcctccccgattcccaaaccctagctgccgctacagtgctcctctcggcgaatttctcttccaaccgtggaaatttgattcctctccgtggaatcaaccacattggtggctagaaggttcatcccgcgatcgatttgcaatttcctctctcaaggtagcacttttgatcttctcttttggttcatcatgtttttgccccgatctctaaatatgtgaacctagggagaaaaccttttggatagaatttttcctgctaccttgtagattgccgatctataggattttgtcacatgcacaggcctgtttgaatccactgttcttcagttttgcaggccggaagttccggtgttcttggcccggaacttctggtctctgtccagctagccagcaaaccttgattcctctatttttccttttaaccattgcactccaaccttgttgattcttgttgcaatggtcagcatgcctcgtgagaagagacagaagctttctcaggatgttccagctgactcgagtcccccggttcgtggtcttagggggagattgggcaaagaaaaaattggagatttttatagtgggtgtcagattccgatccattctaggagggctggtagcattgtcattcgtgaggcaccccgctctccctctctagctgcatctgagtcagataatggtggcaattagaatgagcctggttttgagagcaatcctttgaggttttacaagtcaagggctgttgatcctgatcctagacacccaagagtgaactatctgaagaatctgctcaagtgtggaaaggacagaatggtgagtcctgatactttgcctactaactctcaggatgacagattcaggaccttggtgcaggttgactggtataattctgtgatcatgggaagatctcatccagttgtagatatgaagtggctagactggcaatacatgtcctcaaagaacaacttagttttcaatgaggtgcgcaaggtgtgtgagcgcaagcacatggcagatttgttggccttgcagtattcctggaatgaggaagtgattggatagttctactccactactttctttggcaccaccaagaaggggcttaattttgtgaagtggaccattcaggggcagcagtatagggtctctgtggcatagtttgctgcagctttggggttagatgatgatgacttgagtcgtccacatatctttgtagaggatgctctgtcaccgaccagcactactttcttgtatgagaaggatgcttccaaggattgtttggggactacttgtgggttgcgtccatactatagagtgttgtactctatcttcaggtggtctttgctccccaaagtgggagatgctacagcccttccaggtaggcatgtgctcctcctcagtcgcatgcgctacaacaagccagatttcagcatcatgaagcttatctggagtgagatctatgagatagtgtgtgagccaaagaggggctgcatctatgctccttatataatgaagatgatagaggaaaagactgggatttgttatttcatggaaaatcaacacaagcatttccgtccttatgctcccactacttcagctactccttcttccagggtgactcgtgcttccacctcagctgctccttcttcctctgctgcaccttagcgttctgagtcttcttctcccataaagatggctctccgggctatcttttgtatgtctgctaagactgctaagaaggtaaagaagatagagaggcgtcagaaggaagattggattgcagcaggcaaggatgtctctgatatttctgatgattaggagtttgttgatccttttgctgcttatgagactgctcgagtcattgttagtggtgagggtccttctggcacttctcatttctttaatgaggagtcctctcactccgaggagagcagcgatgatgaggagtcggatgcccctactgagaatgttcctacagatcccaatgaggcagtggacgccgccgggcaagacatcgactctcctcactccggcgacaccgagatcattccttctgatggcgatgatgaggcttgatcatcttcttcccttgtgattttgtctctttttggtgccttgatgccaaagggggagaaaattgcaatcgaagggggtcaaaattttgtttttgctgcttgctgcctgctctgtctgtttatccggatgttccggatcctcttatccggaagttccggacctggcagctcccttgctatttttgcctgtcagcttgtccggaagttccgggtattttatccagaagtttcggacctggtagttctttggcctctactcgtttggacttatggacatgtaataattctctatttgtgtggatgtaataactgttagatgctcttagctgctctttatatttattgcattttatttatgctttgagtgtcttatttgttgtttgtgatgtgatgttgattttatcctcttgagtgctcattatgtcatatcatttgcatatcatatctattcttctgcttatttgcatcccatgtaataattctctatttgagcctcattcatatcttccatatgcatacacaaaggggagtttcattcatctctaaccattcaaaatcaaaattctgatcaatctttttgtaagctttaaccatgttgcaatcaatcacaaaaaagggggagattgaaagtgcattaatccccctagtgggttttggtgattaatgacaaatgtggttaagggactaatgagtttattgagcaactttcaggtgcattagtccaaggtgtggaagatggatgcttggagacccccccaaaagtataagatcaaagcggaccggaactcaagaagtgcataggatagtttatttattgcaatcgagtttttaggaaaaaaccatactattaagaggggttccaggtgatgctctgagatatctcaagtgctcttagtgtgaaccaagtttcaaatttccctaggagtcatatttgcaaatactccatctgtccagaactgcaagtccggaacttcctctcgtctaggtccggaaattccggtcttgtgaataagattttcctaagtatagtccggaagttcctgtcctacaggtccggaacttcctatctagtctccagttcaaatttgtgagcaacggctagatgacgtcacctagccgttatacatatacagctcatttccagctcattctttggccattccactttcacttttcaaacctagagctgttgctagcctctcccaagtgtttcttgccttctccactcaatctagagcctaattcttgtgagaaagagagattgagagggagagaagaagatctggaaaggtgtgaagactaggatcttggatgagctcttgggatatctcaagagctgtcatctcggtgcttattactcttggagatgatctcctagacggttaggtgttgcccgcgagaatccgttgaatattgtggatgtcccgggtaagtttgtgaaggatctcctctcctctgaaagggaacgaggtaagtgaatgaagttcttgtgctgagattctagaggttttccaagtagagcaacctacaattgtggtggatttctagaagtaggttgagttggatcttggtggacactcaattctagaaatttgcctaggagtgtttggggttgaaggctgtggatttcctctggggtttttgcacaagtgaggcaaggggttaatcgagacccagctccttggagcccctcaacggagagtaggatcgcaagatccgagcttcgggaaaaaatcgctcttgtctctttctgtggatgattctgtgatctatcgtctgcttagaatacctgtgcaccatcttgtgaagattggcttagtctcctatttcgaaatttgaatttcatctctgttctgttacccggaagttcctgtcctagaataccggaagttctgggcctggcaggccggaagtttcggagttccttaccaggaagttccgggtctgcttgaattttaccgctgcgatttgtttttcagtttctagggacagcctattcaccccccctctaggcttcatcagcgcgttcaggtcccaggatccccaaccgtacattcctcctacaatggtcagccctttaggcaatcgtagcagttgcgcctcaacggggcaggtaggatcacagagcatagacgccatgcaaacccaggatgaaaccacctgccccgttgatgacatgactcagcggacaccatgtgagctgcatattcccttcaagaacttatcaataaaggtaagctcatagtttttagattttagacttgtccattccgcaagttgctgcttatatatgttgattactaataaataacctctcacaacgtgaaggtggcgtcgggcatggccatcccaacggacccttcagggacttaccactacaggccgattccagcaggatactccaaggtcaaagttgagtttgtggaagccacgtacgaggacctcgacttggactacgctggaggagacggtgagacgcatctacgagacacaagccatgccattatactatggcgcaagtagtacaccatcctccttgggcaacaagcggcgtctcgtgcaccatctcctccggctccgccatctcctcctcaggctcctacaccgtctcctcctcatgctccagcaccgtctccacctcaggcttctgcaccgactcctcctcaggctcctacaccgactcctccgcaagctcctcgtccggcattttccaagtcaagggcaacgaagggcaacgaagaaggcgaaagttgacaccgccaaaaacaaggacccagggtacgattgcacgcaagaggagcttgacgcttatgtggcatcaaaagtcagcagacaattgaagcctcgaagtctagaaaagaagattcctatagactcaagtgtcaggaacttcttcaggggtatgtctgcacttgccaaggaggccataaagctatcggactatgagcgagcacttaataaagcatcttctggaaactccaaaccagtcccttagcttggagagcaaccaaaccaggagatcgaaccgttggtgaccggtgaagaatttggaatacaagattttattaatgacaccgggctaactagggatcaattgctacgaggcgcaccaatcaaaaaggcggaagtgaaatacatgtacgaacccggtaaaccgcttgtcaagcctgagcaactgcagtccctaccgacacaaatgtacaaattccatcaactgtacatggagatgagcaccaccggtagagagataatcggagcgaggatcagggacacggacttcttgcaaggagaagatattctctgaatcaatttcaagggtatctacgaactataccagctggacgccctcgacgtctctattatgagttgttagactttgtaagtatcgttcagttagatttcttattacatttcctttaattaattaggtccttatatataagtacacaatatataatatatactaccttttatctttgtagaatggagattcaaacagcccgacggcggggggttttcgatactggattcatcgaccctcgtaaagtaaacgtcgaaatgatcaccaagtatccgcaagccacagaggacaatctcgtccatctcctgaaggcgcagcattacaagacattcatactattgtcgtacaacatagagtaagtttttactatcttcctaccaaatttcattcccgtacgaacatgctaagtgtttcatatgtaatacatccgacgcacattgcagattccactgggtccttttactcttcgacttggaggcctgcgtagtcaacgtatatgactcaatggataaaaaagagtctacgtttgaccaggtttttgaacttatagacaggtactgtcataagttccaatgttaattacgaatcttgttataattaattgctactacgaatcatagctttaaactccatgtagggcttggtatcggttccgtcatttggtccgcggcaactgaagaccaagacttaggcggaagtttaaatttcatgtgagtacaaatgctctacatttatattgaatctccaattcaaatacaagtgtatatatattaattagatctctcgctgtttgtcatgtatatatagtgcgcaaagcaagcccagggaactaacttgtgcagctacttcgtgtgcgagtattgccactgccttgcaaaccaaatcatcaacacaacagagcttgatgtacgtacaaataaattgaaaatttcattgcgtacgtatcgatttgttgttcactaattaatttcatacattcataggttattcgcatgtgggataacctcacacacaaggaatttatcacggcggttcaagaacaactcatgggattcatcaacgaacaaatccttgatcccgagggtgaattctactgcgacggaaatacaattcataggtcgtttctgagataacgactactactacatcgaagtctgtcacgccctaaaaatcgcctaaattaaaaatgcatattttaaatcatttttagaaattattttaaaagcctacaagttaaactctaataatctaggaaaaatttcaacataaaattgagctagataaaattttattaaatactttgcttgttcctctattttctagatttttctgggaattatttgagcaagggaagtatttttaataaatgaaacaacatttcacgaattattaccaacattccccctccccgcgcgctccaaagccggcccacgccggcccaacccgccccgccgccgcccccgagcccgagccgccgccatgctccatcaaatccgccccaatccgtccccctcgagtccgattgattgaggagttttgatcccctcatcctcctctatctttaccccaaaaaatcggagcaaaccgttgagtattctaaccgaatcgaattcattttcgaatttatccccaaaaccgaatttcgattttcttggatcgatttcttgcggtgggaatccgatctcttcaatccaaggctataaatagcaccctagttgtcctcttttgtttgccccctttcccgagctctctagtgcgccgtagagtcgccgccgcgtcgctttagccaccggcgtcgccggccaaccaccagccgcgccgcgccgtcgccctagccgttgccgctgccacctctcgccgccgtcgggtgcgcgtgaccgagggctagcccggccgccccctccccgtcgtcgccggccaccggaggaccgccgccactgtagtccgagtcgccgccgccgcccctctcgtcgccggccgtcgtcggtcgccgttcgtcgtttcggtgagcaccattgggttcgtaccgttgccctctacgtgtaggtgtcctccaaaaccccggccgatcatcctagctccggcgaggccgccgtccgagccaagccgctattgatgacgtcatgctgacgtcataatcctttctttttcagttttttaatagatgaaatagattaaaacttcggaaaatcataaataattcatcgtagctccgattcgagtggttcaagttgataattttttctaaaatcgagatctacatgttaaaaatatcgacatgtactgtttatgcttgtttttgtactgttttgttgatttttggttatttgctttagtttccgacgttccggaggagagcgtttcagttgaggaaggttcggaggtttttgtggaagcccaaggcaggcaagtcacacagatcctaaacagccctttgagcatgttgaacccgtttaaagctattgttttatttcaacctatgtattattttcaaatgtcatcgggtggtgaaccttttccaattaattaatggccgaagatgactttattttcgtatgggttataatttgattagcatgaaccttatatattggattggttcagctaaatgccatatgtatgtttgcttagtcatgcttagaaacattagctaattaaagaggaataaatataaattatattatattattattattaattatggttaaatttaatggtagctcacgatggttaatcgtgttactgttatgaaacatttatcgtgccaaccacaagccagcatgggcaacggctttatcttttgtatagcatgattcattatagtgtgccagactgtgaagtagcgagaagtccgtgggggtcgctggggagtccattgcctctggttttgacggggagattatgatccaggaacggtgcaccatggtgagttgtgttgtgcaaggggtattgtcacaattcctttccaaggtaccgtggtggtactgaggctcatggtgacatgttgtgggattgtgtcttgtgggtacagtggtacacctctgatcagagtaaaactattcgaatagccatgcccgcgattatgggtgagttgagcaatgtttttcgtgattagtctcacattattcattaatggtaattgtgataattaatttgactcctggtttggaatggtatattcctggtatggaggtttgatttgtacaaccagggttggttgttcaaatgaggtagggcctatgcaacacgggtgtgttgtatagtgtttatttaatactgattaattattcaactgttttactattctcttaaatatttattaaatgatgtttatgcaaataagctatattatgccatcctttgttatcctgtgcacttgcatatttgctgtgtggcttgttgagtatgtcatatgctcattcttgcaatattcattcatcagaggaggagtacttcagtgaagctgatgatctggaggattaggcttgttccgggttgagatgcctatggagtggagtcgccatagctgttctgtagtttgttttagtttatttttttccgctgcgtagaatgttattctttgagaggaactatccacctctgtaataatttattatttgcgaatgttaaataggcatttatttgtactctattatcaatttgttattgtgtgcctcggctgattcctggacgagggtttaacactcatgtaagcgtttggaattttggatagaaattccgggcgtgacaaagtcgtagctagctaggacatcataatgaattgtaattaatacatgtctatttttctatatgcatgtacacatttactttagtgtaaatatatattttggtcatatatatatgcacataaaatgttaagtgctttaatatatatatatacatatgcatttgcataacatatatgtataaatacatatatattatgcatgtatatgtattgaaacatatataaatataatatatatatatatatatatatataaaccatgctgcaatatggccatgcaaataataaaaaggtcagctcgatctttggtcccggttggtaacactaaccgggatggtggttggtgttactaaccaggactaaagatcgatctttagtcccagttatttcacccgggactaaagatagagatcgtctcggattggtaaccgggactaaaggggggttatgaaccgggactacaaacggtttcttcaccagtgattgcaattaccagaccgagatataatgtcagatgcactagcagacctggctattgagcttgatctccctgccaaatccgacataatggtcatcattaacaagatgttgctaccatccactggtctgtatatcaggcccaaggacgcatggattggatctgatcttcaaaaggtagcaaggatcaattggtcgaaggctgtttttgatgccctccgcgacaacgttattctacggcacaagaacaaaacaggcccaaggcagcagacatatatacaccgccgcattacattccttgtggtaagcatcccttatttacccaaccattccatttccaatgcagctttaattttctaatgttattgtcacccttctctatacagctgttgtacatcaataacctcaaggtgccaaaggattcattgacagttgatcactgccaaactcctcgcatacagctctacaccaagcagcttgtggaggatatttcgcaggaggatcgtgtcaccgattcatctggaaactatgtgtttggcaacctccctgtgagccctatgtcaatattgcattatatttatctgtttgcaatatagggaagagcctgtcatctatctgaactgaaatgcactgcttttttattgcagatgaatggtattcttggtttatgctatagccaccctgactatgacaaggaaaaagaaccacgtggggacaattccggcactccctttgctgacgagttggtttcgacggtagaaatttctttccccagcatgtttgacagtgtaggtccccatttaagtggtctccaagatgagcacaagcagcgtgtactggatgctcttggtgaatatgatcaccagtcaaagttaagtgcagatgctattgccaaacaaattaggctggttcagacatgccatgcgcgtgtcagcgaccatatcatcagcatcatcaggggtgaaagccgcactcaaccaccaccggatccacaaccacaaccagcctcacattcacaaccagacaaccaacacggcccagttgcatcgcaaaccagtgaggaagcacaagaccaccacactcacagcaccccggacatttcgcctaccaactccccagcacttcagccttccaggatcataacaccagatgctgcgttgaatgcgacaccacagatcacatccactgaaccacaccctcatttaccaggggagctgtttccgaccatggacaagactgccactggagatgaaactcaagcccacactcctcagccagatgcggattttcaacgtggcggcgatgttggtattccactgcaaggaactaattttaataccccttctttacacacacaacgagctgtgcacaaactcactgtatttatttttcggtcctactcttacctgttatagttttatttgtgtaaacattagtcagcatcctcaatcattcgcaaggtgtaatgccttcgctcgctgttatgcaatgttcttctagtaattcatttggtggcccctcaattattattctttatacaacatttaccttcagtacaaaacattattgccacacactttaatatttctgtaacaacaatatctgttgccaataggaagacctgtgctaataacaatgattacaactgacatctacatttatccgttgccccaggaattattgctattaccatgactttcgagggcacatacacaacccaatcccatactgcagatggtattgaacggcaccacgatctgccagatgcggatgttgaacatggcattgagaccgacatctccatgcaaggttgtctgcgtttccagtttttctttcccactgcataactttcgcaaccatgtggcactatactcattttttttgcaaagtatagtcataatcatatccagcgttgctatatttctgttttctatgcatacctcccatctaattagcaattatcttactaactgatacacttgtgatgtgagcaatgcaattactaccatggattcttttgccaaactacaaaattgcctcatagtaatacccttactacctgcacaatactcacactgaacctctatagccctacctgcagtaccatccaattttagcaacccatttactacaagctcattacatttatcttgtatatcagtttcccgtatatatgaacattaatcaaagtccttactaataatttcatcaatgtacttagctttgtctacttagtaaaatttcctttaaatgtattagtgacacctttacccctactctatcgctgcaaccatgtgcaataacgtttaccaataggattacttacttgtgccataccacaggaaatactgcaattgacgtgactaccgagggcacaaacacagccaaatcgcactctggatatcaaattgatgggcaccaccatcatccagatgcggatgttgaacacagcagcgatattgacatccccacgcaaggttttctgctcatccagttcatttgctttacactattgtcacgaccggaaataacccaacgggcgttccttacgtgcgtgcattaatccttgtcccaggaggcaaggtacaccaaaagttgatacaattcagagtttaacaagcggaagcgtaaatagctaatttattacatgggcagcgaaggcccagcacacacaaagacaaacgagaaacaacggaagactagggcgacgaccacaggcacttgacggcaggcacgagctagacaccaaagccttcatcctccaggaactcctcttctgggtttgggaaaaattgagcaagactgagtacaaccaccgtactcaacaagacacacccacaagtgcagaataaatgcaagggagtacaaaggagttatactataaagggttagggttgcagtaaacagcatttaaagacattagttgctcaaagctattttgtaagacattagattctagaactatacaattattaatcaaggccgtgaacccacacgaacctgccttaacccaagggctacgatgattcagaccgaactggcaacccgaccctgggtcccagctcgtcccaagccaacccaagccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacagacgaaagacgtgacatagtttccaacccatcctagccatagacaagagtaccgacccaatcccacctacggccggaacccccgggacaggcaggcaggactgaacccctagcagcaggacaccggccctgtgccatgacatctcgactaccgggccgcagctcgtgtagccttcatttgtcctagagatgtccatcgacccccgacttcttccatctccatccgtgtacttttgtttataactagactgagccacaaactaagccttacccactagacatgtggaagtacggtagtgctttgcaacagaggcccgaagaccggtccttatatggccgaggtgctactatcaaaaccatgcacctcgagcccagcctaaaaccattttggggattttgaatagaaggagcggtgtgaagccaattt

SEQ ID NO: 68226 - DNA, 714 bp, Oryza sativa
agaaccccagagtccgcacatcctcaaatacaaagcacttccctagttagatgtaggttagacttcccgttcgagaaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgct

SEQ ID NO: 68227 - DNA, 553 bp, Oryza sativa
  unsure (1)..(553): unsure at all n locations
tgttcatgtcttgcacataatccatacctcacgtataagatgggagaaaaattgtgggttagtatgcttgcatatgtggatataccattccctgaatatatggttatgaacttatggttccttaatgttgaaaaaaatgtttctcaagcttgtgatgactttgttaattaaggtttaaagagttgagggatgaataatgtccagttttgaagtttagggacgaattttaggctttgatagagttcagggacttaaaataataaaatgtacttttctcttagttaaatgacaaacaacttcctgtttgttgcagctgcaattcaatgtctaaagaaaaagaagttgtatgaaacacagattgagcagctagcaaacttccaattacgggttcatgatcaggtgatgaaagatatgtgcgcatattaatcttgaattttgaannnnnnnnnnnnnnnnnnnngttgaaatgaattgacaggaagtagtctgttttggtatgctagataataatgcttgagagtgcaaaggcaaccacagatactgttgatgcttt

SEQ ID NO: 68228 - DNA, 563 bp, Oryza sativa
tagacctttttagtatcagagtgagctgcgtgctcgagacatacgaatgaccaaacgtatctaaaaaaaataaacggtgtcatatattaaaaaacaaagagagtacagaaagggcaatagtcagtagtaaatgatcttgaaacttgaaagccagaaatgtaaactgctaataaaacaatgttcttatattcagctcccattaagcgacttgctcatacaaaggggaaaacaaaattatccaatggtctaagacaacagaagagtaggtcttgcacactttgtaaaatagaatgctaaattctatcaaagaaggccaacatataacttactaatgaagatgtccaatatgcaaaattagacaaatcagatgcagaaacgcagggaccagaccattgacagctatggaggaggcaaaagtatcatatcatccatgatcttatcagtttcactgtcggaaagcccataataacatgtactagcgaacgatagtgatgtttcttcttttagaaatagaaagaacatactacttcgagaatatcactatattagaaattgaataatat

SEQ ID NO: 68229 - DNA, 11420 bp, Oryza sativa
cctatacttgataatgatcccatctcattaaagaagcaatgaagagtgaacattcatctgaatggctaaaagctatgaaagatgaaatgaaatccatgagtacaaataaggtctgggacttagtagaaattcccgaaggagccaaaacagttggctgcaaatgggtctataagactaaacgtgaccccaagggaaatatcgaaaggttcaaatcaaggcttgtagcaaaaggatttacgcaaagagaagggattgattataatgaaacattttctccagtgtctactaaggattcattcagaattattatggcactagttgctcattatgatttggaattacaccaaatggatgttaagacggcattcctaaacggtgatctgtatgaagatgtatacatggcacaaccataaggttttgttatgaaaggaaaagaacatatgggatgtcatctaaagaaatcgatttatggactaaagcaagcatcaaggcagtggtatctaaagtttgaccaaatcataagacaatttggttttaaagaaaataaaaaggatgactgtatatacactaagtttaaggagagtaagttcatcttcctaatattatatgttgatgacatactcttagccagtaatgacaaaaatatgctactggaaacaaagaaatttctggcctctaagtttgaaatgaaagatctcggtgaagccacttatgtgttgggtatagagatttaccgagacagatcaaatggtgttttagggttatctcagaaagcatatatagaaaaggtactgaagaaatataatatgcataattgttcagcctcgcctgctcctataatgaagggggataagtatggaaaattccaatgtcctaagaatgagtatgaagctgcgctgatgaagtcaataccatatgcttcagctgtcggaagcataatgtatgcacaagtgtgcactcgccctgatttagcttttgttaccgggatgcttggcagatatcaatctaatccaggtctagaacactgcaaattagataagaagaccgtgcgttatcttcagcactaaagacctcatgctcacatatagagagtatgaaaaccttgcagttgttggttattcggactctgatcttgcagggtgtgtcgatgataagaaatccacgtcaggttatatattcacccttgcaaggggagctgtatcgtggaaaagctccaaacaaagagttactacatcgtcgacaatgcaggctgagtatgtggcatgttatgaagctactggacaggcaatatggctgaaaaactttatcccgggataacaaaccactcaaattatactgtgataacaaaccactcaaattatactgtgataacaaaccactcaaattatagtggttgacagtatatcaaaaccactcaaattatactgtgataacaaaccaacagtatactattcgagtacaacaaatcaagtgcttctgccaagtacattgatatcaagtaccatgttgtgaaagaaatgatccaggatcagacaataagcgttgagtatatgaacactaagttaatgttagcggatccacttacaaaaggcctaccacccgctgtatttaaagaacatgttgccggcatgggtttggtagaaaaaccttcgatcctggaataagaaggaacctatatggcactgactccccataaaactaaggcggactcattttgtaattaaataggaaccatagtcacttggttcagtggtgcttaattggctactgtaatctagtgtcttgatgtactgttttgttgaaaagtgagtccataagtttgtataagcctaatgtaataagttcaaagagctcgtaagattaaagaagtttattttaaaatataatggtatgctatagtcactggattctttgatgctttatattggtcactgtaatccttttgtcttggtatactattttattgagagatggacttataagtttagcctcacgatcaagggggagaatgttagtgtgaacacaaaatatgatcttgcggctaaacctaaagtcggcaaagagatattttgtttagggcgatcgctacagtgatcgatctctcatgaacatccctgatcgggggataaccgccataccctagtgtcggtttcccctgtgtgcagtggctataaatagagatcaatacctaagtgttaaaccttaagagatttctctcgctacccgatcaagcaacccactgaaacacagggaagaaccaagacacgattctctctgtgcttccaaactagaagagaagaaagaagaacaaagacagagagatgggaactccaggagatcaaggtatgatccaatcccatttcaatttgtagttccactttgtgccaaaccgacccaaagcaatccaacaattatataatgtattatgtgttttatttatttatatattattagatactaaatatcaaatacatattattttgacaccgtgtcattgtcctttatctcccactttttagacttcgttcgatcaagctcattgtgtgagcttccagggcacgcaaaatggtgtaagtcattagcacaggattaattgagtattaaattaaaaatgataataaatttattttatttgtaaaaaacttttatataaaaaaatttgcaatacatgcaccacgtaatataccatttagtagttcgggaaacatgctcgacataaataagggagtagccaatccgataaacgccttagaacatagccttaaatgtattatttaggtcctaaaaaattaataaataatacacaatatatttgtatacttggtcaaccatagcctaaaatatcaaacttatgtcctcactgatccccatatatgtaagttctatatataagccactatccactaattgctaaataatattatttacgaggtattcatgcacaatgcacctaaaaattagctgatatctaattagcacgtgtgtcatccagcaccgaaaataaatggtgatactaagtgcacaaccatcaacaaactatagagtaagtagacgatgcaaacaatatttgactacaagtagattacaactatgagtaataccattcctacacttctataaacgctcctaagatatcacatgatactctaataagttagaaagaatctatgaaagttatataaaaaagtaaacatctatccataaatttacacttaaatcgatgatccattactttcaaccattaaattaaattagatatattaaagtaatccctctgtcttaaaaaccatataatatgtctctacatacgtacacaactcctatataattacgtacacaagagatataaaaagaaaaaaaaaaggaagagtgtgtgtatgtgattcgtcctatctggtagttttctctttctttccagctctaagattttcccaaattgaggatatataaacatagcaaccgctcctagcgaggtggtaaaacaagccatgccgcggcgctgcctcacgccacccattgcttcactcccatctcgtcatttttctttaaagtatttttttactaataatgtaaaagtcaatcatatgagctcatataaatatgtgcagatgcacactatgaatacatatacatgcaccatatccctatattagaaaaatattcattcagaaaaaggaaaaacaaacgtatgtacaagagactaatattcgctagaaaaaaaaacaacatataactacattatatctatttttatgtcatcctcatccaaataattttaacaaattagctcaaattccaacgcatattaacccccgtgtacatgcataggtgaattagatgtataatataagaaaaaaaatcaaaacttatattaacttgtaagttagcataggataactgcgtgagcaaatattttttacgtggtcctcatcactggagctattagatagtcgaatgatcaaccctgcttttttaaaaaaaatatctatactactgaaatttagtactattgattaaatgcttaaacaaattatgtctaccctatacaataaatcaactctaagacacataaagactttcttatcacctccatcttgtttcacttcttccataaaagatgccaagtatgaatctcaactggctacattatagtaattatataggagtatacattattcggttaaggtgatccgagtaagatgctaccgttgataataatgcttaactggcctgctacttaccgataaaattatgttaccattgagaagcacgattatatcaatgcgggacccatgaatcaaggcattagagctaaatccttagcggctatagtcggattcatccgatcgtcagaggagcattcatattcatatataagtttaattgttttatcctattaattggtagaagcggtatttttaaatatttatatatagatttggacctgtgagacatggcacttggtatgatgtggatattaactttttatggtattaatgatgtattgggtattttttatgtaactgcaattccatcgattaaaaagacactcatacttcaaaacaatggtaataagttatggcgaatggtgaatttatatataattgggataaaatgatttttggttggatatgatagccattctgatcatttactacatcaaaattaatggtctattcaaggtaaaaaaaaattaatggtctatttcttatagtgaatagtgaatatggcgagatatgatttcttttagtattctttttataggcaataaataaattgtccgcgtatccgcgcgggcttcctttctagttagtctaataaagctcaaaatgtgctgctcatattctagatagtgtaccaattttaatttttaaacaaaattggtgtttttttaaagtacgttttaaactaaaaacaaagatataaccgcaagtaccgtgtgggagcgtcacaaaaattcaacgtagaaattcgcttgtaaaagcatgggtgcacgaacactgacaattatcacataaactatattttgagaaacatagtactaacgttacgctcaaaacacgcgcacactcatccctataaacacacactcacatcctacccattatccatttgagtatcttcagaagactggaccgacaaattttgtgtttgacaaaatcaccacggacgctttattgttaatgggtacatcacgtactacttaaaaattaattaaccataaataaaagcactcgtgttaactataggacttgaatttgataggatagttccaccataataaacttatagttgagctatagtcacttcgcaacttatatttgttaatcacgagtggcatgcctagataattattaatttgaatctgaatttttaagttaagggaatcaacaaaataagaaacctgctgctgactattaataccgaatccaggaattactaaatcatgagaaaatataactgagaatctttgtatttaggctatgtttagatttaggggtgaaaatttttgccgtgtcacatcggatatacggacacatatttgaaatattatacgtagtctaataacaaaacaaattacagattaatttcgcccgtaaactgcgagacgaatttattaagtctaattaattcgtcattagcaaatgtttagtgtaacaccacattgtcaaatcatatagcaattaggtttaaaagattcatctcgtaatttacacgcaatctgtataattagtttcttttttatatttaatacttaatatatatatgtccaaacatttactagaagatctaaacagtctcatacttaggttccgcttgcgaataccaatgagattatgtacgtgccgacgtcgatcaagccccagaactatactaaagcccagttggtgaaaagaagatatgagatcaagacgctgaggagaaattgacttgcactgaccttagacacgggcacacggcgatcgagattaactcgaattttccacgggcgcgtacaagcggataaggacagggtgtgcgcagcgacaagcaaggccggttaagagcaggtataataaagtacgataagccggcgacacaagcatccacgtcataaaaatcataggtggaagagagagaaaaccagagagagaagacagcgggtgctaatgcaatcgccgagctctagcacaggaaatgatgcaagtcctgagaaccagccctcagtcctagcttttgcccaataacttaacaattgctccatcaaagattgagtagaaggaaacaagtctcattaaaaaaaatcaactgcttagggatgtgtgggtaggtaacttaacagctagttattatacgtatcatctattagtaacatctattacttacgtgtataaatttttaacccatcaacggacgatactattaaacttaaacttgctctaaagaagtagtagagggaggccgggacagatatcacaaagaataaagagatcagggacagattccacgagaaggtttgccgatatgccgtggccgcaagcgtccaagcgcaagcctacagctgcttacgcgatgccgctcgtgttaccgcctgcgacagaaaccgccatgcacgcgcggcggccgagagagatagagagagagaaaaaaaaaagagaaaaagaagaaggcggcaaccaccagccgcccagccagcgacgctcgctgccgctgcttcgtccgcctgcgtgctgggctgctgccgctgccggtcttcctcctttaatttgttccatgcccttgtcgcgtggctgtgctttgcatgcgttcgttgcggctaggtcagagtcagggtcaaagtaggagtagtgcgctggtggggtggtaggagtaacctgtgactcgtctgcgagaaaggctgctcctcgggagaggtgcgttgagtgtgcgcgcgcgcgcgatgcatgggcatggcaatggcaattttgacagcggtacgtgtggctgcgtcccatgcggcggccgtaagcgtgcggtcgtccatgtgcgagtgtcggttggcgcattttggcaaaaatgccacggccggccggccggcgccgcgcttgtgtccgcttgcgttggccggccggcgccacccgccgagctgttgtgctgcacatgcgtacgaacgcgcgtgcatatcgtggagctctctttctacgcctctctacctacaactacaacagggctagtacagctactgttccatggtggtgcagatgcaaaagaaatcaaatgcaaatatgcgacgcgacacgtcggctcggcggtgaggtccaggtggcgagagagagagagagagagagagagatcgatccgggagttgatggcgcgtgctgcgccccgcgggaaaggcaaggtgggggcagacagcgccgtcgtgtcccgcgagccacgaccagccctgtcgccccgccaaagccgtcgtcacgtcgatcgatccatcggtattacttctacgcgcctgcgctgcaggccaggccagcggaaagtcagcgacgtactactacccctacgtgccgacgtcaccccggcccggtgaggcgatccacgacgtggcgtcagtactgatcaagttcatgcatgcgtgcgtcaccccggtgagagcacagcattcctagtgcatgcatgcgcgcgctcttcttgtccatcaagttcgatcgcctcgcgcaggaccatgccctcctcacctagcttccagcctgctttattcttatggacgatcgcccacggactactacataccgaccctgcagctcatgatacagagtaccctgttcgtgataactccagttaaagtatgcatttgtgtaaataaggatcttagagcagctccaataatctacctaaatcaaatcaagatttagtttttcaaagctctccaactgatttaacaagttaaacttattgctcactccaaccgtctctctattaaccctatcaaaaataacaagacccatatattaacctctagttccttttttccttccctttttactacccaacaagctagagaaccggaggtggggacagcgacgctaggaggggtcggagtttaggacggtggcgctaggtggggccggaggcggggacgatagtgcaaatcgatagtgagagttctcctatacggattgtagcatgaggagccgctcgatgccgtggatatgatgtcatcgggccacatggctgccaggtgcccacctacatcgaagtcagagacctagtccccttgccctagagagcttgatgtgctcagcagagaggatgggtgggaggacggcaaggggaagagcttgttggctaaggtgtggaggtgggcaaggaagacgtagaaagaagctatgtgcagcgacttgcgaagacggcgtacggcaaggaagatgacttcccatccgcgccgccataggagcacgtgttgatgccgtccctatccatggccacgggtgtcgctgaggtcctgcttgtcgcaggcgtgcccacagccggtgtcaggcaagtcgcagggatgtgcctcgagctgctgtccatgcctatgaagatcgacgaggcggggttccgacgtaaaggaggtggttgatagccggcactgaagaacgtaaagtgatgacactttggtgatggaggcgaagtcggtcattgacagacgctggagcacaagaaagataagaggggcgtagccacgtgggaaggaaaaatagtacgtgtggcccactgttggcaagtgattttggttggccaaatttggtcagtgaggagagacatttggtcggtcggatggcttagcaatccacttggcgagattattcgagcacaatttttcgttagaattgtctaattttagcttaaacagtgattcggagagaggttgttggaaattctctcggatcagatccagttaattgtacgtgtgacatagggactggtaagcaagaaacatgcaaacaaaatcatgcgctgcctatcactactgttggacgtaattgtcggcagtattaattcagttcagttcagttcaattgaagaagagtaaagagttgaatcgcagcgcagcagtacagtagggccagccgcgcgcccagccggccggtagcccggtaggcaggagggggccctatacgtgcaggggcactcgtacaaacggccgcatgcatgcataaatgtgagccctttttggagccgatcgatcatatcgtacgtgccgaaagccgattcgccggagcccttgcgcccttttcccccaacacccataaatatggcagtcataccgttgctgttcctgtttcttgctccatcatgatccatcgatcgatcgatgctggagtactgcaagggtgtggctggagtctgtctgtctcgatcctgctagcagtactacgaattaaacccagccataagatatacaattgaaattctttatatttcaaaatggaggttgtagcttactgatattttaacgagttcagttttagttggatgcaaaatttgtactcctgtatgcactatatatttggattgatcatccaaggtgtctcaagattcgtcttattaaattgacaacaaaggttactatggtccggctcatttctcccacaagagctggattaagataaagattttcatggcacgttttttaaactgctaaactgcacgtttcgtgcgaaaactttatatataaaagttgctctaaaatatcatattaatttatttttcaagtttgtaataattaaaactcaatcaatcatactccctttattccaaattgatcatcgtactccctccattccaaaatataggacacaactactttttaaagatgtttcataatataaggcgtgcatgtatgtatggcaattaattagcatctcttctctcctaaattattattatttaaatcatacactcacaagatgcttaattctagggtgcatgtattgtgttagttggattgattcaaacaaagagataataataattgtttcttgttctttgagtcaagtgtggttacgccttatattttggaatgaagggagtataatttatttgaaaatattcctaaatgatcatcatatttatgttcattcattaagtctattcgttatttgtgcattggggtaaatgagcattgatgcaggcatccatacacacaagtgttttgatttgctattggctagaaaatagtggggattgtgcatgcatcaagtttattgctaaagtaaatgtagcatgagagagttattatattttcttggtcttggtgcactcatataatatgaagatcaattaggaataaagggagtacgttaataccacctcgttttgcataaaaaaataatcttcatcttcatcttcaggagaaaagaacaccacctatgtctcacgataattttaatttgcttttgttcgtcaatcataattcatactccatatattaatataatattcttgtacaatactccctccattccaaattgatctacatataattttttttaggttattcctaaatgatctacatatttgtgttcatttattaagtctattcgttattttatttgtgcattagagtaaatggacattgatgcatgcatccatgcacacaagtattgataacccacatgcaatatcttgatttgctatttgctagacaatagtggggatggtgcatatatcgaatttgttgctatagtaaatacagtatgagagagatattagtatttcttggtcttagtgtacctatgaaatatgtagatcaatttggaatggagggagtaccatttactcataagaatttgtttctccgtccttgaatataaacatttatattcttggctttgtaatgataatgcccccttatttaatgtgctaaccgcttaaacttttttaaaaaaagaaagaggggggggggggggggaatccccacctgagttccataaaccatcgtaagagagagtttacacagtttgagattaaaaaatacagattacagatcatcttagggaggacgatagagtttccttccaggaggaaacgaccactttgtcctaaacactctgtgctagcagttgaaactttgctgagacaattgataaacttgtacatttcgtcctccatatataaacttgtacgtttctgtttccagcaaaagttttaatcagctttcaacaatttataatggtaaaatggtctttttatatccctcaacggaggaatgctaacgaaaacctgacggctatgataattttggaacaaagattgtacgatgaaattttcgggaagttgggttcgtcgatggtactttttagatgggacgtttatcgatggaatttctttgattttctaaaaagaatatactccatccgtcccataatgtagcaacctaggatgggattaggctcatcctatgactgaatctggacaca

SEQ ID NO: 68230 - DNA, 630 bp, Oryza sativa
aatataaaaatatttgagtcatacttaaataacatttgatgataaatcaagtcacattaaaataaatgataattaaataaattatttaaataagacgaatgaacaaacgtatctaaaaaaaataaacggtgtcatatattaaaaaacaaagagagtacagaaagggcaatagtcagtagtaaatgatcttgaaacttgaaagccagaaatgtaaactgctaataaaacaatgttcttatattcagctcccattaagcgacttgctcatacaaaggggaaaacaaaattatccaatggtctaagacaacagaagagtaggtcttgcacactttgtaaaatagaatgctaaattctatcaaagaaggccaacatataacttactaatgaagatgtccaatatgcaaaattagacaaatcagatgcagaaacgcagggaccagaccattgacagctatggaggaggcaaaagtatcatatcatccatgatcttatcagtttcactgtcggaaagcccataataacatgtactagcgaacgatagtgatgtttcttcttttagaaatagaaagaacatactacttcgagaatatcactatattagaaattgaataatttataagaaacgtcttt

SEQ ID NO: 68231 - DNA, 593 bp, Oryza sativa
cctccccctcgcgacaagctaatcccccgaagaaacttgtgcttcttgcccggccaagatcgaaccaatcctggcgcagaaaaaatcccccaaaaaaagcgagaaaatcaggaatttggaagtgagagattgaagcttccgaaggttttgggagggagagtggcgtgtaccccggtggcgagctcgtcagcttgaattcgccgccggtgagcgagggaaggggccgccaagcccggggcggccggggaaggacaagacgagagggtttggttttctttttttttcccctttccgtgctgcgtgtgttcgctgcaagcctcttgggttcaagagggcagagggtttttcacatcagaacatgagagggtgaaaaaagaaactgaggataatgttattggattataattttatcaaagatagctataaaaatgaattaaatagataatactattggttttattcttgtgagatttgaaaactcgtatacaaatatgctatacattttttctattaatatacatacgttaaagcgtgttatttgtttagcgtacaatgcgggctatattgaatatagccatagcatttatcacttg

SEQ ID NO: 68232 - DNA, 588 bp, Oryza sativa
aatgtctaacgaaaaaagttatcaaacaaggctaacatccactctaataaagtttacctatcttcttaacatatctgccacattatctccttctatcttttacacaaatagcaattctaccttgaatgtatctctgtgggctgaacaagcactgcatttgatgctgagagtatacacaaagctggacaaagtgagcctcaaattgttctgtttgttgggacccttgcaaagaactatcctggcataggtaaaaaatataactacagatgtatctttgcttatgtagagcactgcaactaactattttaacaatacagggttagctctgtcgagaggctctgcatgcaagtggtacattaacataaatgtacctgagatggttgatctaaagaataggttggtactagatactaaatgtactataaccatctatatggtcaaatttatttaaatgttctctgatacatgcattctatttttttcaggattggagcaaacttccagccaatcaaactgcttcaggcaccaaccacaaacattgctgatgaaaatgctgatgacaaaactgtgagagaactcttggacatg

SEQ ID NO: 68233 - DNA, 15885 bp, Oryza sativa
atctctgctgaactcaccattctggatctatcacccatggaacttcagaattttatttacaccagatgaccattggtgatagtccaaacctacatttaagtccagcaattttgatttatttatttttcttaatttgcactaattatgttctgaacacctctcaggctgtgttcattcaaaggtgttgggaactaatctctcgcacactaaaacatagctatccattaacacatgattaattaaatattggtaattttttttaaaataatttttcttaaaaaaacttttacaaaagatacaacctttaactgttctgtttgggaagcgtgcatacggaaaacgagtgatgagttagaaaaatactctctttgtcccaaaataaaccaacttcgtatgaaatatgatacatcctaatactataaatgtggacatacgcatgttcagatttgtaatactgggatgcatcagatcctatacgaggttgatttattttatacgagattgattttttcttttttgcggagggagtaggaaaaaacacagcccgactactttcgtagcagtggcatagtattatggtggtgtttcagagcttaaactagtttagtccttgtcacatcggatatttggatgttattttggagtattaaacatagattaattacaaaactaattgcataaatgagagttaattcacgagataatttttttatgtctaattaattcataattagcacatgtgtactgtagcatcacataggctaatcatggattaattaagcttaatagattcgtctcgcgaattactccagagttatgaaatgagttttgtcattagtctacatttaataattctaattagtgttaaacatccgatgttattgggactgagtttatacatatatcacgcacaagatcgaccacgcaaaccgtgtccgtgaaatgcaacacacgctgctcattgacttttttttttaaattgacgattggtaaagaaactcgatttttttccgcttgcgcagtggcatttgggcccaaaggcccaagacacacacactctctctccccctcgtcgtaccactcgccacgccgccgttgcaggagaaaccctcgccgccgccgccgccgccctcttctccgccggtagccggtacgcgacggcgaccattttcctctccttccccgccttcttgaacggtttccccaattttctgaccgccgatttgtttgcagctcgcgcttctcggcgacatggcgagagagaaatccaagaaggaggaggagggatccagtgcgacgaggaatccggcggccgagctcaccgaagacctcatcgtcgacatcctctcccgcctccccgtcaagtcggtctgccgatgcaagtgcgtgtccaggcggtggcgcggcctcatctccgaccccgaccaccgcaagaagctcccccaaaccctcgccggcttcttctacagcagcgagaacgaatcgagcttccccgatgaagaaacatttccaattgtcatttgtgaaacattggttggctacctgttgtatcgaatgattaatgctggtgtttattagctatccactgtaggcatgtaaaaattcaggatgttaatcagtgcttatgtttcttacaatttgacctgtttcaattctgataacattacacccttgcgctcttgtacattatcaggtttgatgcttgctaaaatcatgtgaatatacggtgaaaatgcatgagttttcatattgaagaattcagaggacgtggcaataggcttatgtgactttatgatgaaatgcatgagttcttagatagatagaagaaattatgagaaaatttcatgtttataccttgagaaacttgatgcatttgcactatgtgctttttatttgtaccatcaggttgcacttgggcggttgagcctgaagcagagcaacaacaatgcattctcagaaggaaccgaagaacacttggctgcagtcagacatcttctcaggtatgtactactgctatttagcagagactgactattggtgcagctataaggagtgtggagatcttcggcttgtcagctacagtgatagcgacatagctggggatgttgatgattggaagaaaagctctattctttgtataaagtcctatctgctggttgttcaggaaggagaaagtggtgaatctatcatctgtgaggatgaatatttcgctgcagcttgatatggtcatatggcttcttgctgaactgaaggatgtggaggcaggcaggtgtgttggttaacaggtgctcatttgacccaaaatcccaaactgaatcaaattttttggtttagaagttgatgtcctgatctgaaattttgatgaacaacatgcagggagagggatttctgttggtttaatcgtgctcctccaaacaccttctctactggagattctgattcaccgagcatttccttaacaagcgaaatgaaaaaacttagttttgactgccaatcgtatctcagctttttgtaccaggtcctatttgaattgaaatttcagatatgtttttgcaggttgtgctcgacgagctggtaattaataaatcaaagttatttcagcgaactcgattactgacaaagaaatgctcttcagatcacaatcaaattcagtatgtgtgccacgtgagtatctcaactcctcacacctattcctctccattcagtatcaaagctatctctcgttaaaaagttctcatcttatctctctctctctctctattcttatatccatcggatcgaactggatcatgtgttgttaatgagccttaggtccgttcattagcatataattagttttttttatctgagcatataattagttgagtattaactattgcaacatcgaacaagagtttatttaatttttaaagaaacttttatatagaaaaaatattaaaaacacaccgtttagctttaattttcggaaagcgcactaagaaagtaaaacctaacccctatatgcacattcgaactcaaccttgtagattgtcgtggtagacccagataaaatttagaatattgacaaacctaagtatttgatataaaattttattttaaatattctttttctttgaaacacagtacaaacataggctcgtaaaacgcacactcatcccaacatagaattttaatttccaaaaataacttcacaactattttatattataagacagaagtagtatgaatatttagtgtctactcatacttgcagtagtactgtgagactctgggtgtgtttagttcgtcaaaagaaaatttttgggtgtcacatcggacgtttgaccggatgtcggaaggggttttcggacacgaatgaaaaaactaatttcataacttgcttggaaaccgcaagacgaatttattaagcctaattaatcagtcattagcacgtataggttactatagcacttatggctaatcatggactaattaggctcaaaagattcgtctcgcgatttccatacaaattgtgcaattagtttgagtaaattgcattggtggtacacaaacttgttagctgggtgcgatttaatacataaatttgtaaaatgctcgtttcagtacatgaacttgtctagttcgtgcgaacgaggaccaaaataacttggtaatgttaattttacgaagctgattaggatgtgacgtgcatacgtgtagtgagtatgcataagatatgcaatatttataaatttggtctctactttatccttcatcatggaaatgatgaatttcatatatttctaaccctcatatcattgctaagttttttctttatcttttttctactatcactacatccaattattattttatcagagaggtgtatgtctaatagcaaccttctcagatatgtatttacgtagtattctaatcagcccctaaatcaataagattagccatgtagtgttcttttcgcctttctccgcacgcatcagacaagtttatgcactaaaatgagcattttacatgttcgtatactggattgcacccacctgacaagtttgtgtaccggcaatacaatttactcaattagtttctttatctatatttaataatctagagtatacatatattcaaagagtgtacatatattcaaagattcgatgtgacgtttttggaaaaaaaaatattgggatctaaacaaggcctctggatggctttgcctcactgtctgaaagtgctggacctacagtacacatagcaaccgacaaagccgtaccttgtccgtgcatgcatgcaaccgacaagcaggatggatgtatatgctagggggacaccaaacatgaatgaactcatcacacaattggcaccaagttggatggatcaccatggatgtgactccctccgacgatatttctagcgtgttttgtggcctaggatatccgagtggtcatggtttcatcaacctagttgcagaggatgatatcgtggttgttgagataaatatatggtgggtttgggatgattacaaccgctctgagtatatacttcctccgtttcacaatgtaaatcattctaacatttctcacatacatattgatgttaatgaatctagatagatagatagatatatatgtctagattcattaacatcaatacgaatgtaggaaatactagaatgacttatattgtgaaacggagggagtatataggttgagggcgtgaggcacgctaacgttttgttatgattgtttgttttgtattggagatacactatctatagcgagattgtttgctccatacgtaaaatacgcagattcgttcgtaagaaagtgatgtgaaatgtgatactcattgaattctagagaagctatatatatatataggattctactaataacgtttgcatgtatgaaagaactattgtattcgattaacttgttacatattcaatgaatatggatttataaagatatatagttgttggcattatcttaaaatcacatcgaactatagttacttattagatgtttgtatggaacttctccattcaactaatctagattcctttttagataaatatcaatttacataattttccacatatatatgactatgaaatatctccatcgatttctgtcgtctagatcattttctttcacggaggagttattttctttcacgcttcttcttgttccaatttaccgagtcacttgtctccacacatcattttcattcagataagaacgtactgtacgtacatccacgaaatgccgcgtaggcagcgtatatacatgcgctagactgatagtgtgacgattagctaggaaaagtgcgtttacaatgcgtgaattaaggctgagagatatttctaattaatccagatgggaacaataatcgacttggctttcagtggtgatgtcgcaacactgaaaaagtatatgtcggaaaaagtctgttgatcttttccccgaattttgttaaagttcgtgaaatcactgtggaattaattcaaaccatggcccctgctctcgcctccccctgtctccacttgcttataagtagaaaatctcaaaattcacatagatatgagaaaaatttccatcaaaatttccaaacatactcttacactaacaaaatatatcgattgaaaattaagacatgactcattctgcttaatttattctttacttataacaaaggggattacattgcccaacaccatagtactcatgtacaaactcccagtgagcccaatcgcataacctgacaactgatctagcaaaccacaaccgttcattgcatttagcgatgaaagagagctgaccactaacccacatacatgctatttaagtggaccaacccaccaaccacgtactccatccttgctataaaaaacaaacctagaatcagatatgacatattatagtactgtgaatctggacatatatatgtctagattcgtagtatgaaggtgtgtcacatccgatcctagattggtttttttacgagagaagggagtagtaaataacctattttggtgagtttgtacatcagcctacttgcatccctaattgcattgcagcccacacaagcatgtacacaatctctcctgcctttaggcgcacgagatgtgtgcctcctcgccgacgtggatcgccttcgtcgacgatggcacggcgcactgtgccgccgccgccgccgttgccggaaagaggacgcctgctgctgctgcttgatgacggcggccctcttgcaggcggccatgacgagcggctggtcggcgccgaggggacgacggggaggttgtcgcagttgcagatctcgatcatgaagccatcgggatcgtggaagaagatttggtccacatagatgccacctttctccacacatcgttgtatgtaagggatgcctagctccttcagccgccgctccactgccaccatgctctcacactgcaaaaccgaccagctacatgtcaagtctagttcataatccaacatggcatatgtaaatttgtatagcgacgtagcatattttatagtataaaatttggtacctctcataaaatttattttttggacctcttaaatactgtaaaatttctcgcgcaaaatttatactaaaagttttggtatttttttggacctcttaagtactgtaaaatttctcaagtttgtaaaagaagttgctttacattactgggcttgtttttaatatatatttgtagcatttcctttggtgtagaaaacttttacataaatagtgggtgatacaacggctagatatattttcatatttttgatgtctgaaaattttcaaaataaaagagatgacatagacgtagagatacctcaattacctcttaactaggaataaaaaaaaattaaaaataacttttcttaattatctgatgtgtaagtttttcctcgagttgtaaattaactatgtacttatgcatcgggacaaaaaaactttttcatgtaatatgatgtgtgtcgtcgttatcgtcgtcgtcgcctgtctgccaccttcatcttcgtgtgtgcgctatgagtcagcaacgttgtcaggtttatgataagatgacacagtcacacacacacacacaagttgctcgtgataatatctccttaactaattggcaagctagtgatcatatgcatgcatccacaacaatcagtgatgcagcatcagcttgtccattagtatataatcactatttcatgtacagatcatagatcagagacagagaccgagacagagagggagacatacagaggcagagaatactaggtcttttgcatattaatgttttggcatgtgaagctacaatgaaatgaacaacaataattcagtgtgaaataagagatacaacttggcctgccagatccatgcaatgcatctctgatctatgtaagttggctaaagattcattacaattgtaataatcaaataaccaatctgcctttatcatatacctaattaacaaaactatatatgtcagtttggtgccaggaacagaggaggctctgcttgatctctttccatggcctcccattgtagcattgagaattgtcatatttgagaggttaatttgggaccaaactatacatgtacgaaagcatgcaacacaatgaatgcctctgataagttgcgataaaaaggatttggaaagggagcttagtggaaaggcaatctgtactccagatgagaatggacgatggggattacctaactaacagctgtgctgtgtctagctaaagggcaaaatgccaagtgaggtaggacatgcaaatgtgtgcaatgtggtccttttctagagagttctaaacttcaattcggaatgaggtggtcaattttaggaatgaaattcgatctaaaaggcttggaccggtcctctatatataaaagtaaaaagatgtaaagagccagtaaaacgaactgctccctctgttttagaatataagaagttaaacagacaaccttgtccagattaatagtactataatatatcctatccaataaaaactccttatatttcagaatggggaagtaacaaatagatagaaaagaaaagaacacacgatctgattatttatccttattcacgaactaccaactgatataataacctattataaaatgcatacctaaaattaggcgtattacaaatgactcgtaactgcagtgtgcctacttatatgaattttgcatgaaacatttaggacccctacatggcaattatcaattgtcactagaattttgttaaccgtgcaccatggattggcctaccgccagccagacatctattgggcatctgtcaatatctggtagggtaaggtagtacccatagcattttatttacttcaactgctttacacggccaaacagaagaaggcggagtcatttgttcaggcacctatttcaacgataaaaaaaaatccaattttacttgctcttaccgtctcagcatgcttatctttttatcagatattttcttccgtagcacattttttttctttgttttcctccaactaatctttccaacaaaagtcaccatttttacctcccaactaatctatcctactaacggaggaaaaaagaaggaatttaggagcatggacaagcctaatagttactgggactttgctaatgctagctgaagctccaatgtcaaataggggattaatgatgcattatcattttaataagaatctaaaaatagcattgtaaatactaactctgtcccagaatatagcaccctaaaaccggatgagacgtatcctaatactacgaatctagacatgcctcatatccagacttatcagacttatagtaataggatacgtcccattcgattttaagttattatattccgtgatggtgggaggatatgtttaatgatgttaatttggaagggaaatggtagaagtagccgtggagatatgaacagacaaaagtccccggcaactttggcaggccataacattattaattagtgtcctatgttgttagccgttgatgattggtgcgacgtttcacttatacgtactattcgtccatatacatacggagtatgctctaaaatatttatgtgtatggggccgttttgctgacgttgacacggatgctaacacatgtgccaacaaaatagagacgtgtcgaacaggtaattagttagattaactttgccacgacacgaaaagaaagagatgtgtcgatccaaaatcgcacaaggcgtcgatcggcagtgcatactctgttcggccagttaaccaatgcaaatggaaatatctctttgagaaaaaaaaattcatgctgatgggatcatgaaggtgaatgggatgtgttgcaatatttgtagtgatatgatccaaatctcgtataccaaacgtacctggaaggagatgtgattatctttaggattgatctctgttttccctggcaggctgtcaggatcttcagcctgaagcagatggataccaatcccataattaaacagcctgccaataattaaacgatcgatgatattattgcgttgcatgcaccaatcagaccagaacaaaagaagagaaaaagagaaaaacataagatgtatttttgaacggttatactgttaccgacgttttatataaagaagatatcctattttaaagaagaaacgagatcaaaactgagcgaaaatcacgactacgacaaaccctccagatcgaagggaaaaacattggatgtgaattgtgtgtaccatgcgccgtcgaagtcgaaggatccggggcgacggacggggaagaagccgagcacgtcggtgtagaaggtgagcgactcctgcaacgacctgcacacgatgctgatgtggttcagcgacgccagcggcagcccgctgcccctgctgcccttcgccgccgccaccgccgccgtgttcaccatcgccgccgacgatctcccgctagctctcacgtacactctaatctctcgattgattccaagctccggcgaattgaagagatcaccgagcaaatcgagctagcaattaattaggaaaactgagctcgattgctagctagctaaattaacacggcacggatgaactgagctgttgatgattgtgatgatgagcgatgatcgagaagggatcggatatggaggaatcgggcgggtcggaggggattaaatagggctcacgagatcggtgccacttgacacgtgggatccacgtcaccatcctgctccgcaaccatggcagtctaagctgtactagctaagctagtggatggctaagctccaaattaaacagtactccactccgtattgtctacgaggatccaatacattaattaatggattaatagtgccgccaaagatgaattaatggattccatgatcacggcagagctaagagctaactcatctgtccaattgaaattagttccctctcctttagaacagagaatttttaacaaattatataggaattaaattttgttcctgtaaaaagattgatataaaagagaattctaaggtctcctttgaaatgaagaaagagccatcgatcaatggatacgatggaagttgattaattggagcatagctgcaggaaggtagctagctgcttccagacgttacgagacggatcaccggaagagaaggctgtcacggctagctagctagctcatcatccctgtacaatttgtctattgctggatcacacatattgacaacactgtcggtgtaggtttgttcctctctcgccgccgcaaggtccagattttggatttctctctaccgctttcttcgagctaaattccactttctttattttaaaatataagccacaaccatcgttaatacaaagatcaagatcacctagatgcgtgcaaataacgtggtgttgaagttgaacgatagaggatttaaaacaaagcgaattacaggaagatatgttagttaaatgcatgcaaaagacatgaagagaaaaagagataagtccattttatacccccgaactcttgcacatttgcctaaaatacacatctagctaaactttaaagccgggtattttgcatcccctagcttttagttccgtgcagttacccccctccccctccccctcccctcttaccggtttgtagtccggttttaaccaacatggtgctaatgtggcagtctactcagcactataaatataaaaagcttatgggttccttatgtcacactctcctcctccttctccttcccctttttcacaatccaacgatcctctgatttcatggagacaagattgatgagtgactcgccattgctaagctcgtggaggaggagcaaggtggccggcaatggtgaagctagctcgcgaacatcaattgcgttgaccgcacaatctcattggagacaagcccatcgctcgctgaatggaggcggtggaggtgcacctggtggaagaggagctagctcggggtggcgaggagctccgggtgacggtacattgactaggcacagatcaacccgcacctacagagacaacggcatgaggaaattgaagaagcaagtagccatgccgcacgcacgcatcaacctaccgctatatgtctagccgacccggagatacttcaccgtcgtaggaaggagctcgtggtggaggcagggtttgagctcctccccacgtgactggcttcggtgggggaaactcggtggacctcctcggatccagcaaccccttgccgagagtggagaaggcaggtcggcagggccgcctcgagctcgactcccttcatagctgcttctttcccatgtcgctggcttcgctgccttcgttggagcatgctgcccgcattgccgcctacactggagcatgccaccaccttcgccgacgcgtgccatgctgctcacccctgtactttccctacgccgcgagtgaagttggagggctcatggaggaggtggcggcgaagctttccgctgggtgtgagacggtcctcacctgtagatggatgtgtcgctccgaaggggagaggaagagtgggtgagaaagggaaaggaggaggaggaagaagaaggctggactagcactagaattagaggaggatgcagctagcaagcttgctggtggcggcatgacaccagtgaggcaatgagaggtggcgtgtggggggccaacaaagggaggggagatgggttacagattatatccatgcatgaatttaaaatgtttcacagttagtgaaaaaacagacgattgacaaatagctagcccctagaaatagatattgtttacttgtagttttaagaccgcgactaagcagtttcaggaccttacatgtcgtgtaaattgtacaccttatatgtgaagacattgttaacgccaaaatttggtaagattctttagtggattaggttaaggaaagagcacaatcaatcgatggaaacttatccagaagagaccgagtttaagaaagaatcgtgaagaccatggcatggcagtttaattctatctattaattagacaggatttggtaatttccttttatctttaggaagtgtttatttagtgtccgattaggacttgtatctttccttttatcttaaggaaatatgtgtcgtgtctgatatggattagtatctacccatgggtataaatatatacacacaccgggtctctgtaatctatctctcgatcaatacaacttcagcgcattgccaccctttttattttcgtttttctcgatgagttcttatttcgagttgggctgcatcggcttcgatcaccgacgaggggtaaggcttgttatggctgtttgcatcagcagggctagggcctcgacactctaatcttatcgatgtaaacacctatttatcacatatcttagttaatctaagtcaatgtttcaatttagttgtattagccagatcttttttagggttttgttagtattagttaaattgtttcattggtctagattagctaaatgtatccaccaccctgaaaatcagttaaaggcttgattgtctagatattatatttttttcatacttagtgctgtatcaattgggtctgacctactaagtcgtgcttagaaccataatctctagcccgctttttgattgtcaataagggtttcatcggggtttcagctgatgagttatcaggacattgcatcggctcgcaaggattacatataagttagatttagccgatgacaacaaagagttcattgattatctaatcatatggatttaatgacattggacctccagccgatgtatgttttaaccttcggatcagtgcttattccatcatacctttattagtcgattggtttctactggtttatattattgtcttattacattatcatcagtagactatctttatatcattatttactcaagtgtcaaaatctacatcgaacatatagccgattgttcaaaaccctatcgacatcggttaacatgctatattggcttatcggccgatcgactctttgatcttcaattcatctatcttatcggttgcaggatcaaactgattggcacgcccacacttcatcgatattttggacctgcactggagctaagcagatctctcaggctgttgtgttcgtcgacttaattcacaccaacacatacctggcaccatcgatcgagcgcgaacttttcgtcaacggacatgtaaatggtaaatggcaacatattgggtcaactacaggagataaggggataactaggccagaaggagaggaattgaagccgtatgcctcactcatctccatcaaaatatatatgtgggtgagccatcctgatggtcacagacataaaagccgatgttttctaaaacatcaaggaaatggagttccgaaaaaaggcttgattctttggccataaacaatggaagccacgcttaagagtggtcttaggaaaagagtgtgccatgaaggacgaggccatttctagaggtactagccttacaatgcacaacagtttcacttggactccatacatttctatgtcgctccctctattttccgttcaagtactctttgcatagcttttttattgagtgaagtgtaccggcggtcctcaaacttgtcgaggtgtgtcatctaggtccctatactctcaaattgcactttaacgtccctaaactcgattatgcgcccattagtggtccaaaccagcctcgggatgacttttagctgacatggcatcgtgacgtggatggtgctagccagctgcgggggtaatattgcaaaggagccctcctttttttttccaaatcgtcacgcacatcttccctgtgtcccctcgagttcttcgcgtcagagacgagcggcggggaggtaggcgacgcaaggcggcgattgccggcgaatactccatccttgctccttgccgctgccgaggagtgatagttatagttagagacatactcaaaaatctgggaagatacttgtattttgtcttttgtttcatagtttcctgggatggtagaagtaatctaatattttgtttagtgagatggtacatgcaactcacagtggtttaagctccagtagtgatctggaatataattgtgatgcactgcaatttatctagtaatggcactgcaatttatctagtaatgtatgtcctgtctccagtagtaatctcagaattgtgatgggatttagttagctcatttttctgggattcagtaagctattttttttgagattcatgtgaaatcaggttaaattttctcatgagaacaatatagcagcaaaggccatttcattccattcagcaaaggccatagccatatcatatcattgcacaaattatgccattacatttaatccatgtcactacatttctcaacacagattcagccgttcctaaacaaagcatatatattgatggccaaaatacatacacagcaagctacaaaacatttcagtagcagaacaatttcactaccaatttctatcaaaacattcatcttctttactagctgcttgtcctcaatttgttctgcaacctgccttcctccaactccttcaccttcaccatgcaaatctatcacctgccttttgcctctcgatctagagcaagcttgcaaataccctctcttaatcaaatattgctcataatattcctcccaataccaaaaatcacatccagtaccattccgctgcacacaattgaacaaaatgaaacctaattggcagagtaaacaaaaacatattgaatcaatgtggactgacctggtgacttgggcaggtgtaaaagatgcgtccgtagttctcggacgtctttgccttacgccgaacgatcgtcttcaactcgcattgcgggcattgaatcagagggagcgcaggcttccccatccgccaagacgacaccgatgcagtatatcccccatccatggcggcaacgaaaggacctactggggctgcgtgatttagatattgacggctagggattcggcagcagcaaggagcaaggatggagtattcgccagtgatcgccgccttgcgtcgcctgccttgccgccgctcatctctgacgcgaagaactcgaggggacacagggaagatgtgtgtgacgatttggaaaaaaaaggagggctcctttgcaatattacccccgcagcttactagcaccatccacgtcatgatgccacgtcggctaaaagtcatcccgaggctggtttggaccactaataggcgcataattgagtttagggatgttaaagtgcaatttgagagtatagggacctagatgacacacctcgacaagtttgaggaccgctggtgcactttactcttttttatttgttagctgaaacattacaaaacaaacctaagatgacaaatttaaagtaataacacctctctctctctctctctctctcttcaaattctgcat

SEQ ID NO: 68234 - DNA, 10841 bp, Oryza sativa
atttgaataaagctaccccaaaagacgagtatccaatgccagtagccgatcagttagttgatgctgcttcagggcacaagatattgagttttatggatggaaatgcaggatataatcaattttttatggctgaggaagatattcataagacagcttttagatgtcttggtgcaatcgtcttatttgagtgggttgtaatgacttttggcttgaaaagtgctggagccacgtttcaaagagccatgaattatatatatcatgatctgatcggctggttgatcgaagtttatattgatgatgtggttgttaaatctgaagagatagaggaccacatagccgatttgatgaaggtttttgaaagaaccaggaaatatggcttgaagatgaatccaacaaagtgtgctttcggtgtatcggctggccagcttttggggtttcttagtcatgagaggggaattgagataactcaaaggagtgttaatgccatcaagaaaattcagcctacacagaataaaacagaattgcaagagatgatcggcaagataaattttgttagaaggtttatttctaatttgtctggaaggttagagccttttacactattgttaagattgaaagccaatcagaagtttacttggggggcagagcaacagaaagctttggataatattaaggaatatcttagctctcctccagttttgattcctccgcggaaaggggtaccttttaggttatatctatcggccggtgagaagtcaatcggctcggttctgattcaggagttggaagggaaggaaatggttgtattttacttaagtcatcggctcttggacgcggaaacgagatattctcctgtagagaaattgtgcttgtgcttatatttttcctgtacaagattaaggcattatctattgtccaacgaatgcactgtcatatgcaaaaccgatgttgttaaatacatgttatcggctccaattttgaaaggaagggttggaaagtggatattctctttaacagagtttaatcttcggtatgagtcaccgaaggcagtcaaggggcaagcaatagccaattttatcgttgatcatcgtgatgatttgatcggctcggttgaaattgtgccatggactttattctttgacggatcagtatgtactcgtggttgcggtatcggcttagtgataatttcccctaggggggcatgctttgagtttgcttatactattaaatcctatgcaaccaacaatcaagctgagtatgaggcagttctcaaagggttgcagttactcaaggaagttgaagccaacgctattgaaattatgggagattctttgctagttatcagtcagttgggaggagagtatgaatgcaaaaatggcacgttaatggtttataatgagaagtgcctagaactgatgaaggaatttcggctagtaactttgaagcatgtatcacgagagcaaaatactgaagctaatagtttggcccaaggggcatcgggatataagccgatgatcaaggatgttaaagttgaggttgctgcattaatagccaatgattggaggtatgatgtgcatcagtatttacagaatccgtctcaatcggcttctcagaaattgagatataaagcgttgaagtatactttattagatgatgagctttattatcggatgattgatggggtgttgctttaagtgtttaagtgccgatcaggctaaggttgtaatcggcgaagttcatgaagggatttgtggcactcatcaatcggctcataagatgaagtggttgctttgacgtgcagggtatttctggccgacaatgctggaggattgtttcagatattacaagggatgtcaagattgtcaaaaatttggagcaattcattgggcaccggcatcggctatgaatcctatcattaaacattggccatttagaggttggggaattgatatgatcggcatgattaatccaccatcgagtaaggggcataagttcatattggtagcaaccgattattttaccaagtgggtagaggcgattcctttgaagaaggttgattctagggacgctattcaatttgttcaagagcatatagtctatcgatttggtattcctcaaaccatcacaaccgatcaaggttcaatctttgtgtctgatgagtttgttcagtttgccgatagcatgggtattaaattgttgaattcttcaccatattatgcacaagctaatgggcaggccgaggcatctaactagagtttgatcaaattgattaagagaaagatttccgattatcctcggcaattgcatactcgtttagccgaagcgttgtggtcttatcggatggcttgtcatggatcgattcaagtccctccttataagcttgtttatggacatgatgctgttttaccatgggaagttagaatcggctcgagaaggacggagttgcaagatgatttgacagccgatgagtattataaccttatggccgatgaaagggaggacttggttcaatcaagattgcgagcccttgcaaaggttactaaggataaggaacgagttgctcggcattacaacaagaaagtggtacctaaaactttttcggagggtgagcttgtatggaagttgattttgccaattggaacttgggataacaaattcggcaagtggtcgccgaattgggaaggaccgttccgaatctataaggttgtgtctaagggagcatacatgttgcaacgactcgatggagaagtctatggacgagcgctaaatggaaaatatttgaagaaatattacccaagtgtttgggttaatgcatgctcggctagtgttgccgatgtatgatagccgatgtattcacatcgccttgagatggccgatattgttatatcgccctttgttgtttttcatattgtaatcggttgtggtttgccgatgtgcaatggccgatattgttatatcgcctttggttgaagttataattttatcaatgcttgacattgtaaaattaggggggcacatatatgaaaaattgcagatttttgagcaaaatatggagttcttttgaatcggcataaaagttattgagatgagttagatacagagccaaagtttcttagccgattacaaaaattcctagagtctattacacaagatatcactgagacagatagcgttgaatagccgacacggcccgttgcctaatttgttcaacttctttgatggcttgggcgtcttgagcatcggttccagggatgactcttagagacttggtcaggtcagcgacattcttgatagccgattttagccgtgacttatgttcttcaatagccttcgggagatcggcggtttcttgtgctccagatccagctcggcattacatttttgaagttgtgccaggagtttaatcttatgagcttcgagccgatcaatattggacttgattggaccctcagatagctaatcaagcttggacttttcttcatgtacaagctgccgattaatctgaattgtggcttcaatatctttacgttcccgacgttcggctagtcttagcttggctttctctagcttaaattggtgctgttcaagatagacggctggagtaagggcatcggctagctcatctgggattagagcttgaacttcatgtagccgagtcctgatcgacccacagtcaaccaccaagctgtctaatgacgacgcctctagccaatgcgagatatcttcaagtgttttctttacgtcatcagataagggagctaaagccttgctgctagtatcttcttctgtttcatcaagataatccttgatgtcaaaagaaaataaatcggctaggacctgcaaggtggaaaaatgacgatagctaaatatcaggacagactatacaaccgatttgatatttttgaaggtaaaacttactgggatggtaggagcagctggttgttcttcttcatcaacattgtgactacctgcagccgatggagaatgatcacttgattcggtctgcacaggaggaggaggtggctgcaaaagaataaagtgttatgaaagattggctataacaaaaaggatttatgtgataatcttactggtggggctggtttaagggttgctgcagccgatttcttcctcacagcagtcttctttttctgcaaatacaagattaatgatcgatcggcaatgaattaacatgactgcaaaaagggattaatgtaagtgatttacccttgagaaatgagctggggcagaaggagtgggaggagttcgtttgggagaagccgatggtgttctttctgtatcgctcacttcggctgcagcttgatcaacatcctcttcgatctcttcttcatccaaagcttgctcaatggatgaatctagggctggcaggtcatcggttggcttagttttctgtgacttggttttcttctttggagcctgagccgatgggtctactgccaatgacctggttttcctcttttttccggcatcggctgattctcttatgagcccttgaagaagagttgaagtcttgggggcattatagccgatgacaggaggagatggtccacctccattaggaatgagacccggagcatattcaatgtctctgccactattacttttgcgagtgggagaggattctgttgtctacaagatgagaagaagattaatcatgtttcaaatcggctaataattgttcaaacttgacaagggtaaagatttacctgaggaataacatcggggaacagatctgtcatatacatagaagctggttgatggaagatatgttttttccattcaccccaccatctgtcaaagttcttgctcctgaaccttgccagttctatgttctcgatgttgcccaagggaggtcctgggatgttgagtaactgatccatcatcagagttgatgaaatttctcctcgacattggattttatcagcaaagaacaggccaattggtagctgtcccattccaaactgtctggcagagctcatcggatggtagaattcataagaaacttgtatatttcttccttgatgaataccaacatgaaggatgtatgggttgattgaagttgagaaaacttctccagatttctgctatctctcatgattgatgtcttcaaatctgaagtccgatgggagatccaagtcggcagaattctcatagaagaaccagacacgggcgtctttttgaaagttttcataaaagctgcagaaccagtccttgagcagctcagccgataactttgctcctgaatcggctggtgtggatgcatattccccataggacatacacctgcggtgggtgcgttcttctccatcatcatcagcaatcggctctagtcttggaaattcggcttctgtcatagatggccgattaatggctttcataactaccagatttagccaagattgcaataaccaccatggtcctcctgctccaaccactgagccgacagaaattttagacgatgcattgttcagtgtttgatataggtagccgagaaggattttgcctagaggaaattgcctttttgattctagggcttcggctaaaaattgctagttggttgtagggccgcaacttgatccacagaaaaggaatttctcaagccacatcaggaggaaggccacatgttctcgaggagtgacagacccttggcccatatatgctgccacataaccagaccaaccacctatgcttttggttctgaaatcgaattggttcttagtgttcaaactcatagggttagccgatgaagtcacatctaatccagtgatcatggtgatgtcgatcagagttggggtcatcggcccttggttgaacaaaaaggcattaatggcattggaccaaaaataggtggcggcagccattaggggctcatccttagctgaattggctatagtgagggcgagtgcctggccgattccaatatcatcccaatgaacctgcttgctagccgatacgcgcttataccatgtagtccagcttttctcaggggaggttttctcgagggatggccaagatttgaaggtgttcttccaatggctcagattagggtttgctaatctaaaggggattctattggtttctgcaatgatgaattcagtagggtcggaatcaccaattggaccaaggaaatagtggttctcatgcgacagacttggaattgcacagattggacagatgctatggatgcaaacaagaatagagaagaagaaaacaatatgaggcaggagaaaaccaatatgttgcaaaagaaagagatctagccaatggatacttacctctgcatactcagccgatggcgcgacagatggactggcggaggtcgacatcgccacgagcggaaacttggccggggaggagatcgccttgaaatcactatatagtctttcttgttccacttgcaaggcaaggaaaaaaatgtcagtttcgttattacaaccttatttttttatgtcaaagacaaaaagctacgtgcaaattcttattggatctcggttgttcttaacagcgatggctattattttttatgttcatttaagtcttcaggtagcaccaccagatcttcaacaaggtggaaattctcatatttcgtatgtacggtctaaattattttccttagatacaattactacaatagtttactattataacaataagtaaaaataatatgtaagatggcttaaacaacataagcttacataaacattaggtgatgtgatttgaatttaaaatagtatgtagataatgattcaaatttaaaaataagatgatgtggctctatgagagaacaaaatatggaaaataatttagaccgtacatctaagggctaaaaaaattgagatgatatggcttaatgagataataaaagaggagtgtgacaccctgaaaattcgaacaacgaaaaatcaaaactccaaaaatatgggccttcaaaaaactttttcaataaattgcatcatgccgattctcttcgcctatttcattggaatttggtttcgaagtttatcagtcgtgaataggggataaataattaggaataaaacctaaaattaggttggcaaaagaaataatcaagatataatttaaaataaagattaggtgaggatagaaataaataaaatattatcgcgaccatatttgtatcaattaaatttaaatgcgatggaataagaattaactctaattaaattcaagtaaattatgtaaaaataaaaataacacatattgagtaaacttcatttatgcaagatttagaatttatagaatcaaatttatatgggaaataaactaacatcgggataaataggaaaatacactgttcattgcaccctagccctaacccctcctctgccgcgcgctctggccgccctgagccccgcgcgccgtcaccattgctgccgccgcgcgccgtcgccatcgccgccgccgcgccgcgccgtcgtcgtgtcgcctcgtgcctcgcgcccgcgcgccgctcgcttgtcccgtcgctgcgtcgcgagcctgccgcctcgcgccccgcgccactgccgcgcgccgtcgcgtcccgtcgtcgctccgagccgcgcgccgcccatgctgcgcaggcgccgtcgccatcccactgccgcgccgcgcgtgccgccgtcacctcgagccccgcccctccgtcatgtcgcccgtcccgtggccgcgcgccagtctcctcgcagcctagcgcccagcgcagccgcgccgccgtcgcttcaccccccctccttctctcccttttccccctctctcccctataaaaaccccaccttccccattctccccactccattccctcctcctcccctctaccctcaccaccgcgccatcgttctcgtactgccgcgccgccgccttcgtgccgctgcgccgctgcctttgtgccgccgtcctcagtgccgccgcaccacaccgtgtgccgcgccggggcttgcgccgccgtcgccgtcgtcgccgccgaccgccgctgtcggtaagccgccgccttcccccccccccttgcgtccaccgccgtcgccgccgggtgggccaaaagccgagagagagaggaagggagaaagaagccgggagggagagagagaaaagaagagaggaagggagaaaggagccgggagagagaaaagagagaagagagaaaaaaggaaaaagaaaagaaaacgaaaggaaggaaaaagaaaaagaaagggagaaaaagaaaagggaaataaataggaaattaggaggagatttaggatatttaaaatattaggaattaactataggattaactaaagtgtagtatttgcaaaataatactataatcatagattattataaattattcttgataatttctataagaaatcaattcgcggtagtaatttagatgtaatttcttatagattattatagattatttttggtaatctctataagtaatcaatttgcggtaggaatttagatttatttaagaactaaaataaaggtgttgaatttttaggaaaatttcttaggagacacaaaatgtcttaggttgaggaatagttctatttcgcgaataatatagtggatataacaatcgcctctcgtgctcgcttttcgatttggtctttattagattttatttgaattctagtggaattcaaatcaattctttgcacgtacttgtagagcctgagggagttgcggatccgagtgaaggccaagacccgctagactttgagcaaggcaagtcatcactattctttgaacatgttgatcccaattgcgaaattgttttgtttacaaataaaattacatgcaatgatgaacatcctacttgtgattatgccatgccttgattgttgtctacccttaaaatctttgtaaccatgattacgtatgagtccctagtcaattatgacgattgcttagaaatgctattctagaatcttgcatactcatatttgtcaaatgctatatgcttgggcaattacctttgggaaggtaattgagatgcagcatgtggagacatgagcgtcacattgccatgatgttgatgacatgatttgtgaaaggagaaataaaattaaacaactattttcgactagggcggacggaggatttgggtggtgtccggaaaaggctagtgccgtccctggtcaattaaggaccgagccatgaagttaagcatgaaacgacccccgtacaaccgcacttctcgtatgggtatagacctagtggaatagatagctgagcagaggcagtatccatgcatagtggtttcttgatatgtgaggcaggggctctacggtggggcagccattggtaggacagcgaagcgggtgtctacaatggtatcgccatcggtaggactgccatgtgagaatctaaacataattataacctaatgcatgtgtgagtcttcctttcccgggtgcgccagaactcctctcactgctagaaaccgtgtacgcctagagtgcatgaggatgtaaagttcatggagcgggtactgccaatgcgaggttatcgaaaagctttgccgtgacgcgtctcatgtgttgggacgaggctcatgtgttgggcagtcgcggagtgtgggtaacgtgtacatccactgaagtgtgagtaaaccgaatctattcaaatagccatgctcacggttattgagcaccgggacatgtattacacttggctagactctaaattcttaacttgtatgggatgggatattgcatgatgatttttatgctgttggagccacttcctgagagacaggaaggtggacgtcctcagaaaaccatgacgactcaatggcgggaagctatccttgggatcacaatggatggtggacagaaccgtcattgtttaatatgaacactggtactaaaatttggtcagtctatgctaggtcttaggcttgtgaaaagaattacaaaacttgctttgcgcaaaagaaccatagccattccttgaaatactcctatcatgtgcattgttgctgtggtggcttgttgagtacggttggtactcacccttgcaatatatacacttaatcagaggccggagatgaagtttcggaggatccctatgcctattaccaggagggtgatgaagacgatggcgctcagtaggtcttagttacggttgttgcctgtggcaatggtgtgccgctggcttaactccgctgccttatctacttctgcttttggaatgtattccggaccgctcggttcgataatctaagactatgccggcgggcttatgatgtaataattcgcactagactcttgtgtgtgtgcatttggtatttcagctatgaactcgtgtgtaccagactacttgatctagggaaatggtactgtttacacgattgattcctgttataaaaacgggggtccacaaggagagataattggaaccatagattaatcatctaaggactaaaaacaattgatgatatatgacttaatgagagaagagaaaaataatgatgaactatataggtatataggatatttaaaaaatgatggagagatatattgaaatattatgtgaattatgtgggataatttaacatgcttatattttaaatctctaaaatttaataaattattaaattataaataatgtactccctccatctatttttgatagacatatttccaaatctgaaaattttatttttcataggcatatttcaatccaacaacatatcctcttaatgactttctcaaatttaatgcttcactctccattttttcacacaagattggctacatgggtatcgagaagtgtaaatgttaatggatcgcttgtttacgaggaataactagtagcatgtttaaatggatgat

SEQ ID NO: 68235 - DNA, 32429 bp, Oryza sativa
atgcccatgtagccaatcttgtgtggaaaaatgaagagtcacgcattaaatccgagaaagtcattaagatgataggttattggattgaaatatactatcaaaaataaaattttcagatttagaaattgttgatgtgaaaacacgaggcctgggagatcttcttaactccagtgcaggtccaaaattcgccttcgggtatgctagcgtgccagttgatttgatcctgcaatcaacaagaaacgaggacaaagaaaccgtggttaaatccataaccgatagctgatcggctaggtgccgatgacatatcatttatctttgagccgatgtcatatatgcatcgatcggcaatcattaataagtaagaaagaactaaatctactcgatcggctgtagatattaacgacatatagtccttatgtcgatatatacttaaatcaagtgattgggatagatcggtcgccatgccgagacagtataaatcacttagatcgaaatatatattaataatgagactatatgtgtttatagcatagccgatcagatagatctagcgtgtatcggctaatactccgataccactctatattaagatatcacagcaagtaaaatataccaaacgaaagcctaatatacttaaatgcgtcaagatcttagtacaaagggcggattcaacatgtcaataaggcatataagataaatgtagttaaatcaggtaagatcggctgaaaccccgatactaccctaatcgacaaccaaagccaggctagagattgagattctaatcacgactcataagatcaaactcaactaatgcagctataagtatgaaaagaaggacaatatctagacaatcaagccgttggatgtatcatagagtggtggatatcttatataatctaagccaacatcgatatttaacctaatcggctacattctactgacagatgttagccgattgtaggttagatagcgatattgccaaagattatgtgagatatatgataactttgacgaattacataaacaagcttagagtgtcataaagatggaagcactaatcccgagaacgcaagccgccataacaagttttacctcttgttgatgatcgaaaccgatgcagctcaacccgaaagcaagaactcatcgaaacaaaacgaaagtaaagagggtggcgatgcgccgagattgtattgaacgtgtgttagtttgattacatggggctcggggtctatttatacccgagaattacaaaatatgtccatgtcggacacgactcatatctctaacaaactctaagataccataagtcttcgcgtcagacttttgccaaacatatctctaaagaaattacataaaatatcctaattaacagatacaattgcctcctcaggactctatccatgtgtggcaatcatcatgaagcacatcaacctaaaccgacaacatatgctgtgtcatatcgtcggactcggctcaatcggctaacctcgtccgactcgaactctgccgatcttagtcgtagccgattcggacttcagccgaccctcactctgtttacgggacgatttacatctcgagttccatctcggtttcttctttatctctgatccttggattaccaaatttggtcgttaacacaaatatgcctatcaaaagtagatggagggagtaattgttagtggatgatgacatgacatatttgcatgctaagttttaaaaattagtgggctataaagtatagtaagagaggatatcattaagaggctacattgattgtatatttttttcttaaaaaaagtagtcatatttgaaagagcatctatgcctctagttggttttggtttattgatgacaaacgattatgggactaatgcacttattgagtgtataagcaagtgattagtccgatgaagaagctaggaaatggacttatcgatggatgagaattaaagagaagatattgaagatgcgggtatgacgtgactatctatggcaagacggtgaagcgcaagcgacgctcagctgcgatggaccatgcggtggtgaagggcaagcaaggggcttggtgctgacgaatctaaaccggtggtgaagggcgagtgaagaatgtgtcgtgatgaaccgtgtgtcgatgtaaaaacacgaggcctgggagatctgcttaactccagtgcaggtccaaaactcgcctttgggtgtatgagcgtgccagttgatttgattctgcaatgaacaagaacaaagacaaagaaaccgtggttaaatccataaacgatagccgatcggctaagtgccgatgacatatcatttatctttgagccgatgtcatatttgaatcgatcggcaatcatgaataaataagaacgaactaaatctactcgatcggctgtagatattaacagtatataatccttatgtcgatatataattaaatcaagtgattgggatagatcggtcgccatgctgagacagtataaatcacttagattgaaatatatattaacaacaagattatatacgttcgtaacataaccgatcaaatagatctagcatgtatcggctaatactccgataccactctatattaagatattaaagcaagtaaaatatgtcaaacataagcctaacatatctaattacgacaagatcttaatgtaaagggcagatttaacatgccaatcaagcatataatatataaagtagttaaatcaggtaagatcggctgaaaccccgatgctaccctaatcgacaaccagaaaacaggctagagattgagattctaagcacgacatagtagatcaaacttaactgatgtagcattaagtatgaaaagaagaacaatatctagacaatcaagccgctagatgtttcatagagtggtggatatcctatataatctaagccaacgtcgctatttaacctaatcggctgctttctactgatagatgttagccgattgtaggttagataacgatattgccggagattttgtaagatatatgataactcaacgaattacataaacaagattagagtatcatgaagatggaagcactaatcctgagaacgcaagccgccataacaagttttacctcttgttgaagatcagaactgatacagctcaacccgaaagcaagaactcgttgaaataaaatgaaagtaaaaagggtggcgatgcgccgagattgtattgaacgtgtgttaatttgattacatggggctcgggtttatttatacccgagaattacaaaatatgtccatatcggacatgactcttatctctaacaaactctaagatatcataagtctttgcggcagacttttgctcaaacatatctctaaggaaattacgtaaaatatcctaattaatagatacaattgccttctcaggactctatccatgcgtggcaatcatcatgaagcacgtcaacctaacccgacaacatatgccgtgccatattgtcagattcgactcaatcggctaatcccgtccgactcgaattctgctgacattagtcgtaaccgattcggacttcagccaatcctcactctgtttccaggactatttccacctcgaattccatctcgatttcttctttatctccgatccttggattatcaaatttggtcattaacaccgtgtgaggccattcgaagccacggattatccgcattagtcatttgagaaatggaagatgaaatgtcaaagatcaagaagatgagatcttcccgatgatcaaatgaccttgacgttggtaaccctccaagtgaagaaacaatatggtgtgaaggtactcctattggtataactttgctttttaaatttgagtttaggatgccgtactattaagagggataccacatgcatataattggttgaatactagtgctcaaaatgcttcatctttgtgtgagttgaaaaacctaagccaaaatttcaatccccagttgtttcttttgtcacaacacttacaccgggtttctttgcaagtttttcgacatctcttgatggttttggaccatgttttatgttaggtttgatagcccatgaaactagctttccatatagtccaagatcttcgaaatcggagttcggagtaaaaaagttattgcatttttacttgagcaacatcagactatcagatttgaaatcagactatccgatgtatcggactatccgatttttcacagaacttcactctctgtcttgatttgaaaaaatcctatcaagtgagtttttctaagtatcgaagtatccgatgtcggatcagaaagtccgatgatacaaagactccgaaatttcatggaacttgagtctctgtttaaggacaaagtttttgcttctaaaatatcggatactttgatttaacatcaaatagtccgatgtctcggaaagaccgaaattttatggaactttgttctctgtttctcattgccttggaggtttaaaatatcggactatctgatcttgtatcgtactatccgacgtgggctgaaagattcccctctaacggtcacattttggggggatctatataaaccccccaccaacccttttctagggttgcccaaactgatttcatcccaatcttgctttgtgttgagctttgtgctaagtgctttggatttttgaactctctccctctctatctcaaatcccccttgttctttgtgacttggatctttgtgtgtggatttggagtttgagagtctagtgtgtgtttctctttatcttgagcactaggatttgtccaagagttgtgtggtgtttattactcttggaggttgagaactcctagatggctaggtgtcgttcttgggccgccgatctacgtgtggttggccaagagaagtttatgaaggccagatctcgcctccgcaaggaaagagatacccttattggaaggaggagtgcatttgtgcaacctcacgaggatagggttgaaaaagacccggctctttgcgagcccctcaatggagactagaatcccctcaaggatttgaactccgggaaatacatcatcacataaacctcggtgatatgctcactctctttgccttcttgttatattgctttgtgccatgctaatcttattgtgggttgtgctcacctctttgcttgtggattggatctagagcttttaagttgttgcatgtttggttgttgttgtgcaggttagatagtctgatctcagttcagataatctgatcacataggactatccaacttgatatcagacaatccaaccctgttttgttttagcttccgcatttatttctaaaacgcctattcacacccccccctctaggcgacatcaaggtcctttcaatatgcattggttgtgaagtagtcataaggcgagccaattttggacataaactgtggttgcgaagtacttcctccatttcatattataagactttctagcattgcccacattcatatacattaatgaatctagacatatatgtgtgcctagattcattaacatctatatgaatatgggcaatgctagaaagtcttataacatgaaacggaggtagtagtagggaagtagtagtaataatatagtagtaagatggaaaaaagtctacccttaactaaagcccaagagcaagtttaatagtatagtcaattattagctccaaaccttatatagccaatataatagaccattcatacaatagttacccgtaaatttgtactatatcattaatacatggcctcatctctcttacacacacaacgtttagaagtttgtgctaccgttggctacaaatctgtagcccgcttttcttctctctactctcttatttcctccacatgtgcttatagcttatttgtagccatacttgctctaaaggggcgagttgcattcactagataaattttaaataaatttaatgaaaaaaaatattataaagcatgacccacaaaagtaactatttctccacctctctcgttcacaccacctagtccgccgccgccgccctcccaagtcatggtcacggcattgtgattatggaatgtgggcacgactgtggttagggaggaaggcgtcgccgccaatagaggagaagaagaaccggagctcatgaaggtgggggaggtagtcccagccatagtcgacgaagaagtggttggccgcattggctcaggcgaatacaagggtgggggcaccttgggcttgagcggcttagcctcataattccactgaaatctcaccagaaaaaatagtgaaaattcatgtgtctaactttgaacacattacttagccctagacttagccaatctctgactccgcccctacgccagtagaggcaaaacatggcaacaatgtccccgtcgcatggtggctactgggtgctcgccacatggtggggggagccgctgctgtggctatggcagccctttcgggcaggaggtggagcaggccccctaggtcacctccttgagatcagtggtggtctgggacggatacgtggatgggcggctatggaggagagaggagatgaggtgacgttgcatgagctcggtgagggcgaagccgctgcctacgttgctcgggggagaggatagagaggagactaggcagccgctcgagcttagtgttggcatcgccgctgctcggaaggtgacgacttgtcgatgcctcgattcatctttaatttcgatagtcaccgccctgtaaactattgggcgcctcgcatcaaactattgttgctattgacagttgcaatacgggggagccgtgacagcggagagacgggcgcaaggcggtagggccgacgtccgccttcccacggacacctgacggtgagctcatgctaggacaaatcaacgttaggtgaaggtgggagtgccaccatcctctccttccttcaccatcaacgcggcgccgccatcctttgtctcttgccgactcgtctattaaggaagggcggttgacgagcttggaacgggaggctggaggaggagagataaagaagtgagcgattaaatgtcactgatatgtggggggccactattacttttttttagaaaaaacattttacttattattagaatgtcccacgtagatgccacatgggttgaagatgaagtcaaccctcagtactgtcccttagggctatatttactttggttttggaagacgtgggattttgctgtcgagggacgtgcaattagatagggatgtaaagtggacttgtcctaattaagatcgaagccgaaagttccttggcccagtagatgtgcttaggacacgtccctttctaattacggcccgttccgtggtgaccgactccgatccgaggcgagacgcgacgcgagagagatccgatccgagtagaagaagacagaagagggagatggaagggggaaaaacacaggaaaccctagcttagcagtaccacgcacccacgcgggctccgtcaaatttcatccaaaaaaaaaagtgtttccgcccgcgcggcggcttccctgagagagatcgatcgatcggatatccttgtggattactattaattgttgcatggcaacgaggagaggggatcgaagaaagaagaagagtagtactagtactagtgacggcggggagaggatgatgagggatttattgatgatgcagcgattggaggtggaagaagaagaagaagaagaatcccaagcggaggattatgagattgtgatgttccgccgcgtctggacaagatggcacggtcgtaactttggctccttcgacgataccagtcagtatctacatcttcttctcctctcttccaactccaaaacacaagattaattaatttctattctagcgattaataatccttattagttaacaataatcgatcctatgtgcagcttatccggccatgcgttacacgtttggacgcatcccgaaatcaagttttgctggctgcgacaacggattgcagatcttctcaatcaaactcctcctccgcaacagaccatcagctccagtggccacttcatgtctatggcctcgtcgctaccagggactctcttgatcctaggcgcaaccttctctttaatcgcactagagacaactgccaaatccttactcaacaggtatatattattaacctcttcttcttaattcgagtccattaagaggttgattgactagctcatatatatgctcttaattgcaggatccctttctagtgctaacaggaccgtctcgcgcaattgtcttaattgatcctgttcaatttgaggttcagctcaaagcaaagtccaataacaacaccctgcatgatcatcctgaccaagatcaaattgttaactttggagtggtggattctggctatcttccaggcccaacgaggcattgcatcggcaagcggagtgaggtcgagttcacaatctcagtgcttgatcgatcaattgaggccactatcatcagcgtccagcttgttggtggctcgtcatggccggatcatctccaaggaaagcttgtttcccgtacggccagtgcaattcatcaagaaatcgtgctacttgattctcaaaaacaacaagatggaaaaatgcctatcgatgatggcggcttcattcagctttcaaggcgtgttgtttcggtagaactggctggccaactcatagttcaagtgctggctttcaattcccagcagcaagtagttgacaatgacaacgacaacaagaaggatgagattgttgcaaaacacgagattgtttttgatcctaaggaagcttcattgagtgtggagacgtgtgagctacaactaggaggaggaggaggaggcccatgtaagcttcaaatctctgttgcttggtctctggtcgataggcttccccctgttggctatttctaacttacccatttcgatcgctgccattccaaattactatcatgctagctagtatctctattcagacaatcatatatatatttgagacatatatagttccaattaatcttataaaaaaactggctaatatggctattcgggtatcgcccctgtttgatttggctcatgatggtttgcgtattttgggggtggaatttcacgaatctgattcccgatgttgggtttgttttgagtttttgcgtctgagctccgcgttcatggggcgattaagggcaaatgctgcgtacctgtctctctggttcgttaacaaattttctctttcctacaaaggccaggtacaagtaattattcaaagaaaaaatgaaggaaataacatgtataattagctgttgatgggtaattgggtagagatctgtttgaaccagaataaagatgatgatcaccaaagtaaaggttggtgacatggcatgtatgtaatatatgagtatatattgtgagatgcaaagaagatctgggaatcgcattttgtgtacaataagttgttcaagtgagtccaatctttgagtgatgttctgtgttacatcactcttggagtgttatgtaattgttcttcacatcaaggcacaagtagtctctgacatgaggttcctttttccgtaaatttgatttgctcactgctacttagctatacagggtgaagaaagaagtgcgaaatttccgaataaaaacaatttgtgcttgattgcatagtgtggatatggcccaagctctttggactgttggtctggaaaatgaataagtcccaatagttcaggtgttggactgacgggattgggttaaattaatgcctccttacatacataaaggaacctaatggttactgtttgtgactttttaagttccacataattatttagatgttctatagttcaggtgttagagcagtgtgatgataatgtagggtgagtcatattattttttcctctactgaagtgcaatttctaagatagtttcacgctgcatcctttctttttaattttcatgcaacccagtttaagaaccaattttaagaaagtcataaagttgttttggtttcaaaatggtctgtagttctgtagaaagctttttttttggtgatgctacagcagtaacagtaactagtcttcctcacaagcaaaagctatattagactttgaggcacaatttgtacccgtgggcttaatttttaaatgctgcactccttttcggacaaatggagttgcataaacactgatcgaggcatggaatgtcatagtttacatatttgagatttggcacaagcgttcagtgtgaacgttgcagccaggattcgattcctgaactcctcacttttcgcctggattaaatgaagggatgaaaatatgtggctcttcttatcttaattccattggatggctagctcctagccatcgcaacaatacttgtgtagctgaatcagtaatgcaccataacgatggtgaatgcaagattttaaattggaaaaactcatcctctcacaacctacaacatctaattagctttgtttccctgtacgtggtttctttagataatttagctctgttctcggctattcagttatgatattctatgggtctccccatagtcgagtcctctcgtaggttggcctttttgctttcttagttggtcggtgtcttggtcatggaggctaggcatgcaggcggtgaatttagtggcggtggttgtcagaggtggtcgggagccagtgccctgaatcgacggtcttggagacagcggtcaggagctggcaccccgaatcgacggtctcggcagtgacaacagcgggagccaacgcccctcctatttgacggtctccttgacggcaacagtcaggtggtggcgccactagtaaaaaacaatttttctagatgggcgacagagtcagacggggggcgacgaaggctttcgtggctgctcggcgcttgcagtcacgagccagatgttggaagccccagcagcggcggcaacgcaccgggagacggcacgatcgaggcaacctggtgcaaggtggagagacagttgaaacaccggtcgagaaggtccggtgggatgccgtgagctcctagctgcgccggcggcaaggaaggacgtggctggcagcggcggccgcccggatgccacccctccagagctgggggcacagctcccaagagcccctcgaagatttcagccggaaggggtggttgtcaagccggcgaggtggacgactggtgcagaggcggcggccgacaagccgacagagacggactgcgtcacgactcggcgccggaggagcacgttgcggtggggcgaccggggacagggagggcggccgtgcctacggcgaccatcgtgccacctctaggtaggagggagagggcgagggagaaggggagagggatgacgagagctcgacccgggccgcgctatctggccgctctgccacctcgtcgctggtggcgccgcccgccagggcgggaacgacgacgacagagcggagagccatggggcgaccgacgcgggtggcaaccggggccggagcggcgtccggcacgggctcagggccgctaccgcctggtcggctacatctcggcggtggtggcggcgatgagccgccttaatcgagcaagttaatttacaccgggggttaacatgtgtatgtttagtggaaatatcaatcctatgtgtaccgggcaattccaattctcttttaatgtggttaatctttaatatattttttaagtctaaaacaaagtccatgcgcgcggacacatgtatgtatgtatcttggttcgcactcatgcatgcacgttaatcaccagagttctactatattattatatgtgacctttttcttccctagtttttagcagtcactattgattaagttttcttctcttgactgggccttaattaccattttcatctattttcgcaaccacatagtaatatagctatgtcatgcggtttggcagctttgcatacatcacaaatcaatggaaagtggagggaaaagaaagaaaaactaatataattaacctgaagatcgatcgagtatggattcgaatgataatggcaacgaaggaaacagcaggtgccttttgaatggcaggcaggcagcaaaagtctcaaaagtgatggacgatgaatggatcctgcaactacaagtgactttaccatgacatgacactaatgctaatgcccaatgcaccgcaactttgcactaaaaggttaaattaaagctagctaggagaagaaacaatacagtatatattagtgcccccatatgtacgtggggccggctacctgcaatcttattggtgcatgatacatgggaggatctctctatttatataccaatcaagggcaaattgatccaagtcactggattcatcgtcatcaaccatgattccatatgtgtgtagtttgtacgtacatacacaggtggtcttccatcttaagtcttcttcagacttccctggtcttttaatcgatcttcaatatatgcatcaagcgaccatgcacaaatgtattcctatatatcgtgcacggggagttaacatatattcagattgtcatctataaatatcagtaagatgtacatgtggctgtaccccaaccacatgtgaaaacaagatttttgcacgtggtcacctaagccgactgcatgcgaaaataatttcggcaaaaaaaaatataaaaatctcctgccattgaagcctaaccaaatgtttcaactccaccaaaaaaaaaagcggagcgggctagaatatatgctctcacaaaatgaattagagatgtggagcagagggttcggtctgctccacaacttcaccacagaccttagctgttggagttaaatttaatagttggagcccaccaaaccttaaaattatacactttcctatctctatatataagtatatacttgtattgattgcatttgatacggtatacatgcaagaagcatatatatgctttgtcagctgccaccagtaatacatgcaagagaagaagttgaaaacatttggtcaagggtggtggtgatgaacaaacgcatataccagttacattattattggtagggaccgtatatatgcttatgctggctggtgtcatcgtctcaatgggtacacatcgatgtgtaaaaagttaggcctaagcttctactttagtatcaaatcataacaacataagatcgcatattaaacataccatatactatgtcttaaaatataagaattttttactctgacatagcatccgagatgttactttaacttaaaaaaatctataaaaataagatgttttaaataaaatagttacatattatgatatttgtttattgataaatttagtaacatcaatttttcataatttattttttattttttattaatagttaaagtcaaaaatatttcatttgttggagtattgtaaatctagataaaggttgctatactttgaaaaaaaaagtatataggccgatgtatatatacccgctataataattaatcgataggaagagcatccatcatatatggaggctgtgagtctgtgagcagctgtatgaatgtcgttgccaaagggacatcatttatacatgcatatctctctttattatcagctttatcgtttggcttataaaccaaacaacatatttgcaaacgaaaaataatttataaataaaacttttatataagtatttttggtgatctaaaagcaaagactaaaaaataaactatgataaaaaaaaccccctaaaatcaacttcaaatttaagattgaaaatttaaattttgggtgacaaacataagcgaaaaggcgaggctttatgtatattgatctaagtaattcttttcctatcattcgattcattgttaaatatacttttatgtatacatacaattttacatattttacaaaagtttttacatattttacaaaagtttttgaataagacgaacggtcaaatatgttaaaaaaagtcaacgacatcaaatattcagggacgaagggagtataatatatggatacccgcagaggcctctcaattaatgaggtcagaaaaggcattttaattcccttgcaacaaaacctgactaataggttcgttcgagtctttcttttcaccggcctgacgaaagcgggacaaaactttattaagataaaagaataacaaattagcaaggggcaaagttgtcgtggaaaacataaaagcacaaccaacacccttcctgacataacgagaaaggaatagtaagagagtttaataatatagtcaactgctatctttaaatttaactatagttaatttaatagtcatttcatacaaactagtaatatttggtctcatctgtcatgcacacatgcagctgactataaatctgtaacccattgctattctttcttttcatttatctttttgatatatgtttatagctgacttatagtctgctattatacatgctctaaaaataaaaatatttagacatccatcttgatcaactcagcttcgcaccgattccacggctgaatattacattgttccttaggatcaaatatatctacgtaaatacaaatgtgtatttagtggtctaacgcatgcctgcctgaaacagtactgtgtgagcgtgtgcattttgatctatgttaattgttgcaaaataacaagtattcctatttatatttcaaatagatgcatggctagctagctaattttgcttaattaaaatttgcctccttattcaccaagacgttaattaactttactttaggtttccagtagtactagttaattaagttaagtagcaaattaacgacacgtagatgagatctcagagagaaataaaccgccgcatgaacagtgcggaggtcttcctagctagtgtgtactatattatatagctagctccatgtgtggtcaattgtgctgaaagcaaacccacttacatactttcggtcactttcataataactgcaaattagttgaacatatatatatataaagtgaggaaaggaaatggtaacactgcaaattaagttcatgagagaattgtgatcaccttagcagatcgcaatagcaaggtgctaattgatcaccttagctcaactggttaatgagctttcttgtgatgaaacatgcgtacgcgcgcgggcttaacatagataccctcttttacactaattattttttagcggtaaacatcgcgataacaaggcacgtttgtgtgacttcactaatataaatatatgccggctcggtatatcaagattttgatcattaatttcttaaaattttatatagttcagcaccacaatatgttttaaaatccagcatgataataatttataattcacatgtgaatctatatagaaaattgatagtaaaaattaagtatatttaacatatatagaacaaaaagctaaaacaagctaagtaattttggaatatgcatgcaatgcaacgatataatccaacagctaagccccctctcatgcatatattgcgtgcgttatgcatatcctccgtccttctcgagttgacaaagtatagttgattaaatttaattgcttcgacatgtacagggacgtccactgtactcatgtcacaatcagagaaacttaagtacgtaggagtagtatgtatttacatgggcagcaaattatacgatccgtagatttaattaattaattagtaggtagctactccctccgtcccataatataaaaatttaggaccggatgggtcatttcatactacaacgaatctggacggaatattgtccagatttgttgtactataaaatgtctcattcggttctaggttgctatattatgggatggagggagtagcttaaagttagggcatgtttagcacagctccatctctcctggagttaaagcccaagtaaacagtttcagctccacctaaaatggaagtggagttaggtgaagctctcaaacaaaataaactagagaagtggagctaaattttggcagctccacaattccacttcagactcaactcctgaagttaaatttaggagttagagctctaccaaatggacccttagtatcaataactgtccataagaccgactgaaactagaagatacgtatgtacgttaaattaaccagtgtgcatgcctgtgtacgatctgtatgttcgaccaacggcgaccggccgcggccggccgatgcacgaagctgccctgcaggtagcaacaataacacgctacgtacgtactgtaatatactccctccgtactcgtaaaggaaattgtttagaataatgtttaagtcaaaccttagaaatataaatcatgaataactcttaagttgttatatttgaaaatataaaaattatatgaatagatttgtcttgaaaaatactttcataaaagtatacatatatcacttttcaataaatatttttatagaaacagaaagttaaagttgtattttggagaccgtgtcgctgtcctaaatgactttctttactaagtgtagagggagtacacatatatgtacgttgaattatattgattggagacattattatgtactccatctgtttccaaatgtttaacgctggttgattctattttgatctagtcaactagtactacataaaaaaggaaattggagggagtagtgtgtctgcatgtgtgatcactagcgagctgtatatataagtcaccttcataaaaaagtgcatgtctatttcgtgaaaacatttttacgcaattgaggtcctctgctgatagatgggtccgagaggctgtagaacccgcgtgtcagtgagcagtactacatatctgcatctatttttatgctcttccttttttctaatcaaaataattaatacaacagtttatacggtagaacatattttgatagacaaagtagcatctaaacttttaccgacagataattgtcctctttttagtgttgtggtatagcgctagttaaccacctctatcatactagtacattttatatacaccttgatcacacactttcatagttttatcaagctaaacctctcccaaaatacctcctaattaagcaccatagaaaaacccaaaatcttatcttaaaaataatttctgaaacaaaacacctgccatgcatgttgaccatgtaaaatgcgccgcggcggagtgggtgaagattctaacctgacggtgccgtgtgcctctatcaaaccacgagaagccaaccagtaaggagtactccaacaccacaattatttttagttttgatatttgctttatgccaaggacccagtgtccttgctaaaatcgtttgtatcgtagtgtttttttctatgaaagattgttactttttttttcacccctgtaaatacacacgcatatcctattgatacgagagtgttcgaaagataaggctgacatactttgagattaaaggagttatcacggtgactcattgttgatgaatacgttgcctaccactgaatgaaaaataatagtaagtttagaactagaatcaagtgagtaggtttaatcataaaaaaatctaaccagttgagctaattttatctcgtggaaagttgttattttctatagccaaatacgatatattttattgtctcggtcatatatatgcaagcagtaccaatttttttcctaaaaagatgttagcatatattttttcaacttcttatatatggatttttggtaattaagataaatgaaattgataataattataaccttggtaaattactagtaattacttcctccgtttcacaatgtaagtcattcttacatttcccacgttcatattgatttaatgaatctagatagatatatatgtctagattcatcaacatcaatatgaatgtgggaaatgctaaaatgacttacattgtgaaacggagggaatagttaattgatcgtcatttattttggtattaaaaagaggttgtccatgttatgcgaagacgatgataggtagctagggccaaatgcatgtcaacatcgatggcttttggactataaagatgtgaatgcgacgcttgtggtgagcggtcaattggtgggagtgggatggcttcttttgcccaatcattcacattcatcttggtgttccattgtatgtgtatgtatgtcctaacctgacaaaatatatcacattaataatttgaatataacaaaaatatgacgtatactatagactcggaaagatttacgatattttgtgttgtgatgtgaaagtgagtgtttgaaaaggtaagagaatatatacagatagatcgaatcccatcggtagcctagcttttttaccacaaaagttatattagtgtgggatcgaataataacttaagtatacctccttttctatatagtttgttatatcaaaaggataggcaggtaacaatactaagaattatgtaagagaataaattagattagaataaaaagaagagattatgtgatgggtgtcattttcgtgatgaaaggatatgtaagtggaggatgtgcgcggaagaaaaatatatggaggatgcaattggttgatagtatggattgccaggtggatacgcaagaagatggatgtaggcaacaaagaggatgcgccaccggctaattccattccaaggatgaatgatggaccctggataagtggtctggtcaatcatgattcactaatactactagtaccacttaacaaaccaaagaaaatacaaatttttaaattttaaatttaattttaaagttgatttgaagatattttcaatatagtttcttttaagtattggcttttaaatcgctaaaaatacatatataaaagttttacatgtaaattagtttttattctttaataagcggttttggtttattagaaaatatgggcaatcaataaggaccttaaattttaagctactcttttcatcctaaaataaatagacaaaatgcgagatattttttttagatttatagcatttgaatgtgtcgcattgttttattttagaatgggtggatgatgtatttagatataagctacaccgataacaaactgctagtttgagaagacgaaactatttaaagatgccatccattgtgcagttgcagcgatggttgccggttaatagcgagatatttaaccatttgccacatttagatgtgttaattaactttttttcactggacccacacgtcatagacatatgtggacccacgtgtcattgaaataggggtggcaaatagttatttgccaaatctaaaagtggcaaatagttaaaatccccgttaatagctactccaagttgatagtactatatctttctgctacactaaacttgatcatggtggggcccagaaagatttagtgttaagctactactgatcgagcaagcaggaattttttgattattcggtttggactttggactaacaagaaagaaaaagacaaaagatgcttatccgtgaaaaggcccctttgacaggtgactcaaaagcaaacctttccctctcctttctactggccttttatttctccttttttgttaatttccttccgacagaaactaatttctcctcttttaaattaaatttggttggggtcacctagcctccaatcgactcgtgtcgaccagccactcataaacaataactagctaatacgttctctggatcttctctctcaaaggttatgttgccgctatatatttacaggttggattattacttttatatgcttctatacctagatcaatgccaataaaaagcactcaaggtgagcatacctggttttgtcgtattctgtcctacccattcttatcttgtatatatagatgcttatctcaactttttggtgggtttttttggcatgtgataattattaacaaggcaatggttttgatatatcttaaaatgttacaaaggttttatcctccttttgtagaattttggatcgcagcaaatggtttatttctattttagctgtcaacataatgttagtctagtttcactagccccgtccaaaatatagcttgagttctcaacaaacttattaatagcctacgataaaaaagtgtcactcttctagttaagggcctatagtaaggacctagtgagttccaaattccctaactttaatctaggtacgacaacatacggttgaaaagtcataactggacaattaacaaaagagaaaacgtgttgtagatcagactattgggaacaatttaatctgctttcaagccattgttatggttacgacttataaaccaaagtcaacacttctacttttaacaaaccaaaaaggctaggttaaaaaatagaaagcgacaaaaaaaacccttaaatcaattttgaaattcaaaactggttgagttttcttttgttaaaactcagaaaatatattaattactcctaaatttcattattttttcttacaagggtaaggttgatgttaaaagtggtttgccaaatgttaggaaacatttatcaaccgtgctaagaaaataagaaaatgagagagcattctatacttataactggtgatgtactcatgtccacatcgtgaattaattttatacatagtgtgtgtttagttcctgaaaaaagttggaagtttgaagaaagttgagagtttagaaaaaaaaagttgaaagtttatgtgtgtagaaaagtttttgatgtgatatgatgtgatggaaagttgggaatagagggaaactaaacacggccatagagagcaacgtggttcattgcacgcacaaaggatccaacttctcattttgtcttgagagtgtcacttgttggttgggccacagcccacatgatgcatagtgctgccaagtggacgtactcactctccatctctcatcgccggatccatcgatctaaccctctctctgccaaaccttgagtattgctctacgcactcgtgtagcacatggaaaaactatattggctctgttataaaatatgaagatttctgaattttacaccgtgattaagaatatttgtgagtatttgtgattgattcacataagaaaataggtggagaaattaaataagtgtattattatgattgattgagaagagaaaatatgtgtacaatggacacattttgaccgccaaaagttataatacaaagggagcaatagatgtgctggtttatagttggatcagaaattgggtcaaatgatatacattaattcatatagcactatcacataggcactacaatgagaacaaggactatttgtagtatgcagtagtggtttaaatggtttaaatggcgtgatggtggtctaaaagtatatgggcattgggcaagactgttgtcaccatcatttccaaagttttgaaaaaaaaagataaacttttgcttagatagatttcaaaatagaaaaaaaaaacagaacatgatgtgcagctgtcgaataaaagaaaaaaggtacacggaatatagctttagcgaaaatagcagctccattgtttggtcttcagtcatagccaaaatttgagtcttaaaacttagttttaaagttacttttggtgtttttttattgtagtctatttttcagtattagtttataagccgctaaaaacacaagtataaaaagttttatttataattattaatattatttgttaataagcgttatgatttataattagatgtctatcccatgacaaagttaaaatctcgctgaccttttttttactgaggatctttcatgagaaaagaacaatgatgcatgcattcatccaggggaaaggaagaacacaagcagcatagcaacagtagattgactatagttgagcacaacagtaagctgttgataaccaagagaagaatctacactgcactccacttgtcttgtgctatgttgccaatgtgtgcactgtgaagaagaagcactcaccaaacttgtccactcctccactcccagcaatagtatttatggtggcccctcaccagcacaggggcgcggatcaggaaagattaacaggagggtctgaataaaatatataaaattatagccacctcttctaatagatgtatgacagaaaattttagtgaggtcttcgtgaggtcttccatgattacaacataggtagtggggtcgtagtgaggtctcgagaccctagagatcccacggtggatccgccactgccagcacatcacctgatttgcactgcactgctcttgctttccccctcctgttgaagttgcagagtacagcagcagcagcagcatatctatctacctattccttcttactcctcactttatactccacttatttgtcaaatctttatttttctactatactatttctcttttcaagggaaaagaaaagaaagaagaatatatgttgagcagtgagagagatttggaggtataaagagacagacaccaacctcctccatcttcaatcccttccttccttccattttattttcttttattttcccaacaaagagaaaagagggtgaggagcctccatccgcgaaaagcaactccacccgacaacctgccccatgcactttccgttattctcatttcacccctcgcaattttacactccgccccccatgccctctcaaaactaattacaatccagtccttcaccggtcagcgatgcccactccggtggccgccgcgaggcagtgcctctcgccggccgccgtccccgccctcgacgccgccgtcgcctccgctcgccgccgcgcccacgcccagactacctccctccacctcatctcctccctcctcgccccgcccgcacctcccctcctccgcgacgccctcgcccgcgcccgcagcgccgcctactccccacgcgtccagctcaaggccctcgacctctgcttcgccgtctccctcgacaggctcccctccgtctccgcctcctcctcctctggcgccgccgacgagccccccgtctccaactccctcatggccgccatcaagcgctcccaggccaaccagcgccgcaacccggacaccttccacttctaccaccaggccgccaccgcccagacccccgccgccgtcaaggtcgagctctcccacctcgtcctcgccatcctcgatgaccccgtcgtcagccgcgtcttcgccgaggccggattccgcagcggggacatcaagctcgccatcctccgcccggctccgcccatgccgctcctcggccgcctacccacgcgcacccgcccgcctcctctcttcctctgcagcttcgccgccgcggacgacgccgacgtcccttcgcctgcggggaacctcgcgggcgcgggggaggagaactgccgccgcatcgccgagatcctctcccgcggccgcaaccccatgctcgtcggcgtcggggccgcctccgccgcggacgacttcgcggccgcctccccgtatcgtatcatccatgtcgaccccaacaccatcgaccgctcagacctcggcgtggcggcggcaatggccagcgccacctccggcctcatcataagcatcggagacctcaagcagctggtccccgatgaggacgcggaggcgcaggagaatgggcggcgggtggtggcggaggtgacgcgagtgctggaggcgcacagcaaggtcggccgcgtctgggtgatggggtggtcggcaacgtacgagacctacctcgccttcctctccaaattccccttggtcgacaaggattgggacctccagctgctgccaatcaccgcggtgcatgctgcccctgccgccgccggccctgctgctgctggtggactcatgcctccggcaaccactgttgctgccttctccaagccagctgcaaggtcaagcctcttctcttctcttctcttcacttttgtatccacgaattctttatgcataagatttttattaccatccatttgctgactgccgtgagttaaatgtcccccctttctttattgtcagaatgtttcttggatagtagtgtatctgattaggtgtgctagtacgatttgcttatgttctttactaatttcattttcttaagtgttgatttgtgtgctttgcccattgtagtatggatatttttttcaacttgtgcaattgatttagtgtactactgtaattagaagcagcataggtagctaaaaatacataaatctagaaaggtttgttttcttccactgcattttttaaaaaatgtttttacacggtcaatgatgtacaaccgtttttgtttaatgcgatggtttagttactatgttctaagttccatgttactcctgttatgttctatgttcagtcctgttaggtgcgacaagagttgctggatattttctcttctcggaagtgggttccaatttgttgtcatcagaaccttccagaccaacttccttttagatgctctgctgttagtcactacctgtgttatttactgatttctcagctcttttttattttttgcctttaggatatttaatgggattttcttcttataagccttttctctgtagtcctattcttgtaatattttggattttattactacatatgtgtggccatgaaggagaggttctatagccagtgcagaatccatataatgcacatttcaaactgcttgataaagagagactaaagtgtaaaagtaaaataatatggcttgtgtactaagagatgcaatttcatggtaaaagagtggtgcttctgctgcagcacatctgttctttactgttgtaatgctcaaattgctgatagtttgggtcatatatgtgggcagagattatttgtcattaatatgtagtatcacctataatgaattaccttgatgcatagggctatgtgtggcctatataccaatgaactccactgcttccatgctttgttctaccttgtagcctgatctccttggtagggtctttctgtatatcaaaatcgcagcaatatcctgaaattattgaatcaaggattgtttgatttgaactgctttcagttatgtttacaaatatgtcccaccagaattttgcaacactcttctgatttctgtcacagcatagtattgtatggcattttattcagctgtagaaatgttagtgcttaagcattgcaggtattaatgacaaagtgacatatgcataactccaatataaagcaaagatatgcttgtgccttgacctcatagtttcaaacttgttattgcagcttgatggactcctttgttccttttggaggctttctctgtgataactacgaagagaacagcctgacagcaaattcatgcccacaggccctgcggtgccagcagtgcaatgataaatatgagcaagaagttgcaactatcattagcgcaagtggcattacagctgaagaccatcaccagggaggtcttccttcactgctgcagaatggcagcatgatgggtcctaacaatggatttgatccagtcaaggtgtgaagctacctatgtcttttggaacatttatgttaagtactgaacgcagcaagcactgcttgttgatagatgaataatttttggtcgttggtataaaagatgcacagttttttttcagtgcaggttagagatgatcggatggtattgaattcaaaaatattgaatctacagaagaagtggaacgagtactgcctgcggctccaccaagactgccagaggatcaacagagatccttacaaaccatttccacgctatattggtgttcccgctgacaaagaaagatcagcaaatccaagcaaaggttctgagtcaattggggttcaaaaggatgttattaaaccttgtgcagtgtctgctgtacattccagctcaactgcaaggcctatttcatctccatctgtcaccaacaaaagaaatgaagatcttgtattgaaccttcaagccaggcattccaagagtgatgaaaaccttcaagaaaggggcatgcaatcccaacatggcaccctgtcgaatgctgacaatccggatgatcatgcctcaccatcatctgctgcacctgtggagactgacttggttttgtgcacccctcgagattgtagttcgaaaggttcaagttccacctgcagtaaacgtgtagaggattcagagaggtctgtccatctggtacccaagaaggtggatgatttaaatctgaagcatccacaactctctgttcaacctaactcttgctcctggagttccataaatgttgggaaaacatcacacagtacactacactcagtagcttcaggaggcttctctgcctttggccaatggcagaaacggtcaccccttgctgcacaaaattctgatctgagcaattacaagctacttgtcgaacgcctgttcaaggtagttggaaggcaggaggaagccgtgagtgctatttgtgaatccattgtgcggtgccggtcaacagagtcgcgccgtggtcctagcaggaatgacatctggttgtgttttcatggttctgacagcatggccaagaagagaatcgccgtggcacttgcagagctcatgcacggcagcaaagagaacttgatttatctggacctaaaccttcaggattgggatgactccagtttcagagggaagactggcatagactgcattgtggagcagttgagcaagaaacggcgatctgttctcttccttgacaacattgatagagctgactgccttgttcaggatagtctgtctgatgctattaagtctggcaggttccaggacatgcgaggcaaggtggttgacattaatgactcgattgtggttttgtcaagaagcatgatacatggcagcaaaaatgggttggaagagggcctttcattttctgaagaaaagattctggcaactcgcggacatcgactgaagatcctggttgaaccgggtagggcaatcaccagtggatgccctagtggtaaggtggtagtttccccaaggcattttctcaccaaaattcaagcatctttgtgctctggttcaatcagcaagagaaagctcagcatgtctgatgaccaggaaaagctacaagagtcgccaagcagtttgaagcgactgcatagaacatcgagtataccgttcgacctgaacctccctgttgatgaggatgaaccctttgatgctgatgacgacagtagtagccatgaaaactcatatggcaacacagaaaaatccattgatgcccttttgcattcagttgatggatcaatcaattttaagccgtttgactttgataaacttgcggatgacatgctgcaggagttcagcaacatactcaggaaaaatctgggtgctgagtgcatgttggagattgatgttggtgcaatggagcaaatacttgccgcagcatggaaatcagaggacaagggccctgtgcagacctggctggagcaggtttttgccaggagccttgacgagctgaagctcaaatataagcatgtgagtagctctacccttagactagtgccctgtgaggacacattaccaacagtgaaaggagatggtttaggagttttgctcccaccaagaataattctagattgttgatgatattatctgtatagggatcgctgtaattatctgtagtccacaatagtatagcattatttgttggctaaataagctctagtctagctgatgcattgccttgggttctctaattagctactgccagtactgtcatatcattttctacctcagggccttttccagatatatgggcatccgaatgtatattggttgtaactactatggattgtcaatatttgattgttctatatatacatggacacatggtgctcggtcagtgtacttgtgtggttcatgctgaaatccacaactgcaaggttgcttacatattttgttggccaacttgtatatgtgctctcatctcgtcttgatttgtggcaggagttgattgctactccaataactacgtttttattattcctgaatgatgctatcatgtacggtagggtgccgatgatattatagagaccttatagttagttgttcaatggtccatagaaagttgcatggcagcatagtacttgatgcgcctacttgcattagaagcgaactcgaattggatgctagtagtagcagatttgtgatttgctagactccaatgcagaagattccaaacaatctgatggatgcatccgtagtcactcacactaatcagtatcaacaaaagatgaactaggctgtgaaatcccaatagtagttcagttttgatcatcatgattatgcaaataaactccattgtgagtgattcagtatggaaaaattaaggtgcagagcttaattcggatcataattgtctgctcaatggcacatacaaactccagacattgaattgcctggcaaactccaaagggttacacggtataacttggacactttcagaactaatcaaaactgaacgacccgctagctacaacaacaattggacaatgcttgtttagtgatctgaatatggtgatccaacagatcaatgaatccctgtgttctgcagggccgcatgcttttgagcaggtaagtagcccttgctgcttattatttctctttctttcagcagttcatgctatgatggatatgctatctatcaggaaaacaatccattcttcacttactaagctactagtacacggtgactccaataattttcaagttaatttttcacttgtgcttagcatcttcggcccagtcagtgccgttcaagctgtgatctgtttggtagtaaacaacatccccgacgtcgctgacaaagtgatcaactctcaagctcctcagcagaacgccaaacaggtgaagtggcagcggacctgacttctctggctccctgtagtatctgcccagcactggccttgctgcctttgtctgtttttttgttcccatcaaaacaaggcaattgtttcagtactcagtgaacttggtaacagtgcaccgtacatacatactatctagcagaggtgaataatgctggcagtgtacttactgcttctacgaggtgataatgaggaatttgggggaaaaggtggtggatgacatgggtgccaatgtcatggtggatgttgttgatccacccgtagtcccgatccaccgttgtcaggccaccgcggaggtagctccattcctgcaaatagtggtcattgccagatgttcagccctattttcagtgtttgtaagcagaacttaatgaagtatagagtgagaggaagtatagagtgctcataggctgcacccaactcaataacctacagcaacttttcatgctttattctggaaaaactatgatccaatcaatacagaaaaaagatatacctctccacgataccagggaaggtcattgtgaccgtggtggtgcagataagtcaccaaatcaagccacatcacgaatacctgttttgaatgcagacaacgcatatcagatatctagcttttgggtacagtttcagttagatatcccataaatatgatggagtttcttagaagcaaaagcagaggattaatagtgaatagtgtatcttacaagatatgggacaccgtatagcatgagcaccggaacagacccaaacacgcacgccaaggcgacgagcaacgaaatcatgatgcaccagcaggtggtggagacaatcacgtcactcttctccttggggctgaacagatcgctgctcggcagaaagtgagatccggtcttgcccggacttctgtaccactgcagcacattcaagcatccgtatagaagattcagttgtctttctttcttttggggatacagattcagttcggtttcagttgagtcattcattcagcacaattgcgtggagttgccgggtgaggaggacattcagagacttacgaggtagacagggaaggcaagcaatggaaatggtaatgtaaagcgcagtttcttggtgcgcgtctccagcttccggtacaatttctcggtgatctgctcaaacaaattgcaaaagcatatataaaaatttaagcagattatagagtacgtatctatatgttgagagccagcttatatacaggtgacaagcaaaaaactcattcagcctctcgttattttcttattcagtcaataaagctgagcagatgcttatgctaccctggcggccttattcaaatgaacctacaacttaattagcatatatatatatatatatatatgttatgaatcaaatcacgtgatgtgtaatatgatattcgatctgacgctgagctacggatcaaaaagtgatccgattcgcatctgggatccctggtgaataatttagcagcaaaggcacgtgagccagatctactgtctcaatcttgttggtattactattcacggaccacaaaggaaggctgatattttgcaacaagcagggtggatcgttgtggtctgctgcagtggtcatgtgcccttctctccatctgcattattattaatgcaattgcaggtgagcatgtcgcataatacttactgttcgtttggctgtcctgtcctttcccgtcctgccaaacgccccagttggacacgctagcgaagaatacggagtatatttgcgaaagtcatatatacagttttggtactatatatgatagtagtagtaccgcgaattaagcaaatgtaattggtgtatctttttcaaaagggttgtaattgttgtacgggcgatggattgagacaagcataattaaggatagtactaggagtggaatgaagttgagaagtgcaagcaattgtaggatgggcgagagatgagaagaaattagtaagagaggaggtgatctgaaggagtgacaaaccgggtgccaggactcgtccttctcgatatgaccgtggttctgatggtgtgttctgtggctgattctcctgcatatgacattaataatatcagtcagatgctcagatcggatgggtcaacgagatgaattaccatagcagtgatggtccaagatgctatggtaaaccaagactagcattgcctaattgcacatacagtatcatgtgaagagattctggatttgacaggacaggctagttccacgtatataggatggagacccgaatatgtgctgttttttcaacttgctttgcctgcatctatgcttttgccgtgtgccgcgcgtgtggtaaagcaaaaactttttagtttctaactaattaactggtttcagagcattaatttggtaggtgtgcaatagaagtaggtaggtgaaatatatatatatatatatatatatatatatatatatatattctgtttgtgcatgcaactcgtgtgattttgaaaattgatatacatgcatgtatgctatagagagagagagagagagagagagagtataggaggagttggtaccatccatggtaggggacgaggatgaaggagtgcaggaggtggccgacgacgttgttgagcatggcgctgtcggagaagctcccgtgcccactgtgtttgcatgcattttcaatttgtttttcatggagatctcgatggattgatgcatatatgcatatatgagaaaagaaatggaagcgatgaatgaatgaatagaaattaccagtcgtggccgaggacgaagagcgcccagaacatggtgccctgcgccgcccagtagagcggccaggccgcccaggcgacggagacgtcaatccgagtggcggctgcggcgaagagggcggcgacgatgaggaggtcgcgggcgacgtaggagagggagcggaggggggtcttgcgccagcagtgggcggggatggcggcgcggacgtcgccgatgcggaagggcgggggcttggcggcgtcgaagaagagacgggcgtcctcggaagccttgcagtccgcctcctgggtcgccgacgccgccattgccgccgccgtgtcgtggtggatctgattccgatttgtgatttgtgaagcgcaggcagcgaggcgaggcgaggcggaaagggagaagagacaagaaagagaaatttgaggggaggtgtttggtttgtgcctgcgaacgcgaatgcgatggatgggccgcaacgcaaccaaacccaacccaacccagaaaccaagctcctcctcctcctgtgttgccttctgccccctttgcgttgctttgctatctatttataggcctcctttgctctgctcctttcttcccatttcatcaccacaccacacgcttagcctatgtatgcatgctgccttaccttttaggattctcttgcatcctcaattaggccttgtttcgttccttttttttttcctcaaaaatatcacatcgaatctttgaatatatacatggagcattaaatatagataaaataaaaaactaattgcacagcttacatggaaatcgcgatacggatcttttgagactaattaatccatgattagtcatatgtgctacagtacccaacatgtgctaatggcggattaattaggcttaataaattcgtctcgcggtttccaggcgagttatgaaattagtttttttcattcgtgtccaaaaaccccttccgatatctggtcaaacgttcaatgtgacacctaaaaatttgctttttgcaaactaaacaagaaat

SEQ ID NO: 68236 - DNA, 771 bp, Oryza sativa
agctgttaaaacagttttcctctgtttgttctcttctcacgcgttctacgctacgcgggaggcatataaatccggcaagcaagcgaccactcccacgccacgcgccgctctcactcggtcactctcactcttcatttcgtcgaacacctttgcctcacaaccaccccccatggccgaccgcgtccaccccatgcccgctccaccgccgccgtcctcctcccctccgttggaacacgccgccgccgccacggagaccacgccgctgcaccccagcttccgcggcgcgcggccgccgtcgccgggcacgtacatcatccaaatccccaaggaccaggtcctccgcgtcccgccgccagaccgcgcgcgccgctacaaaaagctcgcggcgaggcccgcacgccgccgccggctccgccacgcgtgctgcgccgccttctgcgcggccctcctcctgctcctcctcgccgccgccttcgtcggcgccgtctacctcgtcttccgcccccgcgcgccgtccttctccgtcgcctccctctccatccgcggactcgacgccctcgccgtgtcatcgttgactccgcagatcgacgccgccgtgcgcgcggacaacggcgccaacaagaagaccggcatcgactaccgcggcggcggggaggtgaccgtctcctacgccggcgagcggctcgccgccgggccgtggcccgcgttccaccaggcgccgaggaacgtgacggtgttctcgacggcgttggccggaggaggcgtgagctt

SEQ ID NO: 68237 - DNA, 11244 bp, Oryza sativa
gtctcgcaatttcccccctaactgtgtaattagtttttttaatttatctatatttaatactctatacatgcgtccaaagattcgatgttatgcttttgggaaaaaaagtttctgaactaaacaggcctaaagtctttttgccttacccatctctaattctatattctatatttctagatccatcgatgtgatgtaacatgttgaaaaatgcatatagcagtatgaaacaattgtaagatggtatgtacgcatagaagtattcaaatacaacacagctggttttttgaactgcgccaccggatttgcctcccaatactactcatgctggtggaggaattacatatactaaattacttacttgccgtttaaacagtggttggtgaatgaatctaccggattcccttcaagcagcaggggtggatctagcgtgaaggcagcggaggctcgagctttcactactggcaattggatcacgggagccctaattaatgaagtttgcactaattttcttttgtcatacatatatgatacatataaagggagggctatatatagttttatctagttattttttaaagattccttactattttttcttggatccttcacaatcacgtcaaactatagtagatttatggagcaacttggcatgttaattacacgtcaaaaccgtgcactagatgatgatgagtagccgttgtgcattttattttgatatattctagggacaataatgcgtgcatcccatggattttttttgaagtagttcgagctggaactaacgaatatgaaataatctccgttgggggcaaatgaataatactacctcgattaaatatcttgtttaacttatgatgtgtttcatttgcaccctgcacctttgggccgtcgcttataaagttataattaagagtttaatccattctacgtttgtcattgcaaagcacatgtcctacgatatatcactgataaagctcaattctataatatactattttgtcattgtgtggttagtcaatcattaatcaaactccgtttaaagagaaaatgacaattttacgaagggtaaaaatgagattctgcacaacgccgtgacttgtgaaataattttggatgataaaataaacaagcaattctatttttcgcgaatgagaaaaaaatatcccaataaatgaaatccatacgtaaacatggtactctaagagaaatgataattttctaccttaacagagttgactagcagttaataactaacagtggtggcatatatgaaagaaaacgaattgcttgatagtatatcatagaattctgcttcatcaatggcacatcctataattcatactttatcgatggcatatagtggattaaatcattaattaaactaaacaagtaataggccttaaatagctgaactgtacaatatattaaacatttcaatattctctttatgttcttactagtgtacggcaaaatacctggtttaattaccgcaccggatatattaacccggtagaactgaaaaaataaaatatgccacatgaattgaaaataattcatggcaataacctatttttattttcatgtgagttttctaccctcatactgtagactttgatcaaatattgtgtcaaacactacaattttgttttgaatagatacattatgccaaaaaaaaaattcagattttaaattaaagtgctttcataaaatgttggtagtatatatacgattaatattaaaatattctatgaaaatttaatgaccaaagtttatttctcaaaattaaaataaaaacaaaaggaaggtggtggttatgatatcgagctagctagctaggggacaaacgtattgcagatttgcaatgaaaaaaccattatattcaaatatttccatattatcaaatagaagactggcatgtataactaatcagtcgtgcatcacatatatagtatcccaaaacgcactccaatgataagatagaatcatagttgactaacccctacacgatgaatgattgtttaaataatgccccgtttacttgcaacaaacagttgactactttgtcactccattcttttacacaatttgtgcttatccatttactggagatgtctgttcacaattattgccagctaggatatgagagtgtacttgcattgtctgtttttttctaaggaagagtgacatagttattgcaacatagatcatattccttagatcatattcctttctgcttattcgttctattattactgtggattatttatttcatgttttttaaaacaaaatatttttactatattaattataccacttattctaaaccatataataacacgacagtcttcactattatatacccttattataataatccaataaaacaacatcatctttcccctcttgcatacactcttatgtaatgaaataatgaaagagcctcatcatcatacatatttaacacaatacaaacatagacacatatatacatatgtgcatttataacttatccatataaatgcacacatgtgtgcatactcattcctgtaaacgtacacacgcatactttactcctatatgaacctatccaaaaggcttgatcaccatatccttatcagcagagactaacccgcggagccataaatacaacaaaattgaaaccgattaatttctagataagattgacctgatttctttcaagtccaatcaactcccagttaacagatggtacttaactattcgatatccctcctcctgcatgcatcacgcatatggatgatcgatggcaacgtcgatcgttgtgtagcgtttggacccgtcgaccgggttggcgacgcccccggtcatccccggccgcatacaccgtcctctcctctccggctctccgtatccacgacacgccgccccgccccgctgacgcacgcccccggccttatgctagctagctagtagtacaatatagtatatggcaatccgccatgcaaacacatatacgtcggcaagctagagcctgtagctaagctactccctctgctccatccgtattagttactaatttatatggtactttaggtttatcaaatagaatttaattaagtttgtagaaaatataacataacttctaataaaaataaattcactataaaacatatttagttatggatttagtggattaaatctatgtttgtagatgttgtcatgtttttttataagaggtgttctatgatattctctggtagaagtgtactgtttatttcttcttaatatagatgtcatgtatatttacgggggaatatccaatgaaaaccatcaaataagtaaaacccgtgaaaaccatatctaaaagttttgtaaattcataaaaaaattactagaggtaggtataggcatgaaatacattcataccagatctcaagtccaaacttaacttcatttgagagaaaaaaaaagacaaatttcgtatgaatagtgttatgttattattcacctcaaatttgtttttttgtttttcccaaatgaagttgagtttggacttgagatttggtatgaatgtactttatgtgtatacctatctcttataattttttcatgaatttaaaaacttttagatatggtttcacgggctttcacttatttgatggttttcaccggatatgtccccatatatttatactatcatatcaactactgatataaacgtagtagaatattttctttcattggtactacaacttagaaaataactaccaaaactatttctaagaccataatactggtataatatatagtaatacaagtagagtacttattatatcttaaagaagtttaattttaaaaaataaaaatacagtgtctaactacctagctgttgtatgctcacgagtatatacatggatccatttagcagagctacagctcttaaaaataacttcaagagcatacttagagtagaatttgtgaagcgcgccaaacccttgcttcacctagctctctagtttattttactgagatcagtaaagcctgctccacttctctcctttatatggatttaaaattgtttggttatgccacggctctagaaaagatggatctgaacctagatccggccatattatataggagtacgtagctagtactagcgtatacgtccttgccgcttagctcaaagtcgtcgccctcctccctctatttattcgccccacccctcgctcgagctcgctcgcacctttgccaccccccaccctcgatccagagacgcacgagccaaccttgctctcaaccgttaatttcctctctccacgactcgacgccgcacgacaaaccagcggaggcgctcgcgcgctcgccttctcctcgccctccatttgaacaaccccttcaattaactcctcctcgatcgctagctctctctctctcgttgcctcctcgatctccttgaatcgatcagcggcaaccagcctgatcgttgtttgctagttagttaatttccgtcgccgatgccgacgacgcctcgtcgcaaggagccatgaaccgctgcaccgacgtcgagatcaggaacgcgctgcgcctcctcgcgcccaagcccaccgaggacatgtcccgcctccaccaggcctacgaccgcggctagcttagcgagtagctgctactagcgttcataatcattctgtgttccatcgctcgagttcttgaacacgaagaggagcttagtagtttgtgtcagctgttagtttaatttgtgcatagttcgctgcgcgcggcgacgacgacgatgaaggaaggaggaggaggaggaggggagaggaggaacatcctggccaagacgatcgacaggtgccggtcgtcgctggggcaccggacaacgaggcgccccgcctccgccgccggcggcggcggctacggcggcgcggccgtgccggcggggttcttcgcggtgctggtggggccggagaaggagcggttcgcggtgcgggcgcggtgcgccaaccacccgctgttccgggctctgctggaccaggcggagacggagtacgggttcgccgggtgcgagggccccctcgagctcccctgcgacgtcgacgccttcatggacgtcatgtgggagatggagcaggccgaccccgccgcgtccccgcgctgcggcgcgcgcttcggcggtcccgccgccgccggcagcggcaggggctacgggggccacggccaccaccaccaacaccaggggtaccagatgatgagcaccccggcgaggctcctcgtcgccggccgctcgtgatcgatgtctcggcatctctcgcgacgccggccatcgccggcgatctcgtcgtgcccgtccttagttaatcaatttgctgtctgcttgtaagtactatagtaggcacgtgttgggcgcatgcagagagaggtttgttcacctgcttgcttgctttgctatgctatgactgtgatagggtaggggtgttcaagttcaactgttcatgtcaacgtttgtttccatgtcgcgttcgatgtatctctgtaatcgtagttttgtatgtgtgagtgatctcatgcgtgttcaaccaacccctaagtcgataaaagatcgatgcatgtacatgcatggtgttttgttcagtgttaactgtgaatcactatgaataaaaagactatagtgaatctcagttctgaatttcaactagttttactctatcttttgtggtgatgtgcgcccttttgcatctgatttcaagcaagctgccaaaaaaaaaactatttagaagctagctcttcatttgatgaatgcgtgcatcggttttttcttcttggatctcaaggtcaaccgtttggtgagcctccccggagtctgaactcgacaactcagcctcgaccaggagagactacgcaaaatgaaaggcttttcttgagctagccgtctcctactctgcttcgagagccaatagcaaaaaaaataatactaccaatatgaacaagtcaatatcacacgaaagtctaatctaaagacaacttgatccgtataaaatctgaagaccagttgatcatcttctgcggttgagttgggcctcgtgcatgaggcacaggttattctgacctgccacttgctgcccttggagatgctctggatttctaaaacggtagcaggacacaatcattgccattatgatacaataaaaatgacctcagcgttctctgtcctctacagaaatgtcagagacatcaacaaatcgtcatcgcaaacaagaggacaagtttgacaatgctcacagaaatacttctagcagggatctagtataaatggattcgggaaataagacaaggaattacaatatggcttggggcaagttgcggctgaggtcagattgcatgccgacctgaagaaaatccaggcctagcctgccgggattacatttccctgtgtacagtaatgatagcccacccaaccaaacaaccatgacgtctggacgccacaactcgacaggtgttaacttcagaggcatataagatggctacacaattatatcggcatcaactttttttgatggcaatatatctgcatcaatcaaacaattaaaaaaaggaacacaaatccaacataaagatgaatcagctcacatttaaatatgtgaaacagacaaattctcgatatacaatcagggttgaaggctggcactaacgttacagctacatacaccttgagtaaccctcgataccacttctggcaggtcaagccccatccaaacaggatgggacaatctagttctactgaacagcatgaaagagccaaaataaaaaatacagtacaatatggaaaactgcaagtgtactgctatacacccatttctgtacaatgtttgctgcactggtctatgtaagctggtcaaaatcagagatcaactatattatgtcaagttaactaatgtagtgataaacatcatctgacctctagaatccattggacaacatcctgaagcagctcgaacttttgactgaccgcaacatttaggaaaacccgcatcttgctgaggaattgcgatgattcttccttgcaccggaatgcacctccacaggagcactgctcagataagtgtgccgctttcacttgcctgcagcggaggcagaccaaatcctgcaagtgatagagcctctctcgctgacggactacctgtagaagtgcattttccatctgttcacgatggtatggctgcccgcactgcggcacagcacacctccactcctgaccttggagtgttgaatcacggcagagatcaagatcccgacaatcattgcaatagctgcaaacacgatgttgttacgtaagaattagtaacatcaagggttgatgaaaactagtgcttattcaccagcccaatacttacaaacttgtgaattttacgaattggaataagccatggtaggcaggtagtacaaaatagtagctagtacatgattacatatagtcaaaagcatgccatattttggaaaaaataattttgacctagtttattttccttcttccaaaacattaccatgttttcaataatattgttatccataactttctttgactcttaaaaaaatggcaatcaataatgcttttacagcaaatggcatcacctacacctgacctaagtgaatcggtcacagttgtatccatagacgtatgtttacatcttaaaatgttgattatatggaaatcaaataaacagtttctacaatttatcttagaggtaatacctgcaaatcacattggggagagtgaatgaggcacatggatcttggaactgtgcttctggagcaaactcctttacacgaactaactttaacaagttcttcctcattctctgtcagatatttttcaagtcaggtcgtggcacagttttcttagaatttagatacttcaattttgtaataaaaactgtcaaaaatcaaggcaggaaactcctatgttttgaagagatagaaatatgggtgtgaaaagatatacatgcagttccacaaaaccacaacatatattttgaacagtggatcctcatttagcacatcagtgaaagaaaatattatatttttggatacaagttctacagtaaaagcagttaccatcagttcacaatggattaagaggcgaattaccagaatatcatgctgaacattctgatcaagagcaagaacagcacatatatgcttaatgaactctaatgcagcatctcccttatgtgtgtgaggatcaggttctctgtttgtaagttcaactgattcggacttgccttttcctttgaaatgatgaagtatatcacttacaatcctgagaagcttgtctgcaaagtaattacttatctgcaatatcagatatggaattcagattaaagttgtgtatgttagtcgcactagatgataatcccagtcccaatgttaatatatactccctccgtcccaaaacataacaacttttagccttcaggacttgtcccaaaatataacttcttcaccaacattctctccgcaaccaatcacaaccctccaccattcaattttgccacctacctccacttctcatccaatcacattgtgtgtttaatggcgcttccccatgcttggccgatgtcctccgagacatcgctaatgagggcgctctttggtgcctagcaggagctgctaggcttcgtgatctctttactaggacttggctgctattgcactagtttgtgtttttttttcctttgggtgtatggtattctgttgtatccttgatgggtgggtgtcagagtttttctctaacaccgtacaccttttcttctctatcttaatgaagtgatacgcagatctcctgcatgttctaaaaaaaaccatgtccaaccctaaaaatccttatattctaggacggaggtagtatatactttgacattgagcaacatgcatttcaaatttgaactttttaacagactattaagattgaccttggatagtttcatcataacccatcatatatatttcttataacctttgactaacaaattgttataaaaactatctgaattacccacactagatactgcagtatttacattttattttttatacaactctaattgctatgattgaaaatatatttcaactgaaacagatcagatgtcaaaatctgaccaattttcaaataatctagatttttctcctttttttttccaattgacataacagtttctaacctctcagaattgaatgtggtagctcctaccaagtcattttcatttaactgggagatggttactggttaccaatttaagattgcactatagagccacaaaatcacctgatcacggagatatcctatgacttgaacctcaaggttttcagcagccatgattgttatagatggtgtgcatgaggtctcatcccttgtagttgatcgaagagctacttgttctttcatgtatttccatggaacatacaaaaactccgatacaattaagacaaagtgatcctgaaatttttggaaggaaatgttacagaaaagtagcaaatactctaattccaggatagtcgccaaagttgcagtcagcaagcagaagcaaacaagtgttagaatgacttaaaaaaactgacttgtgtagctttaggcaggtattctgctatgttccagcttgagacgatgtcgatatcgttatcaccatctgagctgccctcagatgttgcattttgcattttagcctgaataccaccatagttatactgaaccaaaacaaaatatggaaggtgaaaacatactctataagggcaaaatgaataaaacaattcatttgtggcagcaacgaaatgaacaaacctggtccatgaaaagtaaggagtgccaataatgcaaaggttccagctccacccactcaaaaatatccctaaaacaaataactttagtttcacctaagagataccccattcaaatttgcagggggaggtcaaacagtaccttgtctgcaatgttttcagtaagctatcacagtatgcacgtgctgacaacaggtcaacttttccagtatctattattatcttagaaaagttcgcaaagatgacattagctccaagctttcgaaactctgccaacatgagagcaaagaccttcttcatgacctgattaagtttgataatccaaaagagaagacatgataagaaaagttagacaagaaaactaataaaggtaagatgattatgaatagaaaaagatatttattgtaaccagaacgacaagaagattcgcaatatcaacaaaagaaaggacagtgcacttagttacatagcttacattatgaagaagatgatggagagctgggtcatgaagtttcgatcgtgggctgaaaaaacacacacatcaacatgctaagaacacataaagttaaaaaaaaaattcactccctctggtcatgaatacatttcatattcagtatcaacgcagtatccaaagtccaactttcataactaattgatattgtatacattcataaaacccaataaaatcataatatttttagagactaatctctagatatgatttttcgtgtttctagcttaaatatttaagatattgatactcaaagtttcaaaagtacagctgcatgtttgttcaaatggcatgcattttttactagagggaataataactggtccagtgcaaacacataaataattacctgcaaagccaacggtagagatgttgcaatattgcatcagcaaacacatttccagaagatactgcatctgaaatgcatcgctgaatgagttgcttcagcacttggaaagcaggtagacataaggtagcatcatcgaattcagtttcagtgccatttggaccagcaggcatgtcatttgcaaagctaccgatcggccctccttccatttcatctacttgactgctctttaggagagaattgacagccaaatgatggatctggggaagaaatatgtgcacatgtaattcaattgccagaagatacaaaataagcatgccatactttattgtatgttgaaaaggcttaccttaagctcaacagcaactcgtctatacgcaccaggataagtaagagcaggctggatgacctgtaaaattaagtcatatttagtaaagcagcacagaaacagtaaatgataagcaccatgcaaccttaggaaataaaggcttcttacttcatcagcaaagcaagtatctccttcatatgtgcctcctaaatcgggaataccatcgtcagatatccatagtaccta

SEQ ID NO: 68238 - DNA, 11739 bp, Oryza sativa
tcgtatttcccaagaaggcgagcgagaacgggcgggcgcgtggggcttacgtgtgacaccgcgaatcggaacagcagctcaccgcgacgcgtcgccacaccgttggctcttctgtttcgcccgcgggcggcggcgagcgctcgctacgctacgcggcgcccccactcctctgccctccatggcgctgacgcgtcgccatcgaggagaggaagccggcgacccgtcccatcacccaggtgaacgtgaacccatctccccatctgcctctcttcctttccttttccttgattggtctcgctttttcgtctcgaacgcccacggggacccccaaatttagcacgagcagctcaaccccacccaggttaccgctatgacggatggatggacatggatggacggatgatgaagaattttttttcgttacctggacgtcgaactcgacgtagtcgacggggaatcgggcggcctcgttgaacgacctgagcgagttctccttcacctcctgcatccgccggtcgggcgacgccagcgcgttcatccccttcccgcggtgcccgatcaccgcgaacctctgccccccgccgccgccgccgccgcccgccgcggcgctccgagcacccgccgcgtccacctctgctgcataaccaaggaaataactaacgccgccgcggcacggtgtctcgacgccacgcaatgaatattgaataatccgtacgtaccgaggatggcggaggtggcgggggcgccggcggcgaggacgtcgagcgccatggggacgtcggcgacgcgcgcggccttgagctgggccattatattcggaggatgtcctagctgcgcgcgtataggaggatcgtgggcgcaatgcaatgcaacaacgagacgtgacgcgacgcgacgcgacgcgaggaagcgggagccgagcctaatttataacaaggcgggggaaggggaaagggatcgagtgttgggtgtgggtcgttggagaaaggaaggaagcgggaatggggaatattcggggtggggatgcgttcgccatggccagccatcgcgcgcatttgccaatttgctgccaccgtccccgcggatcggatggtttatcctccaggatattccggtccaaaggcacgcacccgacgcagacagacgcttccctctgctgctacaactacgagaacgaaccaacgaacgaacacatcaggacagcgctgtttccgttttttcacctgtcctttctgccacgatttttccccttttccttttttaccctccgtgcctcgttttttctctttgaccgaggctgtgttctgtgttcatacagatgttaggtgaaaatttttgacgtgtcacatcagatatatgaacatatatttgaagtattaaatatagactaataataaaataaattatagattccgtctgtaaactgcgagataaatttattaagtctaattaatccatcattagcaaatgtttactgtagcaccacattgtcaaatcatggagcaattaggcttaaaaaatccgtctcgcaatttacacacaatctatgtaattatgtcttttttatattgaatactctatgcatgtgtctaaacattcaatgtcacatagtgaaaagtttttacgtgaaaactaacagagcccgagtcgacgttgtgcgttcgcgtacgtgcaatcgttcaaagccgccatcgtggcaatacaacttgacaagtggtgtcgtccagatggtttggaacagctggtgggtagtactagcttttaccacggcttcgcccgcccaatctgcagcgaactcctgcagcatccgcccgcgcaacgcgtgcgtgcgtctgtgccgttgcttgcgcgcgctcgtcgatcgccgctcgctgcctagctagccgttggtcgagtgtgtcaagtgatatcattcgtatcagccacatcatgcggatgcatcgatcgttctggtggttccgcttttcgtcgtcacttcgtatgcgattctgtttgtccaataaagaagaaatcgtgattctgttccacgacgggttaaaggataagacgattggtttattcctgctatacgtgatggacacgacagattcatcacgagagcacaaaggagcaccttcttttctcggttttatttaggctgaaccctgagaatatgtgcagaggagattgcaagtttcagtttatatatatatatatatatatatatatatatatatatatatatatatatataaaggggaagggttaattaagggagaaggaattaaagcttgcaagttgctactagagtagatattttcttctttcgtgtgtagctgaattcggtatttcagtgccgttttaatttgtttattgtccatgtggtagcaggagtgatcctcctttagtttagtgattatgtccaattgtccattgttggtagttgcatccgattctttatataaaaaaactgcattatactgaggggtcaatgctgctgtcagatcaacacgcgcgagaacgcaatatctcttggaaatagaatcacgagttcatttcatataaaagacgtgaattaatagcagcttattcctcaaaacagccatagcacgtacaaacagcactatttattttgaaaaaaaaaaaggagaaaaaggactagctggctgagaatggcttgggctaacactcgactaagtacagccgggttaattaatttgattaattaacgaggaaaattctttaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcagaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatccccatttcatgcaaataatcattttttattcagtcttacccctattaaatgtgcatgacacaccagtgaaacccccattgtgactggccttagaagacaagaactgctgatgacatggttgatttggttcgacacactaattgatcaacacttgcaactccccttcatttcatgactaatcctgtatatccagcatagcaacaacaaccttcctttttttctgaaaccacgtacggcaggacggagagagagacagagatcgactgataaagattacagaaaaggcagtttacagtaataattttacacgtcaacttaacaataaatcatcgtcaagtagtccaataatgggagacgcgtcacgcataaattcaggcaactaggccacaaatctcctgttactagtacttgtttaatccattattgcgcacacggccggttggttaactcgcatgactaagtggaatcacatgcatcagcgcattgtccattgcccctgatcgatatactgatctgaatatctgatgcccttgcttgtttggttggatctgatagtagtagaagatgaaatgcaggtgattgcaaattaggacgacggctcatgctgaggtgctcgtcttatcctgcatttgtttagcgacttggtcgatctcttaactttgactctctttttttttttagaactcttaactctgactcaccaccagcacagcagattgatccaacaagggggtgtttcgccaagacgccaagctagcaaggtataggtagcttcctgggctcctgtcctgtggtgtgccagtgccaggtcgatgcgcgctcgtgtctgtcgcctcctggcgtcgcattgactttggataaatggattatggatggatgccatcgcaaaaagcaaggacactagtaaaaggatggccttttctttagggagaggagagaaggtaagagatggcttttgattctgactgttcggtggtgagttggtcgatatcgatctagacatttggtgcgtgttttttcacatctacggtgtcgatgcatagctggtaactagttagatggcgccaaataatctacccatttcgtcatttcgctaaattaatcatgtctaatgttcaccattattgcttatccacgctacaaatgcaatgatagggctgtttttttttaagaacatgatagggctgttgagcctgtcttaatcttccagttggcacgacgaaaatgctgaggaaaaccttaccacgagaggagatatgtgaatttgtaagccatttgctcaatctgttgatagatctagaagacacaggggaggatcacgtgacgtggcggatgtacgaggaagaatattctctggtggttggacaggcaggagtgctggttttgccaagagctttgatgctgatggagtgatgagatggatataccgatagagtggttgctgcgtcggttccacgtcacttcaattcgtctgcatcacggcctcaaatacctgccaccgagcgaccttctctactcgccagtagttctttttgtttcttcctctcatgttttcctcaagcactcacaagttacaacctgcgtatggaagtgtttagttcccttcaaacatccaaaaatttcatcatatcaaatatttagacatatgcatgaagtattaaatgtggatgaaaaaaaaccaattacacagtttgcatataaattgcgaaacgaatcttttgagcctaattacgccatgatttgataatgtggtgctacaggccgtgtttagttctttggctaattttttttaagtatacggatacacatttgaagtattaaacatagactaataacaaaacaaattacagattccgcctgtaaactgcgagacgaatttattaagcctaattaatccatcattagaatatgtttattgtagcatcacattgtcaaatcatagcgcaactatgctcaaaagattcgtctcacaatttacatgcaaattgtgtaattgtttttttcgttcacatttaatgctttatgcatgtgtccaaacatttgatgtgatattttttgacaaatttttttaggatctaaatacacatacagtaaacatttactaatgacggattaattaggcgtaataaatttgtctcgcagtttacatgcaaaatctataatttattttattattagtatatgtttaatactttaaatatgtgtccgcatacttaaaataaaatttagcatatgaaactaaacaaggcccatatcaaaaaaaaagttacaacctgccattgtttgtacatgcgcgagcgcgacggtttagatagagagcgagcgtgaaataattgtgtaatatactacctccgttctagaataattacatttttaccattcaaattttattaaaaaaaatactccatccgtcctataatataagggattttaggtcaatatgtcacaatcccttatattatgggatggagggagtatttctaccaaagtgggatccaattttcctttaatcaagtttaataatagtaattagctgagtttattgtctcaatattacttttagtcaagtgtacgtacgaaatgtgtgtatgcagtgtcgttagtaaatagggttactgtgtttgttgctaatctgtctctattatcagcggatactcctctctattctttcctttcatcgtaaaaataaaaaaaacacaaagttaataaaaaaaataatactctcattcatgtgcatagagtttataccgtaaactttacacgcataaactttatacgcataaactttatctatagaaatattttatatataaaatatttgaatccggatttgaatttaaatcgtgtatgtaagcttttgacttataaacattcgctctacaaactttaggtggataaactttatatgtgtaaactttaggtgtataaacttactaaaagaggaaaatataaaatatttgaattcaaatttgaatttgaatcgggtatataaactttggcaaaatttgctacaggacacgcaaaaaacatgtaattagctgggagacaccatgaaaacgtgacatagctgatggacactacaaaaattatgtaattggctgtagaacactggtcgcattattttgttatttctgggtcaaaagaggtgagatattttcctaaatgaccagattacccccttctctttccttcgttttcacgtgcgtagtggggcgagggttcacggtcaaaatccctgaattcctcacttattagcgaaggctggctgcagctttgcttcgtcgtcctcctccaacagctcgccccagtaggcagcaggtcgccatcctcccgacgctagcgagcggcggcggcggcggccgcggaaccggcggcagcggtgtggctggagtagccggcgacggcgctccgtggcgcgacgacgacacaaaccgcgcgggcctcgcgaggctggagtggccaccggtgggctccccggctcttcggcgtgacgacgacgacgacgacgcgggcctcgcatggctggagtggccgccagtgactccgtgcctcttcggcgcgccgacgacaacgacgacacaagcctcccatccttgcggcttgcgtgtgactgtctcattctcctgtctctactttggattggatggactcaatgcttatcttctgatctagatcacatttctttaatttcgttgtttgaattcaaaatttgtttgaaaatttgttcgaaatttctgaaagatttccgaaatttcggaatttcgctgacccccgaaaatcttccccttctcgatagattgaaccctgcccaccacgcgccttcccagcaaaggagaaaacgaaggaaagagaagggcaatccgggcatttaggaaaatatcccacctcttttgacctagaaataataaaataatacaactagtgttctacagccaattatacattttttgtagcgtccatcagccgtgtcatgttttcgcggtgtctcccagctaattacacgttttttgtgtgtcctatggcaaattttgccataaacttttgacttataaacattcgcttcacaaactttaggtggataaactttagatgtgtaaactttaggtgtataaacttactaaaagaggaaaaaacgatcgctggcaacgatcgatcgcccgttagccttttcgatttagaaatgtaattattttggaacggaggtaagtaattttttttatgttgacccttatgtaaaagggaaatttaactatttgacactattaggtttgtcaattatccaaatacctcttttagatttagatttgctctctttttttttttttgcctctctaagatggtggcttcttatctttttaccacttctgcccatctgggatgccaacgtggcaatgtagtgtaaaaagcgacgtgggatgcacttgtcagtctcacaagtctcccttcctctctgcctccggcagtattaaaaatcgacgcggcaaccctctctttcccagcggcggcggcggtgcgacggctcgcggcagaggtaaaggaggagccaagtgacgccgcggtcaaggacgagcatttacacgctggatcggacgtgcgaagccgtgctcgcatcgtttgcgccaacggtggtcaaagtcctcgacgagtgcctctacagctacgagttggtgggtggcgccgccgtcgagacagagcagcgcaacgcggcctccctcgccagcacaccatgggaggaggagccaagcgccgccgcaaatccgacctccgcctcgccatgctccatggcaaccacggactccagtcggccgacgcggcgttcctccctccccagccaccctaagatgacgtgggcggctccgctgctgctgacaactctatcgctggaggcgctgagctcgccacgctcttccttggagaatccgctggtcggtactgacctacgccatctccgtctcccgtacttggctccctttcctactcctccgccgctgcagccaggaaagagagggctgccgcgtcaattttaattggcaaacctaatagtagcgaatagttaaatttccctatgtaaaaacttccatactagttaagtatcacataatactttcccattgtactaagacatagtatcatacttatatatcaaattatcaacaaagaattataagcaatattcaggttttatttggaactatactttcacaactttcacactctcgacttttgtgcgtatgcttctcaaactactcaacggtacttaattaatactgcgttaatatgttttctatgtggaaggtgaggttctcatccccttgattcgaaaatagtctaaggtacaattatgatggtgccccaataatatcacagtgctcacccgcatctcagacaactcagatgtgcaagcaaaacagttttaaaaaaagatgtgcaagcaaaagaaatatgaaaattatcctcaaaagagggggcaataacacatatgaaagaagcccgatactctcccatcaacgggctcactcataacgctatcatacggcctatccgtctcgctgacatgcagcccaaaccagcctacaagacctaatataccacgtgcgcgcgggagcctctcgcggagagggcttgcggcggcacggcccgtccagcgttcatgttcatggaagcacatcccgtccttattctgcgactgattaggattccgaaatccgagtcatctcaaattaatcaggctgccgggaaccctacaaaatcaaacgcccgaaattcgccgattattattcgtttattcgcggcacggcccgtccagcgttcatgttcatgtaagcacatcacatcttaattccgcgactgattaggattctgaaatccgagtcatctcaaggttaaccaggctgccgtgaaccctccaaaatcaaatgctcgaaatccaccaattattattcatttattcgcacgcaaatagggcaggtaggatgttagtaagtctgaacaagtgggataaatattgtgggtcaggaactggacacaaaaaaaaagtattttgggaactaaacaggttataagacagggactgagggtgagggacatagaagtgccggtgcaattgaaagctgaattgagaaaatctgaagtcaatttgaacacaggtatgtctaactcttttgccattttcaattcagttaatagagatgttttagttgatattgtcaatataagtaatattgtgttggagagaaatgagtgtgagattgagacaaatttgacagtcgtttgtgttagagaagaagcaaagctatgttgtttgctgcggaacagagtaagtgcaatgagcatctgagtttgttgagattagtgatgatgttgaagggatggttaaagaggaaggaggcaaggagaggattctgcagggaaggtggagtgatccaataaaaatcaaagactaaagaatacataggatctgagcagaaaaagaaggggaggaaaaaaaaagtaaatcatgagatttttttagaatgtgagagggattagggcgacaaagaaagcttagggagttaatttttgaacaaagaattgatatgatatgtttgcaagaaacaataaagggtttagggtttttgaggagatggctgaggggatggagtgctaatgtaaatagtgtccaaaagaagaggaagaaggaattggagaatgctttggtacagctggataagcagatgacagtggactttttgaaattgaatgaaaaatcagatatgagatggaaaaagaaggtggaaaacatttacattcaggtagcagattttggtgacagagaaaaaggagggggaaacttggattttacaaggagatggttaatacaccttttttccataagggctgcaaatcaaagaaaaaggaaaagccatattctttcttctctgcaagaagggatgttaatatcatagagctctcacaaattaaacagcacatctatgcatattataaggggttgtttggaaaagaaaaaagtagggaagttcatctaagtcctgaaatctggcaagataagctgagattgactggggaggaaaaagtttggatggttagacccttctctttagattaagtggacaatgtgatgaagactatgaaaaacaatacaactcctggccttgatggattccctatgggtttttataaacaagtgtggcctcatataagggttttagttaaagagatgtcagatgacttacacatggatgagctggacatagataggatcaattatggggtgatttctcttttgccaaaaatcagggatgcaaacacaatcaaacagtatagacccatcagtctaaaaaatgtgattcttaaaattcttacaaaggctatgaattttaggatgactgaagtggcaaacaaagtgattagttggtctcaaactgcctttatacctggaaggaatattttagaaggttgtgttattttacatgaggtgatgcttgagctgaaaattaaaagggatactgggattatcctcaaaattgactttgagaaggcttatgataggatgaaatgggattttttgtatgaggtcatggacaaaaagaattttgactccataatgatgggatggataaaaaagataacagaaggtgggagagtaagtattaacatcaatggtgacgccttacaggggtttgaggcaaggagaccccttgtctcctatccttttcaatcttgtgggtgacgccttggctgccattttggataaaaccaaacaaaggggagtccttgaaggtctggttccaaacttagtggatgggggtttgactcaccttcaatacacatttgcccttaagaattccgatgagaacatatttgcccttaagttattattctgctttgaagagatattagggatgaagattaattatcagaaaagtgatgtatatgtcataggggtggaggataatgagggattaagaattgctaatatgttgaactgtaagattggtatgatgcctttcacatacttgagtttgcctatgggggtttgtcacgtcctgataaattcatcctgaaataaaaatcattttctaaaaggaataatagaattaattaaaattcgaaaagaaattggtaaacactaaaatacgtgcaagaaaaattcgaatgtggcccggagaatttttgttaaattctctttggtctaaaaagagcactcaaattttacttgaattttcagagcaccggaaataattattaagcaacaacaacaattaagaaagtttattatatttaaaagaaagctaaaaataatcctccttcctcctttgggccgagttcagcccaaagtctttctctcctcccttgtccctcctctctcgggcctcctctcctccccggcccactccctcctcctctccttcccggcccactccctcctatcctcctcccgccttgacctgccctggcccaagccgagctgcagccctcccgcgcacacgcgccgcacgcgcgctgaccgcgcggaccggtgggtcccacccggtcgtcgtcctcctcccgcccagctcctcctctctctcccgtgaaccctagcgccgttcctccctcaaattcgccccattcaagccggctctttccaaattgattagggggaatgaatcccctttccttcctctctcattcc

SEQ ID NO: 68239 - DNA, 666 bp, Oryza sativa
tgtgccctaccaaatttttagcaatttgaattgtactttggctagtttttggtttgctaaaaaaataccaataataacacacatatagattgacaaaaaaaaattggcactaccaaaatttttctaggttttggtattttccatattaattttggcatggtagcaacggaaaaaactgaaaaaaaaagaagaccagggcacacactacactgatgaatcccctaatgatttttatcaaaatcattaagttaaggtagatacacatcttgtcatatgatcaaatggtttcgccaaaaatcaataatcagacaacaaaatgtgcgaactcgatattttacacgactctctttaccaattctgccccgaattacacttaaaacgactcaacagcttaacgttggcttgccacgccttacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatatccgtgagcaaaaacggcttatggtattgcgagcttccatcgcactaca

SEQ ID NO: 68240 - DNA, 1587 bp, Oryza sativa
taaagatcaaaatttttaaaaccgggactaaaaacaatctttagttccggttctttttggatccgggactattatggattttgccggaccgaccaaagatggtttctccccccagtggagttatataattttaattgaacatagtaatcacattttaattgtacatagtaatcaccctttgcaacgcacgcgcgtttgtaattaaagtcctatacaacaacacatttcatctaacagaaaggaactttacagatggtacaaagtcaatatgaccgtaggaagttatcatgtacccaagattcactagtttgctattgcaggcttacatgaagttatcatattacccttataaagtttatgaccttaggggcatattaaaacattttagtggtccccaagtaacatttgatgctactggtgagagcagttgacgtggttcccataacacttttctaaaatatatgctttgctggatggtacttttcctcaactccgatcgctcgagtcgaacacttgtgcctggacttaaaaactctcccatcttttagctcctcgtcacttcacttgtcttagccaaagaacctgctcaaacacaatgcctttagtgatgccaattcgagcaagtaatcttgttcgaacacattttccttggaacaggccttattgggcgaatgcaaatttttggtcagaaccggctacatattagaatttatttgagcaaagctcaaaaacactttcctcatcatgcgagtttttggccgagtataggggatggtgttcaccccctgctacaacagtaatggccagcgataactagagactgggatgcacataaacgtacagtatcagcacttaacgatggcattatcagtcttcggacacgcacatatctctaaactaattgtatggtgagaaaatcgaatgtaatccgagaagaaagatggcggcatatttatagcaattccgaaaataaaaaggttcagtttttagtacaatgaaaaatcctcttgagacagacaggccagcattttttttgttgaattgtcgtgtatttatttggtttgcttcatcttaacctgaatttattggagtccaatccaagtgcttttatttgtgggcgtcgtcgtcctcctcggcgggagtccaaccgtgccggcgcagggcgtcgcggacgaggtcgctgtcgtggtagccgtcgcggaagttctcgatgtcgtcgaccatgtcggagagggatgacacaaagatctccttcttccactgttccatccgcgggaagccgcagatgcgctcgccgtagtcgtcgcagcgttccaggttcaagaacatgtcatgcgtccaccgcttcggcaacccggcggcctccatgccgcgggtgtgctcctcgacggcgcgctccatcttcttcggcgacggcagcgtcctccgcccggacagcacctgcgccacccacctcgcctgcaccttgatgaacaccggcaccaccaccatggccgggatccccacgaacgacagcgacggcgcgagcgccggccggaacacgtgctcgtacagcggcccgacgcggttgtcgtcgacggtgacctt

SEQ ID NO: 68241 - DNA, 14842 bp, Oryza sativa
aattctgaatttcagttatttcttaattgtatttctatatggactctatactctacttctaatattccttatttttaattccgaattttagttatttcctaattgtatttctatatggaatttcagttatttcctaattgtatttctatatggactctatactctacttctaatattccttatttttaattccgaatttcagttatttcctaattgtatttctatatggctctatactctacttctaatattccttatttttaattccgaatttcagttatttcctaattgtatttctatatggactctgtactctacttctagtattccttatttttaattctgaatttcagttatttcttaattgtatttctatatggactctatactctacttctaatattccttatttttaattccgaattttagttatttcctaattgtatttctatatggaatttcagttatttcctaattgtatttctatatggactctagtctcctcttctaatattccttattttttaattccgaatttgaactatttctaaattgtatttctatatggactctagtctcctattctaatattccttattttttaattccgaatttcagctatttctaaattgtatttctatatggactctgctttttctttttctccgattaatgtgagaatttctaggccataaaagtgaacgtggaggctcctttttctatttatttaataatataatagattataagtatattctcccgtcttaattactgctaccatcactgactcgttcgagggggaaatatctccgcagtcttctcgatcgggttcgattgcaaaggtattttacattatgattacacgctttatgacggttttaaggcacgttttgcattgcggaggcatgagtattttgcgaaacggtccaggtcgtcccacatgacagcgtatctctctctaattgaaagcagcgatccagagaaaggaaagacacagaccggtacagtcattacaatactctacttccctccgtttcagaatacaagacgttttgactttgatcaaaattaagctgttttaagtttaactaaatttatagataaatatatagtactatatataatactaaattagtttagtcgaatcaataattaaatatattttcataataaatttatcttgggttgaaaatgttattaatttattctttaatttttaatttcgaatttcagttacttctaaattgtattcctatattgactttaaactcttcttcccatgtttttcttaatttcgaattttagttatttgtaaattgtttttttatacggactctaatctctacttttaattttattatgtttattccaaattttagttagttttaaattcctatatggactctatacttcacttctaatattccttatttttaattccgaatttctattatttcctaattgtatttctatatggactatatactctacttctaatattccttatttttaattccgaatttcagttatttcctaattgtatttctatatggctctatactctacttctaatattccttatttttaattccgaatttcagttatttcctaattgtatttctatatggactctgtactctacttctagtattccttatttttaattctgaatttcagttatttcttaattgtatttctatatggactctatactctacttctaatattccttatttttaattccgaattttagttatttcctaattgtatttctatatggaatttcagttatttcctaattgtatttctatatggactctagtctcctcttctaatattccttattttttaattccgaatttgaactatttctaaattgtatttctatatggactctagtctcctattctaatattccttattttttaattccgaatttcagctatttctaaattgtatttctatatggactctgctttttctttttctccgattaatgtgagaatttctaggccataaaagtgaacgtggaggctcctttttctatttatttaataatataatagattataagtatattctcccgtcttaattactgctaccatcactgactcgttcgagggggaaatatctccgcagtcttctcgatcgggttcgattgcaaaggtattttacattatgattacacgctttatgacggttttaaggcacgttttgcattgcggaggcatgagtattttgcgaaacggtccaggtcgtcccacatgacagcgtatctctctctaattgaaagcagcgatccagagaaaggaaagacacagaccggtacagtcattacaatactctacttccctccgtttcagaatacaagacgttttgactttgatcaaaattaagctgttttaagtttaactaaatttatagataaatatatagtactatatataatactaaattagtttagtcgaatcaataattaaatatattttcataataaatttatcttgggttgaaaatgttattaattttttctacaaacttaatcaaacttaaaacagtcaaaacgtcttataacatgaaacgaagggagtagtggtttttttaacttacacaatacaacacagacactcacaatacacgcacactcacccctataaacacacacgcaaacatacccctataagcatgttcgaagattcaaccggagatcatgtcgatcgagtgcatgggctgctcgtctacttgctactgctactagctacctgaccgtgtgccatcacgtcagagctagccatcaaaccatgactccatgagtcacgagaaggacgtatatgcgcgccgggctccatgtctcaactctcaagggaacgaacggcttcaagccctctctctctctccgtccggccgtcgcgggtgccgttgcaaaaggagaagcggccagcgaggggagacacgactctacgtggacgcggccggtcgctctctctctccccccttcgcccatccggcctcccaccggtcgatcgatccatccatccatcggccggggcgagacgtaccactgtacacttggatcgcgcggtctgactttgctgcaaaaaaagcgcaaaagctgcacgtcgccttgctgctgcccgcaccgcctcgctgcatccaacacacacctgtctctctctctagctctcgctctcgctctcccatgtgaacctctgcacgacgcgagtcagatttctgtttcattgtcttgtctgcttcgcatctctcatgtgaaaagcagcggccacaaaatttcatcccaaaatgttgttttcgtcatgcgtcagcgagatattcctttttttcctgaaccgtatatactgcgataatatttttagtgttataatcggacaatatatatcacttaaaaaccttatatttagaacagaactaaaaacctagcacatgctaaacgacctagaataataagtattctgagatggaggtagtaagtaggagctaaaataattttaaaaatatgttaatatgattcttttataaaactttcgtgtagaactttttataaaaaaaaaacatagtttagcggttcaagatgtatgtacgtgaaaacgagggaaaaaagttagaaaaaaaggtataaaagaactcattctaagtacaactatataggtattttgttgagacagatgatgggataagatgatagatgggaaagtagatgtttttcgtgatgacttgggcatggtttttaaagaaatctaagtgccccttctattaatgttggatgcttgtataaattgattagtgttgtaattattgatttcttattgttgtttgtaagtgacgtggagttcagcgaaaaccacaatgatatgaactggtgcctggtggtatatcagtatatgcatgtaattcagctcaaggctgagtttgatacagtggttaggtttggctatttagtggaaagtatataattaattacatactaataattaactactacaaactttaaaaaatgaatttatttgctttttaaagaaacccttgcattgaaagtttttcatgaaacacatagcttattagtagtgtagaattagttgggcgttcaacccaacttcactttagaacacacctttggtttatggtgtttgtgtttcagtcttttcaagtagcccaatttagagcgatctctttttcctttttttagcctctcttccttctacattggttttacatgggagtcgtcaggtgtgtgagttccgtactagtggtatgataattgtattagtagtatcatgggttaacaatttgttggttttgtttcggaaataggccagctcaactgtggcagtggtcaccggtttagtttcatgacgatgacagcatgttcggtggttgcgatgccactagggttttgtatctatagaagatatgcatgcgtgtgcctcgccaggcgaagtgcatgttagctagtactaaagcatggagaagacgtcacagaagactagtattaaggcccatggtagctctaactcatatactcccccgttaaaaagtaattatcaattattccctttgagttgcaaacttttgatcaacaatattctttttaactaatataattatttagcatagcatcccagcttgttttagctgcaacttataagccatatcgaattactccctccgtttcacaatgtaagtctttctagcattatccacatacatatagatattataatgaatctagatatatacatatgtctagattcattaacatctaaataaatatggacaatgttacgaagtcttatgagttttagaactaacttcgtgttttttttctgttggttttgctagcatcacatgaatcaatgcctttatttttttttcagtattgacttttgaaccactcggtcccatttgactcaggtcattattagcagggtaattagaaaattgattaatttattataatatgttgccaagttgaaaaggtggattttaaaaagtattcaagaatttttttttaaaaaaagaaaggttaaaacgtaccatatttggtagtttgagaagtatgccgatgataatcgagtacctagctagttgcactttagaacaaggcataccagtagaaatatagaatcttaacataatttttttttgttcttttgattcccatggcttaagccatggttgtgaaaatgtctctaaacaggtgcaaagttgtagttagctagatttgtgatcaaaagtaatttagtactccatccattttatattataagttactttatatttatcctaagtcaagcatcttcaactctaaccaagtttataaaaaatatagcaatatttttaacataaaataaatatactataaaaacatatggatttgatgataatttgttgtcatacatgttgctattttttctctaaaactactagtatgaaataggtggagtacttcttacattggaacttatggaacactttgttgtgcttaaataatactaactatcaaagttcatctattcttggtcaaaacctatgtaaaaatggaattaatttgtaagctggataaaagtattttagtctaaaatgtgactaagatgcctcatacttcctccgtttcacaatgtaagttattatagcatttctcacattcatattgatgttaatgaatctagatagatatatatatgtctagattttttaatatcaatatgaatatgggaaatgttagaatgacttacattgtgaaacggagggagtactaataattttagtcatgctcagctccaataccaatctaaaaacttgaagctgaagtgacagggttggtcctaagttaattgattatcatgtgatgactaatatgataggtgcatgtgtcattgatttggcttttagtactgtccataaaggaagtatctggtggagtaattatgctatttactggtacctcacaactaataagaaagtcggtagcacaaattaacagtagataaagcgtggcatgcatgcatacacggtgcatgcaccacttaagctaattaaggtgaaaacctttaggcatcttgagtgctattcatattgacatattgcgtgtcatttgtagcatatgtgtgcacgaggtttaatttagggatatgccagcaagcgtgttcatcagatgttacacttaacagcgaagtatgagtaacaacaacggtttggttttgggaaacttctgacgaaaggcagctagctggcccccgatgagatgatacacatgatgatttattatgatgacaatatttcatatatattctgttgacatagatatttcacagcacgattttttgctagcttttcgacatggtaagtcagtgttggtcgtgcattagttagttagtactcgctgtagatgtagtaacgagctagagtatcgatcacttgtaccgtgggtaccaatttggtcgcggcaccattaattgagaaaagattcgagtgactggccttctactgggttctctaccaacatatatggataccacaaaatcaaaaggttttggatgaacagtccacgtcgaccccttccaagatgggtgacagtacacaagatgtggttgatcgatcttaatagtactgtacaaccagctagctaaacccagatcactgtacactactaaagtgtgtgctctaaatatatacagcatctcaatcacactcacacattcacgcaccattaatactgttcgacgagcacgtactttccatattgatgaagcaacaaatcggttgccacacgcagctctccggttcgtgttcctaaaagaagagctgttcgatctgttggaactttttgtcttgcccgtactgatatttactccctttttcagcttaaagaaaaggtagtgctactaatctcttttttttttaaagtacagattatctttcacgtatgaactcatttcagacgaagcagagcaatgttatgtcaaacccttagtcacagtgaaggagccaacagcatcatcgttaagggcgagcacagcaaggaggcacgagggaccaccccctactgcatccaagtccattagatgcccatagtgtataccactcaaggcaagagggcagtcggcagtatatagagtactagttggcatgttaggaaagcaaacaacgttcgtatccaattgatgtttgatttatgttttgtctcctattttagtcactaccgtcgcgttgtctttttttttaatctcctaaattttaatcatacgtttgtcactggtcgtcgttgagtccagatgacttataaagtttcattgcaatattgatcagcttttatttatgtcgaaggcaaccagtagtagtgggaggaggaagtaggggagccactgcttaatcgataacaatatactttttccgtaaaaaaaaactcaatctaagaaaggtcacaacaaatttgaataattattatatagatttgtcgtatcaagaacggtcacaagttttgagttttttttagagggagtatggcagatttcgaagatacagacctggtctatcaaccatactcgaatgcatgcgtggtcggtcaatcatatcatcatattaagctgccagatatgcacacgatgattgatcagtagctagctctgcctacgcaagtgacatgtactacgtatttgcgattgttgattggtttcatcgaatgggcatgcagatgatcgatagctcgatactagctagcaccgaggaggaaataaccaatttggtcttaagctagaacgaacggatatatatccacgttgcatttatatttttcatctttttcatgagaaggccagagaagaggaactaattaacggatggacacatggcggtggccggcgacagacaagtgtccaacttgtccactgtaactgctggatgccggctatctagctacagtgctcatggggtgctggtaaccaccagtttgatcgatcttgagcttcagatagacaggatagtacagtggacctgcagtactgaaatctcccccatgagacgatgggtcctcccgatttgttggaggcaagcgtacgtggagcttcgcagggaatcgacggtggagctccctcccctcgtctggatcggtccctccaaggctagcagttgcacatggccggtaatgtcacggggctaggacagagtactgtgtgccctctgtgagccgagatccacacggtcccaaccctcccacaatttgatggttcaccagctaaaagaagttgggctgaatgtggcatgggaaatcttttgtgaaggcggcctctcctcgtcttcttgttgccttttgaatcgtagcaaaacttgaaaatttaaaactattttttagagagtcgattttgagtggttttgtttctttcatcgcagcattggtttttaaatcgatgaaaagatataggtataaaagttttgacattgcctactagtccatttctcaacggatagttattcataagtcaaacgagcaaagctgctagttttgttaaatcaaacgcatagaaaaccatacaatttatatcttccgctcctttcaccctcagaaattttagtgtttttagacaagttggtttatgtgcaatcatccaagatatacaagagctaggtgagcttaagattctgagaagtaactgtttgataaccatcttctaagaatctggaaacgttgggtgtccaacttctgacttctagtttattttctggattttataactacagcttcttagaatctggaccaaaagttggggtctgtttgggggagcttctagctgctgcagcttctcccagaatcataagctcccccaaacagtccagcttttgctccagattctgagaagctgtagttgtagattccaaaaaatgaactagaatccagaagttgggaaacctaacttttacagattcttagaagctaactaccaaccagctgcttcttagaatcttaatctctctcaaacagaccattggacagtttgggagaagctgcaacatctagcagctcccctaaacatcccttgtatcttattgcccatagggatttcaagatttgccactcatatggccccatcgtcttgcttatacttatgcttaaattttaaaacttagttttacagatgattttatgtttttcttattatggtttattttacaatatttggctttgaaacgctaagaacacatataaaaattatatttataaattattttttattgctaataagtcgtacatataatcataagtataagcaaaataatggggctgtatagtttcttttttaggtttagccattagggtatctataatgggaccataatgtcttcacgtggagtcccaaatcctgaattttgtcaagtaatattgggagcgacaaaaatgctaaaacaggcagaagccgaatgtttcggtgggctatcagttatcagttcactttctgggagtggtccaaatgattttgaaggcccatccataactcaagatcctcatttgtgctgagttatggagttgagcaactatccatctactatcacatattcacatgttggatagtgggtcatataacctggcagagaactggcaagaggtcaagaaggagatgggaaggaattgttaatgggctttatttgatttttgcatttatgcatggattgggccagccttcttggagttgatgactcggagtgatccgtacaaaaatatctccatgggccgaataacaaaatcctttttaaataggaataagttcactttggtcccttaactagttactgaatctaaggaataagatcactttgactccctcaactgaccaccgaatctaaatcgtatccctcaactgcaataccagaaatctcgaccccccgaacttgcaaaaccggtgcaatttgactccctcagcggttttggggtggtttcgctgatgtggcgccacgtggcacctatgtggcgatattgaccgagtcttcggtcaacgtggcgttggcgtggcagtagaattaaaaaatatgcgtgggacccattagtcattcacacaaaaagaaatatgggcccactgacatgtggggcccacatgtcagtccttcctacttcctcctccctctctctctttctctcaatctctccctttcttcccattcggccggcgggcgggagggtagcgagagcgagcggccggcccagctctgcctcggtggggaggcggtggcgcaccgccggggtccaccgacgatggcaacggcgcacggacgagtggagcagcggcggccatcgtggcgcagcagaaccggagcagcgacagccatcgtggcgcagcagaaccggagcggcggcggccatcggagcttcttgggcgccgccagcgacgagctgacggcggtcgagtagtggagtgacgcggcgcacacgagcaggacaacgccccggccttctccagccccgccgccccggtcttctccagcggcctcctcatcaccccccgcgccagtcgctttgtcaccgacgacgaccccgcgagccgtcagagactgtgccggtaaccgcgaggacgaggatgacgagcggcagcgcgggtcgccgccaccgttccccttgtcctcccactgccgcgagccactacggccgagccgccgtcgtcctagccgctgaccgccgcccctggtccggttccgatgcgcctcgatgccgctagccgccctcctgcacgtcggcctaatgggaagaaggggagagaaagagagagaagggagagagggaggaggaagaaggaagggctgacatgtgggccccacatgtaagtgggcccacattttttttgtgaatgactaatgggtcccacacatattttttaattctactaccacgtaagtgccacgtcaacgccacgtggaccgaagactcgatcaatatcgccacataggcaccacgtggcgccacatcagcgaaaccaccccccaaaaccgccgagggagtcaaattgcaccggttttgcaagttcgggggttgagatttctggtattgcaattgagagatacaatttagattcggtggtcagttgagggagtcaaagtgatcttattcctgaatctaattcttatccttgaactgcaataccaaatatctcaacccagctcctattaaaaccggtctaatttgactcccacggtaattttggagggcagtttcgctgacgtggcgtccgcatggcagtgttgacgtggtctgtggtgttaacgtggcgcttaggtggcattagagttaaaaacatataagtgagacccatttgttattcacacacaaaattacagggcccacgtgtcatcctctatctctttcttcttcctccctctccctctctctctccctcttctctctttctttctctttctctccccttcctcttcccctttggtcagtgacagccagacgggaggcgagggtggcagcgggtgggagggtgggtgagggctggagcggcaaaggcgagcccacagtggcgaaggcaaaggaagcggtgtgaagaagaaaagaagaccaaggagaaggggagagagagccatcctcatcaccgccgtcgacgccactgccctagagctccctggccaagctccatctcgtcgttgcgatcgaccaccataggtcgctgccccgcactccctcgctgtccccgcaaagaagataaggagaccggggagaaggggagagaaagagagccgtccccgtcgttgcggggcgccgccgcctagagctcccttgccgagctccatcccgctgctgccaccgtcgaccgctagtcaccgccccgcactcccttattgtccctcgagctccggagcggcgatggtgggacaactacggggatcggcgacggcaagggtgcggcgttgggggacagcgtgtgaaggcccacgcccgcgccatggttgaggaatgagaggcgtgcgccatctcccgtgcccatgcctgcgccatcgccgttgcgcctcgcgcgccttctcgcccgccgctgccgctccgatcctcgctgaccgaaggggaagaggaattttctttgtgaatgaaaaatgggtcccacacatattttttaaattctaacgccacactaggtcaataccacaacgttagcaaaaccgtccttcaaaactatcaagggagtcaatttacaccggttttaatagttaggggtcgagatatcgggtattgtggttcaggcatacaaatcagtctaggcctctagttaagggagtcaaattgaacttgttcctttgaactataccctgacatgaaatgcttgatcttctattttgagaaaatccgctatgtacctttgagaatttgttcaatcccttgtgtgccgctaaattttgccttatcccttatatacccctgagtttttattttcgtctcctctatgcctattctgttagttgaccattaaatgttttttaaattgactatattatccctctcttatatttatgtgctagtttagtaataaaaacacaattcttatataaaaaagatctatttgtaaaaaaaaacaaaggaaatatgattatttgacacttttttaaaaaatctaaaagttttaaataatttttaatttatctttttgaaattcatacattgttttcatcaaaatttgaacccaataaataaatagtttcggttaaaaaaaacataatttctagctaatgctcttatatggattttgtcaaaaaaaaaattgttcaccaatttaatttttctttttcgaatttaccataactaattattccccattttattttatcatgaattacagtttttcacattatgaattatgaagtagatatagcatgtaagtatgagaaatggacgatatggttattttagaaaaatctaacagttaactcacaatcaactaacagaatatggatgtaggatatcaaaatgaaaattcaagggcatatagatggtgagccaaaattcagagatacacgaatttcctctataattttagttgaacttagaggttcaactgttcaatcctaatgtagcaaaggagaagcgaccatttgttttcctcatgctctcagaaaaggtttcggaataaacagggtgctcaatacgttcaggatggcgacttccgttttctccagagctgattcctttggcgattgcaatggcgattgatcttcatggcgactccctcccccctggtggctgggatttttcccccggcaattagctaagggatcagtgctggcaaattcatggtactccggttcacttttcttcgtacttcagtccttctccttttcgtttggttgttgacgtttcgcgatcgaccttttgcttgaatgagaactccctggctttagctcttcgggcttgtttaggtggatctcctactgatttctatgttagtcatataagggatcgatgcttctctttctttgtgtatttataagcttagatcttttatctgccgccatttcatcttcgttttttcttgtggcgcaatggaagtcctaattggtcttatgagttcatgcgctgggaaaaagagcaatcagatgaatggactattgtcaagagaaagaaaggcaaatctccttcaaatcattcagtgatcccagtctcatctgtttttaatcgttttcgagtgcttaatagttcttcatctcgtcctgctggagttctgcttaataatgtttcttctaaggagccagaaaaggttgctcgacggattgccgacggtgatcatcgttctgatagtcatgattcgtcttccatggcccctaagtctttgtccaatgacttagtctctcatcagaagaccgataagcctgatccgacttccaagcataattattttaaaaaaaatattctatccacccctttttgggccatgagaaaaagcccatggatcagcccaagggagttaagccacaaccagtttcgtggaagccgcaaccaattcgcggaaaatttgggtgcaaaatctcctataaactctgtaatccccactgtgtcgcatcctctctcttcacccgactccacagtaaacccccctctttctccggcgacgaactcgagttcaccaatggcgaaccttcaacctcatcctctctggttcatcccgccggggcagcacttgcatccggctggtccaaatcaccgtcgaagggttgacacagtaaacttcattcctactccaatgcggcatgaggattttgtgctagctattgttcatcctgctttacctgaagacctttgggatgaacatagggctgagattagtgggttttttgaacaagtcagccatgttcgagttgctgcttcttttccacacccaaatgttgttgccctgtttcagattgattctccggatcaaagagatgcacttgttcttgggctgcctattaactatgatggaaaccatgaggttagatttgttaggcatgattagggtccaaactggcgtaatgttccttatgatcatagagggtggataatgatgcttgattttcctttggactatgtcaatttttataacatcaatcaagtggtgtctacttttggggagcttgactggtggtttagctaaggtttggtacaaggatctatactcagtgccccaatttgttgtttgggagcagcctaatgctccaaatggtcagtcttggaccattatgtttatattttaaatggtgaatttgctgatattttaccacctgatgatgatttgccacatggtgaggggcctgtcgatccaaatgttgaggatgcaccagcctggcagtttggaaatgaacagcagcagcataa

SEQ ID NO: 68242 - DNA, 546 bp, Oryza sativa
ggtgacggtaaccgggcccccgggggtttttgaaaccctggtggtgctacattaaatatttgctaatgacagattaataggcttaataaatttgtctcatggtttactgacggattatgtaattatttttttattagtgtccaaataccctatgcaacatcctatataatactcgatatgacacgtcaaaattttacacacctgcatgtaaacaccgtcataaattgctctgctcttccgtctaagatttgagcattgcattcttaatttccagatgagccacgttaccccgaagtcgaaagttttccagtcgtgcttgtgttctggtttccaggccgtagccgccgtacaccatcaggagattagactcttcgacgctccggagggattatcttctcttatttggaccgtgttttggtccaaaataattattcaaactttcaacttttccatcacatcgaagtttttctacaacattaactttcaacttttcatcacatcattccgattttaactaaacttccaattttggtgtgaactaaggca

SEQ ID NO: 68243 - DNA, 591 bp, Oryza sativa
ggagtttttttttcctattctttgcatactatttattactccattctctagctgcacgtctcaaaattaaaaccaatgtcacaactcacaacatagtaaacagtcctgtatgaagttttattcaaggaatagttttaggaattcaggacagttttgcatttatcctgtatgagacgtggaaactgttgtttcttttgcttccaatgctttgtaggtttgttattctgacaatctcttcttttttctgaaactcagcttttgggccgatcattgttttgtcttggactgctccttaggtatggttctcaactcatggcagcatccgaaaatcaacttgatttcccaaagattatcagcttgctgaagaaggaatatcttctcaaggatgatttcagcttgaaggttcgaggtttgcaggtgtgcacacttggaatcaattactgcacttactggcactagaaaaactagatggatggatggcatgtccacctgtctagataacaagaatgtgctttagtttcatttatttttcatatttaaaaactattcagtactagatgatatatttttctgtgcatgcaggctttggga

SEQ ID NO: 68244 - DNA, 7017 bp, Oryza sativa
ttcctagaaagtctttttactgcaagagaggggttaggcaaggagatcccttgtctcctcttctttttgttttaggggctgatctcttacagtctattattaatagtgcctatcaacacaatgtaatatctatgcctatcccaactcctgacaatgattttccaattgtgcaatatgctgatgatacgctactcttcttatctgcatcatcaaatgagcttttcagcttaaaggcaattttgaatacttttgcctcctcgacagggctgaagataaattttgagaagtcatgcctgattcctctcaatgtgcagcctgaaaaagtacagcacttatctaagatgtttggttgcatgattggtaccttgcgattcacttacttgggtttacccatgggtataaataggcccaaggtaattgatttcagccctcttgttgatagaattgaaagaaggttgtatgctacctcagctttgctatcttatggtgatagattaactatggtgaactcagtgctctcttctttgccaacttactacatgtgtactctctctttgccgaaaagtgtcattaactctattgatagagcaagtagacattgtttatggagaggatgagacataaattcaagtaagaagcctttagttctttgggatagggtttgccagcccaaatccaaggggggtttgggagtaatagaccttaaatttcagaacaatgctctgttgatgaaaaatcttcataagttctataataggcatcctgttccttgggtaaatctaatttggactacatattaccctgataaagttccacatgccttgtctttaaggggttctttttggtggaaagatgtcttgcagttcattgatattttcagaggcttatctaagtgtacagttggtgatggcaagacttgtttattttggactgacttttggaatgataatataatatcagtgtcttatcctagagctttctcctttgtaagaaactagaaagactcaatgctgcagacttctttaaaggatctatctcagatgttattccttcctttgtcagatctggcctatcaggagtatcttcaaattcaaatggcagaccctttggatcggctctctgatgagtatcataaatggtcctatatatggggcaatgacaggttctcttctcagaaaatttatgctacaaatttcatggatgtgcagtcccctgtatatctaaaatggatctggaagagtagctgcactatgaaggttaaggtttttggttggctccttctcattgatagattgaacactcgtgatatgcttgacagaaagttttatgctcctcaaggaagtgatttaacctgtgttctatgctcatttggagaaagagaaacccttgagcaccttttcttctcctgtcccttttgtactgatcgctgggagcaatttggtatagtctgaaatctctcctactcttttgagaatatgctaacacatgccaagaactcctatcaatcttcgcacttcctggaaaaggttctttatgcggcctggaatatttggaagtaacgaaataggttcatttttgagaatgttgtgccttctgttccttcctggatgtcgttcttaaagaatgatatgtcccttcttgtttttccgtctaagattagatgatagataagttttttttgttcctggctagacaatttgtaacttttgtaattctattttttaataaaatgttttaactgtgggggcttcccctacagtgttttcctaaaaaaaaaagaaaaggtctcggtgcttgacaacagattattatacttttattaacatattattatacgttattccccgcaaaaaaaacatattaacgtttttcactaaaaaaaaacttgcaactgttatttagcaatttcaaaaaaaaaatcttattaggaccagacctagttgaaaaattgtaaagaaacacttttatttcaacaaaaaacggattgaacttttacatccagaatacttttggtgcgactacgtggttatacctagacaccaggtacgtgcgaccacggcggcgaggtgaaatccgcagctcccccgccttgtcgtagctgagcccaaacacggtcacgtggagcacgcatccatcctccgcgcacagggcgtccgccatgtcgaggccacggcgaagcgcgcactcgacgaggcagaacacgccgtcgcccatgtacgcgagcgtggcgcccgagggatgccctacgtgcctcttggggtcctcgcgaagcagcgtctcctcggtgatcttggaaccgagcgcggcggccgatgccgcggcgccgcgagacgcgacgtcgcaggagcagaggcggccgtcgtcgtcgagcccgacccacgcgtccagatcgtcgacgtagtgtccctggccctggaacggcagcagccagtcgccgagcggcgtccacgctgccgcggccggacggcggcgggcgatgtcgagggcgtaggtgccctgcctccggcgttcgtcgtccccggcgcgccggttgtgcgccgacacgaagacggtgcggccgtccgggtgcacggcgtaggcggtgacgaacatggggtcgcggccggcgccggcgaacggcggcggcgacggcgaggggacgctctcccatgaccaccgctcggcccgcccggaaaacctgaacgagtcgcgcgcggggtagtcgtcgtcgcggggcgccggcgacatcacctggaggtagtgcttcgacgcgctgcgagggtccagcgcgtacagccgctggccgtggacgggcaccatgatgcccggcatcagcggcgccgtcgggcgagggccggcggccagcgacgacgtccccgtgtcgtacatgaagacgggagcatcctcaaggagagcatgcgtggcgatgacgatcttgctgccgaccgcggccacggccgggaaggagaggtccaccggcgcctctatgcggacggcggcgtgctcagggaggtggtggaacatggcggcgccggtgccggaatcggtgaactcgtcgacgtccagcttgtggatgacgtatcccatgtcccaatcaagcaccacgtagatgtgtttatcgtcgtccctccgacgtgaccttttactggacatggcggtgttgctgctgtgctgatcctgcaacgcccgctttgagctcaacatcgtatcttcctctgcctgcttcgcgcgcgcgagtaaacgaataatcggtggatttcggaataggatttataggcttcctcgccgacggattcgccgtgactaattccaattccgtttcggaagtccgagtggattgcaacattcccacacggcccgtttggttgggattccgagactggcccgcttcggagtcgctcccacccccggaaccggatcgtctgactttgcatagtaacgtcatgagcgtgcagttctacaatatccaccgtccattccatcctacggtcctgcttgctctatcctcgcactggtgcacaggcacccaagacggcaagacccaacgttaggcccacaaaatcagtggcactgtaaagtgggatttttggattagtcatgagaggctgttaattttggattagcactctcagttttggcaccgttgacagttggaggtcctactcttgctaaaaatcagttctatgcatattgcatatattgctcctatgtatatctataacttaatataaatattcgtatttttccggtcgtcacaccggtttttcgtcccgcttcgtcgcccctcatcccccaaaatcccaatccgaatccaatcaaacctcgtaaaaaaatcacaatcacaatcggagttcaatcacacaaatcatgatgcatgtacacatatatatccaaatataaaaaccaaaaattagatcgaagggagtcgccgccgccgctgtcgttgccgaaccaccaccgtcgccgtcgccgccgcagggacggctggctgccggcggctcccctcccgctggatccggtggtgggggagagcaccgccgacgccgtcgtcggtggtgggggaggactccgccgccgccgccgctcgcgggaggaagggcaccgtcgttctcgttagatccgcgccggtggtgggggagggtgccgccgacgccgccgtgggtggtgggggcgccgccgccgacgccgccatcgcagtcggatccatcgccgccggatctagggcgggagggaggcgagaggggagaagggagccgcagccgccgccacgaccgccgaatctgccgcgggagggagcctagagggggtggagggagccgccgcccccaccctcggatccgccgcggccaccaccaacccgccgccgccgacccgagagggagaggaggaggggggagggggggcgccgccaccgccgccgccgctcacgggaggaggggtgccgctgccgctcgggggcgcggaggggagggcggcgaaggcgaagtgagatgggagggagggaaatgggctagggtttcggcggctgagagggagagggttttgtttccccactatcgacgctcggccgtccgatcaaaaccctagagatcggacggccggtgtcgtccgggccaaaatcggcccaagatggatcgagagtgaggcatcttttctggcccaagcctaggttgcggcctggggaagaaaagtgagcccgcgcatgcgcaaaaggccgtgggccaaccggcatgggccggaaataagtctattttaagtccctcgggctgaaaaaaagagaataagttcatttttagcgctcattttttcagaagcattacaattatagttattgaatgtgtttatttcgaagcaaacctaaaaggaagtatttcctttctttttccaattaaataattgttaaatgatgtttgtattaataaaattagcaattaagctctgaaaattccaatataatttcaaagagcgtaactaatcatggggaattttaaaaaaaattaaatttaaccatgtcattttatttctcatacttgctctacttgtaaatttatttaattatacacatatacctacttaaaaataccaaatatttcagagaatttgtattttaattaattgcatatttttctgatatgtacgcttcccgttgcaacgcacgggcacttttgctaaaccaaccaacacttttggtcaatatacacactccgtaatcacccggtgtaatgcacggacactttttctagtagaatatatatttccttaatgcaacttcatcgaccaactttgcaagtacctatatacgtatgttgttttttccttttttcttttaaaaaagttgtacgctcataacacatacacattcatttctataaacgtgtaaacttacgccctaactttatgagcacctcaaaaaaccataccggtatatatatatatatatgtatatatatatatgtatatatatatgtatatatgtatatatatatgtatatatatgtatatatgtatatatatgtatatgtatatatgtatatatatatgtatatatgtatatatatatatatatatatatatttatttatttatttatttgagatcaacaaagtctacgaaggtaattgctaaatgttggatgggctgtgccgccgtgagccctcttcgcgagaggctcctgcgtgcgcacgtggcccactaggcctggcaggttggtctgggctgcatgacagcgttatgggtcgggctattggatggggtgcagtgcaaacacgggattgctaattagcacagacgcgccattaacttaagtcgcgcgcatttttttttggcccacagctctgcggcccatgtcctcacgcacagcccatttccttttttcccgtggcaactgtcttttttcgcgtcgcgaagctgccacacctgcacaaaaatcaggaaaaaacgtgattagatgtgttgtaaatcaacgcgcctattagcggatcaccggatccgttccctgtccttcccacaacagtataggcgtgagatgatgtagaacacccgcgcccatccctttgccgtcaagaacattgcagaagtagacaattaatacagatatagggtggaactctctcttcattatagatcttatctggagtacaagccaaccattagccatagatgtcacaccctccccctgtatatataggggtcttagtaggagatagatcttatctctactccggttcggattggtccacaagaaaggatctttatctccccgggagataatattccataacactcccccttagacctatccgcgactaactcatgcctcgtcaaaactcctaccaaaacccagtgggaaaaaggctaggagaaagagtacatagttatcgctcatgcattgcacgttgttgcctcgttaaaaacctcatgtgaggaacaacagcttcactcactcaagggaaaaagagtacaacactaaggactacacggtccatactgtgggtcatgttctagggtgctctccccctgaacctagtaaacatcaaagtcttctcatcccaattctccggaaaagcttccgagaactaactgttgggagagactaggtgatcaatcctctagattattactcaacttgaattgctactcacatcacctcgccttaggagtctgtgagatagcccacttgtatttggtgtcggtcaataaagacagatctttctatgataggaccttagaaacaggtctaagtgatcatcatcgagtcaatgctccgggcatactctaagacatttcaatgtctcgcaaatgacaatcaacacatagcacatactccccctgatgacaacctttgtcacagaccatgttcccatagcataaaacatctctcagacgtatgcgtgggcaagaatccttcagatcctcaaaccattagtcttaaaagacttatctcatttcatcactaaaatgagaatagggaacatagagagtaatgcattccatcactatcatataccacaataccatactgttgtgcaacgcaatcta

SEQ ID NO: 68245 - DNA, 6464 bp, Oryza sativa
gtattagctttgcgacccttcaaacagccgtgggctattgaattagcttggcttctcgccagagagttgccaccttgggccaagaacacgtttcttggttaaagactcggcggttgtgctctttctagatggaccaagccatcaaggtgacaattatatcaaagccattgcatagctatttgctgacccttttccggttgtggtaccactagctaacgaaggagttttgtatggtcggaagaatttcgggccatccgatggcattgagaactatccactagagttggcgagatttaggacaggacacaaggatgtggtccattgtctcctcgcattggtcgcaaaggacacatttggcagggcgtggcagccctcatttgtacaagtggtcggctgtccagcaagcgcggtgggtgatgagccaggtgaagtacctgcaatggtgtggcgcattgctcttccaaactagagattctgggaagctttcacgaccaaggaagagcagtgagtaggcagacttggtggaatattgccctgagatcttccacttccagacgaagttgtcagcttgcctaggtagtagggtggtcaaggagatacgctaccagatcctaaggtattgcagcactgcttcaactcctaaagtccccctgatgtcgctaatccatcgccgatcagtgattgcctccgccactattcgtttgcggctcacgcgcgccaagacaagggaatgcagggctagcgccaggctctttaggttagccccttcagccatcgatcctcccagaaaaggatgcaggtcattatcgtagacacgaagtcgcattcttgattagagatcggcattggtagccctttccagggcttgcttgcattggttcgcagtgcccaaagccaccgagcatgaagggccagacccattagattgaggtcatggattccaagaccatcgtagttttgggcacacatacattgctctaggcgaggcggcagtggccacccttggctttggctgttccagtccagaggaaaccccaccttatcttattgatccccttgataacccatttgggaggggacatggcgatcaagaggtggattggatggatcttaacactgaattgataagtgccaggctgccaactgcctggccggggcaagctaaccagctttctatgacgggagcctaccggcgaccgagtcaagcatcagttggagctcggccttgttcagcttgccggtggagagcagtaggcctaggtacttgcacgagaaatgcgtgattaggcaaggtagcttgttctgcatgagctccatttcgctttccccgcaccgaattggaatggccgaacacttgctatagttcgtcctcaaccccacgactgaagcaggttgaagaaggtcaaggtgctaagccttgacgaacatggaatttagcatttccattacgatgacgaacaacatcggtgataggggatccccttggcgcacgcccctgccgtgctagattgtccttcccggcgtgccgtttagtaataccttgtactactagtgctaaagaggatggatagccagacttgccaccgtttaccgaagccactatggagaagtatctcgaggatgaattgccaggagaccgagtcgaatgcttacgccaggtcgagtttgagaaggattgctggggagagaccggcatgcaacttccttgccggctggtgtacaagcacgaaattatcgtggatgcaacgatacttgatgaaggcactttggttgtcggcgaccagcaaattaagtttgggcactaattgctttgataggattatcgtgaataacatcgcaaagctgtggcaaaggcttatgggccagtagtccttcaagccacttgcgtccgcacgcttcggagcaaagttatgagggccttgtttactttgtcaaatcttgatccgtccagatgaaagagttggttgagggctacaaggatattttctttaatgaccgaccaacaagatttgtagaacaagccggtgaagccatccgtccttgacgcgcaatcattaggggtgtccttgattgcattccggactttgtcctcagtgaagcacacctcgaggttgtgcatgacaggtcggctagggctaaagaagggtaagctgagtgtgtgcttccttgaagttgaaggggtggagcctagcactccggcgtagtactcgtgtaccattcgctctttatttgcgtgcgagatggcgaccatcctattgttagccagctgctggatgaaattctttcatcgcctatagggtgcttgttggtggaagaagtgggcgtttgcatccccctctttgagccaggtgacgcgtgagcattgtcgagccatcgttctttctagggacacaagggcaagcacccacttcttcaacgcatggtggagcacacactcctgttggctaagcgggcgatgctcctcggcagcgtcaaatatgtcaattatctcccttgtcatggccagttgcagcttgacgttcccgaccttcttgttagaccaactgcgcagcgcctttgctaggcatcacatctttgcgtccaatcggtgaatggggtctttgaatgggcaagggaagtaccaggaatcctggactgttacgaggaacccatcccgcttcacccagaagctctcaaagagagcgagcagagcgtcaagaagaagacgaggtgtttaggaggagtaggtagtggtcagacatgtccatcgagagaaccttgaggaatcaagaaggcagggttgtccagttgtcggtcacgaagatgcgatctatacgctctagggtcgttctgtcccagccgttgaaccaagtgaaggccttgcatttgaggtgcacctcttgaactgaaggtcacaaatgacccggcgaaagcgcctcatcatgcgacggtgcatgtttccgttgttcttgtcttggtcctagtagatgagattgaaatcccctaccaccaaccaagttcggagaaggaagtctggatttctcggagttcttgaagaaaacgaactttgtcggagtcgccctgcggcccatagacagaagtgaaccaattgatcgttccgtctatgaactctagccgcattgtgattgataactcgttagtgcggtggctgaaacaactagccacactcggatcctaggcaaggaggatccactccccctccccgcatttgagtagccgcgagatagatgaaactagatagattagggcctaaaatttgagaggccgacataagggagattacattcagtcttgtttcttggagaccgaccaccaagcgcactacgtcccggcgtgctcctgcgttcaaccctctcacattccagactagtatgttgtagtttgggctagtcattgggaataggacaggggggttcgaccggggctagcgcattaagcctccaccgcgatcggcgacccctgcactggtggcgcctggatgaggtccatgccgaataggtccgccaacgcttgaatgtgttcagtggttagaggctcggagaagaattctttgtacgccttggcgtcttgctcggagggcttggagtcggggatgactttttttttctcgaacacgagtcagggatgactgggacttccgttcctaacttcttggcgaggactgattgcgccttggtcaacgtttctcatttccactcctctcaaacattctcttagggcttgttcgtttaatcatcaatagagaaggattggtggggattgaaggggagtaattccacaccacaataaatatggaataaatcacctttaaatcctcttcaatccctctatgagagggattgccttaaacttacaaggtcaactttaggataagtggttgtttagacgatgcacacatggcctattttttgtgccaaaacttgccacaaacaacttaggtatggtttggtaagaattagtctatgacatagtaccataagtgtatcatgtcaacactcaacagttatgatagtgaataagacactcatcacctactactataatttaagaaaatcgttaaacgagtaatcgttatttcctcatattttctctttccgccttccagttcctggatccaggtgaccaggtcggacagctgcggtcaacgcaaacaacgagtaaacgcaaggctgcaagcagaaagggtcaacgcgaacaacgagtaaacgcaaggctgcaagaagaaaggcgcaaggtacgagccgtgccgcgagcagcggtgcgcgctagacggagcagtgcagccacggtagacgtgcaggcggcatcgacaaagggcggtcatcggtgctgatcaaggagtagcagcaggacctccaggtagccgcgaccgtcgaaagcatcagcagatcccaaaatcagtatgtgcccttcaatctatcctcagctcagctttctcgatgtggattcgtcctccaaattcttctcttgcccttagcaaaattgtccattttatgtgtaatgaatctgtgctaagatctatggattcattctccaattctctgtgctatttcattctttgtccatgtcttcacggtgaataatcggtgaaaagggggctcgagtatgtcacagcgaatctcgggaacttcgtcccgaaacgaggcttgacaatgtaccgatcgcaggcggatcttgtctggtataaggcggacgagcgcctctattgctccctcactgcgccgccgccgtcgtcgtgtgaggaggatggatgagcgctggcgttttcccgccgagtgggatggacgagcgccgagccgcttgcgggcctccctcgctcgctttgggctggtggtggtctggctttgggctttaccgctttagttattgggcccagaaaatattactcgctagttagaaagctactactaatagtttggcacgttattttaagaacctgaatcgagaaaatagagaagtgaagacctcctatgcatctgcatcgcaattgatccacgatcgatcatcgttccggatcatcgtcccgaaattattttaaaatttgttgttgtcctatgtcgctaactagtgttttaaagagccatcttttggaagatggagcctcagaccgaggttgtgctgtaggttctcagtgatgggccagggctatagttaggaggggtgaaattggaacacataccaagatggatacggatacaagcaatacggagtatgggttacggatatttattggaattcaagtcaaagcaacaaccgtacatatcaaatttataatagacattaaaccactctatgtattcaaaattgaaaaggcaactagattaatgcatattaaaaattaatagtagcaactctagcatgactgatttactgcatttacatcattagtagttttaccactagtattttaatcttgcagggagttttgcactagtagtatagtttactctcatcaaactagccgtacctatgagtttacaagtatagtcaacccaaaatgtgcatccatgcatactattcacggcttcacgaattatgcaaatacgtgactgcgtgtgcgttaataccaaggtacccaatagagtttgcaggcgagcacacgtctctcgtttgtttgctcatgtttctttgggttgtgtgcaatatttaatctgtaacttttgttttctttttttttatcaagagcctgacggctcccatttcttttactagaaatgaaacatcgagctacaatagtcttcagaaaaaaaaacaggaaagttcaaaagctagccctattacaagggttcctgactcttttcagaagttttgcctaaacagatatctaacagtaaaaaagaaggaaagggaattacaaaacatcatcacttatatctatctcatcccttgatccttttggtgttgattctccatccgaactgcgagttgtagacttcatttgccgactgtcttatgagtctggatcccagtagcagtcttcttcgacttgcctcctccttctgcagtagtgcccaggaatcaacccaatggcaagccaaaaagatcacatcagtggggtcttttggataaactttttcaaaacaagctttatttctagatttccagatggcccaaattatagcagccattcctaccataactaagtctttcatgttcttatcaagttttttcaaccaatctccaaacatgttttgactatcaagggctgggttcagattcaggacacaaattgcagtgttccacattaatcttgccaggggacagtcaaaaaacaagtgttgcatagtctcctctctatcacagaactgacattttttatccccttttctccaacctctcttgtataaattgtcttttgttaagatcttatttttggtgaagagccaaaaaaaaccttaatcttcaaaggagttctgaacttccaaatttttttctgtgggaaatgcacttgttgtagcttcaaa

SEQ ID NO: 68246 - DNA, 710 bp, Oryza sativa
atcttccgccgttgttttggtcaccggtgagttcgccgcgtcgccctctacgtgttggtgtcctccgttcgcgtcgtcgtgccgtcgttcgccggcgagtttgcgcgcctgagccgccgccggtggtgacgtcaccgctgacgtcatcgccgtcgtctctcgtggtctggccgtggaccgatggatcttggccgtccgttttggatgggtcaatatcggccgttcgtttccgtgagccgccgccgtgcacccggttcaccgtgaaccctagccgctgacgcaataattcccttttccttttcaaaaataattcattattgcgtcataattcaattaaaatctaaataaatgatttaatctgatttaatctttgaaaattcataactaattcatcttagctcgaatttagttggttcaagtttctaattttttctaaaatagagatctacatgttaaaaatatccacatgtactgttcatgcttgtttgtgtgctgttttggtgattttgctcctttctgtttagattccgacgtttccggagagtccgtttttgcaggagaagattttgaagagttccaaggccagcaaggcaagtcacacagatcccaaacatccctttgagcatgttgatcccgtttaaagctattgtttctattcaactattgcatttattttcgaatgtcattgggtggaattaacctaatgtttg

SEQ ID NO: 68247 - DNA, 12244 bp, Oryza sativa
cattagcacatgtgggggtactgtagcacgtatggctaatcacggactaattaggctcaaaagatttgtctcgcgatttccatgcaaagtatgcaattagtttttttaatttatattttaatgctccatgcatgtgtccaaagatttgatatgatgtttttggacaaaaattttgagaactaaacaaggcctaaacatggccaaaatccatactactatttcttgctaatcaatacccatttacctataaaactaataacatatatttgtacattacagctaaccaaacccatacgtagggctaactaggatgtaatgtaaaaaaaaggagcagactgaaatggacatggggaggaccgaaccgtttggttgctcggtttctctagcgttgtgcatgtacggtgggaggaggggatcgctgtaaggtgactccccttttacattagtaaataagtatattttctcccttttcaccacagctttaaaaatgatcactccatttgcatcgttgttctatggccctcacatgtcaactgatggtgacatgtggaaaaaaaactaattttggacaaatagtaacattacactagtcacctgatttttttttccttccaagttaagttgagtttaagatttagtggtaatgtagttcatgctaatacctacctcttatagttttcttttataaatttagaaaacttttaggtccagtttttaacggttttcacttattcaattattttcactggatattcacccatgttaaaattgcatatttgaacccttaatactgtggaatattggatgaaggagacggttttagagggatacctttatgggcaagtggaagccagggaatgggtggttgtgcgatagggtggcgaggtggcgatgatgctgctagtggtggatgcatgatttattggttatgtattcactcaacaattgtaggtgtcatgtgactagggtttggtgggcttgggttaggagaactaaggttacgagccgagagtgtaggaggagtggatttgttcaaaaaatgaaagataaaaaatagagtaaatttcacaaaactatatatacattgaccaaattattacaaaactaaatttaaaatgatgtgtcataaaactacagatttaacatcaaatttatcacaaaactatagatttatgattaaatatcgcaaaactatagatttattaatagagttatcacaaaattacaagtttagatccaaaataatctcaaaccttaggcgtttaaaactcaaatataacaatagtgctaaggatttaaatcccaaaatctgtagttttgtgataactatgctactaactctatagttttgcaatacttagtcataaatttgtagttttgtgataaatttgatgttaaatctgtagttttgtgataatttgttcaaagtatttgtagtattgtgaaatttactctaaaaaatatagtattaaacctcgtcaagtatatacatatgtaataatacagggaatgcccattgcttcatccctaacgttgtggagcaagggggtggttggccgatgttggaggcagagttgatcactagttggagtagttaggaggcaagagtggtggttacggatctgtcaacatgcatgagcctccagagatgagaaggagagacagagtaggggaactcaccagagttaacgaagtgggtagtggtgaccgtggtggaagaggagagagggaggcgatatgatgaagaggaaacagttgggtgtgcattggccgatgccaacgtgccaatgccgataagacaaagggcagtggtgcgtagataacaggttgagacgcattgggacatggggaggcggggaggaatggatcacaagagcatgagagaacaaaggtgggtaatgtttataggtgttaacaaatttgaatcaatctcgacatttaaaaacgacacaggcaaatagataaccccttgaagtgctataacgacaaatgtttaagcttaaatttgaaaaataaatcccaaaatcaactccaaattttagattgaaagtttaaattttagatgataaatataagcacaagcaaaaagataaggctgacagtatttctcgaccggacggtggtcataataaattaacttaaaaatatcggcaatgtattgataaatagaactcatgtgaaaacgtgttagatgaatggccacgtacacaatcgattgatcgatcgacagctagctagctacaagtatatatgtgaatgtcgtacgtacgtgttaatcggtgccacacatagctaggcttttatataattgagttaattggtccttcatgtatctatcaatcgtccaaaaaacgtacgatcgacgactttgcactgcatggacacgcacgtacgtgcatatatatatatacgcacgatcgatttgcactagtgcagtacgatcatctcataaattattaaacaattaaaattaaattgtttggcccacgtttggacaatcaaacgtgtatatatatgtctaatttggagttccaatgggtacggtacgaaccagtacacttgactttattgtctttgtatttaattattatgatgattacattgacgatgtctttttctcctcggtctaataagctaggtaggtacgttaatcatcatgtgtgtatagcctaacaattaattaatgtcataaacaacaaaaacaagttatacaatgctactgctttctagaattaggccggcctacaattctgggcaatgtacatatatatacaccatccgtttaaaaaaaataaactttagccatgaacctgtgtgtccagatttattcttagggttggattcttttgacggagtagtacatgtgtactgtgtacacctaataagtcaacttgatgcatatatacataactaaccgagaatcacacttgagcctgcctacgtgatggctaaaacttcacatatataccttttgcgtgtgagcgacgagaagagaggaaaatcactggatgcaacatatagcacgtgttgattttatggtgtccactaacttaactgtgtatttaagtctaattttttttcatgaagaagaagcatcacccagactagctattttgtctttggatgattgatcggcataaattgtctctgtcttttttttttgtcatgaagccacattagtccaactattttatgttttagattattgatcaaaggtgcaaagtttacatatacagcatgtagagtcaaaccatctaatttcaaagaaagagcacattgcgcctcatatttagcaaatttgtcagacaacttttaccacataactgccgctagagtattcacaaccaattttgccaatggaaaactttgctcctggaagaattagtggaacctgtatactctaaaacttgtctgaatgattgagccaagaagaagaggaagaatttttgtcatttttaaatttttattttttaatatttacagcaatattataccatccaaaatatttacagaagtagcccctgccgcccaactggagagcggcaaggtgtgcgcattttgtactgaggtcccttgccgccctctgcaagggctgcaagggggcaaatgcaattttcgccctgctaaaaatgtatttttctagttttttttcatcctgttcgtccctcatgtcaccctgccaccctggtctacttctgtaaatattttcactggtataacatttctgtaaatattaaaaattaaaaatgaaaaaaatccgaagaagaattagtggaagggccatgacgtgtagaaatatgtgggaaacataaggcccattagatccaacagtgaatacaagtgtcaaggaataatagcccacacacacaaagagctaagaattttcagcctgtacacatggatatggacctcaatgtaggcccaagttgatgaggccttctcaattctcaacgagaaaggccccagggatatatatggctcctcaaggaaaaggttcactttgctcctttaagtatagttgtggatttgatacgtcatatttctcaaccacaatacctgccatcacgatttctccaactattaaaaccgtttaaatggttgtattaacggtggtttttactgacgtgatgttcatgtgacagcctaatcatcaaagatattaaaaaaaaacttgggaccacatataagtggcaagggagaaaaatggaagaaaaaaaagtggccttcgtgttcttggcagcagcagtagacgccgccgccaccggcgatgtaggaggaagccagaggaggggtttgacaggcggtcaacctagcagcgcagaacgagagtgtgcgcacacagcgatgacgagttgagttgcagaccaagctacactgccatgatagggccaactgtgagctatccagtcgccgagcttatgctcatgttgctgcttcgtcgtcgcctcctctcccttctcttgtccatctactgattggtaccttctctgcttttcttttcgttcttcgcttagctgattcattcgttcgtctctactacatggcgcccttccctaaaccctgattgattccatttttgcagcttcagaactagttgggtttgctccatctctgtcctctttgggatccaaccggtacaatacatgattgattaataattgataatgtattcactttgcgttgattcagaatggctgcccagtttgatcaaccgatccctggatgcaattatgctctcaagttttaatctttttggagaatttttaaaaggagaaaaggccccaaccaatacgtagactagaacatgaaggatattttctaattacatatagttttgaaccaaccaaagcgacggcgatcttgctcttgagccgtcatgctccaagattcacgtgcctagattaggaaatggatttaatttcatccctcgagggaacatcacctcattttttccatgccacttaataaaagattgaaaaactttaacaatatagattaatatgaaatatatcacttcacaaacagacaatgccaaatttgacttctacaagatgcaaaaaaaaaacaaagtaaactgaaaattcgcagttatatttgttatttgtagaagttgaatttgaatttgcatgtttacatcgatatgttgcatattaatctatcctatcaatttctttcattttgtatgactgtttagataacatgcgggaaacgagtggtatcctttcgagggatgaaaatactttcccatattacaaaacctcccataatgtgccgcctcctgcctctgccgcttgcccttttgtgccgccgacgaagtggagtaccatcattgccactgcgatggcaatggcagattctagagcatggacaacatcttcatgtgacacaaggtaagagacctgctcatcgtgatcgcctacttctctatcccactgacccactcgatgggagctcgattggggagagagaggggagaaagagggagaagtggccactaatctctggtcttatttttattttgtttttattatcattgtaatgccatgtatacgtcacaagaccaggtcatacaacacgtaggtgacatgtaagtgtgaaaaacattgtctatattgtcgagggagtcgtttagagcggttttggtaattggaggaatcgttatacccaatattatggttgaagaatacaaattaaatctaacctatataattaaattggtttttttcccgctcctgaatgcataatggtcagcatatgtctccatccaaaactatttctctcattctctccgacttgaatatctatctatctattgtttgtctgttttgttttggcttatcagatttaaggaatgatttgcatctttaccttgttgaaaaattattggctaatcaatcatatgcactcactactaaaaaaacattttttagcgacatttgccttttatttttctaggcaggtataaccctcgaagccaaatgtccgcctacaaaaatgtaaaccggggtaaatttttttcatccgcctgcaaaaatcaattttttcagacgaaccacttaagaggtccgcctgtgaaaatacctttatttttgcaagtggacctcttaagtagaccgtctgaaaaaattgattttcgcaggtgaaaccttatgtggtccgcttgcaaaaatcatgcctccaccaaaaaaaatatctaagtcaccgagtcgtccttatcttcaactcaaagtcaaccttatcttcgactcaacctctccccaccactcatttcccctctccacacacacactctctatctctcacgtgcgcgcagggcaacgacggtgttgggagtgactccgacgagtggcagtgttggtggcggctccgaggaggaatggtgtgggcggcggctccaccggctcgcctcctcgccgcttcccctcctcgccccctccgtcgccgggcatgacgagcgacgacaaacagctcgccggctaccctcctcgtcacctcctccaccggccacaacacgcgactacgacggctcgcctcctcgccaccttcgccgccggcttccctcctcgctgcctctgccaccggccgcaacgcgcgatgccgccggctcgccttctcgccgcccctgccaccggacacgacgcacgacgacgacggctcgcatcctcaccccttccgccgccggctcccctcctcgccgacgtgacgacaacgacgaacgcgccgacgcaacaacaaccgagtcgaggcgacgacgacggcgccgagtctacgactgccgcgacaacgatgacgacgacgtctgtggaggctgcgaatggaggaggagaggcggcggcttggctcctccctctcctatgtggggtggcggacagaggagagccgtcagccggagggggaggccggcggcggcgcccgtgggtaggggtggtggatttttttcatttgctgagatgattttcgcaggcgagcgatagtataccggcagtccttcccccgcctgcaaaaattgttttgggccatctggaaaaacgatttttctagtagtgacaatgaataatccaatcaattgcctaaaaaatccaatcatcaagtaattaagcttgcaagtaaaaagtacatgaatcggggttgcatcctgaaagaaaaaggaatcgatgatttagttgtccgctccagccggtaggagtagtgtagtacgaagaaaagatgaaataataaagcagaagctgcattctgcgagaaaacgggacagcgagatgtcatccacaaaaaagctttgctaactgccatcttctcttaattagcagagtggaataatgttgattagtttaagcttgagcctcagatggacatcgacatctcatattctcatgctttaatatgtggtaatggcattggtggtagtcatgaagctagaacactcttgcattgtgtggttttttttatgaatatataataaaatacgtacattgaaaactatgtcaaagtcttagaccacgagtaaaaaagaatccagggagcaggaggttcagatggtttgatttgctaaatatatgtagtagtacttcgttgacaataatactcgatcgtataaagggttaaaaggctattttggagaactgagacttactatatactccatccgtttcacaatataagtcattctagtatttcctatattcatattgatactaatgaatctagatatatatatctatttagaatgacttacattatgaaacggaggaagtatatacagctagcactgcatcatgggctcatggcaataaaagagctcgatcacatcgaccaagatacaaaatacacgaaaatctcatacactggaatggttatctggataacaaacttgcatgagttcgatcgatctggccagggtccaatgatcccatcgcattcgctagctagctagctaagcccatgtttatatgaaatccattttaagaagaaggcagcaactaccagctgaaacggtagttaatcaccaaacatgcgtatctacatcatgcatgatgctactatgttagcgaagaatttaatattattattattggtaggaagtagtacgaaggaagaaatggaagctagggagggctccacagagacacaggtggtggatgtggttgcaaacagaaacagaaagtgtcgcgcactgccatggttgatggaactcttgataacttcattctttaaccatatagtataagctactccccctccaaaatataagcatttttagctatgaatctagataactgtgtgttcagattcacagctaaaacttgttatattttgaaacggaggtagtaatatatcttcttttcaatttacactggaatgttatataaatggtcccttcataacttcacataaaaactatcgtgggctcgtcgactctatgtatctgttatggagacccacatcgtttagagctttttatttgaaaaatgcagaattttgttttttaccgaattcagttcgattacttaaagaatgctttaaaaatcctattttacaaaggctctatgagtttctaaaatctatttatttgtacgtgactctaccatacctactatactgagatagtccacaaaactagtaatccaacggttctcgaggaagacaatagcggggaactagttttcaatcggtgccaacggtggctgcggcgttacctctccacataatcccactcctgacggggcaagaaacgatcgggttggcacaacaaggctggagagcgacgacgagtaggcgaggcgagaggatgaggaaggcatcagcggactgacaacatctcctccctttggatctgaatctggattggtggcatctcctctctttggatctagatcggcggctgttgatgaaaaaaatcgaacacaccggcctaggagatctgcttagctcctgtgcaggtccaaaagttgttgagatgagggcgtgccagtcagtttgatcctgcaactgacaagatatgcaaatagtagatcaaacagccgatcggctaacaaaccgatggagtagttccagccgatagtgataatagccgatgccgataccagccgatagcgatagcgtttaagcaatcggctatatgtccaatgtagataataatataaaggcaatcggctgatgatgatgtaataaaataacaatataatccagtataaaccaatcggcaaataatgatatgataaataagtatcgatccgaaagttaaagcacacatcggctggaggtccgatgtcatgaaatgcacaagattagattaaacagtgaaacctttgttgtcatcggctaaattcaacttatatgtatatgcaatccttatgagccgatgcaacgtccagataatttactggctgaaaccccgatgaacccttattggcagtcaaaaagcaggctagagattatggttctaagcacgacttagtagatcaaacttaactgatgcagcactaagtatgaaaagaaacacaatatctagacaatcaagccgatgactgattttcagggtggtagatgcctaagctaatctaatctaacaacgcgatttagccgataccggtagaaaccctaaagcgagaagcaaccgatagagctaaattgatatgctaagactagattaacagagacatatgataaataggtaggcaaatatatcatccaaaccagagcaatccaagaggtcgaatgtactgatgcagccttgaacgacgccgacgtagacgatacaattgcctgggccgacggaacattggacttaccccttcgccagagatcgaacatcgatgcagccccgcgtcaggtagggatgaaaacggagcggatacggacggataatgctcataccatattcgttttcatattttttgccggatacggaaacaaatacggatagctcgaatacggaaacaaatacggactatctcgaatacgaataagaatcgaatatgatcggacacgaatacggaaacaaatttttcttggaacacgaaaaccaattcaacttctaatagaaacaaatatcaacatatataattagctcattttatataaaatgtagtataatttataaatatttttaaaattttaaataatattaataatgtggactagtgttaagagatgaactactattaaaatctaaaaaggtatattgaaggtcatagagttataaagaaatggggtatgtcttgtggcttctgcggatatccgaattattattcgtatccgacggaaaccctgataccatattcgtattcgtatcgagagaaaataccgtattcgtatccgtatccgaactatccgatccgaaaggtatccgtattcgtttttatccggagcggacggaaactatccgctccgttttcatccctagcgtcaggtgccaagtcccgccggacgataaaataaagtagaaaagataaaaggtggcgatgcgccgaattgtattaatcgtgaagatagattacatagaccccgggtgtacatatttgtacccatgggttgatacaagttcttgtccgacaagaaataaactttcctaaagataaaaggcaagataaagtctttataggacactaaacacactttcctaaagataaaaggaaactaacgaactattcctaattaatagataacttgccatgccgcattctctttgaactcggtctcttctggataagctttctttagtatatcaatttccttaactgaatatagcaagaatccgacaactgacgacttgacaattctcatcggctaatctcaggacttcaaagccaatgctgactctaagccaataactattccgggcttaccaaatttcactgttaacagcggcatgcacgatttagatctggagcagtggcgaggtggctcgagcaccgacatagtgacacatgtgagagtcacacatcttcttggaggtgatgttctgacaccctctcggcctcttcctcattagtgcttggtagtgaactcttcggatgaaattctttgttctggatgccaggaattgcaccaatggcattctagatgttgcaaccttctcaaggatattgcattggaagtatcctattggtgtcgcgtctcgtgccagcatccccgtaggttgggtttggtggctatggcgatggcatgatctatatgaatgactgacttatagcttagttgctcttagtattttccgtgttggttcaacgttagttatcgactgtgatgatagcgaaatatgactgacaaggaaacaaatacagaacaaatgagtgtggcggttgccattttctgttgaactctataagagagtcagggagaccttttggaaaactacagaatgaacaaccacattatctctataattgtcatcttgtggtccaatcaatccatgtattttcttcaatattttacaatcttcagtgtttgcacttgaattcatcccatagttatatttttttccttatacattccctttttaatcattgtttcaaatagttgttctttaccacctcttcctaactttcacttgcttgtttttcatgtccacacttcccaactcattaaatagtttgttttttgaaagaaaatgcatatgaaagtttttttaataaatatattgatttatttttaagtttattttaactaataattaattaattatacagtaatccctccatcccattttgatcactctctaaaattgctgaggtattcccaaattgattgtcatctaactggtgtctatccatttacatgtgtaagagtaaatgtgttgcgtttctatccgtttatgtgtgtaggagtaaatgctatagttacatatccgtttgtttatttgtgcatgagtaaattgtattattgcatcctcacgtgcatgtctaacataatattttgatcgataaggtttaatttaagaaagaatgatgttttttttcttgatcacgataacacttatgaatatgatgatgaagaggtgtgtaaaacatagttgaagatgtggaaatgggtggttgtctctccctctcctcctttcttctccaagtcaacagttcctacgctaccaaacccgatcggacgcggacactgacagagccgacgccgacggacaccaaacttcccttcaaatcaagggttataggagcacaccacgcgggtgagcctcaagaaaggaagggggcgagtccggccgccgtcgccatgtccaagccacagcagcagtcgg

SEQ ID NO: 68248 - DNA, 27411 bp, Oryza sativa
tgcttaccccattccgttaagatgactaactatgtagggtcaaaattcattttgagtttgctctatcccttagttttttttttactaaacaagtggaaattcgtattaaaataggggcaacatttataaaatgaagcttaatgtaaaaaaaaaaggagcaaaatcataatgtcctcggaaaagtagggacgaacaccgttaaatcatgttaacaagagcacatacaaacttcagttaaaaatgacaaaatcaaaaacttcaaaaaatagggatacaatcttaactgaagtattacaaaatcacaaagttaaaacaaaaggtaaaatcgtagctgaagttaaagaacagaaataagaacacaattgtccatttttacccagagatgactacacggtggcccataaaccaggctgtcttacaaggtgatcttgtgggctttgtctgtaaggcctgtgaggccatctgaggtccgaaaccgggcctagctcgtccagatgttaggacgtcaaaattgcttgttagttgattggaataagtctattttgctccctcctctcttgcttcgttgaatcgtatccctcaatcacaaaaccggatataacaccttgcacaatttcaaaaaccagttcaaattgactctttgggtggtttcaaaagcggtttttccataatgacagatcgacttggtctaagtgttttcacgtggtagcccaatcattaaaggagttgaatatagaagggggacggctaatgggcggcgatcacaggcccacctgctccccctgtatgctcccttctctccccctttctcctctctttcttctcttcatactacagtacaccatacaattttaaaaaataaaaaaacaaagttgaaaaaatttatgtatagaaatacaaatactatatataaaaaaaattgaattcaaattcaaatttgaaatgagtatgtaaatttttgacttataaactttgggtctataaactaatatttgaattcaaattcaaatttgaatgggtatgtaaacttttgacttataaaatttgggtctataaactaatatttgaattcaaattcaaatttgaacgggtatgtaaacttttgacttataaactttgggtctataaactaatatttgaattcaaattcaaatttgaacgggtatgtaaacttttgacttataaactttgggtctataaattaatatttgaattcaaattcaaatttgaaacgggtatgttaacttttgacttataaactttgggtctataaactttaggtgtataaactttagatgtatagaaatactatatataaaaaatatttgaattcaaattcaaatttgaatcggatatataatcttttgatttataaactttgggtctctaaactttaaatgtgtaaacttgaggtgtacgaactataggtgcataaatttattaaaataggaaagtaatacggtgtcaaaaaaagaaaaccaggtggaggaagggggatccggatccgatcgccctgggcgatcgctcgcccagtagcaattccggcccgcaatgccggtttaccagtggcggactggacaaagttggccgttgatatcggcggggttggcaaataagttccacatcccgctgcagccgaggcacacgcagcaggctagaggggctcgcggtggcgttccacagctggtcctctccatcgccgccctcttccgcctcccaatcaacgtcgtccgttccacacggcggcaagcagcaacgacggaggaaaccccatgggcgctgacacgaggtcctccaaggtccggtgctcgccgtggaggcggcgtgcgaggtctattatgtacacgcgggaaacagagaactgtgtcgccttgacgccgaacagcctagcgacgtcggcgatccacggcgttgggaactcgaagagtgcaacgacccgccagatccttgcgacctcctctctatctcctcgactcctctaggctggccggcgtgcagcgcacctcctttcccttctcccctctctccccagatgtgggaggcaagcaacaagcggcgggagtggagctgggcggggcggctggtgggagatcctagtcgcatgacgtcccgtgcctcgtcgcgcacaacgacccaccgctcgctctcgttgtcgccgtgctctcatgcatcgatggcgacatctgcccgtcttgcattcacctcacaagccaccaccatgtcaactgagggctcttgagccaccgctgtcaccgctgccacctccgcaaggtgtcattcaattctgccaccaccgagcatgatttcggtagcaccacctatgtggtggacataggcgaaccttaaccctagcttcggcgagtcgctgcaatggatagctttgtgaccttctcccgctgtcgccgatgttggatcctcctagcggcgagtgggacagtggcggcattcgaggtgtacaatatctactaccacctggccatggtggcctggcgccaccgcctcgtgcagctggttggcataagctctctcagctcgtcctcgatgaccctaatgtcagccgagtcttcggcaaggtcggattccgcaatgaggacatcaagctcgccattctctgcccatgccgctcttcggctgcctacccatgtgtagctgtccgccgcttctcttcctttgcagcttcgccgccgcagacgacgctgttatcccttatcccaccgggaaccttgccggctcggggggagaagaattgtcgccgcatcgccaagatcctctcccgtggtcgcaaccccatgctcgtcatcacgggtgatgcgagagaaatagaaggactgacaagtggatcccatattttttttaatttttttgaccattgtaccttacaaatcggacccacttctatttcaactcctttgatgactgagctgccacgtcgggacacttagaccaaggcaatttgccacgtcagcaaaacatctttcgaaactatccaaggagtcaatttccaccggtttttaaaattgtgggtggtgttattctagttttgtggttcagggatgcgatttaaccagggtaaagagatgcaggatgcgaaatagacttattcctagttgttacttccacgtagattcggcccatcctcatacccatgcgctctggatgtaggcaggaatgtaagtacgtaacaacatatacacaaagtgttggaaatatagtcatatatcggtatattttaatccaaaatattaagacaataatcatgacatgaataatgtgaggtgatctagtgataaaattaaacataaccaggagcatgcttaagataaaataagcatcatcatcatgtagagaacgcaataacattgcgactaacagaagtaacaaaaacagagatagcggtagaatgttatacactatgaaattccatccctggattgtgaggtagaattgcctccgttggtgttgtcgatcggtgcaccagctccggctcccggtgcgccagctcccgctccaggtgcgccatctccagaagacatgatgcaaatgaaccgacgacgaacagaggaagaagagcagtcgtgcggaagcactccccaaaaacttgatcacccgcctacccggtgcagatctcaggcgaggtgtggtttcggagggcttgctcgttccgatctctcatgtgcgcaagcgatcagaaccggggaagcagaagcagcacaagcggtgcaaggaggaagaaccagcaatcggagagaaagcgtagagatctgatcgggggtctctgtttcctaatagcgcaggagaggaatccgcccgttgccgcagtaacgacgcgatcaatgcgtattgaattgcctgcccgttacagaggcaatctcgcggggttggattccggtccattgcaaaaggatcgagagagagacagagagagatgcagacacaacgcaacgcctcggcctccccacgccctcgggccggccggctcggctcggcgcgcgcgcgcgcttgtggctttccgatccccacctcaaccggtcaacagggagcctccaataactccctatttaagttgagatactccacttttaattcccagtgtggtattattatctttaacatttattatgggcccttgagattttaatagaaaaatcgggcctagcccatttattctaacacaaagtaagtaacaacatccatgaagtgacctgcatgagaaaatactcctctctcttgccactcttttttatttctgccctcctctctctgtcactaagtcctctccccactcctctcccctctcccctcactctcggtgagtgagggccacggcggctatcccatcatgggtctggcagagggagcgagaggctgacggaggagtggccgagcgcagatccagcggcggccggctgccgtccccagccctgatccagtggcgacggccctcccccacgcggatccggtggcggccctccccgcgcggatccggtgcccctctcccttccgcgcggatccgtcggtggcggcgacgcaatgaggacgacgatgacggcgacggtgatgggaggacaagcacgccgacgccaaccggagggcgaggacaaggatggcgttgacaatgagaggattctagggttagcgtatcggggtagtggggtagttttcaattttcagaatttatatatattttttcatgattttttccttttctcatgtggtcagcttaagcgcccatatgggaaaatccgattttcgtagacctttgagcacaggtgggccgcccatccacatgcaaaagtcgattttagccgcataaaaaaaaaccaaatctgtagtagtggttactcatattgaccaaaggcaagcccagcataattcaagagtattaaaatgaatatctaatattttttataaaagaaatagatatatatcgtatgtgatgcgtatgtgtatgaaaaacaaataaaatggacgtcatattcaaaccaagaagtcatcatattcaacacataattaaatatatatgctatataaatatcatttttttaatgaaggtactgccaggtctttacccaacagtttgatttatgctatataaatatcattactactatatgataatatacatgccaactattaggtttttggctgtaacttttctttctacttctctacattttgaataacagtttgattttatgctatataaatatcattactactatatgataatatacatgccaactattaggtttttggctgtaacttttctttctacttctctacattttgaatatacaaccttaaaattctagattcacccctaatattaaccagttacaaccatttcacattttgttagagtgcgcagcccagtggtgggccacccaagtcacattgggcctgttcctccacaagcccaaccgaaaccacaactagacctacacaatccaaaagactagtctgatgggtgagaaccgccccccaccttttgagtcgtgctcccccatcataaattaccgatgtgggactaaacccaacaatctctcccgtcacatcaacccatgtgacccgatgaagactccatgtgacccatggaaattgttccgggttccaaacctagggcttgtgggtctgcatgtgacccaaggaaattgttcagggttccaaaccttgggctctaatactacttgttagaacccaacaatctcccccgtcacatcaacccatgtgagtatgtgacccatggaaattgtttcgggttccaaaccttgggctttgataccacttgttagagtgcgcagcccgacctaccaactgtgagccacccaggtcacattgggcctgctccaccacaagtccaaccggagccacaactttaggtcctgagcctacacaacccaaaagactagtctgacgggtgaggaccgctcccacattttaagtcgtgctcccccatcatcaattaccgatgtgagactaaacccaacacatttaatttctcatctctccttaatcctaaattaaacatcagaaattcagaaatgtttgcatttcatgacaaagagagtaagtatatattaagaacacaaacttaattcctacgaataactagtgaaagtttatctttgttcctatgaataacacaaacttatctttttatcatgaaaacacgttgttttagatatagatatagtcgcgctagcttcttaattcaactttgagtaccacaatactccctccatactcacaaaggaagtcgtttaggacaatgtttaagtcaaaccttgggaatataaatcatgaataactctcaagttgttgagtttgaaaatgtaaaaattatatgaatatatttgtcttgaaaaatactttcataaaagtatacatatatcacttttcaataaatatttttatagaaacaagaagttaaagttgtgttttggagaccgtgtcgctgtcctaaacgacttcctttacgagtatggagggagtatctgacagttggacacttggaatattaataaatataggattcgcggagctattaacacaactgcatcgatctctctgatattgcagttagcaaggaattggaccacacgttcaaatattaaagtgtgcattgcatatatattagccaatgatcacctagaactttggagaatgtatggctagttcgttggtgttcatattgtacttgcgtaatctcttcgctctgcatgtgcgtgtcgttgactagtgaggtgtgatatatcccagctagaagacacactaattattaacttaagcacaccattcccatgggtctaatttcttttgccaagttcaactacttgactagccggccgtgcatcaatatgcatgcacaccactacgtactgatcgtatgatccaactatagcgtgcaaggatcggggcaagagacgatgcaaacattaggtgaactattttaatccctcgaacagatgattccttgtttgttgaaaaaatcatactgatagttatgaacaaatctttaaatctttaataatattcatacaacaaaaatgtaacaatctatagaataggcataaactgaactcacgcattaagaaaataaaaagataaagacaacatataaataatactagtattttttttctcaatgtgttgtcaagtttgaacttgtttttcttgagcatgcaattaaacttgagagaaaaaagagaacggatattctctctagggattagaatatgttcctacaaacatagggcaattcgaacttaagccctacgtttgcctctctttgatccattaaagaaaaaaaatcaaaattctgaatatacaagagggctaattaagaaataccctcaagtggtaaagtattttttcccttgtgaggggatatccctaaattctcgaatgcatttaaataattatgaaacaatttgataacacagatcaatatgtgatatatcatttcctaaatatacaaaatcaaaattggtttttacaagttgaaacaaaagatcgaataatccaattaagaacatgccctaataatttggtttttttattaaattttatatggcgtatttaaacctaccttgggtttaaggattttttaacatataaatttttattttttttaaaatttaacttttggatggatttggaaaaacttaaggacttatttggggttaccaacgaaggggtccccgaccttccttggccctggactttaattaatttggggccaatgtgcttggatcaacctgtcaaaagcctgaccacactttaaaatactatctttgtgtgcctatatcaagtagccctttgaatcgcacgaatgaaaaacggaaaaatacagcattctgataggaacgtaggtgtaaatcagatgattgcaaaacgcggaaaaacacaggaatggtcgtttgattggaccccaaaaaaaacacatgaatcggatgagaaagataaactcaaggaaaatttttcaagagattgaagctcttgccagtggcggaccctctcttgtggcatgctgtggcactggccatagctatgccatgcaaggattgaagagtatttatgcatttggccattagcatgttgatttatgtgctgattaattggttatttgatttgataaaagtttgtttaattcaggatgtagggatttcgtagaactgccttatgtctgaaaagaagactaacacaacccgtaaaaaataagtatgctgctttagtaaatttccactagtttattgcttttttccttgagcagaattattgattggactgaccatccaaaggtctggccataaacagagcacatatgtaaaatggacgcacactcttgtgaaaattatttcactcgtgaaatttacattacaaatttaggactattgtcgttaacgttttatttagtgtgtcgtatattcaatgagtgcaatttgcagtatagttcgtgtaaaaaaaattataaacaaacgtagtcctatcatattgatccgccatagctaaaatttggtgttggttccgccactggctcttgctatgttttctctaaaatctccattggattgcctatgttatagatatcgtaaaacatatgataggatttaatcatttgttttgaaagccttcatagaaaatttttctatagaattgaaatccttcgaaaccgctatgttttttctacaaatcaaaagcgaagatacgttttcacaggggaggttatgttggcgtttttctcccttcaattgtagaaacttcaaacaaagttagggcgttaattaaccgtgccaatgccggtcagcgactgctcctactagcagttgcaccaacgtatatactgggtccaggtatatttgagctaagctggcggtataataataacaaacatagttagagaaagctatcgtataaacttacagatatctccacatgggagccgtgcagccagctaggtaattaatctgcagaaagcactaattaatcctagcatatcatctcgcatgatcatcgatgcatgcatagagatatctcaaggcacacgtactccactaatccactctataaatagcgaagcacgtaccacgaatccctcagctcgtaccagtcgtcgtcctaagcaagaagaagctaagctagctagctgtgatcggagaggtatacagtgatcagtttgattgtgaatttgtgatcgccatggctgcagcttcgtctactacgactcgtttttgccttctccttgcgctcgtcctgccgatgatttcctccgccgccgccggcgacgacgcgctgccgctgcccatgacaccgtcgtactaccgcaagtcgtgcccaacactcgaggccatcgtgcgcggcaccatgctcagtgccatcaaagccgagcgccggatgggcgcctccatcctccgcctcttcttccacgactgcttcgtccaggtagatgatcctagctaagcttcatttcttcctgctcattgggcggatgatctatggagatcttgaagcaatgcaagctcacattgcttgtgattgatcagggttgcgatgcatcgattcttctcgacgacgtgccgtcgaaggggttcgtcggcgagaagaccgcggggcccaacaccaactccatccgcggctacgaggtcatcgacaagatcaaggccaacgtcgaggccgcctgccccggcgtcgtctcctgcgccgacatcctcgccctcgccgcccgcgaaggcgtcaacctggtatgtacgtgtttggttaccgcgtttggttaccgatggtgatttcggggccggtttcgtaacaacatttctgcactgcacacgcaatgcaatgcagctcggcgggccgagctgggaggtgccgctggggcggcgcgactcgacgacggcgagcaagagcgaggcggacagcgacctgccggggccgtcgtccagcctcgccgacctcgtcgcggcgttcggcaagaagggcctggcgccgcgcgacatgacggcgctctccggcgcgcacaccatcggctacgcccagtgccagttcttccgcggccacatctacaacgacaccaacgtcgacccgctgttcgccgccgagcgccgccgccgctgccccgccgcgtccggctccggcgactccaacctggcgccgctcgacgacatgacggcgctcgccttcgacaacgcctactaccgcgacctggtcggccgccgcggcctgctccactccgaccaggagctcttcaacggcggctcgcaggacgagcgggtgaagaagtacagcaccgacccggacctcttcgccggcgacttcgtggcggcgatgataaagatggggaagatatgcccgctcaccggagcagccggccagatcaggaagaactgcagggtggtcaacagcagctgagctagcaagatgatgatcacctactatttcttgattacttttcacagttttttacggcgtacggttatttcaacttaactcatttctgtaataagttcgtttgttttaatctccgaacttcttgtcacggtatttgtaatttaatttgtttatttgtacctctgagcttgttgcagtatttgtcgtttaatttgttcgtttgtaactctgagcttgttgtgatattaattatcaagcaaaatcggaaccattttacatttcaagaaaaggaaagaaagcaggaggtatttttatcacctaggtgatgtgatttaaatagttaaataaaaatgtgaaacaaattgacaaaatatcacttgaagatatgtccaagtgtaatcaaatctattatctatctatctatcttctattatattatattatattatattatatactaaaagtccatgaaacttcctacaaacgctctcaagtcgccacgtggcgctctaataaaatagagaaaatcctagaaattctaagaaaaagcaaaacatctatcctttgattttcacttaaattagtgagtccaatattatacaccgttagataaaatcgatcttaaaacaaactaaataccatgagccccacctatcctcctcccgcgcatgggcaggtggagtatataagtacctacatggtagtacgtacgcttccttccttttttttttccttttttcttctttttaccatatatatatatatatatatatatatatatatatatatatatatatatatatatatataatggatatattttttaaataatcatgattttataaacaaagaatctaccatcacataacttaaaccggtgtactctttactttgcactattattttcaaataatgcactgttttaaaataaaatttacacaataatatcgtgtacctatcaaattaataatatctatattaactaatttatacgtgcacttaaactgatggccccattatataaatcatcggatctattttttattacattggcctattattctcaagtaatgcactatttcaaaataaggtttacaccattatattgtgtacccattaaattaacaatttaaaatctatattaactaatttacacttaccctataactggtggacctattattataatcatcggatcaattgtttgctaataaataaagcgtctgaaattctctttttgcctgctgcacaatgcacgcctgcacctttgcctttcgcacgtgtgacaaagcgtagtgtctgagacatctaagatgatcacaaccgctgtagcgctaccgctttgccacatatcaaatcatatatggagataattaattttgttaataacatgaaaagaaaattaaatgtgtgatgcagcgagagaataattaagcactatgggttgtgtttttctcaacactaattagctctgtttaagttgaaaccgagagttgattacataataattataattataatgtatttatgttatgtcgtatttggatttcgtactatttgttcgtacaggtgaaaggaatcattatgttataaatgtgagcgcaatattgatgaatatcaatagaactcttactacgacaagggtgataaagggagtttaaggccctctcttttttcccaattccatttttggatttttgtttgcacgctttccaagtttctaaatggtgtcttctttaaacaacattctaatttttttagaagtcaattcattcgtttataccctcaaatagctatcacataaattatataattcatcaatttcatcctaaaccttaagtactacattttttttcatgcaagtcatggtgatcagtaaattggtgatcaacggatcatcaaagttgtaagataaatatgtaagagttactctgaacaattgtaaataggtgtcaaaattaatttctattaattagacatctaaaggtgtcaaaattaattgctagccacaaaattaatttctctctacgtgtatataaacatggacgaagttggaacaaatattaccatatgtcccatacatatatattgcgcagttaatattctaattacatgtgttaagtcatttaaaattccttaaaatgctctcaagctgccacgtggtgctctaataaattagggcaaatattagaaattctaaggaaaaaaaatcaaagtatctattacttgattttcacttaaatcggtaggtccaatattataaaccgttagattaaattgatcttagaacaaactaaatactacgaggtcccacctcggcataggtacgcacctacgtgcgtgggtacgtacgcttcccctccctttttttcatttttctctttcttctttttttcccatgcatatgcttccctccctttattactatatcatgcgccttcatgagacgatttaatcaaaagaattttgagtatcttgcactcgcatttttcatttgcagccatactacacgtacgatatatatatagatggactgtatgataattaaccagcaatggtttcttatttagtcgagaaaaaaaaacatgattcaaaagtcgtaagtacttaatccatctcctactcaaaagttgtgaatggttttttaagataccttaagaaaaatagaacccttaaattattactccctccgtcacctaatataaaggattttgatattttgcttgtattgtttgaccattcgtcttattaaaaaaatttggaattattatttattttatttgtggcttactttattatccaaagtactttaagcacaacttttcgttttttataattgaacacttttttttgaataagacgagtggtcaaacagtgtaagcaaaatatcaaaatcccttatattaggggacggagggagtataaaataacattatccaaactttagtttgctaaagtttgccctgaatctatgagacaaaatttctaaataaacaataatcttacctttcaataatataatataagtgcccgcgcatacacgcgggccatcttcctagtttacttaattagctttgcatgtttgtaactttgtatatggacttctagcatcacattgacgtggcacttatgtagcagtttgagtaaaaaaataaatggaacaaaaataaaaactaaaaaaactaacaaaatatacgggacccatacgtcaaccaaaaaaaatagtggaacccacgtgttagtgggtcccactacctcacctcagcctcttctcctctctttctcttctaggcctccatcctccatccccgccttcatcctctagcgctccggcggtggtagcatcccacgacggcggcgtcgaagcgggtgaccgccggccacctgtggcttgcgggctccaagaacgccagcggcggcaagaggaagagagaggactgcagcgaggacggggggagaggagtggcgtttcagtgggcggtgggagaggaggggcatgcggtgggcggcaggagtggagcggccactctccttccctccagatctccgcctccttgctccggctccaccgccgccggcgacaggacccgccgcgccgccaacgcttctgcgtggaggaggaccgaccgcccccgccccttgtcccagcgcatccatcctcgccgtgcggaggaaatgcggaagaggtcacccggtttgacaactacgtcgcgcgcgacgggcccttgccgactcctcctgcagctcctaggccagctgcgtgaactgcacctcagcttccgccaagccacgagcacatgcccccgtcacggaggccgctgacaatgacgactcggccgcctcccctctcaccccactctcctcctgcacccattagatccgcccgatcaccaggagtgtggccgccttggaggcacaatgggcgacggagagaggggcggcgaccatcggggagaagggcgacgaccagcgggaaggagcgaggcgacagtcacaatgtcactgacctcaaccgccacggggagttctagggacctccgctcccgcctcaccgccgcggggaggctaagcatcgaacccacggcaaccacgcgcatttgggtcccctcccggctatgatggatctgagagccagtcaccgttggatcccctcctgtggcgtcttgtccagtcgccatcggatctcctcccgccgtcgttgagttccccttttcggaggccgacatcaccattccctccctctgcataactgcttcccccacgtctcctgcaggtggtggtcttcattacggtggaagaggagcggcgaccttgtttccctttgagcggcgccagtgaagccacccgccggccttctccctctccacgtgtgctcgccagcagacgagggagctcgaggagggaggaaggatgaccgggcaggagagggaagaaggaggcgtcgtcgccgtcgtccgtggagaaggaggcgttgacaggagaggagggtaatatgtgggtcccatgaattcttttatgttttatctgactgatatgtaggcctcacatgttttttaatttttaatttttatattttacttccagtgccacattgccgccacgtagaacaaggaccaagtcaaattagctacagaagcgtcatgtcagctaagaccatcatctaaactgtcgagggaccttgtttgccctggttttgttagttgggggactgattgtatctggttttttggtggaaggacgaaaatcagactaggcgacaatgagggacctcaagtgaacttattcctttggttctgaacaattgggcttgtagttatgggcctagtcccagcatgagccatgcatgggccttctatctccgaggactgtccaagaatacaactgtaaactagcttcatggctagaccgggtaaaaaaacagaagtttcacggtgtgggacacctccatcacatctctatatatgtatcttccacaaactctaatgccgcttattataaaacatgcaccaaaattgaaatcgtaaaccatacacgaaggagggtcatagaagattcaaaagtgacgatgacctcgaatcacgatatttgataatttagttcaaccgtagtctatatccttaagacactgattacagataatccctccctcatccaacataactagtatggtggcccgcgcagattatgcggctagcatattattatattttctctcatataatagtatatatgttttcttatggtattattcaaatatattaaaatgataacataattttaaattttgcaataactttataaaactactaatgtgtaatattcatattgtattttatatacatattagttattaattatttttaatatcaaatttaagttatttgtaaattacatatattcctatatggactctagactcgtcttttaatatttcttatttttttaattccgaactttctgtaaattgtatttttatatagactctatgctcttcttccaatattatttacttttattctgaatttttattatttctaattgtatttctatgtggactctaaactcatctttcaatatattctttaattattaatttcgaatttcagttacttctaaattgtattcctatattgactttaaactcttcttcccatgtttttcttaatttcgaattttagttatttgtaaattgtatttttatacggactctaaactctacttttaattttattatgtttattccaagttttagttagttttaaattcctatatggtttctatactctacttctaatattccttatttttttaattctgaatttctatttttattattaattgtatttctatatgactctatactctacttctaatattccttatttttaattccaaatttctattatttcctaattgtatttctatatggactctatactctacttctaatattccttatttttaattccgaattttagttatttcctaattgtatttatatatggagtctagtctcctcttctaatattccttattttttaatttcgaatttcaactatttataaattgtatttctatgtggagtctagtctcctcttctaatattccttattctttaattccgaatttcagctatttctaaattgtatttctatatggactctgctttttctttttctccgattaatgtgagaggctatttctaaattgtatttctatatggactctgttttttctttttctccgattaatgtgagaatttataggccatgagagcgaacgtggaggactggaggctcctttttctattcctttaataatataatagatagattacaagatatcaaaaatcctcgatcaacaacgccgctaagaagtcgttcgagagaacctaggagagagatgtaaataactttatcctaacacaaatacactaatacctagtaaaactctaaatcctactaatttataatcaactactttgtacaaatatttgatacatactctaatattatggctaagtttgatttagattattgagcaaattattgtcatggattaactactcaataatagtaaattgataaaataaatattgaaagaaacccactcaacaaatactactccacccaaaaacatattttcttttgtaaatttagacaagtacagtgagtagcttaaaaataatttaatagaacatttttaataaaatacattttttgacgtgtgaattagtaaataatttttttaataatccaatgaattagttaaaatgaacgtggccgtcagggcgtaagtcgtagtcatccatgataaaaactagtttgacctagcgtgcaacccttgttctcctaagctgtgtttggaggtgggtgttgggaacccatatcccatacacggaaaacggagcggtccattaacgggtgattgattaaatgttatcttttttttttgaaaatggatcaatatgatttttttaaacaacttttgtatagaaacttttttaaaaaacaaaccgtttagcaatttgaaaagcgtacacacggaaaacgagagaggagggttgggaacttgctcttgcaaacacacccctaatctcttgggaaatatgaaaggtgtgaaaccagagaatcttttgaaacaagaagctatcccccgtggatcttgttgtgaaaattaaggaatcaagatatcttggacactggcgggaaccaaacgtctaactgagatgatgccatagaaggccgctttatccgtaaatatctccttgtttttattttacctataaataacactcctatactcaatgaatggacacgttgtctttcgttaaaaaaaatctggtgtgcaactgggaattaggaattagcctgtcatttccagccaaatcggtagcatcgtttaatgacaaaaattgacctgaccgtcagaatcagtaactatgtgctaatttattaaatcacgtacagcttttcacagaccaaagccctcctgaacttttctaacgaggaaaagtaatagacctaattaactactagtggtgtaatttaattatactgtgctgtagttaagttttcctttccatcatgtcatgacgtgtgtgatttttactctggtttactggctactgctgtcatattatatcactatcgtattgtcataccttgatgcggtgtatcttccagaaaagaagaaattagatgatcacttcgacgacaagcttcgtcttgatcttttctttttggaggaaaaaagagagcaagttttgtcttgctgatccaatcaacatcggaatcacgaaagttatttctactccaatccatagtacaagataccgcagcaagtccggggaaaaaaaaacaacggtggcagagatgtagggatgaaagcaatgattcattacaaggttaacaccataaataaaaggcagtagcaaaaaaaaaaaaaaaccaccatcacacaccaacaacatctatacaaaactcagaaaaatactagcatcggaccgatcaccgctaaatgcgaccggctgccactagaccaacaaaaaaaagccacaaaccgaaccggccaaaaccaaaatctgacagcaagcactgcactcaactctaggtgagagagaagatggaaccgctctcccccacaaggcctgccaacatcaccaatttgcattaggtagggcgttgccgtaagaagacaaacatttagagagagcacacacaagctgcctaagagaggtttttgaggggggacctcctgacgacgtcttcaagtagaaaaacgacgatgatcaccaactcctcccgctaccgccgccgccgccacccttgccagccccagattcgggcgcacccacgccggatccgtgggctccaccactgcctctgtccaggcccatgccgtccccgccaccgccggtgctgtcgtgtcgtcgccatcattggcactaaggctgctgcacagggagacgacttcccttgatggagggccaaatcctgatagggagcattggatctggccagaggggcacgagatctagcggctccaagctgccatgccgcctatactccacgctctctgccccaccaccagcgcctcctccttcgcctagcctcctaggtcggacaacgttgtgtcgcccctagccgtgaaccgttgccttgctccgaggcgccggtcggtcctctccgctcgctgccgaaatggcaccaccgaccttcacctgagtccacccacgccggatctggagaggaggaagttgtgagccccgttgccgccgtcctggcgagccaccagcttttgccgacacttcgctcgagcagcagcgagggaaggggtgagaggatgttgggttgcggcggtggctagggttgccgtagccttagccgccctctctgggaggagacgcgggggcattggaaaaagtctgttagcccaaccatagttttcaattttctttggggtcgaaatacaagcccccaagatgattcgcaaatttcacagaattagataaaactgagtttgggagatctctgaattttgagcaaataaattcgaggaaaattcaaagaaattgtgaaccctatccatcggcgaaggtcctgcagtatccatgcatgcctggtctgtatatagaccctatctaatagttacttccccgtcataaaatacaacaatttttaaccttaaaattttatgttaaaaatataataatttcttcatctacattttcttttcaaacaaccacaacattattcccgcatttaaattttctactcatctcattttctcaaccaattacaaccttaccccatttaattgtaccaatttcttgacacgtacccgtgtccaaactttttatattttagaacaaatataatataaaattagaaattagtcttagtatagccccaagttgagtatagcttcaccgctaactgcttatcggaagctctttagctcttcaaaaattagaccgtagttaaattgtctgaaccgtaaatctcccctcttcggcttctgccccgactagagacatgcaaaccgatcggcgatcgaagcaattaccaccacatcttccaaacaccaatgcaactacgcaagttggccaagcagcgaggcaactagccaagtagcgcatggacacacgcagcataggatggtcgcatgtaaacactgctctttttctttaaaggtggggacgtggggtgtactctgaatgacggcagagaacaaaggacaagagatcacaagcaagtgtttttccaaagtgaatgaccactgtgctagtcaacatgtactccatatatactatccgtgttttaaaatataataacttaatactaacttacaatataacactatgaatctagacatatcattttcatgtaaagatgtgtttggttggaaagatgtccctagataggtgatagcaatccaacttttgaaggtgtttgattggtgaacaagggtagctataggacggttcgaagaggaaatattctaaaatacgttgaatgagtgcatccggccaaattaaccgaatgaggatattaattttgatcattagtaattaattggcgacaattattttttttaattagtaataacttttcaaaattaatgtcaaggagatataattagtatagtttatggtgaaactaataataattaacatatgttattattacttactagtttattattttcctcctatccgttctataaaaatttggatagccatatcaactcaccaaataaaaattggaccatatatcccaaaaaatatgaattgttatatcctacctaatcttaaccatgaacaaaacacaccataaatttatgatactgggttctatgtctatttattacaatatgataatattattttttttgcgatgtatatgataatagtatatattttgagcagaaagaaagtacttcctctgtttcatattataagactttctagcattgcccacattcatatatatgttaatgaatctagacatatatgtgtgtctatattcattaatatctatatgaatgtaagtaatactagaaagtcttataatctgaaacggaggtgggactagataatatcacgcataggaatgggggccaccggccggattcctgaggaggaagggcacaaggcgcaacgagacggacgcggcacaggagcgacgagcaggacatgcgcccttcgtcgtccttcctctctctgtctctcgttgacgacaggtcggaatatcggagcaggtacgtacgtaaggtggcgtttttgttttgcccgttaattagcgtggttgacgcggcacggacagtctccggctccggccaagcgcaaacgaacagtcagtatgtacgacgatacgatcgacgagctgtacatgtttccaaaccgccagcgatggcgacagggacgacgaaatttctgcagataatatgcagctagctgctgtgcctgtgtacgtcgtcgtccgggcagtacatgtgcgagtgcgagccatagtagctccagatatgcgtgctgatgtgtgtcaaaccagtggcgcctcgggacaggtggtgctcccagtctttccatgcgggcgaaaaggacttttgcccgaccgcatgcaaaaagaaaaaatcgcgaaaaaaataaaattcaaaaaaaaaggaaaccctagctggccggccgctcccgccggccagctgcccagttgcgccgccgcccgcccacgcctccagatctgggcggcctgaggcccgccgccgccgaccacgtcgccgcccacatcgtcatcgaccgctcccgccgccggtcgccctggttccgccgccggccacccccgctgccgcccgccacccccacccccgccgcctccagatccaggcagccccgccgcctccagatccgctgcggcccgccacccctgccacctccagattcaggcgggaggaggtccgccgccaccgaccatgtcgccgaccactcccgccgctagattcgggcgggaggatacgcccatcgcccgcgtcgccgcccgtatcgccgccatcgtggaaggcccgaggtcatcgaggctgcccactcgccggatccgctgcccactcgcagctcccgccgccgtcaaggaaggctcgaggtcgccgactcgccgacgccgcccactcgctgaggctgcctactcgccagatccgccgcccccgctgcgcgccggccgtcgccgtagccgcagccactccctagggcggcggatccggtcctcccggggcggtgccgccggatccgccgcccgccgacgccatcgccgcccggtggcactctcggagagggagagggagaggagaaagaaagagaggagaggagagagagagggggagggtaaaaaatagaggagagagagacatgagttaaaaattttgaagtggtgggagggaaaagagagtggagagagatttggggtcgtatttttgcatacatagattttcgcatgcggctccttaagtggaccgcatgcgaaaatagttattaaaaattaatttaaaaatatgagaacttcgaatcaaattttatgatattaaatcaactcatataaaaaggttgccaaaaacaaagttgtagaactcgttgagatctaccaattttcttttggtcatttcttcatccaaatttgattggactatataaaatttgaactttataatataagatattcaaataattttttcacatagtaaatgatttcaaatagaaaagttgtcaacaacaaagttgtataacttatcaagatctacgacttttgtattggtcatttttttatatgactttgtttgaacagtttgaatttgaatttcaaaatatgacaacttcaaacaacattttaaaatacaaaatgatttcaactgaaaaagtcatcaataacaaagtggtataactcatcaagatctatatcttttattttggtcatttttacatccaacaaagtgatttgtaacattgttcacaaaatgtacatatcttatatagttgaagattatctatcttatataatttggggcttactctacagtgttttccttaaaaacaataaaatataaaaccacgttgtcaataattgagatatgtctagtggttgtagcacatgaaacaataattttgtttcaatttcctagtggagttgtgtgttgcaaataagccattgtgcaaacatagggaagacaatttcttgtgttttattcttataagagaaaatactacaccatgtacagtatatcatgtggtttccagttccttgatttagacatctaggtttgtgcgtgtggttggttcctggtgaaattaagaagatatatatcgatcaccatctcatcagtttgtctccatagcgcccatcgcatttgccatgcaagtcagggcaacaaatctcgatccactgattaattgaacacggtcgtagtagactacttcgtcgaaattatgagaaagcaaagcagcttatacaatacacaagtcgtacttgctgcctgtgccgtcgctaataggcaagtgcactctgctttttgtatagtcagcttttcacatatacaaaggcaagctgtacgtgtatcgacatcttcaattcctgttacaagaaagtccaaagtatatattcgaggttaagcatatattgtgtgttaactaatcttgatacgccggtgagaatcggatcaagtctgcatgggcatgacgccgttttgaccatcttttttgcgcacgaaccaagaaggtcgtgttagcttattttaagatcgatcgataggattaactgcttcggcattttctatgagcttatgttttttcctttaaaaaaagtaacatgcccttacattaggttcatattattaggaaatgtgttggatgtcgataattggataaagaataaatcatataaatttttttacctaaccgtttttatcggggaattttcttttttatgtgagaatgcatgttgtgcgcgagggaggaggacagacaactccgcttggaagtatactacctctaggttgataatacttaatgtttttggataagtctgatgccaaacttttaaatctgattttaatcatggataacttttaaaatatagagataatatgtatagattaatcttaaaatatatatttatgatattttgtgcatatattataatagaaaaatagtgatccaaattattttggcgactgtccccttatccaaaacgataaagtagtatgtctacatcagcgtgatattataattaatagtatgttagggtgtgaatctttcgtttttatttatttaagttttagttgaattggttaatacataagtaacttactatctccgtcccgaaataattgtaattatagattatttagaatatattaagagctaagaagaaaacgtatcttatacacgtaagttttcacttctacaaaaccatgcacatcagttaatagatattactgaaaatttcagaaaaaaaattgaacataatgtaaagtcttgtcgtcaaattcatcgtacacatagagagggaaaagtaacttgcgttataacgtgtgcactcgaagcttgtatccacagcatatgctatattataaaacatttgtaaatttatgacgtcaaacaaagtttgactgtgaggtatagtttggtgataattaaaaatttgagaatcagtacccaagtagtacaaaaggacaactaccctgttctaactgccctccatttcaaccgattagacccaggaccgtaaagcaggaaaaccatgttgttgggtaatttgctggactgataaagaaagctgcaaatggcatcctccccaggtgtagctataatgtaacctctcaatcagcattcctgtctagctatccttttcctccccggaaaccgcaacatactactccagtctcacttttaagtgtagtcaaaagcttttttcaccatttgaccttccattttatttaagaaattataaaaaataaaaaataataataagtcaagtatttattatctaataataataaaaaaattctaatcataaaaatattttaaataagacagatggtcaatcgtcgaacaaaacgggagactacacttaaaatatgagacgggagagtactcaacaaaactaacgcgacaacagtagcttttgactgcgttttcaacaaaccactcaagcaaccagagaagaggatcaaaaaccacactgatactaatcatgatcgatttcttcctcgtgttggctacaatgatgctgcatgctgtacttccaacttgtctccatttctcgttgatgccaaaatggcaggctttgtgcaatcaaaacgaaaccctctcatgatcaaagtacaccacaacaacactctagctactggctactcctatcactacgcaaaagttgttgtaccaaccaataaagcgatcgatctcctactaccagtagtccagcagcaacgaagcacaagacaagaaattactcctccacccaacgaaagcattatttattttactgaccaaaagatcacctcacctctcccggctggctccgatcgaatcccctcctggattttgatacatcgattggattggatatgatgcagctatccacgatggagaaactgtgcgtgttctctcgcgtgcaccgtcatcgtcgtctccatcatggcgtctcgccggcgcctccagcgggaggaggaggcgccggcctgatgtccttgagcacccccactacctgctgcatcgaaggcctcttctccggcgagtgcgccgtgcagaggaaccccacctgcaggcactccaccatctcccgctccgccaccgtcatcgttgtctttgctgctccactggtgccgccctcctcctcttcctctcttagcctcgcgtcgacgatgttgaggctctttcggttccggatcacacctcgggcccagctcaccgtcgaatcatcccatctcacctgtcctgtcacaagctcgaacaccagcacgccaaagctgtacacgtcactctctggggtcagctctccattgttactatccacggggtgtatgtagtccgatatcctaggctctaggtcatcgtcgaggaggatgttggttgggaccagattgccgtgcacaattggacgtcccgatgatcctgcccatccctggtgcaagaacgcgagccctcgtgcgattcctagtatgatgtggtaccgggtaggccaatcatctatggatttcttgtcctgctccgtggtgtcccacatatcagcaccggtttcttccatgtccatactacttgccggtagctcgtggagccaccggtagaggttgcccttctctatgtactcgtataggaggagtttctcctttcctgctcaaatgatgcaaaatttgaatttcaaattcatgaaaccaaggagttcaattgttattctatccatactttatataatatattgcgatgtaaaaatgtgtgaatttcaaaggattttcgttgaaacatactgttcaaatccacataaattaaattgttttacgtgaaagcaaaggaatttaattgttattctattcgtagttatatactataatacaatgtaaaaaccgaatgattttttagcaaaagaatagaagaagtgcagttagatcagctatcagttttcagcatgaagccattttcaaatttgtttttgccactctatcatacactgaaagatatgcttttggaattttgtctagactacacattctagtcaaagaacaagacaaattttagtggaaaacatgagtattatttctcaagtcattatctaaaaacaaattagttatattttttttcaagcaaattggctgacctgcaatgcaatagccaaggagcggaagaatgtttgggtgcctgagccttgcaagttcccggagcccggcagccgccgccgcgacgtcgccgtcgtcgccgccgaccccggccaccgcgccatcgacgacgcgcacgacgacgtgcaggtcccccgggagcacggcgcggtacgcggcgccgctgcggccgccgacgtcggcgagctgcgactcgcgcccgaaccccgacgtcgccgcggcgaggtcggccagcgtcagctccatcagcggccgctcgaccagcaccaccggcgcggtggccgccaccttcaccgcgcccacggcgacctcgtcgtcctcccacgccgccgccgccttcttccctctcttcctccggcggctgaagccacacgccacgcaccctgccagtgccatgaacgccaccgcggcggacacggccaccacgccgcagaccacgacgacgacgatgagaacgacacgcttgtgcttcttcccgccactggacggcgtcatcgtcgccggcgccggagccggagccgacgccggcgggttgtcctcgatcactagtgacgtcgcattgccggctctgaggaaggcggagcggccgaacttggtgacccaggtggagttcacgacgccggagaagttgttatccgatatgtccaaggggctgcagga

SEQ ID NO: 68249 - DNA, 30567 bp, Oryza sativa
  unsure (1)..(30567): unsure at all n locations
ttatcgttatgttttcgtttggtactgacatttgcatttgaggaggaatcaacattataggtggcatcgcacacagagatttgataaagttgttcccatccaacggcgagaccaacctctttattatcatgcataattatacatctattgtttccaaaagtacaatagtaaccaccattatctaaacgtgaaactgaaactaagttccttttcatagagggtacataaagaacatcatgcagctgaagtttgaagccagtatgaagtgtgagagtgaagtctccaatggcctcaacttcagtttcaactccattagcaactctaattcttctttcccctcttcttagggtcctcctcatagcgaatccctgcaaggaatttgcaacatgaattgtcgctcctgagtcaatccaccaagaattggtggcataatcaatattcagggattcatcaacaaaagaaataacatcagtacctttcttactgagccatctcataaatccaatacagtccttttggcggtgtccactctttccacaaaagtagcacccatccttttcttttcccttttcttctgtatagggatttcctccagatttattttgctgggattgattcgaagattgccctttttctttaaattgaataggcttaggcttcaaatactccttcttaaatttcttataccttttcttctcggagtgtttaaataaatttgcatggtcaactctttctgccttaagcctttcctcttcttgtacacacatggctattaattcatcaatgccccacttgatcttcattgcattataattgatcgtaaatggagaaaactcctgaggcagagatgacataatgaaatggacaagaaaacctttagagatttccatttccattgatttaagcttagaagccatgtgatatttcttcataatatgttccctcagatttccagtaaaatcatatctttcattgaccaatcttttaataagagtggtggcataaaccttagaagagcctttaaactgctcctcaactttagcaagatattctctggctgtctgagtatctggaactgctcctcttattgcgtcaataatggagctcttaataatcataaggcatttacggtttgaaatatcccattttgcctttacttcatcatatctcctttttagggtctcataattttcattttccggtataggctcaaccggaggatcattatggagggcataatcaatatccaactgagctagagtaatttccagcttctccttccatgaagcataattacttccattaagttgttcaatattgcctattattccggcaatttgtgaggcataagatgctgcataagagagaatcagcagctaaataaataccttcttttattgattaaatccaaaacggctttggccagagaaggaaatgaacaataaaattttgtgaataagtatttattaatcagctttggccagaataataaatacaaaccacactttatcagtttgtttaaaactccttttattaattcaatcaaaacagctttggccagatttgaattgaattaataaaatttttgtaatcaaataaaagtcaatcagctttggccagaatgacaattatttgtcacacttaattgtaatatttatttgtagcggaaataaactcataatgcataaaacaataataactttaagtaataaatataatataatgatcataaaacaaataaataaatgaaagtgaattttatcacataacaaagtcacttattattcttattatcattaattaaaacataataaaatatctttaatgtttgaacacaatgatcataatcataattctttaaaaggaaaaaagttaattgtaatattatcttagcccaatctttaattaggcccattactatacagcccgttactatgcagccacacatttttttaatggaaatcttgagctgggcctttctccccgagccaggccgcattcggcctggcccatcacagccgcgccgcctcccgcctgggctccaggcccatcaacctgggcctgggccggcgtttgctgcctctctgtgcggcctcatcagcccgcgtcgggagcgacccgatccgagccgtccatcttcatcggacggccgggatcgctcccatgcggaacaaaaccggcgcggcggccgcccccgcgaaaaccctagcccccattctctcctcccctctttctctcacgcccgcggcgacggtgagcgagacgacgacgacggcgaagcggcgcacgacggggtggagatggcgccgccgagccttgctcgccggggctgcgtgccgccatatccggcgcgcatccccgtcgagcgttgctcgacggtgccctaagtagccggtcgctcgcgcaaggaagacccacggcggcgacggcgagacgagcggcgacggctacctcagcgaggcggcgacggtgacctcagcaaggagcacgcgaggaggaggagccgggccggcacggcgggtcgcgaggccgctcggggaccaagtcctcgggtgcgtgctcgcctcttattgcgtcggggcgacacgaaggtcgccgccggccatcatgcccttaggtaagcccgccgctctccttttccccatgattttagggttagggttccatgatttggggaatttttggggtcttactgcagctagggtttcggttcttagggatttgtttgagatttgcatgaatttttgctttccccttcttctaatttcttcaacccgaaaccctagaaggcctaattccatttcttatacttcgggattgcatgatttgggctcaattcaacattaacagagggatttgggcatgaacacgaagaacaatttgaacataaacacttattgagttccaatttgaggccaacccggtgctctgataccattgttggattgctttggatcggtttggcacaaagtggaactacaaattgaaatgggattagatcatacctttatctcctggagttcccatctctctgcctttgttcttctttcttctcttctagtttggaagcacagagagaatcatgtcttggtttttccctgtgtttcagtgggttgcttgatcgggtagcgagagaaatctcttaaggtttaacacttaggtattgatctctatttatagccactgcaggggaaaccgacactagggtatggcggttatcccccgatcagggatgttcatgagagatcgatcactgtagcgatcgccctaaacaaaatatctctttgccgactttaggtttagccgcaagatcatattttgtgttcacactaacaataataattaattcggtttttatcttgtgtgcacgaaaaagagaaaaaagaaaagaggaacgtgggcccagtgcatgaagtacgtacgttcatgcacgtatgtgggccttttaaggatagattaaattggttgttttttttataatctagtggttaaaaataatgggttcaccagattaaatgaaaaccgacagttagattttctttaatttctctaaatttattagagtgccacgtggcggtataggagtatttgtagagtgccacgtggcggcatgagaatgtttgatttttaggatttgtttagtatggatgtgagatataccaccacgataatacctagagcatcatgttattgtttatattttgacaaatatgtatagtcaaatagttctaaaaatacaaaaatactttgagaatcttaatcacaaacaaattataatttaattagatcaacttgaaaaacacaactaaattgtgttgtttttattttttaagtatgtagatctaaagtagtgttgtatatttgtgaagtgatatttcacttcctaaaatgtgatgtgatttttttaaaaaaaactatcatacataggtcggcctcatgtgttggtgttgtggtgtattgaggaccataatataacttttataatttaattaaagaaatacaacatgatcaccaattggatatataagttaaaaaatattttagaaggtggtttaaagaacatttattgggtattttatatttttaattatagatcatagtttaactatatttattatatatatgtatatatatatatatatatgtatgtatgtatatgtatatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatatgtatatatatatatatgtatatatacatatatgtatatatatatgtatatatacatatatgtatatatatatgtatatatacatatatacatatacatatatgtatatatgcatatatacatacatacatatatatacatatatatatatatatgaactaatatatttcatatttatattgtagaaaataaccgtccatttttatagatctatattttttggctgtcttttctatctacgttcttattgtttttccattccgtgaacagtagaagtttaaatggacgtgctaatcgtacgtcgtacatacgggagaatggtagtagcgcttgtatctaaacaggtggaatggtgtgtttagttttcgctaaattggaagttttattgaaattagaacgatttgacggaaaagttggaagtttgtgtgtaggaaagttttgatgcgatggaaaagttgaaagtttgaagaaaaagttggaaactaaaccaggccgaagttattatttttaatgatagatctaatttagtggtgtaaaataatgggtccaccaatttaaatgaaaatcaatggtgagatttgatagtgtcatgtgactgtctaggagtgtttataaaagtaccacatgacggtataagagcgtttatacgaagtttaatgtacttttagtatataataaaatataatagatagataataaaataacgaaaaggagaaaccgctggttcagatgcggctgtcacctacatccagcgtgcatgataatttctttttattaagatgctcatacagtactactggtttcgatttgcaaacaattctctgtgcagatagattgaaccgttatcagccagtggcatagatgcctgaatcacctttctactgctatctgttggccttttccgtgttcttgtcctagcctgttgggaaggtagtgtgtacaagggtgtatttaatttaggcccatttaaagtattgtttcctttttcctgatttctactataatttaaattatttatgtcaagttcagcccatgctagctctatgcaggaataagtctatttaacctccctcatatcttgcccttgatcaaatcatatcctcaattataaaacgggtataacgcctccctcaacttcaaaaaaggtgcaaatcattttcttcggtggtttaggaaaaggtttatgctgggtcagcaaaaaaaactttaaaaaatattagtgggatccatatcccccccttcctcgaactctctccatcctcttttatgtccttcctctctctctccacttctgtctcctccgatgttcttcttcatccccatcctcatctgtctccgccccgtcgctcctgcttctcctcttcctcgcactccttattggcctcgtcttcctcctttacccctccgcgcctgtcgcgtgcatggccgagcttcaccccgacctcttccacgtcaacctttcctcgttcccagttatcgacctcgaggttgcgacggaggaaggtgatgcttccatgtccatccatcctcgttcccagccgtcaacctcaaggttatggctgtggtggccggtgaggaaggcggtctgtagcaatagaggaagacaggagggatgcgagagagctgacaatataatgtgccatccatccctcgtcttcctcccccgatgtgccgtcattgtccgccacttcgatgcacatcacgtcagccctctggggaggctgcgccgtgcatgggggaggaggcgggctctcttgtgccacgcgtgtagggagcggaggagaagctgagtggcatctgagatggaaaaggttgaccagagccctagtacgtgatgccaacgggctacgtgaggagcggctcatccatggacaactttagtgactaaaacccgatgtctcggtgcatccttctcctcctccccccatgccaccggtgactccctcagtcggtgactccattgccggcggaagcagagtactcgcacggtgtaggctgttgtgcccagtgccctccaatacacgtctgccaccttccatccgtacggaggagctcgtagcgcggatctcctggtcgcaccttcggtagccagcgggaagagctcgtggctcggatctacggccaccacgcgttgtccgcaaaggaggaggatgaggcggcagagggcatatagtgcattggagtagtgccactgagcatatccttgcctacactctcacatacacgcggggaagacatggcctccgatgccgtcactaacatgtgaggcccaccacatatgttttgatgtctcactgacatatgggcctcacctatagaaatcgctttctaaatcactttaggagctaatttgcaccggtttttgaagttgagggagacgttatacccggttttgtggttgagggagggataccattcgattgagggcaagagacgagtgaggtaaaatagacttattcgttctatgcatgatccacatgggcccaaacaatatccattgtgcctcatagaaagagtattaggcccattcgccgaagcccattggcagcttaagcaaagcactgtatatccaaacatttgtttcttcttgagtccggtaaggctgtgttcggtgctttcccatccctctccctcgtttttccgtgcgcatgctttttaaactactaaacggtgctttctttgtaaaaaaattctacacgaaagttgcttaaaaaacttaaattaatttatttttgaaaaaaaatagctactccctccgtcccaacatagaagagatttcgggtgaatgggatgtattctagtactatactccctatccagattcatagtactagaatacgtcatatcgaaccaaaatcccttatatttagggataaaaggagtaatacttaattaatcatgcgctaatgaactgctcggttttctgtgcggaggagatggttcccaacccaagttacaaacacagcctagtggtgtttggattcagggacttaactttagtccctatatttagacactaatttagagtattaaacatagactacttataaaactaattatataaatgagagctaattcgcgagacaaaatttttaagcctaattaatccataattagagaatatttactgtagcatcacataggctaatcatagattaattaggctcaatagattcgtctcacgaattagtccaagattatggatgggttttattaatagtctacgtttaatatttataattagtgtctaaacatccgatgtgataaggatttaaaagttttagtcccatctaaacaggtcgtctaatactgagctggattgattggagtttttgcagtttttcacatgcatgcatagtcttaagtatcttacgactgcagatactgaatgtttgaaagaagttctgtcagacctgaagtatctaacaatctcaaatgccactaatttatgaaccgtactgaagaaatagaaaacgaaaaaaaaaaggacatttggttagcgagaggtcattgtcgatgtggagatcaggggtacacgtacgtcatgacgaacgggccaaatcaaacgagcggactacctacgttgtatgcatggatgattgatggagtcaatttgtttttatttcttccgagacagagacagagatagatggagagatatggtgtcaattcgttgtttccaagtcgtcctcacaaatagaaatttccaccacaagcttgaccacagaggctagttatattggtcaattactaactctcattttagggcgtaatatgttttgaaactaaagtttgagtacaatcaatatgttcttaacagctataaaagtagcatttctatccttttttaaaataaaaaaaatcaattatgaaatttgaaatcctgacacattttttttaatatgctatacatttgcaattcgactactgttggtcaaaactcaaaagcatggtccctctaccccaagtctccaactaacctcccctgcacctgcacttggtagaaaaatcagaaaaatggccggttgctagagctgctagctaacctaaaccaaaaccagcctttatctcaactgtttttgtctccttctcttcccacttttgctgcgagctggttgtgcgttttcctttttgaaagaccaagttgtgcgtttcacctgttccgttccagctcaagtacaccgtgtagatggtggctgcatgtggcaaatggcatgattatttggaagcatccgtcgagatgtaggctcgctcatagtgtggcctgttcgtgggccaaatccggcttggcttggttcttccagtactttagcctcgagacattactatagtcggcagtccccaaaaacacatgaaaaacaacacagtaatttttcctgatttctttaaaagcatatatttctgattgattcttttaaagtattttttattaggtaaataattttagaaagatgcaggggcccttcaatttccaggcgtcagcattagtcatgttgggcgggacagggtatggattgaggtttagaagggtatcaaatctgccaaatttacctagataaataattctccggatggatatgtttcatttatcatgtaagaaatggaaggattgaatggtggaacttgacaaaatcagatggatcaaggtttcattacagaaacacaaaaatcagattcagaatcgaggtcgacagtcaaaccgtgtgtgtcgacactcgacatccaataagaaggaagaccgattaacggaaatacactgcagattttgttaattacataacaaatgtataatcctggttttgttctctccaaggaaccaattctgatcctgggttagaacatggttttagattcttgtatgaacataagcaactctttgaccttgatcaagctatagcatgtgacctaatcaatcaagatacctatttgactttcataatatatttttccctatcacttgagcatgcatgcttttgaccatatatatgcaattaattatattttgtttggcacttgttctatcaagacgaatgcatcttatctacatatctgttgccctgtcgcttggttgtttggtgtggctacaatgatcaagtaaatagactttgatgatgcaagcatagtcgtttcaggcttgcagctagcaactggctaatcagcaaatgatgtacatagttgcatactactccctttgtcctaaattatagggcacctctttttaagaaaaattaagctcggtaacttttaactaataagcacactaaccatatatatgctaagtattatacatgttatttcacttatattcatattttaaagtactttcatgtaatattaatttcatatttgttaggaatataacatgaaatatattaatgcttaaagtatgtcattgaagaccgtgtaaaaaaaaatataggccttataatttaggacggatggagtatacagttgtaactcttaagcagatcgtcatcactaacaaaccaacagaatgacaagaatgcgcatagaaacacatgtttcaaacatggcattagagtaaaagtttataaattatgcaactctaagttttccatcaccctaagtatatcactagcatacatcatatttcatcttcactccagcctcagctcaaaagcttttgatcctaggggcattcttgtcttttttttaagaatttctctcattcagcaaattaccagtttttagagtgtcttttagccgtgacatgtttttacagtgtcttttagctgtaacacgtttttacaatatctaccagcaaattacactttttttaagagttctatagcaaattttgccacacaattattagtggaaagtagtagcgtactgtatttttcaaagggatatgaccagtagagcatatgaaattgtaactcatggtagttaatccctcattaaaatctatcagtacctatattaatagaacacttttcaagagatccgacgttaactaaagcatgcaaaattatatttcatggaagttaatgtcttaggagattctacgttaagtagaaagatctgaccgccaatcaagtattatatcatcaagatcatatatacattaattgatttaatctaccataaagaatggtgtgaatgttaaaagaggtgcctcttttgtagcgataactaaattaagtgggttccatctagacatcaattcatacccttgatttcttatataaatagtataaaataggggaactggagtctagaggtgctcctttgcaacttttctttcacccttgcaatgctcacggttggtagatcaacaaatgtgcaaagcgagggatctaatcgtccacttttgcgaaagactcttaacccttttttccttacctttaggtctacatggtaacatgtgtttgtcaggcatcccggatcagatggatgggtcaaaattacgcctccctgaggaactgatgcccacaacttttgacctttgcagtattttcgctagaaagaaatgactgcagaatccaaatggattcgtagatttggagcaatttgcttaatttcccttgttccgaggggcatcgatccagcgatttgtcatttgtccatggttttaaccaaacattttcgttggaacaaaagagcattatcctagtgttaactatagcaagtgaactgtgcaacaacaacgtgatctctatgagacattatttgactgttaattaagtgtgtgttgacttgatagtattcaatgccatatgaacaaccttttactgttaggagtacttagtagtactcctgtgcatcaacatggacaaattgtctctggagaactttcttttttacaacatgggcaatccataaccttgttgagtttaatttatcctaagattaattaaggccttgtctggtttgactagttagattttacatcatctaagtaacacataattcttgatacatccatctatcacttcttgattaaattgaagatatgagagttcttttttttgtcctaaggaaataagtagttatataagtttctattaatgtaagatatctgtataataagtatggatatatgttaaaaaataactctgaaaaataactatgtcttttcaatatctcctaagaccataaaaatattcagcatatatacaaagtccttaatggataaggggcatagtactcttttaagaaaatgcgcatgctaatctggtaatattagttactcctacttgggagttgaattcttaaaagaaaactaggtaaaataaacgcaagtgacatgaattagaagcaatttcaccgatcaccacccggttattacctcgatgtttacgtttagtataattaatcaactgcggtgataatcaattcataaactccgaacaggccacatgagtcaagtaattgctgagaatattcctctctcttttgctagataatttcctttcccaatcatgttgcccctgtatgaaggagccaaacacatgcaacaaagagggagagtgtggctttcttattcacctcctttttctgacctttttagttgttcctggtcgtcgtcttctctctttctaaaacatcctcttttctcatgtttctctccataagaaaaagccattccttctcttgtggcataaccaaggattaaaatctccggatatgccctttagctgctaggctttccatcagctacgaccagctatagctggctatagcggcagctaagcccattagctgttttgcaaaaactaacataaattttgcaattctcatacagttcaaagagtcaaagacacttgatattatattcaatagttccataccacattcaatatccgagaatcatataaaaatcttgcacatctcttgttaggaaaactagagaagaatggggagagatttgtgcagcccagcagtccccgccgtcttcagcacaaccgtcacgttcgcagcttggggaagaatggagaagtatggggagggagggattggtgcagctgccgcccaacacagtcgccgcttggtgccgggattgcacagccccgcctccgggcgtcgccgctgcggcctccacgtggagctgcagtcgttgttgctgcaggtcagagtcgccgtcgccgctgcaggttgcaggcttgcagccgccaccgttgcctccgggcgcagccgccacaaagctgccgtgcctttttttcgaggggggagggtgagagacagagtgattgagagagagagagatagagttagggttgaactgctgctatatggacctatatgggctgttgtttagctttaggccttcagcccaccaagttagttgccgctatctaagggcccatttagcggctatagccagttaagagcagctaatagcgccatagaatgtgtagcggcaaattggacatatcttagcggttgcttctcctagcagctaatagccggagatttaaatccatgggcataataacatcttggcctctttgttgtatcctatgtgaagttttattactttgtcctggaagaataaaaatggctggcgacgactatgatttgttttggaggagactggtgttgtattgtagtcaaatatttacagaacaccagatatttggcaccactgatcccctccataccaggggtaacaaataggccaaccaaatctcatattgtaacaaaaacattagacggcgttagagaaaatggcatgataaaaaaaactgtgcacatcacttgcaacagttcatgttacattgtagaacatttagttgcaagtagaaaaggtatacatgagaggctagataggggagaagtcctatttataatcctaaattcttgcagaaagaaactcagcatcaatctagaattacaaaaccaaacatttacaaccctaaactctctatccggctcactttgtccccttagagcaaattcatgttacagccctcttatccagttcaaaaccttataatataactgtagtaatttatagtgtgtttttctactctttctttacagaagatatggtgccataaatagagttaaacacaaaagttattgtttggttgatttaaacacaaaagttatttgtggaattaccaaaccaccggagaacaacggacgttcgcccaaattattaagaaatatggataacgaaggatacaatagcaacaccaaggcgatatgaacaaggtttacaacatctatgattatcacgatatctgggtgggttttatcgttgaggtgtggtaaaggtaacagactgctataatgaccaagttcaaaagaatttaaataaaaaataatttttttgtagaatttatccatttttcttattttcgcttgtaactaggcttattgcagagaggggaaacctctctctgatctataaggttaaacctagctgtggtgcggttaatatatagtggacgcctcgtaaagatagcataaaacctgctccaaaatgcttaaatgcaggggtatgtaagcataattgtctttaagccttgtgttagttattccatttgagggcgggattggaggggatcgaggagggttaattctacaccttaatagatgtggaactattcccgccaaaaccccctctatttctttgtgggtggaattaaccaaaacaaggtcttaatgtttggtgtggattgattaacttatatatatcttcctgctttaagaactactccctccatcacaaaatataatgtgtaactatcattaacatgaagatcaagaaagaattattatcacctcatttaaaccactcgaataaatacaatacttgcacccaataaaattaaagatattgagagtgtagtatttaaaaataaataaataaaagaggacaagggtgttatttaactttatatatataatgcatggatgcctttgtattatgaaatattggaaaaaatagttatactttatattttgggatagagggcatatttgcgctagtagtagtttgtcttgtaatccctcaatatattttccagatcccaacagtgctatatccctgagccatgtgttctcacttgtacggtcaaatagctaaatatatttaattcagtggttaaaaatgaaggattatattccctgtcacagagagtcggccggtatggataagcgtgtctcatacttctatgatatttcggcaggtatatatggagtaagatttttaaaatcactgcaggatagatgttgaaaaaaaaacccattaatatcaaaggcaataaccaataagcgtatctgcacctacgtacatacgtgtgtacaggctggagatactgaatgtacagcgcgcacagagtgtgcacatgttgtcgacgggaggatactgatggctacacgctaatacaactctgagtgattaattagtctggatagcttagctataatgagcctctctagctcgaacactcttgaagcaggagtacattatgtatatatgtatgtatgtgtatgattaatggctagcaaaatactccactacgtgcaagttgctcacctgacctagctactagctaattggctggctaatgcgtgtacgtacatgctaatattgctaataccagccatggaacatgttgcgttgaattaatgggtttatttggtggtagctagtcagcctcgcacaaagtagtggaccagccgtcgctcgcgtacgagaagagcaggcgagacagtgcgtacgcagctgctactactaaacacggatgcaattaaggcttgatttgtggcctcgtctccgtgctaattaatcgcgcgccagcccgtgtgcagcccactgttgttggcagacgtcctcactgggtgcgcatcatctgccgttctctatttctacggcaccgtgccgttgatcaatcccaaccgttactttgaatggatgatcaggatgtgcgaacccactggctgaaggatcgatgcttaatttcctcttttcttctttagttcttctgacctgtcccgattgaataaaaggaaagagcgacatcaccgttaaatgtttccatcattgagtaaacagaaacaaaatggtcaggtgacacacgtaaaagtgaaaaaatattggtttcaaaaaaatgaaaaaaaaagatttttctgttagcttgtcgcctcatgccacaaagctaaaattttgataggtaaatttgtcatcaatcgatgccaaggtggaagttacagaacaataaattcaatgtaaaataggagtgttcttcacttctcgtgggttattttgatcttatccgtccatttcaaaccaacggttgggattggccaacggcacgctgccgttgaaacagctaacggcagacgatgtgcacccgtcctcattggtcaccagccgctatagacttgccgtagtagctctacagcagcataaagagatggattattttctttctccagaacaaatataataataataatatctttataactgatgccatttttgaagaaaaatgcataaggatattccagctaactccacaaggtggtggattaaacgatctggtttcgaaaccttgtcgttactaattatttgatattatatcattccctattattcgtgttcttttttcatttctgaaatttactttttctaatttatataagtgtgatattgaaattggcattcaatagttaaattcataaatataaaatttcccgaccatttccgtacaaataatagaaaaataataccgattctgaccatttccgaccataattcgataataaattttagaattgatttagaactttttttttcatccctctgtatattttctagccttaatttgttggatcatttccgattattttatttattttccttccatataagccttatctcaaccaaccaataaggaacatctttttccgaagatcttccacccccgaacacgtaaaaaaaaacaatcggatctcaaattaccatacaaatgtacaaaatgagataaacatgcagtcattaactaccataaaaggtgttcaaggagataacaacccattgattacaacgaaacccccacgcaggcgtaggtaaggaaagaccaggacggacggccaagccagcaaataccaccaccacatcgtgtgaaagccgccgcagcaacgagcgagggggatgaaacccaaagacggggcgaagacgggagacggaacccgcaaagacgcgtattagttgggcggctgccgcgactccaccacctctcctcgctttgcttgcttgcttcctcctcgctctccctccctctcttcgcttccttcccctccaaaaacccaataaaaaacgcctttcctccccccccccccacctcctcctcctcgatcccctcgccgcgaagatccgatcccgagcacgagcagcacaccgatcggtgggtggcctcctccggcagcctgaggggtggcgggaatggcggcggcggcggcgatggccctctgacgcgacgcgcgcctttctctggcttttggctgtggtgggtgcttgtgggtggagagagagagggagagggagagagagatgggctgcttctcgtgcttcgactcgcccgcggaggagcagctgaaccccaaggtgggagggccgtacggcggcggctcctcctcctccgccgccgcggccgcgtacggcggcggcggcggttccagcgctggtcggcatggggagaggggcggtggttacccggacctgcaccaccaccaccagcagcagcagctgcccatggcagcgccgcgcgtcgagaagctctccgcaggtgcgtccgttactccctccgttcgcgttgggttgagttggggtggatctccgggcggcggcggcggttggtggggatcggatccgcgtcggggggacacggattcggtccttccttttccacgcctcctttgatctgattttagtattccttctcgtgtttcgtgatctctgcctaccgaattaccgcaatttgtcctgcaaaatttgtccagaaagcataactatcttgcgctgtttgatatgtagatgctgttggggttagttcatctacttcagatcattctgaaatgaaaaaaaaatatggtattatatgggagatgaattgatagaccgataggacaaggcctatgctacattcagactgtttatttggactctgtagttgtaaattctcgctgtcgcgtgaacatactggttagcttagtttttttttctcatgttttggtcaacatgggcaggggctgagaagacgagggtgaagagcaatgcaatactaagggaaccttctgcgcccaaggatgccaatgggaatgtaatatcagcacagactttcaccttccgagaactcgcgaccgccaccaggaatttcaggccagagtgcttcctgggcgaaggaggctttgggcgcgtttataagggccgcctcgagagcactggccaggtaacttattttggcaaatgggtatatgcttcattcttgcattcgcctgtggagagctgaacaaccggaaaattgcactgttgtaaaatctttactgttcacttttgtttgtctaagatctacgttctgaactgtttacaggaatgagaaatgaccatgttgagcaactgtttatttcatcttgtttgtttatgcattataatactatgctgctccctctggtcgtaatacatgtcattttggcctgggccgccttttttctttttaaatatatttgtcaaacccattaaattataggactatgcaagtacgttgaaatgcaaatcttctcatatgattttctttatccagtttaattattcagaaatattactatacccagaagttttgaaactttgacatgatgcttgtccaaaatacaagtatttctgaccggaggaagtagtaataactagtaagtgcaattttaggcaacaaggatctagtgttgtatgttcagtgtgttgtattgaaaaattaagagcaatatgattgaagcaccaaaacttcttctaaattaaaattagtttaaaagaagtatgatgattgaagtccctttttcgtcattgcaggttgtggctataaagcagcttaatagagatgggcttcaaggaaacagagaatttctagtggaagttctaatgctcagtttgttacatcatcaaaatcttgttaatctgattggctattgtgctgacggagatcaacgtcttcttgtttatgaatacatgcactttggatcattggaagatcatttgcatggtacgaattctatgtttattccctgtagagatactgttttgcatatgaccacaacctgtaaattttctgttaatggtttctatgtctgtacctgcaatactgtcctctgtcacatgtttccttaggtacagattgtccatcagcgattctatccatgcttttctatctgtgctctttatgtggcagaattagtgtccatgattattgtttttcaatatcggcaaatgtttatgtggtggtagactagtatttcattacttagccctaaaaatgtcaccatttgcattaacctgctccctgttgaagtgttgacattttgtctcttccaagggtctaaaataggcttgtaagagtggcaaatagttaatttttccctaaaatggtgcatgacagcataatgtgagtactatgtttgtcatgttttacagttcgctcgcatttctcatctgtgtgtactgtaattttcagctgcaatttttagatgtgtttggctatttgttgtaagttaaataaaagtcataaaacctatggagttacttataaagttatgtggagttgttggtctgcatataccaaaaaattacttataaagttatgtggtctactgaaaatggttcgtgatgtaaaaaccaatgaaatatttttagtcaatgatctatggaaggtgtaaatatattttttatgtcttgttacttctcaaggttctcttatgttcagaaattgtaccctttaactgtattgtgtgagtctaatatgtgattttgaattaagtgtcgatataaatatgtatgaataatgaccgtactaaacttcaataaattgtttatgtggtatagatctacctcctgataaggaagcattggattggaacacaaggatgaaaattgcggctggtgctgctaagggactagagtaccttcatgacaaagcaaatccaccagttatttatagagacttcaagtcatcaaacattctcttagatgagagtttccatccaaagctgtctgactttggtcttgcaaagttgggtcctgttggtgacaaatctcatgtctctactcgtgtgatgggaacatatggatattgtgctcctgagtatgctatgacaggacagttgacagttaagtctgatgtatatagctttggagttgtgttgcttgagttgattactggtcgtcgggcgatcgacagcactaggccacatggggagcaaaatcttgtctcatgggtaagctatgttctgattatttaggagcacatgctatctatatatgctaataacctgaaatgatttatctgtctagtatctcctaagtaattgtttggatcctgacatgtcgcataccatcaatatgtttggtagtagatctaactaatatctgctgcattttatcagaattaaaacatcttgaaaaatagctcataaagataagatatttcctggttactttctggaactgaaaatacaaaagcaaatagagtaaattattatgtcttgatgtccaccttccaaggaacggatgacatattagatgttgtaagctacatctatgatttcctgtcctccatgcttatactggtcaacatactttgatgggctagagcagatcatgtattgtgaggctaaatgtttttttttttttgggggggtgagaagaggctaatgacttgacccatgtactcacaatatttcatattaactgccaggcacgacctcttttcaacgacagaagaaagctcccaaaaatggctgacccaagactggagggacgataccccatgcgtggactttaccaagcacttgcagtggcatctatgtgcattcagtcggaggctgcgtcgcgtccacttattgcagatgttgtgactgctctttcctacctggcatctcaatcatatgaccctaatgcggctcatgcttcaagaaagccaggtggcgatcagcgaagcaaggttggcgagaacggcagggtagtctccaggaacgacgaagccagcagctctggccacaagtcaccaaacaaggacagggaggattccccgaaagagcccccaggtatcctgaacaaggatttcgacagggagcggatggtggcggaggcaaagatgtggggcgacagggaacggatggtggctgaggcaaagatgtggggtgatagggagcggatggtagccgaggcaaagatgtggggcgagaattggcgggataagagacgtgcgatcgagaacgggcaggggagtctggattccccaactgaaaatggctaggagcagggcagcgaggggttgatccatccacccatgtatgtctgtttatttccaacactatttgctttcctgtggcagggagaggggagggagggacggtgggttagatgtacatttctagagaaaaagagagaagaaacgggagctttgaactggatagtgaattcatgttgttgtacttgtaaattctcagaaatttttgtgagaatgaaaggacacttttgagttccctttgaatcatcctcgttatatcttcttatcatgttatgcgctcgtagcaattaataatgtttatatcggactcgttcctattagttgacttgatcctggtcatggacatgggatcattcttcgtcagcgatcagttaatgccggtgctgtgccgactggttacacgatcgagatgctgaagatgctctgaaagcaactctgtctattggtcgatccatcagcgggagagaagaggcaagacgtcaaaaaaatatcaagcagacgttttggtgtcacgcaccgagcacacggcaagcgtgcctggaaactgaccgatcggtggagcgggggaaccgcttgcgcgcacgacgcatgcatctcccggagaacattacaccaccgtcgccgcgcccgtgtcccctgccggccagggagaccccaaatataggctcaactcgctccctgtcacttgccatgtaggaaggcatagataggaagctgtagttacacgcgtacgccctgaatctcaccaggagaaagcaaagcgtgtgtggctggcttttcctgcggttgtgtttggctcaaatcgatctcgatgatcttgtttttgccctagccgtgctggtgtacccggctgcttaggacatcatcacgacgcaacacgcaaagcctaaacggacggagactttagacgagaaggcgacgctaccgtaggcatgaaccaccacggtccaaaagggtatgggtgcatacacaaaaatagacatacgcccacagtgaagggccgccatccaacatgcacttcagactcattagtaggcccaaaccagcacattttccttactactttgctgacctcaggccgaattctccagtgtcggttcaacccaatgataaacggaataagttcacttcaggtaccttaatttgtcatcgagtctgaaaatcatctctaaaccacaagaccggatatgacgcgtctctcaactttcaaaattagtgcaaataaggtccaagttggtttggacgacaatttcgattgacatggtgcttatacgtggctagtttgacttagttctcatcctatgtgacgatgaggtggcattggaagcaaaatagtcccaccctcctcttcatctccacagacagcggcgcctccttctccgctctcctcttatcgctatgggtccaaacactactagaaaattaatttttaggaggccaaaaaagattttagtaggcgggcgctccgtccatcagtatgcaaagacctgattttcacagacggacgtccagtccacctgggaagctgtatcttcgcaggtagaccgcataactaatccgcctagaaagatatatctcccaagcaggctgcagcacaatatgccatctgggaaaatgtgttacgcccgcttgagaaaatatgtagtatatttgaaattaattaattaatacataaatatatctaacaactagtatatacatgtaatacagatataatacacatatattgcattcattagtaaaaagtgttggtcatattagtaaaaagtgttggtcatatatacatgttaattacacaagcacgtcatttcgaaatatattgttaattacacaagcacgtggctccaatccaaaagagacttgtagtctcgctcatcgctaggctatcttcggggtcgaagaaaagtccatcttgataacagcactcgcagtggatgaaacacaggataatgtgggccccacacgattgtaggaggatgtgacgggccactagttaaactttcctatcattagccatcttcggtttcgaaggcttcgggtcataactgcccacgaccctaatgtttatctggtctccgataattgcgctgttgtggtggagagggcgaagctgccaaagcatccaaagggtttccaaggcataacctctccccgtgaaacttcaacctatactccatctcatttgaaatgctgatgcccaactcctctccttcaattaatcgccgccgccattcttctttcattcttgtccgtgatgccataggccaactgtcgtgtggtgccactcgaaaggtgagctcttccaccctcgcgcctacgcgacgatccagagctagagaagggagaacttctgataccagcctcccattggtggaggccaaacatcacggtgagacgggggtcgctgaagcccaaggaaaacgagtcgtcggaggtagtgtactgcattgactacgcagtggtcaggttagtactctcttcttatagttcttcacgcatgatagtgttggccattttcgcccatgtgtgcgagatgttcgtcgatggagttgttctgcaggtcgttcttcatcccacaacacctaatgaaatattggggctctaacaacccgaagcaagtggtgtggacttcatccccatagtgctgaagaagtgggagtaagccattagcatatgaataattgtgtattaattaatacaaactttaaaaattggttcatttgatttttaaagaaaacttttacataaataagaattttttaaaaaaaattcgtaccatttgatggtctgaaaatatgttaacaaaaaaaacgagtaaattgtttggagttgaagaaaacaactatgccatagtctatgatgcagcgggtgttggagggactctagttgtgtgatctcacccctaacgacatacaggaacggattaaagatcgaggttgagaggcttgctttgacacgtttggtatggcagacatcgtccggagggttgtataggtagtcccatacgtaaaatttagcgatctcgtgcgctgagatttttccgaactgcaaaagaaaaagaaaaacggaggaaagggcttcgtacgtcggcgtccggcattggcacgccatgtgtgcggggtgccgcgcgctctagcacccattcagacgcctctcccgttccctgcagggaaagaatgacaggatataataatattgcggagtcctccccctcctcccgcgttgcaggataaacatgcaagcggcgcacgcgccgcggttgattctcgcggagcgcgtgcatgatcagtccgtgtcatcaccgactcaccgcgcgcgctgcgacgacgcgacgctgtgtcttcctccgcttctgcacacggcgcgcggagggctgcttgctattgccgtctacggagtagctgagccggtaaaaaggggagctgccagccttttgccagatttcgctttgcacgggtcacagtctcacacacacacacacacacacgtcgtgtcgtctaccgcggcctgcaggcgagggcgctcgacgtggcgccccgtctcgcccttcgtacgtatcccggtctgcaatagctggggacgcgccggtcacatgcgaccatactatgcacgcatgcagtgcagctgcacaccaccacctggcgcgtctcgtctgctgcgccgctcggttcggttgaaaccgatcgatcgagcacggtagctgagctagctacagacaccggttcagttcctttcgatctcagacacgttcaatagcccgcagaggacaacaccgtctctgtgtgtgaatgtgtctgtgcatgcaaggcgcgcccacgaggagcggagagcgcgtgttgtacgtgcagccaaggcccaaaagcgaggaggggatcgcggtcgctacctcctgcttccgcggggacacccttgtccgcttctgcacgcctgcatatgccgctgccgccttatttgatcgacctccacacacttgtcccgctacccttcgcgtgcgtgcacccaccgccccgcttcgcgccaacgctttcgattcctctctctctctctctctctctctctcgctcgccattttgctatacagctcgttgatgtgaatgtaaacggtgtcgcacggtaagctgagagactggaaaatcatgttgcagtaaaatccaaattttattattgaactgcatgaatcgaatgaagctaagcaagagcatcgacgcgacaggccggtcgattgcacacccacacccttcactcccccctcagtagctaggttcacaaaacacgcatgcactcggtcggtcgggccagcttaattagcttgcttgctcggtcggtctctgcatgcaagctggacgaaccaggcgagtcacgcgccaatacagtccctactagatctggccggagtactactgtacgtactacgccaagaggtgtctcacctagtagctagtacgtacgcgatgaacatgtgttcgtgtttatgtttgtgtaccaccagctagctggctatacctcacatgagagaattactactagttctctaagcttaatcagactacacttccacaacaatggccatgtcaggcttgatgatctgctccgttctgaccatagcgtgatcgccgtcaccggccatctcgtccgtacggttcgtctcctcgtcatccaccttcacctccaccacctccgagggcatcacgtcgtcgatggggtgcacctccgcgccgcagctgatcctgccctccggcgctgccgcgacggcgcccttggcgacggcctgcacctccttgacatgctccggcagcttgatctccagcccggccgccaccacggcggacgacgacgacgccaccagtggcttcttgctccggtacgccatgtacagcgccatctgcgccacgccgaacacgaagcccagcacgttgggcagcgccacgaacacgtccttcttgagcagcccgtacaagaaccagatcaccgcgctaagcaccaggaagaaggatagcgagaatggcatgaactccacgctcttggtccggatcaccagcctctgcaaaacacaacaatcatcagaaccttgtcatcagctgctggttgatcgatcgagcgattagttagcaagacatcaagattgcattcgtttgctagcttacgatgatgctcaagggagcggcgaagacgctgagcgagacggcgacgcagatccagccgaggacgtggacgcggagctcgccgcgggagagcagcagcgtgacgagcgcgatgacgccgaagaggccgatgttgaggccgagcagcatcttcgccgtgagcatcctggcgctcttgggggcgtaggcgaggtacatggcgaggtagacggtctcgatgacgcaccccacaccattgatggtgaccagcagctcggcgccggacttgacgaacgcgtagtacatccacagcatgcagctgaagagcgtcaccacgtacggcgtcgactggaacccctccgtcgacttcttccggtacacccggtagaacgtcggcctgcacgccaaacgcacgcatgcacacacggttaagttattgttcaacctgctaataattagttatcaacaaactagctaacagcagtttctttcgtctgattaatggaagttaaactcatgcttgatctgtgtcgtctcaataatggaactacaactgcctacaaggacacacacaattactctgctaaaagtgacgtgctgagagattttttttttctttccaccttcagctgactattgtgagaattcattagtagaaatcttcagagttatgttgccttcaggtgtatgctgaattctagaatggtatagatgatggtgacccttcatgtgtatcattgacatgtgtgatgcttttttttttgtacatactgaactagtattattattttaaaaacctaacaaaacaatgttatgcatgtgcttgatagaaattgaagcaagttgaggtgcttacagtggcgaaaggaataccattagtgagattaagttacctgcaaaaaagatcaaaggcagacacgggttatcagtgatgtcagccaatacaaaagagagagagagagagagagagagagaggcaaacagagaaaagaaatgcatggtgcatggtaaaaactaaaaagagaaaaaaataaggtgtgtacgtttctaactaacatgcgtgatggctccctttctctgtttagagtaactacctgattagagcctaaaagttttgtttagcagttccatttattcaggacagaaacactagttcttttttttttgttcaaacactagctttgaaagatattgaggaagacacactggagtactaattaaggtgacagaagcaacaaaggagattattgatctagttaactaagaaaacttgattccaatgggtgttttgctgcggttttcagggacattgcttgtgcggttgtgggaattaagatcgatacatgctgccataatgtgtctccaacaatatgggagaacatgcatgcacggattaatcaaatcaaaggaacagagtaagctaatataacagctagaaagaccaccgtatgcatgagatgaatgcagcattcatgagcatgttgatgcctgtatgtacctaagatgccaaaggtgaaggcccaagtgctgcgttccatggacatgaaggccatatcgatctccctagaactcttcctccaacaaaaaaatctgaacaaaaaaacttgatactagtatagatggtagctagctagctagctgagcctcccttctcctcttgctcaatggagagatgcaaaacacactgagcagtcagtggagaaaggaggaggagctatgtaattaagctaagatgtggcttgggttcatggagagccttgaaggcaggctcctatatatagggagagagaggtgagaggaggaggagagatgctggagaaaggaagaggtgtggcaacagccagcagaagcatgtgggccccccacgggtcgatcattgcacactgacctgacctgtcgcgcgatgcgcttgtggcgggtacgtgtagcatacgtaccctgctggaacgggaaaacctcaccagacaccagccatggcaatatgttgtgcatgtacagtatgtagtaacgtactcctaatgtatcgaggggcaataggtttttttcaggtatgtgcgtacacactatgcccgaagagagtaagccgtgtttaatggcggcaacgccctgtgacatgtcaaacaccaaacctggagaggcttccgtgttaagccccccacagtatccctggccgtttccacctctactttcgagaggctctgtgtgcagtgcgattcgcggtgggtgatgcacccagctgtttgacatgcagagctctcccccgatgtcaccgggtgcctacttgtcctgccttttttttgttgctgcaacggccgggctctcgcaccacgatagatttctgcgaaagatacggcagcacggagagggacgcgtcgcgtgcgctgcaacctgcattgtgtgctcgtcacggttgacacagctgacagcccaacattttttgtacgtagcgcgcccgcgctgtcattcgagactcaccgcgaccgtccgtccttccgaaaaatctttccaccagctcgcgcgcgcggctcgtcccggccggccgacgcggtcacgtgacgcgtacgtagctactatagcttactagatcggtgtggcttgcttggttgattgctttcgttgcgcggcgcgggcaccgtgtgtgtgcgtacgacgtcggttcgatcggggccggacggagccaggctttcgggagttcggcggccaagggcgtgccgaaccgagcgaaaaaaaggcccaggcgctctttctgtgctacagatccgtcccgcgcccggatggttaactcaacgctagggctacctctccaactgatcccagaagcttctcgactctaggtttcctacctagcttcaaatgctcatcaatctcgatcggtggatcaatcttggcttgctttgcgtaactcgttttgcgtgttgtgcataagtggcaagattgaacgttaacgaggaaaagcctcggcctttttttctcgaaatgaactgcgatcttgcgagccaggctagcatcgcgcgacggttcgacgcttttgaggtaaaaccgcggcgcaagtcaaccaaatcattggtagagggctccacaaatgagaccacgtcgacgtcgatcgatcgatcggactgacgagcaagcaagcaaagcagagcagcaatctctgcatccggccccgtttccgcggacggtttccaaactgaactcctccatctctctgcatgcgcccgtcgttgcgagccagctcgatctgcgtggattgccttcctcgtcatcgcgcacgcagaccattaacgttgcaggtgtctggttggcagctctctcaacgcgaccgatcgagcccgcccggtcgaattcgggttctcgcctgcctgcctgcctgcctgcctgcgtgcgtggatgtgtgtcgtggcgtggcgcgcgggcggaccgtttcccaatcatggagaaaccaattatggacttatggttcggaggcggacgcgcgcgcgcggtgacgtgacgtgaaggcgcgcgcgggcgcgagcggggggagtggatcgctcgtcgctcgcgcgcgctggggcgcgtggatggctggaatgcgggatctcgcccgcgagacggcgtgcgtgaagtgtgagacgcagattagctttggcttggcaagaccggtatcattgcgccacagctgaatgattgtggcgctaattaatgacaccctcctcgtcatcagccgcgccgtagtagtactactactctactacagtgtaagcaaggaacgcatgatttgcaagcgattgggttttggctatgattagcgtcctcgaacttagggcacccacaataattatctataggctctacaagagatatatatcagcatattttcctacttggaagaaattaaatgaagagagagagcaaagctatctactaaccttgagatactctatagagaaaaacgaggcaattgattagagagctatagatacccatgtagacataccattaaagtagtttactattaatctagtctattgctaagatgtacatcttttatagatagcaccttactttatcattgtgggtactcttactagagttatgtagaagccacgtacatcaatcgtcgtttgtactgtatagtataactagcatggtggcccgtgcagattacgcggctagcatcgttatattttctcttatataatagtatatatgttttcttattttattatttaaatatattaaaatgacaacataattttaaattttacaataactttacaaaactactaatgtgtaatatttatattttattttatatacgtgttagttattaattatttttaatatcaaattttagttatttgtaaattatatatattcctatatggactctagactcgtcttttaatattttttttctttaattccgaattttctgtaaattgtatttctatatagactctatgctcttctttcaatattatttattattatttctaaatttttattatttctaattgtatttctatgtggactctaaactcatatttcaatattctttaatttttaatttcgaatttcagttacttctaaattgtattctatattgactntaaactcttcttcccatgtttttcttaatttcgaattttagttatttgtaaaatggttttttatacgg

SEQ ID NO: 68250 - DNA, 5472 bp, Oryza sativa
tttcagtttgccacagtttatatgttttgtcaaagtgatattgtaaaggttggggaattgttcatttaaaggtttgccccctatccagctgtcctcccagaaaagtgtcttttcaccattgcctatcaccctggagcagaatttcagaaagatgtttttgatctccatgagcccatgccagaaatgggactctccatttttaaatttcaataaagatatgggtttgcaacccatgtatttacttgtcaaaaagctttgccaccaaccttcctcattttccaatctccagatccatttccctaacaacgctttgttcattgtttccaaatccaggatccccaggcccccttgatctttgggtgaacataccaccggccattgtaccagatgatattttcttatcccttgatcttcttgccacaaaaatctcctcctgtaaaaatccaatctctctctaactccttgtggcagtctgtagaaggatatcatgtaaaggggcacattgctaaggcttgaattgaataaaatcaatcttcctccaatagattgaagtttgccactttgccttgccagcatcccaatttgtgttccatttttgttctcagcgtttttccaattcatgtaacttttgttttcatgcttatgtatcattagcttatacatttttaatgtcatattattgtatggactgttttatgaataagtttattatatatatgtttaattgtagaagacaataaaaaataattttcattaccacatatatgtttctctttaacaggatatggcctttgctgaatcaatatggacctttatgccaggaaagaagggatcagttgttcaggggccaaacactagaactctaacaaatgctcatgatggtatcttggatgatattaattgtgctcagattgctgggaagcatgtgggagatcattccaattgtgctaatgtcatcaaggtagatatatgctataactttctattaattctttgtatcttttcaattttgatacatgttaactagtgccttttccataatgtctgttccacatgtattttcacgctttgatatgaatatttgagtacatagatttgaattatattataccatcttttcctccttagaaaacatagcatgttatggttaaaagtattgatgaaacttcctagctttccatttgaaccatgacaaactccccattccagagatgcgctttcaatgatttcagatggtcatgtatgttgttggattgcagtttattctttgtattgcagcatttcaaaaccgaattacatctgtgttcgctgcacgcagttgggaacctatctccagcgcacggaaaacggaacagtccattagcacgcggttaattaagtatttgctattttttttaaaaaatggatcaatatgattttttaagtaactttcgtatagaaatttttttgcaaaaaacacaccatttaatagtttaaaaagcgtgcgcgcggaacacaagggagatgagttaggaacccttcctaccgaactaagcacttctcaattttttgtatgaaattattttgatattccatacattgttgtatgtttcatgcatgcaggagaatccttgtttatcgtcttcaaaacattatgttggattctgttcagcggataggtccgctgggccatcatgtttcatttactctttcaggcctgacaatgaaaggctggagtcatatcattgctaggaaagctagttcaatatcctgagagacctggtgaaccattctgtcgatactacatgaagtttggggaatgtaaacatatgactttctgtaaatacaatcacccaaaagataggttcagttgcaagaccacaaacactatcagatcagaatccttatgcctgcatgaccaggtttgtgtggggtgagtttttcattatttattaggaacaacttcactgtgaaagagcatatagcttagtggctgcagtgacttaagtagcactccaaggtcttgagtttaaatctccacaggagcgagattaagttccctgtttgatggtatagaagcccttctctaaaaaaaatttagaagccggctaagtttctaaaaaaggcggcatatatccgttaaaaaggcatttaaatccagttggatgtagttccctgtttctgtttgatatgctaagttcctaattttaaaaaggcattcaagttcctaaaaaaggctgcatatatccatttaaaaggtattcaaatccaattctgtttgatatgctaagttcctaattttaaaaaggcatctagaagctgggtaaaaaatacccttctctagaaaaaatggttcttcttactgacaggttagaaaatacacttctctaaaaaaaattggttattcttactgaccgaaaatacccttctcagaaaaaaaaaggtttttcttactgaccgtgcaaaatccgattatagctgatattatgatgactcatgtgttataccttatgcagcagacaacaattttggaaaatcaatttgggttaccttcacttgttgataaggccacagctaacacaacaaatcttgtggcatctgcgtcatcttccatgacacccgatgaaataggagaggggaaaaacaatccagatgaggtaatgccattggcatccatcgcttgtttattttagaaatcctatgtaatgtgagtgctttgtgttatctgctgcttgcatagcttgattgtagttttgtgaatttcacaggtgtttgtatgtatatgtggagagaagcttttattccatacaaacttcaatacaacggcagtaaaagaacttgtcgtatttgctctccagaggaggaacatcaagtattgtgatatttatgtaacatggtgcggaaaagttctgaaaggagatgagatcttgagctccatacctatccacacgaatacgcatattcatgtgacacccagactgaggggtggagagtacgtaccgcgtaacttatctatgtatatgtattttatcacttcctactttagaggtgtaacaagtgttcatttgcaggttaattccaatggaatatgagcgtatggatgaacttattgaccgtgcggtccgtgacaataataatgaccttttctattatgtgaaccttcccccagaattgataaacccttataaggatacatgggtaacttttctaagtgatttctcgagatatatcatacaccaactattggtatgtgtttcccgtgatggtcaccagcggaacattacttggtatggtacttttgatctccgggacatactgattcaagcgggcatgttaggatcagcccccatatcgtcgaaaatacatacacccctattggtggtagacttgattatcttaagctagtttcaattctaaaggataaattcgtcgataatttacaaggttcttcctccccttgccatctgaacaatttactttctgtattgtgcactacttcccatgaaacttatggaagatccgatctattcattacattttttataaaccatccgtgcttgttatcatgtggagaaagagttgcacgataccttcaatatgatcatatgattacaaatcttgtgcaacgcgatcttcgcaaatttaagcaatatttgaatgatacttttggagatcctccttcttggatcgctgatatcagctgggttcctgacatgtggaagacatacaattatagtcctaataacaactcaacgttatggaccccacgatatactttggatctaaacagttgctcacattttgccaggaatttcttgaaccatttcggtcgtgaggttagtctttttttaattattattttaacttttctatatgaaccggtttaggcttttgtttgagcttagacttttaagcaactttttggctcatgtgatttatacaccaatattataggctcttatatctgccagttgtaaaaccaacactgatgaccatcattaattggtgctgctttgtaggtgacggctgccaatctagcacttatgctaggttagcagccaacacttagggtttatttactagtgcttttaagggtcctatcttcacttcacataaactaaaaattactataacttagcttttagcttaacaatataagagtagcttatggtttattggttttaaaaaagccaaatgaaaaaaaaaactaaaaaactgtttgtttgccttagattttttagattataagcaggcgtaagcctataaataaaaaaaacttatgacatatacaatgataattaataacgattcctagtcttgctaattaggaatatttgatgatatggaaggaagagaagtgaggagaggccaacgtcgttgctacagttaataattgcttaggaacgacttttaacctctatagaatgaaaactttactgcatgtgggtgtgaacaaggaatgaatagtaataaaaaaagttttattaatactttagagcctttgtagtctccaccattataaagacatagtttttaaataaatatgcattatctaagagtttatatggactctacctttaaacatacccatactgttctattcttgcataggtttctttgcaggcagctgaggctgccgtttctcagaatctagagtttctgcttccaaccatcatgatgctaatgcctgtgtacagtggacctcatcattggaacaatgacttcatggagatgtaagggaaagtgatcatctatttttccttgtttatatattatcttgattcttgagtactagacaatttcttgttgtagattgttaaacacaaactccgacagaagtaacgggcaaatctcctaatatcaagggataagaggccacgacaaattgtttatcagagcgagtacaataacaggctacaaattagctatatgcacatgtggagaagataagataagagagagaataaaagcggtctatagatttggagccaactgtaacatagactccaaagcgttatgtgtgtatgagaggtgggaccatattttaattgtgtagtatatatttatatataactattgtttagatgagttattaaatgggctatatatgatttgggtaatagttggccatactattaaacttgctctcaggtgcaacgagacacatgctttagtaattaatcgtttaattgcaagtacagtgatgtgagttaagcagggatgcagtcagcatcaatatgggttcattgggcattttttttctgtattgataatgcatagtgcccatattaccaaatttattacgctttgatacttgtggtgttaacagcacgtaccattttgctgctatcttgctttctgaggtggaagaggacggtaggtacaacagcattaaagagaaggccacatcatatggatctggaataaaaactttccggacaatttgtgcaagctttattgtattttaaccccccccctccgttttgtaaaaaa

SEQ ID NO: 68251 - DNA, 2242 bp, Oryza sativa
  unsure (1)..(2242): unsure at all n locations
ggtgtttccttttcgaatccctaatagtagaattactcttaatatggttgtcttgttttctggatgtggtcattaacagtagcaacaggaagcccgggtaaatcatgtcgttctgcagaatttggtgcatattgagagccaacacaacaaatagtcccccgttcccccgttctatttaacttgtattatcacgcacgtttatgagctcttaaatggtacgattttccaaaagaaaactgtttaccagcatctacatctcttagagaacttaaattaacttatcaactttccaatctttaatttagtcagttaaggctctgtttgaatctcctgaagataaaaataaaaataaagattaaatgttttacgtaaaagataataacttatgattaactgagttttaattattataaatatgaaaaatagattaatctgatattttagaacaactttcatataaaaaattttcgcataaaacgtaccatttagcagtttgaaaagcgtgccacgaaaatccaaaacttaatgttcactttgttgggttccgaacagcgcttacacccacaaaataataaagtaaatttcatccataatcccatcatccaacagcgctttaaaacaaattatgccataattatttgcgagacaaacaatatttagatattccaatcatcaaacttccagaatcatcacaacagacacagtcatcaaacttccaaaatcacatttgcttcacagtcatcaaacctcctttgggtgtgtcctctagaagtaacagtaagtatcaaacaaactagatgcgcaggtatcaaaagtgctcctccagaagtaccaaagagtaagtactacaaaatggggctacaaaatccggagtcactctcttttgccctgctgaggagcccatccctgtgactgcgaacctctcactcgctctangacatcaatcttaccgaacactttctcatacgcagccacaagccgaagaaagaagtatccaactgtgggtatcagaatgataacgagcatggtgaacttccccttcttgtcctcaggaaggcggtagccgatgttgtccaacacgccagctatgcccttgggtttctcaaggctacaatgcaaacaaaaaaaaaaggttcaaacgtataatgaaaacaaataccacagaaaaaagaacaaggtaaataccaaaaagccataccttttaattattgtgctcatagacttggtaagcttggttaacatttccacattgccctcgctcaaagtaatcatgtgctcagccctaagtaacaatacaaagaacattagagtttaacagcctttcatgagaaaaaataactcttaaacttgacctaatactaaccaggtctgcatggctctagcaaaaatgcgcttttccaagttggacatcggctgcacaacatgaataatattcagaacaatggtaggtgaatggccgaaggttttctatttgctgattgctaccattcaacaatgttttatgttagttttgacatatatctgaaaacagcagcctgtatccacacattagatgtcatggtcgggattacgtatcgtcgcagagggcgtgtggttccgcaagcgtcgccgggcggaacggcggagtagcgcgcggaagctgcgtgccggatgactacagtgcggcgattggatgagttcagattgttagtctgtttatcagtttgttagcttggttttagcacattggttaattcgtgtacccctatttagaggcacagtttttgtggagtttaattaaacagattcaaggggggggttctctcatatactattctctatttgctataccttgctgttcatcacgggcgtcgttccaccaaaccccctcgtccaccggccatcacacattcatatcacataccttcttaccccggggctcgtgacaacttggtatcagagctcatggcaacggacgaatcctccaccaacgcagccaccctcgcagccgcagctgcggtcgcagctccggtctccaatgctgacatcgccaagctccgcgagtccatggccgacgtacttcatggcatgtccctcctcgcatccaaaagtgacttggcggatctcagccgctcagttgccgtcgcctcatctcgccttacatcgctggagcagcagggtgctgcatcgacctcaactccgccccgactcggtggcgacggaatgttccggtgaccaccaccaccaccaccaccaccaccat

SEQ ID NO: 68252 - DNA, 1701 bp, Oryza sativa
gttaacagcacgtaccattttgctgctatcttgctttctgaggtggaagaggacggtaggtacaacagcattaaagagaaggccacatcatatggatctggaataaaaactttccggacaatttgtgcaagctttattgtatttttaccccccccctccgttttgtaaaaaataaatctattacacaacgtaatactcccttcgtttcatattataagtcgttttaattctttccctagtcaaacttctttacatttgaataagtttataaaaaaatatagtagcatttttaacacaaaacaaacatatattatcaaaatatattaaatgctagatttagtgaaactaatttgatttttaaaatattgctaattttgtttaaaatattgctaatgttcttattatattttccatatctatttcacctgactaacaaacacacattgcgggagaagtgctctttagtccctgtttgtaacctctttagtcccgggttgcaaatgggatgcccaatccaggactaaagattcctggcccctgacaagaatataaccgggatagttggtcaccaatcgggactaaaaattataaagtcccattgtgctaatgtgatttttgaatgacccgacaaagatcacttctacagtagtgaaaaggattttctagtggaatcttgtttgaataatttgttaacatcgtggaaatattgctttgccctctctctaaatggaagtattgctttccagcaacgtatcccgtttgcataaactatgcgtacaattttgaaggtacctttttcataccaaaggtttcatggagtccttttagacgaatccttcgtgcccctttttggtttttttttcttatatccaaatcaagaataatacttgaatgcatgggaaccctaaggttgcaaaccgcccaattcctttgtatggctgtaccttttttttatatataattaatggtgcgattgtaagagttttgacccaatttcccttgtactataggtcaaccctcccttttcacagtgaattgcaaaaactcactatctcaaagtagggatggatactgagttggtttggctcggtctagttcgttaggtaacgaggccgacggctcgagctagctcatttagcttgtaagccaatacacccatgactatctttccttaaaagattagcatcaaagatacagtagctgccaggaacatcctgtgcaattgaaaaaagaaatcaagcaactggcaaataacaaagtcttgacacgaaccttttgtacacatcaattcaaaatattgcatcatcaaaacaatcgaactctaattgaaaccaaccaaatgaaccatcaaacaaatcactaagccaaaactaacattccgatcaacttacagtatccaactgccgacgacgacgataacaagctctattaattatttgccactcttacggatggtgatagatgatttgtcactaaacccacatgtcatagatagtgagtgacaaaataattaattgtcacatcttaaaagtggcccaaagttaaatgtcccctaatatttgctccgtgatttggatcttggtggcgccggtgcggagttgcttgctcgtgctcgttccttctccatgatgatgatgcagaggcggagtggcacttgttgcggagtgagacggcaggatgacacaacgacgagagctcgtg

SEQ ID NO: 68253 - DNA, 6804 bp, Oryza sativa
taataattccaaatttttttaataagacgagtggtcaaacagtgcaaataaaaactcaaaatcccttatattatgggacggagggagtacctcctaaaaatacccttagtttagccgaaaggctacactcaaaactaacctgatgtatactaagaaagtaataaatgctcacaattcttcccaactatagagtaccattattattacatttactaaacaccataaaagaacaatacaactcttttttacaccaaaatttccccatattcccctatggccccacctgtcatccacacaaaagcccacctttcttcttatgggccttggggcccatataaattagaccccagtaccccaccccttcgccgtcatctctctctaacctcacgaaacctaacaagaagaagaagaagagaaattccggcaaggaagggagggagggagaagtcgttggtgcgggggagattgatttcgcgggagggaggggagctcgagaggcggtgattcggggagtcggcagggtggcgccgggtgcggcggcggcgggggcggccgtcggggggatggcggcggcggcggccgagaggcagctggtggtggccgtggaggggacggcggcgctggggccgtactggcccgtcaccgtggcggactacgtcgagaagatcgtgcggtaatgctgcgcccgtgctttcctccccccgccgcgccaccctgctttcttgttactagttgactgtacggccgtcgcggattagtgcatcttggatttcttgatgtggaagaattggaccctttgttgattgtttagctgtttattttgagacgaagggagtacatggaacgcgaagcggtagctagttagttcttgatagtggaagttagcagctatccgtgtatgtgtttgatatacacagttttttagttatattagtcggatatatcgttcactccaagcattagtaggagatttggagatttgttgtttgctctcaccttcttaattgcaaacattaaatggtactagttagcttcaattctgtttcacaatgcttattcaaagagtaagaatgcaagcgcatcatcgatgtgtggaaattcgtggtttcttgatgaactggttggttgttggctatatggtgttgtggcacgagatacatctttttttgctcctgattcgaggagactttgtatcactgcatatgtgcagatctatgacagaatgtagcataattcatcttctactttgggttttatgccttttctagttcctccttgctcattcagaagtatttttcttcagtctagcatattttagtgttttttttttcatgaatgatgaatgattcccatgaaaaccaatttcagtttttggctggtgattttactactcttctgtacaaccagtaatgtaatgatgggatgtctgtttggttatggttatggcttttctgaagtccttgttttcactcttgttaattagttgatgttctggtttcgcatgggtgtaattggaatattcatcacatgagtcaaatttcttgtgttcaagcctttcaaataaaaaaaataatgaaagtgggagctgtttgtattgttggtcaataatcagtttgctctgaattattagggtttgtttgcagttgctatcctcctgtgcttattatttagcttctgtggaaacagttaagaaaaacttcgtagtctgtttgagaaatcaaattaatgttagacgaattctgttagtcaatttaaactgttatttctctgacaagtgttctgtttttagaactgaaataatatctctatttgcaacttgattaaaagagcagcagttagccaaacatcaaaatttctataagctactgtacggaacaggattatcatagtccacctcaacgcaaaatccaaatggagcctttgatgttatgtggtgatccaccacagcttcactctcatatacttactatcatgaaacttttaagctcatctcttgctagaaatttttgtcaatttctgtagcacttagtaacctttgcatttttagtactactattcatgaagcatttcaatttatgcaggagtttttgtgcacatgaaatggcaggacaggtaatttgctctcagtatttatcgtcggacttactacttgatccatgtttccttgacttgtgtcaaaactcaaaagtgtaaattattatcgtgttatgcagaagctcgcagggacaccccctgaacttgcattagtcgtcttccatacccatggtccttatagcggtaaagtttgatatcctccatgccctaagctttttattatgatccattgcaattatttgtatttagttctatatcaacaaaacatgtaagctatgataattcgcttttgattccttgcagctttttgtgtgcaacggagtggatggacaaaagatatgaatgtgtttctttcatggttatctggaatatcatttagtggtggaggctttagtgaagctgctatttctgaaggtcttgctgaagcattgatggtattgacatattggcatcgttcagttcttttcactttttgcacataatgacttcctctggtgtttcctgtactttttttttttggttcaaaatgcataaattagaaactgtggcttactacttccaaaatttcagtactgcatatggttgcctacttttgagttcccgtgcaaggttttagcattttgtttggcttgtgcaatcatgcttcatttggcatatgaaatgatgtttcttttttgccaaatggcacatctttcatgttaacatcaacagtagcaacctttagttccaggcaagttggggtaggctagagatgaaactgatgtgcagccacaaaaaaactaagggaagtatagtactagtaataacaatatagttaaagaagacgtgaattaggtcatgattctgggcatgtggacctccaatttccatgcaactctatccaaaaccataattcatctccacaggaacgactgggatttttatgatggcttaccaatgttatcgcaacattcttcctttactcagcgttaggaccagctatgctgaagcaaaggcagagtttggtatcttattaacagagatattttgatttcctagatgaagggaaatacctcttttcatctctcactgcacctgaatttgggtccagttttgtctaaattagttgatctacaattttgtttctcatagtaagccctgtaaactattagttgagcctggacattatgtagaaccatgatacttaacaatacatgttctacccaaccttttggattactttattttccaagaattatagcttgttgtcttggtattgttatttccagtattctctagaatctgtcctttaatgcccttctgcacaacatatgattcatgtgagaaaattctaaggtggtttgcacatccacttatcagctattgtctcataaaaaatgtcttgatctggatatcagctacagatagccttaccttagtaaatagagtgtataactgtaatcaccatttcattaggttaatttttgtaaggaagattttcattagatcaaccctattaggaaactggatgtctgggccagtacccagaataagcagagtgaaactagtatgatcagaagtttaaattctatgaatgtacctatattagtatgttaattttcctatggtactgagtcttcaaaaatcaaaatttcagtcttcatccctactattataaagagggaatcgtcctcctccacctccacataaaagcctctttcctccataaaaactgtccaccctaaaaaaaactgtttactaataaagccaaccattgtataaacaccgaacagctcactgggcccaaatcctcccactaaacttaataaaaaaaaccattgcaatgcatgacagcatgagcctataactagttgaaaaatacttgggtctttgaatttgatatcattttatttcttgagttctctatgaattaaagtatttattgcctttatgattttatttcctgtgtgcaactagatactccaaggcagttctagtaacagtcagaatcatcaaagccatgaagtacaaaaacattgcatacttgttgcagcaagtaatccttatccactgcctacgcctgtctaccgcccccttgttcaaagtagcgatcacaaggagaacaatgatggagcaaaagaatcttgtcttgctgatgctgagactgttgcaaaatcatttgctcaggtcctacacaaatactgatatctagcatattgctgattacctgtgtttcaatgaagtggtcagcagtcattgttggttctaattaattttacttatattgatgtagtgctccgtttcattgtcggtggtatctcctaaacagcttccaactctgaaagcaatatacaatgcggtaatttcgttattttgttttgctaaattctgtaagccacaagccatctttaataatcttctcctggtattttacttgttcattgatggtatgatagttgcatcttgatttacagagggttgaaaaactcacttaagaatatatcttttaaaataaattataagcatgaacttgcagaactggccgctccactattacatatgttcttgtacttgtacacagtactaaacttcatattttcattaccattgaaataaaaagagtaaattttatcaaacaccacctattatggtccaagttgcacaaaaccacagggattttggcacatgacacataaccccatgtattatggccctaaggtttaacaagaccacaccgttaaccaattttacatactcctatatcaaagttttaaaagttttagttacattcatgtaacatttatatgatggataaaaaactcataaatttgtgatgtgattttataaatgatcaatagtgtggttgtgtgaaactttatagctataatacctggtggttaagtgtcacgtgccaaaacccatgtggttttgtgcaacttagaccacaacacctaaaggttaagtgaaatttactcaaataaaaatgaactcagtttggattgtactgtcattgtatcttatttgtggataagaaaaatatccatttatttcatttttttaattagttagtatcctgcctgaacttgctagctagtctttgtatggtttacagactataaatctatgaattggcatccttatctatcattagtttaatacaagcattttttaacttacatgatataaattttatcttctgcaagaccttcgacagtttgtactgatgaataatttgcaccaggtgctgatgttgtccatgttttgttgcaggcaaagaggaatcctcgagcggctgacccatcagtggatcatgcaaaaaatccacattttcttgttttgttgtctgacaattttttggaggctcgaactgctctaagtcgccctttacctggcaacttggtcacaaatcaccccattacaaaaatggatacagctgcaacatctgtgccagtaccaacttcaaatggcaacccctcaggttgaacaaatgctaacatttggcttagtcttgccatggtatttagcctttagttctgttcctcttttggacgaaaggttgtgacgttgttacgatgtttgtgaatatgtaggtgcttacacatagtctagcgtgagtctgctttaacaaatgcttgacacagctttgttaaggaaaaaaatgttaggctaaagtgaaataaaccattgccataattactccatgggctgaagcaacataggttaacaattatcgttgcatatattggtacgcctgactattttaatagcaggaaggattctggcaatgcccttatgccatccatttttggcccgaaaaaagcatatcattgagttttcaaagccttagaggaataaaatgtattgtgagctctcctctattatgaacacgatgtgcttgtgcatctgacattacatgggactacaatataatttcctatagtttatctccaatttgtcaagtacagatgccttgagctggagatgaagaaaaatggatgtactgaatacacaaacgtgaaaacctgcctcctaaaagcttgtaccattgtgttctatttgtccccttcccatctgggtggtttttcaattgtagtgccaagaaaacatagattattctataatgattgtgtcttcatggttatcattggcatggggtcacaactaattgtttggactctgagtgataatgctttcaatggcatggtgtcttcggattgatgaattctatatggataacaagttttgtttttcagcatcttaatcaaaattaacactgaggatacaaatatatcgcaattcctgtttttatacacagcaatgtggttttaaaggtattcgtggatatacataatttgttgtttttgtgagtgttgatgaagccccttcattgtttgtttcataaataaaattttacagtttaatgttatgaaatgccaaattcttattgtttgtattgtacattgctatgtactaatatatgccagattgcccatctacctaattaaagtggaacatatttcaagtctagccaattgctggttttatttgcatgatccagttgtgataaatctggaattgccttatatagaaatttgtttttggcttctggttatatccgtatcattactatcttccatactgaacatgactaactgttataagtatttttcagttaatggacctatgcttacccgccaaccaaatggtgttgttgcaaatattaaaacggta

SEQ ID NO: 68254 - DNA, 23468 bp, Oryza sativa
atgcagggatactgcctccgctcagctatctattccgctaggtctatacccatacgagaagtgcggttgtacgggggtcgtttcatgcttaacttcatggctcggtccttaattgaccggggacggtactagccttttccagataccttccaaatcctccgtccgccccaatcgaaaacagttgtttagttttatttctcctttcacaaatcatgtcatcaatatcatggcaatgtggcgctcatgtctccatatgccgcatctcaattaccttcccaaacgtaattgcccaagcataaagcatttgataaatatgagtatgcatgattctataacaacatttctaagcatttgtcataattgactagggacttcatacgtaaacatggttatgaaggaataaggggtaaacaataatcaaggcatggcataatcacaagtaggatgttcatcattgcatgcaattttatttgtaaacaaaataatttcgtaattgggatcaacatgttcaaggaatagtgatgacttgcctgctcagaatagtccttactattgatataattttgatcaaccttcacctcctggaagctgcatacgttgccttacgactaaccgatacacaaattctataatacgcgagaaaaaccaatattcagacaacaaccaaatatgcacaaacagaatgtaattgttgggggtcgaacctagggttgctcatattactcgcacttgctaatggattccaatcatgctaggggctaaagcttcttaatctttctattgtcatcgtggtctatttaggagttaaccaacatagcatttatgggatacatatatatttggctaatcagtggtttagtctatcaaatggctatggaaggattatggctatatatgcatctatctaaataggacggttatatactagaggttctgttgttagatggatttaggatcaatcaaataatgaatcatttgtattattatttaattgatggaggctttactttgattatgaacatattttacttgtcacaataaattataaaaggttaataattatccatgctttgtatgtgagatttgtttaggttaatcatattatggttacggattatctcttaatgaacaatcctaatttacagttgaactataattataattatatgaggtcaagatttataattagtatttatctaacatacatgtttgtcatatactccctctaatttaatatatgcaacatgcaaattaatactataccgtacactataatgggatgtatagtatatgtgtaagcaacaatatcttattattggatcatatatttgagtagttgctttttactgaaagctatgcaatacatgttgattttaagatggctctgtttggttaactaatggatgtcaaccgactatatatatatattctacttcacatgacattgtatcgactaacttttaagtggtccaaatacaactagctctgtgattattctcctaaaaaagttaaagattcatctatgtgcgtttatattttagttacaaaatatgaggctaaactttatgtaaataatttataagtcatggatttagttatatttggacatagactagtaaatggcactaatattttcctatatacccattaatttgaaggattgattataactaatttatgtggttgctacagtgacaaaacatattaaagataattatgccactgtacaatatccatttttatttattggcacactatttaggttaactattatctaatcatttgatattaattaattaataattataaatatattttattaaatagtgaattatataccattggaaagcttatgaatttagatgaatttaggatcaagtttcattcaaatcggagttaaaatgaataagttatgctagtgtaaagattcaaatttgaataattgtgaaacagtactgttcctatttcatttatttttattccataatttacattgactgacccgtgggaccggcctgccatggacacaacatatataagtgaattttcatagattttaatcatagggaccgcacatgtaagggacttaactaataaagatcaaggggaggattactatttactaatcacgtggggcccactctaacctctctcctccattctcttttctctctctcttgtctgttttctcctctctctctcatggctcggctagaaccggcgggtggcgcggcgcgacgacaagcggtggggaagggggaggctcacctgaccggcggcggggtcgatggagacgccgcggcggggtcgacggtggagcacggcgcgacgacgaggcgcagcgcggcggcggggcgcgtcggctcagcggcggcggcggcggcttccaaagaggcagcgacgccggggatggaaaggagaggggaaagggaggggaggtggtgagggtagtgtgggaagcaatgggcagccggggaggggttaatataggcgcggggaggggtggtcggcctgatggcgatgggacggcgtggcgcgcggagagcgaggcgacggtgacgcgcggcgacgcgacaacgcggggcttggagcggcgacgcgacgggcgggaaggtgataggcgagcggcggcagcgacgggcgcgcggcggctcggggcgtgaggccgacgggacaggtgtgctacgacgggacgtcggcggctatggatggcaacagcgcgtggcgcgggagcggcgatggaacgcggcggcgacggcggcacagcggcagcggcagagcgaggcgatggcgacggtgacggcccgcggcggcgcggggcgcgaggacggctaggcgcggtgtggcagaggaggggaaagggctaggagaccacatcgaatacctaggccataatgaacattgactttttcctatttattcacttttggggcctttttcctattaaaacttgtcccataaattctagatttcacacaaatggagtttacccaatatatgttttaatttagatgaaagtttaccaaattttaatattacccatattttattcttatatatatatttctattgcattatttaaataaggtctaattctaaaattaacctagataattttggaggctttgagggttcccaaattaattaaaatatcctaatgtggccattattattacaatagcacattgaatgaacttatttgtataacaatgcattttacgtgtgtctatttattctataaatataaattgagactcagaacaacattaatctaattgtttaattaaacactcacatattcttatttatatataaagcttaatttatttatatgactattattttatatgagtgattttcatgtcatgaggaactcggcgaaatgttctaagtataaatctatatatcctcgtgaattacttatttataaacacgatcattatagtggtaatcatcatttcatgtgttcttatatttcatgtgagattggattcaaatgaattagatttgattttactatttcttttagctaatcatggcatcaagccatcagcatggttcgaatatttaatatttgatctgtgatttataatagaaattaatatttgacttatactttatttggcttgctttcttgtacactaatatttgtagggttaataataaataacatattctcgtaaattatatctattgcttaaatttagatttttctttactttctttgtgatcatttatggtttggcaagcaatagcaatcataacaaccagcatgatgtaaaagttttaaaaagttcgaaattttagtgatttttattgttgggaattttcaggatgttacatgctataagttgggtatgtgagtcatgctggccacatgagatgcacatgtaataactactagcgcccctataggtgattaagagatgcctactcctggttatcgaccagacagttgtagcgacatctcatcgcctatcaatttaaattcacttgtggaccattaaactgcatatatcattgttgaagacttcatgtctatttggtcttacaccgggatcgaccaagtgagtatggcaaatattgataaggggagtcgcgcataacaagagatgcttttacgaatacggtttgtttatgtatgcctatcagttgcctataggtgatcgagatatgcctacacctggtcctcgaccagtagatcgtagcgatctctcaccacctaaaattcatcttcaggtgatcgagaaacgcctacacttggtcctcgaccagtagatcgtagcgatctctcaccacctaaaaattcgtctttaggtgatcgagatacacctacacctggtcctcgaccagtagatcgtagagatcttttactatctaaaaattcatcttcaggtgatcgagatacgtctacacctgatcctcgaccagtagatcgtagcgatctctcaccacctaaattttcatcttcaagtgatcgagatatgcctacacctggtcctcaaccagtcggttacaacaatctctcgacatctaacgtgacaatcaacattgtcgtgatagcaacaatcaagaccgactagatcggcgttgtcaccaggacgacaacgtccaggactaacgacatcaggacgacaacggacaaggttaacaacatcacgacatcacacgatgatgacgaaactcgaggtccccagagttctagagggcccgaggatgaggtagtaggtccaagagccaaaactccgactacgataattcctcattgtcttcgtcgtcatcaggaggcagttctcgcaggtcacgagaatgtcgtccatctattactatggattcccttcaaatggtcgaggtacgactacggcatgtcttctaccagcaacataacgatccttgcaccacgacttttaatggtcgaggtacgactacgattggtcttctaccagcaacgtagcgatcctcgcaccacgacttctaatggtcaaggtatgactacgactgggtagcgatcctcacaccacgacttctaatggtcaaggtatgactacgactggtcttccaccagcaacgtagcggtcctcgtaccacaactcccaatggtcgagatatgactacgactggtcttcgaccagcaacgtagtgatcctcgcaccacgacttctaatggttggagtacaactacgactagtcttccaccaagcaatatagtgatcctcgtaccacgacttccaatggtcgagttacgactacgactggtccttgaccagcaacgtagcggttctcgcacctcaatttctagtggccgagttatgactacaactggtcttcaatcagcgatatagcgattctcccactacctctgtgatttgttgagtacaactgtacacctggtctttgcccagtgtggtggttgtctcatcatcaacgtcaattctgtaagtatttatgtgtgcaatatttatctgttgatctccttttcttatatcgccttgtcttgaaggcgttcctatcgtttctttacgctattctgataagcttctgagaaacctaaaggaatttcggcctggggacacccagagcagataaggctttgtgaaatgctgagagccaaatgaccatgtcaaacctggtcatgtaagagtgctcaatggatgcgtattaaccaagccgtgtaatcggaaattaactttttcaacttcacagctagggactaggatttgtcaacttcagcatggtttgttataagatttaagctacctttgtggaaaatagtttttccataaaaacagttgggggctaggaagagtaccaaactccattcgctgagggcaaccctagcgagcatactcttttattgtcacacgcagatgcaatttatttttaattttccatacatattataacatgttaccctttgagggttcgctcgggggctatttctatttaatattctattctgagtattgatttcagaaaagttccattcaacgttgtcgaggactccatgtctatacggtcttagaccgggatcgactaagcaagtacaacaaatgttgacaagagaagtcgcggatgacaacatgagttcatttaagttgatggctttgtcacaaactctacaccctctcaattacccgagaacggttgttggatttcgacaaggaatatggaatgaagcgatggtatacccaccgagatggaatttcttgacttccatccaaattcccgattacagcaagacgggagacttagtcgcatgctccgtaccttctcggtcgatattgggacctagacaaacccaatatagtgcctgtggaggctgataaggggaatctagcgctatctctgatctcaccaagaacggtcaagtgagcacgacaaccgctattccaaagtcttcggtcgagaacataaactcgttcatttgcattgaagtcgggggcaactgttagggttttggataccacatacctagggagaggaggaggctgggaatggagttgtgtaacatccggcctctcctaggcaaccgagaagaatttcctggtcggtcacctatcccaaattgctccaggacaaacacgcttaaccctggagttctttggagattggcttccggaaaagaagttgcaacttgtagatatgagtattctattaatcctattaagccctaggtcaggatgtcacaatcctcacctcttaagacaccgatgtcctcattggtcaaccccaggccaggaacatcccctcatagccacatccgtgcatccatgtgtgaccactctgggtcccctcatagccctaggccgggatgtcacaagttggccgggagaggagaggagtgggggagatgagtgggagtgagagagagaggagcggagaattaataaaaaatgttgaaagagtgagaacaggaggatttttgtacgttgggcacttacacccgcacgcaaaaatatgcttattaccgcatgcagatctgttccgggggtcgcctgcaaaaatataaatttgtaggcggtcctctgaaggatcatgttaacggaaaattttggtaagtttattaatagatttagtcaaggaaagagatcaatccaccgaaggtagtttatctagaaaatatcaagttcaataaggaatcatgaagaccacgacttgttagtttaattctatctattaattaggcaggatttactaattttccttttacctttagcaagtatctgtctactgtccgatcaagacctgaatcttccttttttatctttaggaaacatgtaccatgttcgataaggacaagtaacatcccaagggtataaatatatacactcggggtgtttgtaatctatctctcgattaatacaactactctcggcgcatcgccaccttgttttttgagaattttatgaccggcggaacttggcactttgacgcggggctacatcggcttcgatctctggcgaatgggtaaaccataagttctgacggccctggcaatttaacagctacattgatgttgttcaaggctgctttgctttgatctcttgtatattgctatagttcgattggtatattttgcctacctgatcaattctctctttaatttcattgtgtttagagacgcaacggtttagttgggactgcctcggttaggtctgatcttctgtcttagccgatatatctctacaatcacaatgttgttttaaatatatttattgtatccatcacattagacagaattatcggatcattgagtattagattattttatacaatctcgtgctgcatcggttagattcgacctactatattattattattgataaatcaagtcttgttaagtcgatatataggttcatgctaatgtttcatcggagggttatacgaggtgctaaattcctctttgatggttttactgttttgttaaatttaatgcttgaccactctgaacggtgtcatatcagcttgcttaaatccattaggtaattatcaaccttatgctgcatcgattgagttcgacctatagggttgtggttgtaaattagatttattcaagtcagtaggcatcaatcattgtttcatgcatcgaggttttagccgatgatttatcttaatgttgcatcgacttataaggattatatacaagttggttttagttgattacaacaaaggtttcatttattacttgataatttggatttaatgacattggattcccagacgatatatactttaaccatcagatcaacatttattttatcataccgctattggatgattggtttctattagattatattgttgtattattacaagttctcactgcttgtccgattgcctttatatcattatttatccaagtgtcaaaatctatatcggacatttaaaaccctatcgacatcagttaatatccctaaatcggcttgttggctgattgactctatcatcgtcaatttatctatcttatcagttgcaggatcaaactagctagctaggacaccaacatctcatcaaaatttaggaattgcactggaactaagcagatctcctaggccattgtgtttgccgacatatttcgcgtcaacaaagatttagcaccataagccgcacatggatttttcgtcaacataaccgtatgcgaaaataggaatcgattttagcaaatgcagacacttattttccgttagcaacctactgtggtgctcgttcaggaaaatcatttttcactagtgtacaagactttttgactttttttttctagtctatttcttaagtgcggttaaatttataaaaattatgacagtgaaaataattaggtgttataagagtttcttcatttatgtataaacttagttaaattttgaaaagtttgagaaagaaaaaatcaaatggtcttatttttaatatgagacggagagaatagttaataatatactactatcttcatattttaatgtatgacgccgttgacttttttccaacgtttgaccattagtcttatttaaaaaatttaagcaattatcatttattttattgtgacttgattcgtcatcaaatgttctttaagcatgacataaatatttttatatttgcacaaaaattttgaataaaacgtcgaaaaatcaacagagtcatacttgttacttgataggctacgcaaagttggtaggcatatggcacagtggcctagctagattgtaggcctgtaggtcttgaccgcatatacggcctgcacaacttcacagactaggccagtaatggcggcgagcagcgcgatcgccaccagcgggttgctcaaatgccgccgccgcagcagcgccatccagttgaccggccggctgctgtaccaccgctccatcctctcccacgtcggctgcaggtagttccggcgcgcgtcgtcgacgtcgagcgccacgcccctgcacaggccggcgaacccgtcggcgacgtcctcgtcggtggccatgaagtgcacgaccacgcctttcctcgccaggagcgcgacgtcgctcgccgtgccggctagctgcgacacgaagaggcagtaggccgtgacgtggctgcccaggtgtgggttgttctgctccagcgccatcaggttgcgcaggacccgccacgtgttgttgtccaccgtcagcgtcgggacgtgcagcgtcgtcagccgccggagctccacgtcgaggacgcaccgcgcgtcgccggcggcggcgccgagggcccgtttcttgaacctcacgccggcggcgtggtactgcgtcgccccgcgccaccggtaaacggtggcgcgcgcgcgcctgttggggacagcggcagcgtcgtcggtgtcgtcggccggcgacatcgccatgggtgtgaagtgcatgtggagtaagtggacgaggtgacaggggcgtgtgctggtgatgtccacctccacattcgagtagccctggtcctggagcagcgaccggagatggcgcaagaatccatccacaacaacggtggaggaggacgacgggccgccgccggcgatggctgtagctcccggaggctgaggaggcggaggagaagtacacgtttgcgtgcgttgatcttgatcctggccggaatttccgacacgcaccagctcgtagaccttctcgaggatgaagaagggtatctggttctcgagcaggtagaacacgtcgcgcacggcgaagatgtagtccaccgcgctcccgccgcggctacccaccgccgcagccgcctcgccgccgacgttgaagatgtcgaggacgaaccacgcgtcgagcaacagcatctgcacgaacatctgattctccctccatgtcttggcgccgtcttcgtagtagctcctcgcttcgtcctcaacgccggcgattgcctccaggcaccgcctcagcgtggacgcccgctgctcgccgtcgtcggggaggacacggcggagtgccgtccacttcgccagctggtccgtgctgtccagcggtttgtggtggtaggcgccgacgagcaccacctgcggggtgtactgcgagtcgtcgacgcggcggacctgcggcttcaccttggaaatgaggcactccggcgagcggcgccatcgccggccgccgtccaaatccacattgcatagctttgtctcgagatcggcggcgagacgttggatgtctatactgcagctccctgaaaattttcttggttaattaattgcatgtatcatgcatagggtgaaacattcagaatttgttattcaaatgacaactgatatattagtgtggcagcacatgaaatcattcggccgtttcaccaattcaagattgttattttttttatgaaagtaagttaaatacgaagaaaaacctgcatatatagatgcagtaagtaaaactcataaaattgcataccacatgtacgcagaatttgttttggccatctagcacagaaattcattaatttgaatgtgatggaggtgagaaaatttaaggtaatccataaataaacgagtgctagagacagtaatatatatgtgccaaactaaacgaaaaaggacaaatcaatatagaatatttgtgcatacctgttggctcccccatacgtaccgttaatcagtcatgtttccttcgagtagcatatgtgtttcattgtctggaattaatgcagcaaacttaacacattacacgtatatttatatctatggtttcagaaccgtgcattgcatatctccagaccctttctcggcaacagtttgtttccactagatgagcacccatctgcagtgtgcacctttcaaaacatggaagcaaaggtaaagtgcaagcagataactttaaagcgaaatatataattggagagctttatatggctttgagtaggggtcgtacgtactgccttatatatcttttgcaagaaaatcctttagtttgtaccttggctgaatttttcgtccaacagatctacagcggtatagattgactaacacaccaaaatatatggagctaaccctaattgtgcttacctccaagcatggatttcaatttcgatttcgacgaaaatttcagccatttcggcaaaaccgaaatttccaaaatactcagcaagatatatacaaccatggttaaattataagatagtaagatacagtatgcattttttgacaaatcttaagcatatataaaatatatacttcataatgcaaacaaacaaccgattcaactcttagtataacatattaagtataagcaaataaaaaaaataatttggacgtttatcttcggcatgatgttctttttatagactttgcgtgatattatgttctgtcatgcaccatgggccggaatggcactatactatatatttactttgtttaaatcttgtcttagtagtgcatatcctttaggcttctctttttagcatagaacctttatgtccacttctatctaaccgatttcagaaaagaaaaggaagcacgtcgatccttgttgtaagaaaattaagttgtacgatgaaccaggaatagaggctggaaaaaggaacaatatataccaagtaggtagctggttaatttatacttcctccttttagggtctggttggatcaggtacaaaattttagtccctgtcacgtcgaatgtttgacactaattagaagtatcaaacgtagactaatgtgataaaacccattctaaagccctgaactaattcgcaagacaaatctattaattctaattaatccataattagattatatgatgttacaataaacatgtgctaattatgtattaattaggcttaaaaaatttgtctcgcaaattaactctcatttatgtaattagttttattattagtctacgtttaatacttatagttagtgtccaaacatccgatgtgacagtaactaaaatttagtcccgagatccaaacaccaccttattcatatatgacgcttcatataagtagaaagatgcaccatataattaagtagaaagatagactattatacaccattattaaaaatatgagaacgtgtaataatttggttatcacttactacggaactttttttttttgcaggcagggtgccctgcttacaactataaagacgcatttccacaggctccgacctaatacaacaaaataaatctaaattcaaaacgttatgtgttggtatatatgaataacatgaagaaataagctagattaaaaaaatggcctaaatctccctcctctctccaaaaatatatgtagaaattgacctacatgttaaactacccctatataggagtaaagacctcaagtcaaggtgaaacaccccccccccaccccgccccgcccctctattttcctttttatctgcgccgaaaggtcggtctgaaatggctagctcgaggaaggatatacagggcatgtacaatgatgtctaataacgggctctgtttgtttcgttgtcatgcaagtaaatttggtgaagtggaagaaagagaatgaaggaaggagaaacatcgttactatgtatgacaacggctcagagtcgactcttagtatttattaacggaaagtttgttgtacgagggtggagaaaaaaggaaagaagtataataaaaaatatttatgcattaatggtttagaaattttattgtctctactattttaggaggatagtttccagtaacattaattaatatagagagtttatattagactctatctttgtacatgctcttatatataggtggagatttctatagataaaaagctgcctttgagaatatttttctaggtggttgacttaaagctccaactataaaaatatatacataatttccacatacggctggtattactgttccccaggaaaaatgtgtgcatttccgcagatgcacatgagtaagtccaggtgcttgcggaaatgggcctacacagcggcccttggtggccaacgacaaagtctttgttagagtttgtcagatttgatttccacttaacgattcataaacttttttagaaacataatataatcatatagacgctcacaacacgtgcacactgaactctcaaaacacacacgtaaacccaacctctatgattacctccaaaaaactggaccggtatatattgagatgacgaagtcaccactgataccatgctattgacggatacattgcttagcactaaaggaataactagctataaataggagcacacgacttgaatccatgtgggttgctggtttcaccacaaaaaatcctaccagttgagttatgtttactttgccaacgattcccaaatttgttaatcagattgtgataaaatatccaaattcgacttcagatatcgttgaatgagtattcaaatgtcaaatcagatgttcgaagttcccctcaaaccttatcccagaatgctgtgaaaacatgcatgcatatacgtacacttctgttctttctgtgtctcactctcacgttttgggccagcccgcaccaaccctgcaagagccacaggccactgcctgctcgattctcccctcattttcctgggccggcctgggtgctgcctccgctcgaagtaggcctctcgggctggccaccctcaaccatgccgtgcgcgtacggttacaagaaaagagaagagtctccatgtggactccatcaaatatgattcgaatctaagggccagtttggggagcttcagctgctgcagcttctctcaaaaccagaagctctcacaaacagtatagcttttaatccagattctcagaagctatagttctagaatccagaaaaagaactagaagccagaagctggaaaacctagcttttctagattctcataagctggctacaaccagctgcctctcagaatcttaagttcccccaaacaggccctaatataattttcatctctcaaaaccggctcattttatctctctaagtggtttggatggtgatacttgtcgttctacgtgatgcctatttgctacgttgactttattttcatcttacattgggagcacgtggcatctacgtagtattacagtcgatagaaaggtaagagaaattgaaaataagtgagccccacatgcaaatctctcggcggaaaaaataaggtacgacacatgtgtcatgtcctttctctcatcccctcttaactccctctctccccttcttcaggcgataggctgacagccacatggagtccgagctttctaaggtttaggcccatgtggagtcaatgtcggtgctctagcaacctggttgtatgtagccacatggacgggctgcatagatggggcaattgcaagcccacacacagatgagcttgcacgtttgcggcaactaactaagatattgaacaacttcagaaaacatttgggtttttgtaccattcgcatagtataataggtttagttatttgttttgatcatagatctaactactttttcagaattgctaaaaaacttccgtaagttttttttccctaaaacatttagatttgtagtcattagattgcctcaagatctgtgcatgaagggaaaaattgttacaaagaaaatttcacacatatcacgtgtaagatcccgatgctaaccaaccaaaccatagttaaatataagttttatataagttatatcatagttacagtgtagttatattgtagttacagtatagtaacattgtagttacaatgtaattatatttcaattatagtatacttatatatgaaagtttttcactcaaaaattgcggcagttttttagatactatcatatttgtatgcaatatgaagattacacgagtgatcaaaacggaacattcaggtacatatatgtccatacatattcatatcatttatttgaaatttattatttctaaatatcacaaatatatgtccacatcatgatcttatattcagtaagaatttatttcttctaaaaaaaatccaacgacatttttttacacaagctttcaccgtatattgatccatttaccccagcaaagtcagcaacaggtaggttaggaaaggaggttgaataagaaatttgaggttggaaccaactgcaattaacaatctaacacatctactactactattaccacaataaaacatgtttcactgtcagttcataggttcactgtgaaccggcagtgttagaacaacactgccggttccgatcggtgagcagtgaatggtcctatcgacttcttgggcagatcacacggcagcctcacaacgtcgccggctcaacaggagcggagaaatttgattgaaattggaagtttgattgaaattgaaatgatgtgttggaaaagttggaagtttgtggataggaaaattttaatatgatagaaaaattgaaagtttgaagaaaaagtttggaagtaaactcggcctaagataatttaggcgtaagaaagatgaagaagaagattgctgtggccaatagcccagctggccaacagacagtagttaattgtagcatgcatggatatatatatatggattgcgactttaccttcggtactactattaaagttagacaatctgtatcaagtcgatcatacatatagatagatatgcatcacgcggactagctaattaatatctacgtcacatcgataataatcatatcgtttcgatttttcctatatctacctgattctggttttggatgcatgtaagcacaggagtcaatgatcgcgagtataacgacgacgtacgacgacgacctgtagtgattttggctctaagcactggactaataagctacaagccgaagacttaacaacggagagatactcacaaaatgacgcaccttgctatcgacgggtatgtcgtctaccactaaaagcacaacgccgttaaatcttagaaaattcgctcccacggggagtcgaacccaggacctcaggtgctactgagactcttgtaattactaggctacaggccctttcgcaacaacggagtgacttatgacgtacttcctcaggtcgttgcaatattcaggatgttttaataacttttggaatatatttaaatagtttgaagacactaaacaacgatgtatatatagagtatgagtgctaaagggtattgttcagtaaacatcattactggtttttgacgtgaaacaacaggagagtcttctactctgctatatatatttaatatataaatgtataactaatgttcagtaaacatcgtaacatcattactgatcgagcatctttatcacaaagaatcatcagtgatcgagcatcttcatcacaaaacaaaacactgaatcaatcacaaatccaacaacaacatctaaaatcttcatcaccaggcaatcacaaattgttcatcaaacaacgcacaaacttaactacaaatcaaaaaaataaaatgaaacacataaccagacccgcctcaccggggaggggatatcgagcggctgtagttgatctcattgtccttgtgtaaccatggtcatagtcagtcatgccatgcctatcaacctgtggccgtagttgatctccctcaagtagcatacagcatcaccatcatcgcagggctccgactcccttcgtttatgttatagatttggcataccctgtatgcccgtattcattatcatcaggagtaccgcatacctattcttagaaaaaagtatctccaaatatggacaaatgatatataggaggtaaatgttatccacgtaagaaaggactttgtagtctgacttatattagttatgataaggctttgtctttctatatcctattgaggatctcaaagttctacttaggtaagggattatatttacaaatatatggtctagtaggagtggagatcattaaatcataagccttacaccaccatcaatttcacaccaggaggaaacccttttgcttgtcaccggctacaacttgccattttgctcttcgagattagtttagttgctatcttgtttgttctccctttgtactagggatgctacacgcacatcggggccctaaacctttataaaaatccttgtccactactcaatttatttcatactcatgtataccttggtatcaatcgtatgctgtatctctaaatatcatggttgggtcatataacccgtcgaattcatccacctaaaagatctagtggtcggatgggggtttgacagtggggtggagaggacaagtaaacagtggcagaggctctcctctcccttcagttctgagcgcgccaaccaccattgccggacggcaaacgaggcatactggcgagtggcgactacagagatggtggcaaggaggagcacgtaggtggtctgggaagagggaggcagcaataaaaatagttaggaagagtgagacgacgaagaggagaagtagcgatactggcggcagtggcagtggagagagaggcagggacaacgatagggatagtggcagggcgtgatgaggagatgcgaggcttaaaaggtattttcctttgttggctggacttgtaatctcagcaattttcttgttggtgccggttcaattaaaaaacatacattgatttcctatacataagtgccatttttttattgaactgacattcattaagaatgcgtgcaatctaagggggtttggaaccactataaatgttagtttttggataaccgatactaatgaggcggtctggatgtggtgttctatggtagtgatcgatttttataatatatccacttaattattgtggtatacttcttccgtctctaaaagacttctttttcatacagaagcatttgtcccacaaaaccttattgttaggcgtgcacgtggttccactaccctctttattatccttgttttctctcccttagttatagatcagtccaccatcgcgcacgttcaaccttcagctgcaaacgccgttaattagagcttgtgtgtgccaaaagtctagcctagcagaatcctgcaatggtaatgaagggtgaatttctttttacacccataatactaatttggtagtttggctaaaaataaggtattttagacatggagcatataagagaattgattagggatcagaatgatacaaatatatatactgcctctatttctaaatataagcatttttagattgttttgcaatatcagtaaattgcacatatctccagaaaaagtgcatcgtgtttcgctttacaccagatttagtatatactttcactttccacaaagtttttcttttgcggggacattttgcacaaagttgtattaaaataagtttcatttaaaatcaggatgaaatctataaaaatatcatgaaatttctttgaatatgaaaaagaaaacgttgtgaatcataatctaaattcaagttgttccataagttttactcatattttacaatattgttatccaattatatgacccaacctagctagtggaaagtgaaacttattttgatttagccaggtgtaaaatgaaactatttgttaaacctggtgcaaagtgaaacaatgtatactctacatagtgtgaagtacaatttactcaaaattaatattatgaagaaaagattccctttcactcatctcattggtcaaattttgaattatttcaatttcccacaaacacctaattgactgaaaatatttagatttccagtgtgtattaatggaaccagggttcgacaaatgcttatatcatgtactgaatcctacagatgcatgtatatatttgaaaacttgtagaattgttaatcgttacttgtgaatatcttggcaagtgtgagaacaaagtacgtacttagcttgattggtcttcttgattgattgatcagttcaacgtggttttgccgatgatttttaaaattatacaaataagatattcttttcattaacatgtgcccagttataaataagagaagtaaaaagtatgtcaattaaaaacatatgattacatgggatgataaaatcatgaagatcaccacttgaaactgggttatatcgttttttagtgtattaaaacggtatttagtttttgagggggggggggggtaaatatttcatttcaaagtttaccactgatatatcttcactcgttcggtgatgaagatatggggcactggactttgcaatatacgcattaaaattagtttatgcaaacgacgaaaatgtgttgcatttgtttaacagtacgctgaggtaattaaacatactaatttgttcatgaatttggaacaatatcaaaaaggacaatggcaaatgtgtgatcaaacccatgctaaacggttggcatatacgaatattaatttagtaacatgtttttttaggaacataattaagctcaattggcattaagatagagtgtaacattagcattttccaggtatttgtagctcatcttttttctgtctgttatgggcatttagcagtatttattatatgatgaaaccatgacttccgagttgaagttcgatcgtacaacacaaggatttgagcaacagtacagagaaaagtagcgaaaaattatgaattctgtatcaagattataattgaagtgaatccctgtattgtcgtctggtgtgtgctgattttggagatgaacactagctagctagcacgtagtttgttgtactacaagggaagaaatattgtaattaaccttaaactgaattttattaacaaatatcatattaatttattggtacctcatcgtgctttcttggaatatttaggtgtagaccattgattgcgtaaaactcagggggattagtcatcattatttccacaaagaggacgaattcatatacaagaaaaaaactaatctttttcgaacagatatatactagtggttgctgcatgacaaattagaacgacttgtttcgaactaggtcagcatctctcaatcaattagactgttcttgtgattttgatcgggcttaatttgttttataaaattgtgaacttcatcacataaagcttaggtagaactggaattgcataatcgatctcgctagataggcttgctaagtgctaactgctcgatcgatcgatctctagctacaaactacaggaagctataggtcaactatggctgaaacccaaaacgaaggcatgggaaatttgccccagcagccggccggtgagatctacacgatcttcacggtcgatcccaatgacaggaaatactacgttgccgccgtcgacagcagcgacgaagtcatcgttaaggagaatacagaaggctcccgcgtcttcgatgatctccaggtaaggttttaaatctctagctatagctaccgctatctcgaggcaatgttttaaattttaggtaagaccgtgtgttaaatgtcttagccgactatttaaattttaaaacactaactccagccatgctcgatatatataattaacacacacgcatcatcatcatatcattcatcagcagcagcagtataaactttttaataacttctagttaattgtaatacatgtttgttacatatatatatatatatatatatatatatatatatatattgccttgtggatgcagctgtggtacatggtgacggccgacgagccgcagcagcaacacaagcagcagacgtccgccgccgccgccaccgccgccaccgcatggtcagcagcagcagcagcagaagccgttcatcctaagaaacaagaaacggaactgcgccctcgtagtcgccagtaaacctgcagcagaagcagcaggaggagacaagcaggggacgactaagcctgagcagatcgtccccggcgccggcagcagcagcagccggacgcatcagccgcagactggagaacggcggcggtcgacgccggagacaggcacagtaaatctgcaggcaagcggccagctcgccgcgaagaagggccactgcaggtagtgctcgggaagcacggtgcagaaggagaacgctggacaacggatgggacgccggccacggccgacgccgacgatgaccggcgactgatcagcaggagatgctacatccagagggcgagcaacgccaatctcgtcttcaaagccgttaacaccggcggcagagacggctccataatcgagctgacagataagcccatggtgatcatggggagtgatcaagatcagttgttctgctgctggacgattgtcccggttgccggggaccacatcatcgcaggtacgagcccctgctgatttcttcactgatccaattaattataagggttatttagatacgtgcaattaaaaggttgcaggttaatttggaaaaatatcattaaaaggaaataattgatgtctatgcaagcccctaaagcagaaatttcatatccccgataagcaatatctcccccaaaatatttggaattttctataaatttggtttaatatattcaaattttagtaaaaaaggttaaaattttaaatatttcgtgcaaaaaggacaaaaaaaattctgaaattcacgaaatttcggtggtttccgaaaatgtgaactctgtcggccctaaagtaaatctcatccattaacatataagaaatcttcctagctagcgctgttaatatgcttcagtatgtgcagatggaggtttgtcgttgagatccttaagaatggatcatccaagacttgtggcacaatcaggcctgctttccaatcaacatgacacaagatgtattacgccaggtaagaaacggtgttgacggcgattaatttcaaactctagctagtaactacctaattcatatactagtttatactatcgtattaattcatgccaattggtgcgaagcattcgtttttatttagttttcaatcaacggtatatatgattgagttctccctccgtccaaaattgaattatgcttctgcttttgtctacaaattaattaacgtacagactttagcgtactactgccccgtccctaaatatttgacaccgttgatttttttaaaacatatttgaccgttcgtcttattcaaaaacttttatgaatattattcaaaaaatcgagtagtggtaatatatttaacaatgaatcaaatgatacgaaaataattaataattacttaaatttttttaataagacaaatgttcaaatatattttaaaaagtaaacggatggagggagtaattcccaaaccgtctatctaaccactacacttacttcgctcagtagtcgtagttacaacgtcagtcctgatatttgcagtcaacagtaactccactcaacatcaaaataatttcacaatagccaagaagcccttataaccatggacggagggagagcacgattaaaagcatatatatatatatatatattctttcaattgaatatgcatgaaatgagtcaatatatcgtatgtcagaaaacaactaattacgtgatgcatgatggcctaggtagcttgcttgacttgctcattttttctttgttgtttttctcctcatgcagacaagagcgcgtcactcagcactcagcctcgcctcgaagctacagggtactacgtacaaatgagtttgcatttgcgatgttttagtacttatatgaacacaattgatcgagtgcatgcataaaattaatttatccttatatagtgtgttgtagccgtcttatatgtcgtgcagtggttaacctctgaatttgtgcttaattggacatatgcagtgaaacactgaaagatggtaataagcaaggtgataataagaaaggaaagaagaagtgagtcgtcgacgacgacctctgcatatatacagacaaactccaatagtggaatggctggcaaacatcggtatctacgcttacgtataatagttgggtcaaggatcaaccgatcgagacctaacaacaaatgaatatgtactgttgcttaattgcagttataattaagtattgtaataatttgtcgtcgagctgtatagtatgtaagaacaaattagataatgtattgaattctccaagagaaatatagggatatatatagggcttcttgccctagttaattaattaataacgtcat

SEQ ID NO: 68255 - DNA, 37526 bp, Oryza sativa
tcctatcctaggttgctacattataggacgaaaggagggtcatgtctaaattcgtagtcctagtatgggacctagattgttacattatgggacaaagggagtagcaaataatagtccttttggcctctatataaacagtcattgataatatgcctgcgactaacaatcgaattgggatccagtgcagtcacgatagggactgcaagttaacaattgcacacaacttcaaccatccatttttatgatcaacggttcatatctaaagctacagtacccatgtgaacagtattcaacgctacagtattactgctacagtactgtgaacagtaccgtgtgtgacctgagccacccgatttgtatatactgctactgcttaagctgcagtcacacaaatccctaacaatcatacaaactgcctatgatttaggcacctagcatgacctcttctgtatcatttgcaagtgtcctttagcactctggtctaggagatcataaataacacaaagatcataataagagaaacattttattaagctcaccgcatgcatgaggcaacggggacgatcgatgagctggcaaaaaaaaaatggcccatgtgggggccagatcgaccaacatgatagccaaggtacgtaatgataggttttataggcggcagatgttgcgatttgcatgggaataattttgatccacatccagaccgatagatctttccaaatcaacacttttaggccctccatatgtcatcatgttaattaaccacggtccttttgttatgtcagtaacagtaattgtacatgtaactacatctttggactttagcttttacatgcatgcatgcctataccttttccttgtacatgctacatttttatgcagcggtggtggtactactgcaaagtgagagtatcttcaaagtacaatttgtttggtcggataggagatcaggagagaccgtcagtacaagcaaaaggacgttacgcaagcagacacaggagacgtaaaacagtgcagagttgttacctcgaacggagagatgaagagaaaacaaaaacagaacgggggaagaaggcccagctagctagtgaagacattaagaaatgaattaagcaaagaaaaaaaaactatagtaattaaacgtggtcataaaagggcagtagtagtttagtgtatttgattgattcttgcactgtttgttgagccttgatagtcgcataatcaaaagtagcaggaatgtcgtaggagctacatacatgcttctgttctgctctgcactcattctgaactagattcgagaatgtttcattctttcagtttcagatggcgatgagaatatgctgactgtttctatgttgagtttaagtattcgaactgtaactaattaatttaccatacatactgacggatggtcaaagactcagatagttttgacgaaataagcagaattaattaaggggagatgaaataaataaaacactggtagtagtaatttcagtagctagcaatagcatgcagcatcaaagcaagcaaatccagcgcacgcgccaacaaacaaccacatgcgcgcgcgcgcgcgcgaagcatgcacgagacggacagaggcagtcgtcgtgaagaaaaaagcacacacacaccaacctcgatctctcttcttctagctctagctcactcactctcaaacacacactcactcacacactgattaattagctagcaccgtgtaaatgggctgtatctcgatcgatggatatcctattagcagcagctaaatcaatcaactacttgctagtcatcatcatcatcttcatcttcttcattagcagcagcagcagcagcagcaggtaaagctttttgcgtgctaggtatactaggggggctaagccagagcacgccaatggcgggcgggcgaggcctagagccagagcgcgccggcctccttgaggagggggacgagggagccgttgatgtgcgcggccatgacgcggtccatggcgccgacgagcttgccgccgatgaagacgacggggacgacgggcggcgacgcggcggcggggccgccgtacccgacgaggcgcgccagggcgcgctccagctcgcggccgcgcgggtcgaggtccagctcgtgcaccgtcgggtgcacccccatgccgcagaagaggcgcttcacggcgtggcacatgcagcagctgctcacgctgaacaccaccaccgcgctctccgacgccagccgctccacccgcgccaccgcgctctccaccatcggtgccggcgccgccgccggcatgtaccacgcctgctcggccgccgctccgtactgcattctcgccgacgacctggccggtgatctgatgcacaaatggagatgtgtgtgcttccttcgcctgaaaacgattagcttagctagagaagcacagagagctgagctagctagctgtgtgcttgtgtgttgctaagctagaatcaactgaggtgagcttgaacacttggagaagggagtgaagggtgctgggtatgtatatatagagaggagggtgaggggtacaatggtaaatttaggggggcagggaaggaaggctaggccacttccaagccaatgaggtccttttggggttccaacccaatattactcggttttacttatgtttttttggggggtagcactagctcaccactttgtttatttttcacctgtctagtttagtttattgtcaatctgttggtgatgtgaattctttgacttgcttgtatgccgctggtagcttgactcatgcattactcgttgtacatgcatgttttttcacctagctagtggtagctcctccattcatatatttgagccttgtccattgtgctccctttcctggttaattcagcccaaatgaacattgaacaatcccaaatcaagcacaatacgtattgatcatttgatcagagacatattctgcaattaacagaagcatctggtcaacttctatggcaaacaagtcattcactactaaagtttagtataggtgaatgttagtaagtactttccctttacctggaattagtcatatatattatatactaaaagttcattaaacttcctacaaacgcttctaaaccgccatgtgtcaccctataaacgctcctaagccaccacgtggcgctttaataaattagagaaaaaatatgaaaaaagaaaaatatctgaccgtcaattttcatttaaaacggtggacccgatactattaacctttagatcaaaacttaaaccccccccccccctcaccctttccttggctgtcaccacatgtgtacgtacgtacgtacaaattcctcccccatcaatctcttcttttctttcctaattaattaaggcagttaaaaatacacaccataatttgttaccgtggagtcaaaagatctgtttttccatagagttttagccgggagcgaacacacaatcactgttatataaaggagtggtctcgatgctaccgtaaatagaaaatgtgttttcatgggtctcatattttacaggaaaaaatatatatttgaaatatgaggatggcatgagctgtcaattatatgggattcttaatttgcaacgagcataattgtgacccattacatataatctgatgagtaatttcaatgtagtctagagtttatggattttaatgtagtctatgaagagtataattttaattttatatataatatttgtaacacaatatataatctatgatgataacatcagttatcttattaaaaataactttctaaaatagatataatctaacggtctaaaataatgggtccactaatttaaatgaaaatcgacagagaactttttaaatagatataatctagcagtctaaaataacaagtccaccaatttaaatgaaaatcaacgatgggattgtagaatgccacgtgacggcctaggagagtttgtaggaaatttaaatgtcctacaaacgctcctaagccacgacatggcattttaaattagagaaatttctaaaaattctaagaaataaaaacaaaacatctagccattgattttcattaaattaggtggacccattatttaccaccgttagatttatctaaagaaaaaaaaactccctaaccccaatcaagggtccacctaggcctatacgtacagtacgtacgtacgttttctttttacaggtaacaagtgcgtacgttcgtaatgtacttccaccccttcttccctcaatttttttcatattgcacatatttcttctattcatactttattagttacaaaagcaaaaaattggtgttaaacaattcagcaactataacatctaattagaactattttttgatccacttatatctttaaatttatttatgactaaatttacagctaaagccaaatgttcactataattcaactttgagaaaaaaaaagtcaatttggattttattttcagacggtcacgtgccattcaagcaattataaaaaatatgaaataataatgatattatagactcaatcatcgtgcataacttcataataattaaataatatctacaatcataaaggtaaaaataaacataccaaaatatattagttagaaagcaagagttatgctaaagaaataagcaactataacatctacatcatggatccctaaatcagataaataatatttctgcttatgtattttgattactatacatttaaagacccatatttggggttatattttctggctttgtgtgccattcaaacaactacactactggagaatgtctctattctcccggttcggaataattcaattagatatgtaatgacaaaagtaaaataaatctaataactctgagtattgttccaaaaaattactcctcccattttgatattataataaatccaaaataacattagtaaatctgtagtgttcatattttcagtatctcctatatacgaaaagatgagtaaaaatgatatatcttaatcaatcaataaaacttttattctatttttagttaataaagtaatggtaactaaaacactacaaatgtaaaaaatataattatatgtgggtgtactttgtccccttctactttgtgttcttttcctttctcactcaactcctccttataatttctaactaattgacaacataatacaaaaagatcaataattacaaagcaatataattatgattcttatgttatatattttttaagagaacacagcaggggaggcccccgatgttaatataattttattaaaatagaaaagaacatagttacaacagattaatccactttttcttatgttatatctgatttttagtttatttgaattgttattttatttataattaaataaaaaattcaagacgcatattattcatatttcactgtataaaactaaaaatacaccatttgagcatacacacctatctttgcatgataaccaaatagaaaaaaaatacagaatattataaataaaaaatgacaataggtttatatgacctcaaatcattgtgcattctctgtatgtgtcacgtgttatgtcttaattaaaaataaaacctcagaaactgtaaataaagacatctgaccattagtttccacttaataggtggatccatttttttaccagtagatataattttagagaaaatcttaagccgccatgcgctacgtcttaaaatttagaaaaaaaaggatattagaaattttgacaaaaaaatcatcggttttcacttaaatcatttaggaaaagaacacccctccacttcgccctcccgtcacatatgcacagcacaacactacccgtcccctctcctctcagctctaactcaccactctctcctctacccatcaattttttattgcaagaaataatcaataatattaaaacatgtatatttttaagctacacatttgatttttaatctgactattgctctatccataacccctatattttgaactggaataaaataaaatttacaatttaaaatatcaatagggactaaattgaactatttggagaaaatcaaataagtttgaacttttcactaaaattgaaccaaccattacatgttccatttttctaacaattattaaatgcttaaatattagtggtcttgcatctatccaataccatattattacgagtttgtctgcatattaagccacactaagatattaatatatagttggttatatttgttactattatatttaaatttttggactcatgtcgactatattttcctatagatcacacatattaaaaggaagcgaggttctaagatatgtttttgttaatttatatgtaagtatgtaaaacatgcatattgaaccaactaaaaagatgactaacttgatggtacaaataaagcatgtttactaacaataatagttctttaggatttattaaaaaaggccactaaacaatcaattaaacaagacaaaacattttactttatgtttattttgttaggcacgtttttcaaacaaattaaataggtatttttgaaacattgcaggtgtttatacagatcatacataattgtttataccgatggattaaatattatatattttaaaagctaacaaatagcatggaaaaattatctaagtaatgttgatgaagaaaaattacggagaaatagtacttttgaaacatggcatgtgtcatccggttgatattccgcgtatataagcttttcaaatgcaatctaaatacatgcccgcgcaatacaagtttttcaatcatggcaatataagtttttcgaagtagtacttttgaaaaacttgcaggtgtcatcggttgatattccacctatgtaagtttttcaaacacagtctaaaatacatagcgctaccttcctagttaagatgaaaagttgcatgcaattgtacatgcactgtttggtttctgaaaatgtatgtgttgtgctgcacggagacaggcaatgcaaccggacggattaaacgcaaggctttttctttcatggcaatgcagcagcaaacactgcgagtgtattacatcaccaagatgtttctttgtcccccctggcttttgtgcgtgctagcgtagtaccaccacttttccggggcacagcctgtctttatcaatgcaaaggagtggccggcgcccctgcgttgttgttctagtactgctgagaagagaattggctacgagatttgatttgatggtgacagagagaaattaaaagccatcctccaaaagaccggcttttgcttcagcatactactcccaggctgtgtttagtttagcgtaaagtttggcttttggttaaaattagagatgatgtgactgaaaagttgtatgtatgacatgttgatgcgatggaaaaggactaaactttaaatccaaactttgaatctatacacggctatgtgtgtttccagaatcattcctagtcaacaattcaaaaaagcttatgcgtgcatggatggaagcaaaagatcgatcacctcattctgtcatacatatccgttatggaattggttcctattcatactgatctactacttttcgaatcttataaagattcagattaaatactagcacgtaaaaaattattacgtatgattaattgagttttaattattataaacctggaaacgatatatttaatattgaccaaacaagtgcactaacgaccatgccattgcctaaaatatctcctatttataaccagagggagtaccaaattaaaccccgggtgaaattctgagcaaaattaagagctttcaaaggagaagatcgatttaacgaagaatttccctgcctttggaggaaagaaaaaatcaaacaactttgaaaccccagcagaacaacaactactactacggcctttggaagattcaacggccgggcatgcccatgcaatgcaaatgcaagagatatgcaattgcaactttgacagcgagagtgggggtaatagcggctgtcctcgtccttcctgtcgggacgagacgactgtaccgtgcatgcatacaggagtagtaggacctacaaagccagagcaagagcaactcacatgcgttacatatatatggccaaaacgagctttttggtcgacccccagccaaagcaaaatcaaacgaagccagccacgcactgttctctgttcgcgtttgctgtgctatagctgtgatcacccatagtgccccacactagctttggctttgctttcttccccacctaacatgcaaggagatatcatgcgtgtctctgtttgttttcctcgtcacactagggtttgcacagtgggcgttgtctccggccgggccattgcatggtgctctgctagcttgttgttggctttatgtggcagctatagcacacattcatgggacatagttattgtcttctgtggtgttgaaatgttgagaccggccgggttagaccataatatctgatggaataatagtagttgtggagatctatatatattgcgaaaacgctaagtaccgcgtatctgatcgtgcgctgaaaaatcggtcgccacacgcgccatgaggtcgagccgcgtggatcggacggctatccatcggactgtgacgttgccgttggatgttatccaacacaaatgctcccatctctcatttcttcaaaagatttttttcttgtaaaccatttatctaatctacgttctgattacaccattaaatttgttacaattaaatctttacaacaagaccacacatgattatatttcgacaaaaaaatattttagcttttttattgatatttttttagaatgctgcatatggttcttttgatgtttcaaccagtagttttacgatgtttcagctagtgtactcgtgatgtttcactaagtacgaatcaaatattgcagtggattttgatattatggaacgtcgttgtaacaaatcacccatatattttggaaaccctctattaagggaattcgtttctttttttctaccaaaaatgttttacctagtgtacccatgatgtttcactatgtattgatctaatgttacagtgaactgaaacattcttttgcaacgaatcacccatatattttggaaaccctctattaagagaattcgtttcattttttgttctaccaaaaatattttacttagtgtactcacgatgtttcaatatgtatagatctaatgttgcagtgaactgaaacattctttcgctatttgctgaaacattgtttttatgtaaggtgaaacaacgctcgatttaaacgattgaaacattttcgacctacttagtgaaacaattccgatatatttggtggaacatcgtgcaacatttaaaaataatttaataataagctaaacaaatttcatcggaatatatccatgtgtggtcttgttttgaagatttaattgcaacgaatttaatggtgcaatcgaatcatgatttggataaataatttaagagaaagttagtttaaagtggttttgcacgcatgcgtggtgctgacatcagacgtcagcacccgaattttacatgtttggatcgggttcccgatgggtagtcccctcctatatattgggcacccccatctcctataccccctgcccctaaaacagaatgtaatgggcaactagattactagagttatctccctcttggggttgctctcaaaaggaaaacaatatttaagttttaaacaaagtcataaaacctagctgcttccttagttgtttggtgttacagaatataagctacaatactagcttgtgcatagaatggagaaattttgaaatgctgttcaagttaaaaatggaatttccttttatttttgtgtgttttgtgtattcctcttcatgatgtttggagtctaagtagtactcgtgtatcttttggctagctgtatatcctttgtgaatataaagaccagattaatgaaaaattcattatctaaaaaatctatggcctgttatatttatataatgtgcaaatataacacattatatggtttgtcaaacgtgtgttgcacccactattttggtattataaatctaaaattgaaattatatgttacttcaaaactaatcattatatgatccttattttagattatatctggtagctagattaataaagaatacatatcaattacatctagctaattaataatttcaaaactaaataatgaagtgagaatccagtactacaggtacaactttatatttatcaattttaaaagtttaaatcactaaattttgaaagaagaaaaacataaaactagagagtccataatattaacaaagacgtgtgaatggtcaaccgactctctcttttgttgttttcttttgctacattaattaatcggtggcgtcaactctagatgggttacgtgctcaatctgatttggttttgagttagggagatcgtgtcagacgtcctgaatcgctgatttctccataaatgtagagccgtcagccgtgacctccacactatacatgccaaaaaacaattttagcttatgttggagtgggacgcgaattctggctcgggcacctgatgggaggaggtaaaaatcggatgctgatgtcagaatgatgtcagaacccgatttacgtgcaaaattaatttaaacttatttttctcttaaattacttatccaaattatgatccgattacaccattaaattcgttgcaattaaatcttcaaaacaagaccacacatggatatattctgacggaaaaaattagcgtattattgaattatttgtaaatgttgcacgatattccaccaggtatatcgtaattgtttcactaagtagatcgaaaatgtttcactcgcttaaatcgggtgttatttcaccttatataaaaacaatgtttcagcaaatagcgaaggaatgttttagttcactgcatcatttgattcatatatagtgaaacattataagtgcattaggtgaaacatttttggtggaaaaaaaatgaaacaaattcccttaatagggggtttccaaaatatgtggatgattcgttgtaaaagaatattttaattcattgcaatattagatctatacatagtgaaacattgtaagtataaggtgaaacatcttttgtggaaaaggggagggacaagtgggtgggtccagtgggggtgcgcacgtggggggagggggagcgaccgattttcccacctcccctggtcgaccgatcctatttattctccattggagtggcgtaatatttggcggggttacgcttcctatccaatttggttccaatgactaccgagctaactctccatgcaacacatcgtaaaagaatttatgattttgcctcctcctccgtactgtcatcccgctcgtcggtgtgcactggtaattatcattagagcatatcttcggaacttattaaaaataatactattttaatagaaaattgcaaaaatagagatcgaccgactaaaatcacaaatttaataccctatcgaacaatcattattcgataagataaatattgaacaactgttgtttgacagaggttacatgctaaaaagtaaaaatataaaagctcatcgtgcagtgcacatgctgccattgcagttgggtcgaaggacctatcgaacagctatagttcgatagacgtctcttttcatattttttttattttatttaaatatactaacaaacctgtcgaagaatagttgttcgataggctatctattattgtatgttcagtactaatcgtgccgtagttgtttgatatgtagttcgacagggtattaaacttgtgatttcagtcgagtgacttctatttttacaattttctattaaaatagtattatttatagggcaaaaccgttctttttagaagcgttatattgctacgtttgactgctcaagttcgtccactatggttcgtccctcctctaagttcggacgctgcacacgtcatcatcgacacttggtatcatacatcgtcaatgcacatctgctgagcccacaaacctccaccatcatataactagtgctttcccgtaaagtgatattttcttatgtttttggcaaaaatagggtggtgtattcttattataaagatgaggaaaatcgagccgaggatcaaattaatcaatcggagggaaatattcatcttgccagtggagattctctacagtaccactgatgtagtagtagacattgacgtgcgagtctatatccacatgtcaaccaaggctgcggcatcagtagtactgcaaagggcatgcatcctccacttacatgtttgagcatatatatttttatggcggtgcacttcatcgatcccaatgcaaaaataaaaataaaattgtaaggcgtatctctcttaaaaaaaggtccaatccgtggctacaaaatctgcatactccctccgttccatataaacatttttttagcacagtgacaagtcaaacatttttaattttgactattaataaaaaaaataaaaaaaagatcaatcatgcaaaattgatgttactagatttatcattaaacaacttactatcataatatacaactttttttatttaaaacattttacttctatagatatcgttaatcaaagtagtatcttagagaccggatcagagtccaaaaattcttagggcctgtttagatccagggactaaaatttagttcctgtcacatcggatgtttgacactaattaaaaatattaaatgtagactaataataaaacatatctcataactatgtactaattcgtgagacgaacctattgaacctaattaattcatgattagtctatatgatgctacagtaaacatgtgctaattatagattatttaggcttaaaaaattagattaattggatccatgccactgcaactttgccaaattaaaaaaaatacaccactactattcccgatatctactgggtgccatatgtattttgcaaatttttaaccatgccactgtatacgtcttggacccagttggaccaggttttttcataccatatttttgtaaggaccaaaataccctcagtccatagaggatgacaagtaggacccaccttatcatacttgttttcatcctatcttatattttggtatggagggagtacatactttggtcaagatttatagcatccgtaactttggttcgaaatcttggcttttcctacgtcctacgacgactattcttttgtattcaaacttctaactttttcatcacatcaaatgtttggacatatgtatggagcattaaatatggacgaaaaaaaatcaattacacaatttgcatgtaaatcgcgagacgaatctgttgagcctaattacgccatgatttgataacatgatgctacattaaacaattgctaataacggattaattaagcttaataaattcgtctcgcagtttacaggtgaaatctgtaacttgttttgttattagtttacgtttaatacttcaaatgtgtatccgtatactttaaaaaaaatttgacacacagactaaagcgcagccaaacacagcctttaatttgttcttcgtcagagaaggggacagtgtggaggctgcatgcggatctccatgcacacgcgctgtacttcctcccaggcgaactgtagtagagtagctattcgctcgatcgatctatagctagcatcgatccgtggcgcggcgggcgatgcatgggcgaaaggtgctctcgatcgcacgagaaaaaagcaaggcgtgagcaagtaacatgggagcctgtactacctagcactatagattctactgccccatgtctgcatttctagtccggtgcgctgactcagtttatactttttttcattccttaaatccctttgaacaaaaatttctttctatatactaacttttgcacaatatttgatcgttcatattattcaaaaatttaatatagatacttaatagtataagttaagattatattttatttgatgataaaacaaatcacagtaaaataaataatatttatatttttaataagacgaattgtcaaacattatatgtgaaaatcaacgacgtcgtccatttaaaaatggaggtagtatatctaaatcatttttccacgtcgtctatgtaacattatatgtacataaaaaaaaactttgcactgccaaggccaaaatgcctattttctttaaaaaataatgttaagggtacggtattctaattttatcaattaaagaatttaaaaaaaaaatcctcgattggtagatcgatcgagttggacgcaggtgatagatgcctgttctgaactttttttccgagggcggtgatacgtatcttccgatcgctcctttgggagtttatttatttggtttttgtccaatcgctttgtactttcttgatcctttggatgcatgcttgtgctttgtgctaactatccggccgggcctcgacagaaatggctaaaagcttggggcctcgttactctcatcgatctctccatctgaatcctgtccatatccaggttaagatcacgtccacaggcacagcacactagcacaggcggcgactgcatgcgatgcttttcgggctttttgactataccttcttgatcgatcactcctctgcttactttcatggcttttcatgtcatgctcctgcatactcatcgatcgacctctcgtagcatgtaatccttccgtctctaaatacaataaattttagtggagtgtgacacatcttaataaaacagagggagtactacgaagcgtagctatgctgccgtacgtgaaggaggggagagcgcgcatgcaagctagcccaagaagtgaaggggtgagaggcatgtacttggaatatctactcaaaaatatttaatatttaagataagatggtgttatacttttaaaatttcctatcatcaataactcatcaaatgcttattttaaaatcaaaagatgtggtacacatatatttcatttttgcctcgaaaagtactattgtaataacataaacttgttactccacccgtcccatgggattatgctatttcttcatacaaattgagacaccaaaaggacaagtaaagaaaatgattgtgggaaaatagactagtacgtataatagtataaaagttataggtgaaaaaacaatttctagcgatgaatatggacatagcctatatccaaatttctagtcataaattattttttattttttgatcgatggtgtagtacaaaagttggtaggtaattgctgaaatacctttgtcataaaataatttactttgtttatgtgataaacaagatttgtgcgatgcttttcttatatccatgccacaactagtgaatggacatgttaattatatagttgagccatcatgtgttgagtttaagcatgttattcacattgctagcgagaataaagagtttaaattactatcttttttaaatacttggggctatattcaattcgatgatctttgtccactcaactgtttagagaataaattatttgctagatctgaattgccatgtccttctgatatgattttgcatgttattggcaatttataatagtaaagcagaatataatgtgcatcgagtatatatttgttcgaatttaactatacctccttttcacgatgaatgtattgtctagagaaccacatgcgtataaataattctctatctagtttctctacttgtttaaatgagctatatgttggtttgcaagaaggggggtgctgtggttttccaagtggcaaaatttcagaatccaaccatatagcaatcaagaaatgttccttacctgatgttgtgatagataaagataagttcagtaggctcaataacaaggtgaaaccgaggacggtttccaaacaagaagatgagtatgataaggacacaactagatcagatatgaccatgactaccatatgtattcatcaaccaaaagtgcatatgttctatattagatttacttgttatatatttgaacaaatattgctacacaatgagtttagtgtgttttcttttgcagaggtacttgcataggcaaaagaaatgagaccgagcataagaaatgcatggataaatcaaataagttgattggggaccaaatcaataccttctccaagtccattcaaacctcaccacgtcacttttggtccatagatgataagagataaagttctacacgttttggattcggatttgggcctcttgacagcattaacttcaaacggagctaaccgctgatctagaaagaatctcggggatcatgagtacttgttggaaagcctatggagtctactttcagatggttttggtcccacgtcaaaattcgcaccaagctgtcgggaatcagcaaaacaagccacgtacctcatccactccgaatctgatttgggtcttgggcctcataacgatgtcgtgggttaagcccaagggggtgtgcgccatagggcaatcttaggacgtcccaaatcatatttttttaatagtcgtcatagtttagagtcaggttttgcttagattatttctgccatcacagttttgccgctagtttggtttgtgaaaccctaaattcgagtgcttaatcattcatatgcaattgtgttgcaatctatgttgttcttacttgtgttctttgattcgcatgcagagattagccttctcggcgaggtcaacctagcagtgcacggttgataaccaaagaaaacgtggtgctatgattgcaggatttgaatcatgttgatcagaagccggatcatgtttattaagttttcacaaaatcgagagttatcaatatctatcagaagatcgagacctactatcctcatcgatcgtattgtatagcacacgtacaaattgacccttagtaataattaagtgaaaaaagtgcggtaaaattgttaagttaatatatatagtaccgctaataataatatagtacaaattgaccctagtaataattattatgtaaacaaagtgatgttaaacttgtaatatactagtaccactagcttgagcccacaatagctagtgctagtctcatgcatggctgcagttgcctgtacattccacgcatacatatggacacatgcaatggattgttattatttgtacctgtacgagaacgtacgtaatacaagtgtgtacaaccatacacatacacaatggcaggttatgtgtggaattaattaagttagctttattgggcagagaaacaggcaaacagcagtgtggaccatcagaagaaatatcagccacaaaactaactaattaactgccggtaactaaccgaaaagctactagtctgaataaaagtgagagcagcctcctgtctagcacgcttcatcagtacgcgccactcaactccatgaaaaagatcacaaagttatacttactctccccttttagtaacgtgggtcaatgttttacaaggttagtctaaaaaagacgtttagaatgaagtgttacaatggtctattttgatataataagctactccctccattccataatataagacacaaccatttttttatatttcataatattataagacatgcatgcatgtaggcaattaactatgacctcttcttcattaaattattactttttaaaatcctccactctcatgttctctaactctattggatacatgcattgtatttattagaataatcgatctaaactacatgatgataataattattttcttggttattgggtaaggggtggttatgccttatattttggaatggagggagtagctcctgctgatttcaaatatagataattacttcaaactcgctataattggcattcgatcggtggttaaataatactttttttaaggagtactccctctgtttcacaatgtaagtcattctagcatttcccacattcatattgatgttaatctatctagattcattaatatctatatgaatgtggaaaatgctaaaatgacttacattatgaaaaggaggaagtaattttcatccgcagctttgctaatttatcaatcgcctgattctttttttaatcgtccgtcacctatactttcccaaggtgtcaagcaaagctgcacaagttgtacactaaatttgatatagaaaagtgtaactttaaaatagatgaattgcaacttctattttttctttttttattaattgatgaatgaatctagacacatttttatatatgcttatataatcatagaaaatttcctctattagcaagaataaatcagcaagtgcaatttttttgtaagtttaggttagaatattttttgtgtcaaaaagaagaaaaaaataatatatgaaatatttggatatatattgatctaggccatgttcgacagcctgttacaatcctactacaatgcaacgctttatggctagtccattcgcagtagcaagtaagcggcagcgggtctatcaagcagcgttgtactagtaacacatagccaagcactaccttactgttgattattgacaaggtgattgataatattcgctccatttcaaaatgcaggatatacactataaaaaacgattttgtcatagcattaccctttttattttttttcaagcggattaaaaatagtgccaccagtaaacatcacgtttatttttactagcggatgaccttaagtgtccgccagagaaaatcgattttcactggccgatgcttaagacgttcgttagtgaaaatcaattttagaaaaacatatatttgtacctaaatttttcatataaagtcagatgaaaataaaatttgtaccaaacttgttaattaatctcaatttgatctacaactttttagttcaaaacttttccatttgagatcacgtagggttcaaaatattcgttatacgattcaagatctattttacaaaatttcagatatatgaatcacataacctcctatggacatatgatctgagtcaaagttgtagatacaaagtagttcatgactttttttttaattcgaaatcatttagagaggaaaaaacgaattttaagtttcgaacaatgaaaatcaaaacaatagcattctgactatggataataagtacttcatagtaagatggtaatgtaatacatgtgtggagagagaggtctttgcgtttgaatcctatacaaatcacaaagttgtgaatttaatctaaaaatttgcctaaattgtcaattaggatgcatagttgtgttacagatgcccggtaaaaaaatcaaaatatttttgttattttatttctgattttcgttggtagctgcattatgtcgccgccagcaaaaattgatattcgctggcaatcggatgccgccagcgaagatagttgattttcacttacctttagttgctgacgaaatgtctggctgctaggaaaaatatgttttagccatcaaggaaaaatgtatttttacagcgatattttgtttcgttaggataacactttcatgaaggattactctattataatataagttttgaaaatcaaatttgatgttattatattcatcttcaaaagtaatttaatatgattatacttttgtactccctccattccaaaatataaggcacaaccaccattaactcaatgaccaagaaataattattatcacctttttgtttgaatcatcccaactaatacaatacatgcacccaatagaattaaacatattgatttaaaaaaataataatttaggagagagaatgtgctattaattgtcatgcatgcacgcacgcattatattatgaaacatctttaaaaaaaagtagttatgccatatattttggaatggagggagtacaacataagcaattgttgatcaaacctttatcctatcaaaaacaaattccgcaatatattttgaaatagacggaatacctccgttccaaaatatctataattctaggagtcgaagcacaaattaggagaaaggtaaaataacgtatatgtccctcattataagatgggtggatgaaagtgagatgggtaagatgtgaaaagaattgaataagaggtgaccaatgacacaactactactctagaattacactcctatggagggagtacttattttgggacgagtttaaatcctaaatttgtaattattttgggaccaattgaaacctaattcttttattacttaaaaatcagtcaactgaacaactctttgatttggctggggtttcagaattgaactttcacactgttaaccttgtggtgtggtggtgggccgggagcgtcgtgtgcatgggcaagatatgatcgatcaaaaaagggtttagcaaaggcgaaggtaattaagcacctggagagaataatgctccccgttaagagcaagttagccaactgttggcttcaaatcatctataaccaatttaatagctcattcatataatagttacctataaaaatatattacatcattaatacccgatcctacctctcatacactcgtaacgtattagagtccgtgttgcagccagctacaaatctgtagcccgctttcttctctctcttctcttttcttctcgatatatggttatagctggtttatagactgctattatacctgctctaagccaacctttggcgtaacagtagatggctaaaagaggcatgcacgaggatgttaggacgcgtttgtctgttggtcgcccgctgccgtcgtcgtgcatgcaaagttgcgaacgccgcgcgaaagcgaaagaaaagggcgcatccttgcatctactctctctctctatctttatagtttatctctcagttcactcatatagtaattaactcttcgttataaatatatggtccacctgactgtctcatagatttttttggttactgtgtctaagtcggttgtaaacttatagtccgcttctcatcgctctcctctcctctctcatctatctcagtattcagccttcttagagcaagtttaatagtatagcccactgctacctctaaatcatctatagctaatgtaataaccaatttatacaatagttacttactatactattcacatctggtctcacctgttatacacatattacgtcttggaattcgtgctttagctggctacagacttgtagaccgctatttttctctctcttcctttatctttttaaaatatgtttatagttggtttatagtctgatgttgtacctgctcgaatggatggttggatggatgcagctagtctagtgcgatgcccaagaaattaaagaagctagcatggcgatggccatgcatgctgcgctcatttacgtttggggagagggcggccgggagaccggctagcagatggggacgacgaacgcacgcaacgcggtgatcgatgatggtggcgagcatgcggcttcccgaggctgacgctatgccgccgcccggccggcctcacgctgacctataccttctcttcagtctcaggccaatagcgcccatcaccctcctcctcttgctcgtcccgtacgtacgcataccagggatttacttcctatgtggctccgtcttcatttttaaatctcttttaattattttagtttatttttaaagtaatcattacattataaaaataataaatagttgtattcagaaaagataaagtgagaaatagttgtattgggatttagtctttttctattactatattggtaatttggtatgtatgagatggactcaaataatctaaattctcatcccagattaatttcgtgaacatatagttataaaataaaaaaaatggattactgctaactctattaaaaaatataagtatttttgctttttttttgaaaaaaatatatatttgggcatccttcctaaatacaatcaaggttgtaggggttcagacggaagtctcacccggtggatcactaggccagcaccggctatgtcttaaggcgtcgtaaccccttgaggcactgtcgagggtacatctctttctttctcgacgattttctctaggtgaaaaccgcatgtttcttaaatgggcgatgtcgacatccatgatgtcatgacctatatgatggcaccattttcggagtctcatttttgtgatgttgtcataggctcggcatgatttgccacgctttgcgggggacgttttgatgttataggctcctctctctcagtggtttgtgctagcttgtgtggttagcgtgtggttcttggacatattctttggtgcacatataacctcgatagcttttgtcgtgtttttcttgtaacttttcttcttcttaatacatgtcgttgaccttatttggtcttatcagcaaaaagaaaatatgtttttggaaatccttccgttcaaatacattttgagaaacacacataaatattgtttatattttcaaacggagggagtagaaatcagaaacccatgttctcaccaactgcctcttaagaggtcttgatgcacaaatcttgtgattgtagatataagtaatttagatttttgtattttctttctgtaaagaaatgtcattctagtcgatcgctctagctaggcagagttggatcttacaacactaagtgcatgtgcaatcgtttgattctcactctttaaatatcaaataattataaaaaacactaaaagaattcacaatgttgatataataaacatataccattacgcaaaatctcatggccaaaatggcaaaatcaatctatacaacaaaaagaaaatcgtaagttttttaaaacctttgataggataaatcaattattagtcatgtatgtatataacggtattttcggtgtttttagaatgacctagcccgatgatatattgtagaacaaatgataaagtcgtcggtatattataaaataaataatattaatgataaattgttgaactgagacgaaatcaatggtatttgagtagattttctcttacaagtaatattaaaaagatttgtgatgtatactagctggctagatacgtatatatacagtgtgccacactagttttgatttttattatcttagatcaaaattattatcagttgctaagtgcttagtactactccactagctactgcctaagatgtgaaaggggaaaaaaagggcaaaggctgcgtacaatgtgttcccacatgttctttgcggtacccacaccttcttcaagcacaatgaaaattgtctttctcctctaccgatgcctttgtccctgttggcatcatatccatgtactagtagggtctaactaaatctatgatcaagatatttggattaagaaataaacctaataagatcgtggaacaaatggagtaatattctagccgttttagaagcttaggtttggatagggattatcttggtcggtttactgtgttgattacgtgtaccatttcttcagttctgattcctacatactatttcctccatcccaaaatataaatcttggtcggtttactgtgttgattacgtgtatcatttctttagttctgattcctacatactatttcctccatcctaaaatataaaagattttggacagatgagacactttctagaatgagtactatgaatctggataagtaagtgtctcattcgtctaaaatctcttatattttaagacggagggagtaatagacacgtacctacgtactcacctttttttttttgccaattcttgcattaaaattttgcaaaaggaaattatactctagagtactttttccccctccaaccacactcaaccaatttttctttcatcttatcccagaccgccgatgaatccctaataatttatcaattaaattccacaattgctttttttggagggagtaaaatatttaaaatcatttagatgacttaataacttgtaccatcttaattaaattaaatttttccaaaaataaatatcatattactatttctgacttttattattctagtactaatatagtgtgtttataacatagaacctcattgctaacagcatgtgtaacatactttgggaacaatcttaaactgatccatctgttctaatgaatatatataatatatatacttacccgcgagtgagaagtgacttagctaggagtaatattttctagagctggggatgagcgtgttgagtattctctcaatcctaaaataaatatagctgtgtaattcactcactgtctcatcaaaaccaacccagtatggaaagtgatatatcttattataacaaatctgatatacttcctccgtttcacaatgtaagttattctaacatttcccacattcatattaatgttaatgaatctagacatatatatttatttagattcattaacatcaatatgaatgtgggaaatgttagaatgacttacatcgtgaaacggagggagtactatctagcatacagctctagatcttttttaaaacggaagtaggattttgaaacagagaaagcagtaggagtacgtaattagttgcgctgtggaacagaaggtgcagtgcccaagggctgtgccctgcaatctctcgatcgatctacctgatcaacgatcatgggagcattatggggcaacagcgtctgggaattcaggaggagaccaaaaccgcatcgaaacggctccgatcgaaatgacaacgacagtgtgggggcccgcatgtcctttccctgtccatgacatcatgcatgagcgctttggactggggcccaccaccctctcccttcgacctccacaccggcgattgagatgagcgagagccgagagactgcttgctgaataaaaagtccatcgacaccatctaaaggtgcaggataagaaagcaaaggccatgcaaactccgctggacatgcaaacaaagaccaatatagatagttggtcatgcttcttgtgatacctatctgaattcgggtctttgactcaatatagatagttctcaaaaagaaaagaatcaatgtagataatcacactcatggctaataagttttagttatagataatataactatccacaatgagacgtctatcacgattttgttatttttaatttttaaacatatggatttagtctcctaaaaatatttataagatatgatgtatctgtgttcatatagatgagtctacttatgtgcacatgtatttgcgtttgtgatgtgttttggaaaacaaaaacatgacagattttgctttaacctacatataagttattaatagtagtttttttttattacgtgtgagtgcacacgcgaaaaccacactcacgcctacacacccgtacaccatggtcagtagtgtggtgcagcattgttgctaactaaagaattctgctaactattgcatccgttctattttaagtatagttgtgagtttacgtatccaatggttgaccgtccatcttattaggaaattttatgaaaaaaataaataaaataatcatacaaagtattattcatgttttatcatctaataataaaatactaatcatatttttttcaaataagacgaaataccaaacgttaagtataaacggtacaaactacagtcctttctagtacagaagtagggcaaaactatatgactattgacgttgccaaatggtaacctagtatcataaaacagtataaatttcttaaaacagtatcttaaaatatccttttaatttgtaatagttaatttattagtttgtactctcaaaatattatccccaaattggataatggttaaggtttagggttaatggctaaggttttaaaagaatcttatcctaactataaaatatttatggtagaagggaatagattttggatgcaattctgtcaagatgctaatcatagcctcaagctatatttcttacgggagggagggaaccaagtagcagcttgcagtttagcggttcaattatttacatgggcttttatctagctccggcagacagttgcactggaagtggacttctggaagagaatggaaaccgaaaaaaactggtataattcaaggtcatttctggactttggaccatacatggcagattggcagatgactcttaaagataagctaccgtggacaaggacgtggcctgcttgtaagttgtaactggtgagatcaaaatatgcttacctttttccgcatggatttcttgccttacatgtttgtgctgccaactgcgaacatacgaacgcatgagatctaaagatggagcatgctgtgaagcaagcaaagttaacccctacaactgatcattgcacatgacttcgagtaatctttagatttctaagataagctatttaacatccaaaatgacagtatattaaagcatgcaagctttggagaaaaagaggtacgataaaaatacagctacaacactatctagattctagcgcttcttgctagaaaatgcagtatgggcgcatacactgtttatgtgcatatcaaacaaatcataaacttagcaaaatttgagccttcgggcaggtgggctgaccgtactagtatccatgaaagataatcatgatttcaacttcttcctcgacacattatcaaggaaggcccaatcaggatatgggcattcgtagctccaatcaggaccagtatatcgcacacagtgcagccacaatgcctcctcatctgcatcataactgcccaaagaacaaaatattacgaaggcctgaagaattcctaactacaaacttgataactgtaagcactcaccctactggagcaagatttgggcaattcgtacacatcggatcgatgctgaactcctcatcggcttctgtatcttcgtttgtatcattgttcccaaggtcagcacaactgtcaggatctgaagatggcaatgaacaagctagcgtggttgctctgttgattcttgttccctttgacgaacgtggagaaaaattctcggaaaggtacacctcgtcattggctattgggtaaccaatgtgttttagatgtacccttatctacatttgtcaaacaaaaagctgtatcagaaatatagataagtaactgaaaaaacaaaaccataggacaagagggcatactattggcacaaagaatcagcagaaaaattatgaccacatctatctcatcttgcatcagagacatgctatggtgaacagatgtctgataatttgattattttggaagtaacggattgggcatgaagcatgttatcaaaacagggacaagggagctatgagtaaataaagaggcactcaacagtttgcgtgtcacctgtgtgcacctaaaatgcattttgccaagctctagcaggattaagatttccattatgattcagatagtgcagtaagtttaaaggccacttgaactttttctatgtagtaggcttttagattcatttttttttgggaaatttccaggtcgtttcgattgtttgaagtttgaacgagcaaatcaatgttgatgtgtataaggtagtgtgacctgatgagtccggccagtcacaggtttgcacaggacaatgctgtggattccatcagtacagatcctctgaaacttggtgcaggcttgttttccaattggagctttaccatcaccatcacaaacctgcatttcatttcagtaattgaactcagatatgttcttcaaaccagaattatatcctactgagtacacttgctctaccgaatttctgaaaatagttcatgcataaatgaatgcattgttcaatctacttgtacaagaagaactctataggacccatatcaactatttcttttgcttattataatcaattatctcttatttctttggtacagatagccatatgcactgttaccattaaagagcacacaccacattacactgtacaatcctacaattgctcagcaccagtatatcacatgcgggataaacctataattgctcaggcaaatacattgcatgagaagagaggtgcgaggcagtcaataattgccgaaagagatggcaatatcttcagtatatgcagtttcacacacaacaaaacataccaaccacaagcaggattactaattacatacctctgcagtgctccttccttcccgtgcgttgaagtgcacatttgcattaacagtttgctgaaaaagaattatttcagacagatatttgtgggaaatcagcagttatgtatgaaattatgaaatcaaatactaaatgaaatgcttttagttcacaagaaaattccacggagtcgtttcctaggtggtagatccaagccttcattctcacaacatgggaaaaataacaaaaccctacgggtgacttcagtataagaaatggtctacaagccttcgcagagtatattcaagttattttacattggcaaaatcttccgctcttggatccagcaaatttattgacatgttgagctgttgacaccaaataagtgacgtacctcaccatcaggaaacaccccaacaaccttggccacatattctttctgcagcaaactagcttcgatctgcagttatagtattcaattaagaaataagtgtgaaaagataaaagtgttaaagtaacatacataagttgagtgcagacagcagacacaaggaataaacaggacaatagaaaggtgaattcaaattgacaatgtcacctgttgcctgaaactttcagctttgtcagcatttttagcaaaaattaaggagacctgaaactaaccgatctagccgatgcacggctgtcaaaataataatggtggttaaggaatttgagtacaaatataaataaaggtcaaagttcaatcatacagggaagagaataaacaggatagtgaaaggcactagcaataatggcacaattgaggcaaaggatacgaaataggggcaccaatccatgttcagcttgcagaataccgacaacagtattcttgcggtattgaccacacggatgaacctacagaaagaaaacacctccattttttgtagttaacaataaacgactacagtcaaatatagctgaaccagatcaagttataactaaaccttacaaacaatggaattaacacttgcatttccaaagctactgaaatctcaaaggtgttgttgatcttaataggccagaaacatcattcaaccaaactgttcagattaactgctaccagaataagatctcacacttaacaacaaatttatgaattcaagaaggaaaaccttaggtactaatttcatctggtagagaatgttttaataacttcaaaatcacataatcctatagtagctatgcgtgtaccttgacagtttccattctacagatgtttcgcacagctcaaacaatccgtatcacatattaacatataactttcagggcacatgttggctatgaacctataactttagacttgatagttgaatagtcgatacaaccttacacttacaaagttcaggtaacatattttgactaatggatctaagtgaccaaaaaaattccggaagacttaatattaaggataaattaaagtgaaaacagttatattataaaaaggatggcccatgcatgtatatcttttttatacatcacatagtatttgaaggtttctgaacaaaatgatatgaactcactggaacagatgcaggtttgcaaactgtaacaacatcagcttcattttgaaggattgtaatatcaccacccaaaactggaggttcatgcctgtcagagtgacaaccatgaagaatttgacaattaattgtaattgaaagtatgtttctttctttttttacaaagaataaagagcttcagtagttagagagctaacgaaaccatgcaagcagaacgtctacacctagcatgggaaaataaaaactatagacaacattagagctgactcaggaaccaatcaagctattgtttctgtgcattttacagttcccatcaccattaaattaaaacccgatctattactattaacttagaagccaaagtatcagtaataactgcaaaaactgatgaagtaagtggagaaattatataagagatggttgtaattggttgagatgagggagtaggtggaaaggtagccatattttgggatgaagggagtaatatttttgtcaaatgaccatctcaatgtacctttgaaactgatgaagttgactcacctgtgcaagaaatggcttatcttttgtgatgattgcacaacatagtctgcgtgaaccatttggtcatccacctgaagcctcccacacttcactgcatgaacctagaattttgttttttttttaaatcaattctagatacatcagaattttgttttttttaaatcaattctagatacatcattgtagataatgccaaagaaccaagagagcttatctagttccaaacgtgcaagggttgaatcataagattaatttgcaattctaaatggcggaatacataaaacaggacgaaccacattcagaacccaagttttgtgtgtgtatttctacagttaggacccgatgactccatatgcaaaggtaaatcataataaagaaaaaggaacttataggacacatggtaatattcaaaagagatactggtggcatacataatattcacgaggccggcccttgaactcatcggtgaagaggtcaacaatggtcttcccagcccatctgtttttcacctgcaaaccaaatgaaaaaataaactactccctccgatcttgaaaacatgtcgtcttggaacattaatatctttttgcatatttaggttggatgcatgagaagcatatctatagaattgtttcaaaaaactactttcataaaattaaaatatcttcaggctacataaaccaatggtcaaaggtgtattttaaagaccatctccatgtccaaaatgacatgtttccaagactagagggtatggatttggttgaagtaaaactcgacaggatcgcttggagataatagaaacataacccaaattgccccataatgcagagtgacagcttttgtatattgcgcagtggtgtagaggaaagggagaacttggaggtgccaataagttacagcttgcaattaagtagtaatatatttgatggagcagataaaagattaagaaaaaatgttaggccaaaacccagtaacatctgattctatagattttcagtgcacaatatatttattctcgaaacaacaattttcagtagacattataactaataacaagcaggaatcacctgatccaagcaactaaaaaaacctatgttcccaacataaatatgtaataaaatgcaggcaaaaccgaggaggttggttacatgggagatgaactcgaagtagtagggcctcacgtagcgccgccctgcgaagcaaaatggggggggaataaccaaccgcgtcagtccggggcctccggggagggggtttggcgggcagaaagaaagatgcgcgcgttggggacgagacggaggccgggctgcgggttgctactaccgtcgcggaagatgtagtcctgccgctccggcgggttcgccggcgtctgccacacgatccccgccggccccgccgccatatatatatatcccgggcgagacacccctcgatcgggcttgtggcggcggaggagggggcggcggggcggctgctcagctcggcggttcagcgcccgaggagaggaaggaggatgggcggcggcggcggcggcggtgggcgaggagaggacggagtggttcggcggcgcgactggctcggcagtggaggattttagtgagggtgtgcttccgagggcgtatgaccgtaggatccacatctaacgttcgtgggctcctggcattgtcgtgctcgaatcgtttcggcccatttgcagcgttactcacctgcttatccgtatcacttatattggtaaatagtaaatcatttgtgagtgtaaataatgtaaaataaactatgatgaaaaataaatttaaaattaaattctaaaatttaaattttagctttataagtataagcataagtggcccttgaagtatttaaagaatttaagttcactgtaagagcatgcatagtgatttagacggtacccatctatataatcttatcattttcctggcaatatgtccgtatattacaacggacttgtacctatcttcgaagcttttactgtttttcccaaagaagagcgtgctacactcaagggagagagaacggatggacaactctcctttttaaatagtagagatgtgtagacggcacatagacaactttaaattaggttgtctatttagttagctatattagattgtacaatttcgctatgtaattttataccagctaattgaattggatttgttatacaactcctagtttatatttcaatatatgtaattatattgtatgtataatagatactaaaagtagggttgaatttaatatacaactctaactcttttcttcttcctcttatgtacagttgtatttcgtatataaattttgatatcaatctacactataatttagttccataacaatctaatggcttatattttttttagtaatgtaataatttttagcccttaaaaaacaaacatagtatcatctttatgattcaatacatctatactttttataaagttatagtccactaagtctaaagctcagcatgcaaccatgccacatcatcacccgctagcaataattacatatttaatctcatgcaagcataaaacatcatctacaatttatttaatgtacaaatcaacatgcaagcatgtccaatcatcacccctcgcatcatttgcacaatattttaacaactctatctattattcttataatatttaacatatacttatcaatatgtttcacattaaagcgcgggtatcatttgattggttcatgataaatagtgataaaccctgatgttcattattttttttctttttactcctagcttgattgtaaaaaaatatatattgagaattggttagtgcagggaatcacctagtttaataatatgacattatttaaaatgaactccatagaggacgccagatccagtaactcgaggaatgctcgatgacgccttgcttctgaattccaatccccctccctcttgctcgaacggcggcgagtggccagccagcctaaacacgtcaagatcctctgtagtattgcatgtgcactactacggaggtcccccaaactactcaatgtggtgatgaggctaccactattctctttttctttcttgtcttttagaaacaccctacaagtgtaatgcttgcaacatgcacacttgcccttataaacacacacatataccctacatctatgagcaccttcaaaagaccagaccgacatatcttaaaattaatgaagtcactacgagcgccatactatccacacatgtatgttgtctaccactgaaatactgtaataattagccgtaaatactagcatacatgccaagtctatgacttagcttgggtgggcaaattctaccacaaagaacctagcggctagttgcgctcacttcgattttttttttgtttttttgttactaggtcagatgcaacaaaatgattttataaagtgatatattagagctaaaggttagttccaattagtacataagttttattataatagaatattttgaaactacacagtatttctatatatgagatataaatgcaagcctcgccattgaaaaacgatcaaacaaacaaaatcccatctgtacagatgtttatatcaggccaccaaacaacattctgcattatccaagcttaactaaggctgagttcgtttggatgtttggaggtggcaaccttgtggcaggtaaacaagacaagtcattagtgtgtgtgtatatgattaattaagcattaattattataatataaaaaaatatgtttatttaatttttaagaagcaatttaggaaacatactaactgctatggctaagttcttatccctatttttctaactcacctccttctttttctgcgcatacgctttttaaactgctaaatgaggtgtgttttaaaattttctacatggaagatactttaaacaatcatattaatctattttttaaatttatttttattaatacttacttaattatgtgctaaaccctgcttcgttttacgtgctagggagtgagggttagtctacatgactaaacaggccctacatctcgtagcctaaatcgcttgtcaagcctttccttcaattgtggccgctaagcaaggcccgtgtacaccgcagaggcccagacctgcctaaataggcgggctctcctcgcctgcataattagctagcatcgatccacgcctctttgggctctctcgccgtgctgatacgatcgaccgacgacgcctcttgttgccacccacaagagccccggcccctggtagaggaccgaatcccggtgcgaagaatcgattgatgagatgcatggtcgacctagtagttctagtttgttctagctagggccctggaatctggatagctctgtgtctagggcctgtttgtttagttcacgaaatgataatttttaggtgtcacatcaaacgtttgatcggatgtcggaaggggtttttggacacgaatgaaaaaactaatttcataactcgcttgaaaaccacgaaatgaatcttttgagactaattaatccgtcattagcacatgtaggttactgtagcacttatggctaatcatagactaattaggctcaaaagattcgtctcgtgatttcttccctaactgtgcaattaattttttcttttaatctacatttaatgttttatgcatgtgtccaaatattcgatgtgatgtttttggggaaaaaattttaggaactaaagggggcctagtttgtagcagctacgttgtactacctctgttctaaaataagcgcactcgtgaatatccatatccaatgtttgaccgtccgttttatttgaaaaattataaaaattagtcacacataaaatactatttatgttttatcatctaataacaacaaaaaaatactaatcatatttttttttaaataagacggatggtcaaatgttacacataaacagcgtaaaactacacttcttttaggacggtgggagtacttggtactatttcatatgcttcggttctattgttgtggtgtcgcggatcgacagccctaacacgttggccaagacgtatagtacgtcccatttaatatttgtagttcttttatttcttttgatatatagtactttcttcactataaaaatgatttttagagatacccttttaatttctacagaccggctaaaataatatttatatgcaaaatgattttaggtgtctaataaagacccgtctacaaaatttgatttttatatgcgggcgtattaagtggtctacctacgaaaatagggttatttttacagacatatctcttaaaaaatctatatgcaaaaatatagcaccgaccagtcacacatcatctctctaaccttgtggagctacccggaagatcgctggacgtttctcaattactctcctacctctctgcgtcttctcacttctctctaagtcctttctactctcactctctctcttctccctcatctccactactctccttcgagcggcatggacaagaggcggtggtggaggcgacaacggcgagcttctaccgacgactgcttcgggtggtggagacggaggccccctacggcttcaggcgatggtaatagcagaatcaattaatggtagtgtccacatattgaagtggcggatctggcttcaaggagctccacgatggaggatccgtcgctaggaaacttggtgatgacgggtgcaacattgggagctctgtggtggcgggtacaacattgagagctcggcaacggcgggtgcagccgctcaggagatcgaagatgacaaatccgacactcgggagctcagcggtggctgatccaacaacgctggcctcgggagaagcaaatctgccaccagcctccaaagctggagggccttagcgacagcgatgacgatggtggatccgagctcggcgacaacagatccgacggcgccggtctcgataggggtagatttgcgaacgacgaccttgggagctgtggggcctcagcaccaatgacaatggcagcggactacgacagtggcaatgacggactgcagtgacgaggatgatggcagtggcggttgatcagagctagctagggttttaattttgggggttttttttgaattttttcgcagacagttggtttaactgatcacttgtgaaaatcaattttcgagcatactcattttcataagcaactaagcaagtgtgctgcccgattagaaaaatgcatactcatttttactacactatgggaaacgagtcacctaaggttggatatcgagctagctcggctcagggtagctcgttaggataacgagctgctcggctcgactcgctatcttaacgaggtaaaaacccagcttggctcggctcgttgattagctcgagctcgctcgtttacctcgtgagcttgtgactaaaaaacatatatacatgcaaattagtgaatcaataagagtataatacgagtataagacagtcaatcaacaagaaacaactgccaagttccatccattcatacattacttcaagtttcagcacaaatcagtaccacttccacaagcacaagtgctccaacctttggttagttcagaagttcagaaatatgcagtacaaacgatggacataccatcagtaaatcatcaaaaatacacatcagcaggggcaatgcttagctaaacacttgccaagtgcaaaaacacacgccattcttaagtaattaatcaggaaacaacaaaaattaacaagtttgatggctgaaaacaaaagatctgtctcacacttacacatgcaaaagcaatcaagcacaaaatagtccaacaagaagcaatcaagcatgaaaaaccagaaagattagtggcaactaatcagccatggcacaacgtgcaatagctgtagcagcgggccgccgcgtggagtagtcgaccagaagaggatgggagcgcaagatctgcttggagacaacaacagcggcgtgtcgaggtctcgcggaagctcggcatgcatgtggcggcgcagcttggaggctcgtggatgtcgcgcggaggaccgtggaaggcgcagccggcggctggctgcctcgccgtcgccgccccctggccgattggatctaggatgagaaaggggatcaggagagtgaaagactgagctaggttttcttctcttcttatatatgaacggttaattgggccgcctaagtgggctgtatttcggccatgggctgagggggatacatgtgaggaaatatgtctgcaaacttgctctagctcgttaagctcacgagcagttcgcgagccagctcgagctggcttgttatctctaacaagctgaaatgacagctcggctcgttaggaaaatcaaacgagccgagccgaaccgagcttgttacgagccgagcgagctaacgagccacgagctttatgtccatccctatagtcacctagccgtttgcggaaatggattttagctgtttacaaaaatcatttctgttgcagtgcttttagcttgtcatttacatcatagtctaataggaacatgt

SEQ ID NO: 68256 - DNA, 652 bp, Oryza sativa
ttaaaaaactatactaatatctaatttaagcaattagttatattttgaccacataataaaaaagtgcatttactagactttaagcacggtatacattatttttttctgaagactacagtaattcacttggatatacagagccggtgaattaaaaaaaaggggaaaagaaaaggggaaaaaaaaaagagaaaacactaagcttcgtggtctcggtgagctcgcggcggtgcaaaaatagaaaagaaaatgaaaaaaaaacaaaaaagaaagcacgaagctttgtggtctgggcgagctcacggcggccgtgaactcgggaccgccggatctggctgtctggccgctggagggaaaaccgatggtgttggtgaggggatggatggcgatggccaggaggggattaagggcgacagtgcgacacaaaagaaaaaagggagcgcaatggcggcgacggtggcacgcttgtggccaccaaatcttgcaaaaaagaaaggaggaggaagacgattgccgcgcgcttgttgaccgccgaatctgactgtggagattatggataccccatacctacacggcatgtttaggccgactgggtatggagtggcatgtatagaaagaatttctttaagaagactcgggtaaattctaacctgtg

SEQ ID NO: 68257 - DNA, 27037 bp, Oryza sativa
gattcccttttatgtgcatggttccatgatggctgcagtacagcttcccaaggatgagattatgaatagttgttgtcacctaaaatggcactagcactttagcatgagacatacacaactttgttatgaagaacataaaaatcatagattccgttcaggtatcatcctacagaccttactccattggaagatttcaccgtcatcgaattccactgtcagaacaccaatcggatcgacttgaattgactgcccccaaaacttggatttgagattgctgtcgccccagaatttccagcccttgccttcacagtggcaggcaatcagcatggggtgatgactaacctagtgatgaaaatgacgaaaagcaatgtgttgcaattaaatgcttcacactatcaagatattaaattttagttcacagatagaaaaggaggcaagtgtcatgccttgtggaacttacattaattttcagtagatatcagttttgcattatatccttcacataaaattgaaatggaagataaaatatttcctttgcacagaaaaatacaataaagagttagataaccaaccttttctgcaaagaaacggacccctctttcagggaaatcggcttcataagtctctcctagcagcgggttgaatggtttgcaaggtcttgcgacagatgaagcatagccagagactgcaaatgcagctactttgagaattctcatgagactgtttccctaaattttagatttaacagacacgtgaaaaaaaagaactcgttataatagagagacatgccagttgatacatagagttaaaataatttccgaactcaactatgactattttcatacctacaccaaaccagctgatcgaaactacaatatgaacaatcaacaaaagtcttttatgtgtaaaattattaaagcaccacacttcttaaagagttttgtcgcttcagcaagactaacattgtatagcagagatcatttttgtagcacagaatgattgatctcaacacaaatctgcaaactacagacgtaatgcgcttgtttttgttttcttcatgatcacgtctagggattgacattgagctgaagtctaatattattgtaaatgatctctatactctcatcataaaacaagcaaatatcctggaaacgtagaaatacagaaccacatatgtaaaatgatcttaccatctttccgtattgataagcttgatccaaaaggtgtgaatattctaaatcttcaaagcccttttggagggatgagagtggttcattaaagtaaactggaaggcatactcgtgtcaaatccttgccgacactatctttaataattgaccaaaggctgatgcctctctctttctctgtaggctctggtagtttactccgccgtttgatttgtggtaataagtgactagaatcttccatttggatatccaaaagtccctcaccacaactggttgagcttaacattgctgaagatctgtcgtttggttcaatgaagtagtctgcagcatcaaagaaagtagactcatcttcacaagtcaagtcaccaccatcttgcttctcaaattcatcagattctgtagtgctgtattctgcatgacaagcaaacaactacaacattaacaaatgctaatgtcaatttaatgaatgaaagttatagccactgactagtaaacaacatcaggtttttccttctaatacaaggcagaactagtatactcaggcaactaaatgaatcataaacattcaaaaatgcccgatggagtggcgtgaagaaggataaaatcgccagaagactatctgtgcagctaatcatgtgcagaaatagctcagtacgttctatgaaaacataccgctaaaatttccatgtcgagaactggaaaagtcatttcttgtcaacgccccctgtattatacttgcatctttgccttcctgcacaaatatgtgtgtaatacgtaaaattcctgcaggaaaagagagcagagtaacctttcaaggagagtaactttgcagagttagaaaacaagtcccaaagaagatctatgtattgatcagcagcattttaagaactaataagaatatcaagataaatttccacgggcataagaggtttttgttagctgccgattccattccaagttaggcatgtgaaggtttgcactggtcctaaaaatagggcatccaataattaacgcatgcagttccttacctcaaaatggtgcctacaggatccaaacaagcttagctggtcctcgtagcacagcttcagttgtttgcgaaagctggagaactccgtaagcacaatctgctcacactcttgtataagactttcattcagtccctcttgctgcatccgattccgaagcctggcagtcgagaccgaaacatcgctttgcacaaaagttatccttccgctgagtgatcttagcgaataaaaactcctcgccaagatcaaggcctcgatccaggcaacacggtcttcttttgaatctgtcttcaaatgaagtgtctttgtgggggaaaatatgtagaatctcctatcatccgacttgctctcccgaaatgctgacaactacaacataatgtccagttagctttgctatgggagaccttgcacatgaaaatgcagagtgaactttccaacatgtaacgctatccatcagaaataaaatagagcacacacacgcagactaccatccatcgtgttaatcaacagtcaagctaaatgcttattgcagaccaagacaaataaaaataaagatccaaagaccattagtttggcattccaggaagaaaggcatgtgaatcacttccactcccttcaactttaattaaagggtgagggggaaaaggcaagcaaaaggtacatcacatctaacatcaaaatatggagagaaaaaacaacgacaacaaagatttcaagaaaaccaagaaaatacaatcaagatggtgaccactaccttggaccaagcaagtgaagtgggcaagtagagcagttcttggagatccacaaggcccctcctgattcactctaacttacacacaggtcctctatttcaacccctaacccccttactatcttgctctagtatatgtgaccactggaagcaaagcaattgtacatcctttaattgttggggacccatgagcaatggccttgaaaagactcagtgctagtacgactactgcgagttcaacagctagtaaaagacttgtggaaaagcaaccctctccctctggagcagtacaaatcaataatgcaataaaattcaaaaattaaaaaaaaaacattcgctgagcatattctgtaaccacccggatttgttcaacttaatgcacagtattaaccatgcttcattaaggattaattgtgtcacagttggaattaattatatcatctacatttttttaatacgacagcgagggacggataaacttcactgtcttcatcgttctttagagttgccacagaaccctgccatttgtaagaaattctacaggagagcttgaaattttggctaaatccactaaaagttgagggatttttgtgcaaaagatgtgtctggttgtgtgatagagaaaggtgcggccctttttttttttttgggaaatctcgtatcaggaagagaaaaataggaatcatttttgttcatttgtaccttaacctgatactgctaaatttaggcattgttctgtggcattggaccacgaatgagatgattggtcaatcaaaacctcaggtgtttaactgctccaatatgcccccccccccccattcatgtcatgaacaaagcagaaattaattcggaaattttgttccattccaagaacacacaccaagatcatgttgaacaaaataatcgtccaaatgacaaacaaaaaagggaaaaaaaacttcaagaattcgtgaggacaaaagaacatcacgtcatttcgatccagcaaaatgtgacgcaatctcccaactaaccattgcatagtaacgagatttcgacagagaatcttccagtctctttcgccaacgcaaacgaaggaacaattcacacactaacacaatgcaaaatgtgattgatgcttgatcgattcagattcggaaagaggaagaaagagaaaattcctcgcagacacagattcgcaaaccgagaaatgttggggcaaaaaaaaaaaaaaacatgatctgcgagatcgcaggagaggattgggttaccttgaggcagacgacgccgacgggcttgtccggacggcgcgcgccgccgatcctggcggaggcgccgccgatcagcctgacctcgccgccgccgccgccgccgccatcctcgtcggcggcagcggaggcgtccctacgaatcttggagtaggagagcaccccgtcgtggagcgagaaccaccgctcccgccacccgcggccgtagttggtccacttgtggagcaccccggccaccgccaccgccgcgccgcccgcctcgggctccggcgtcggcggcgcgtccggcgccggcagcgccgccgcggagaggcagcagaggccgtggtggttcaggtggtggtggacgcctccgcctccgccgccgctctgcgtcatccgcctccttgattcgacggcggcgacgagaacgaaaaaataaaaagaaaaagagaaaaaaataatgggaaaaaaatggatttcttttttctttttttgggttcgcgaagaggagcgaagcgaagggaagaggagacgcgagttggctttatttagcagcggttggttgctatttatgtgtgggccccacctccctcgcctattttatgccccctccattttttttcttataagtcgcaaaaaagcttggaggagggttgtttttttctttcccaaactttaatttggccatttcttgagttaatttgtatgttttccacggatttttctcctttttgtcctaaatgcatccaagcaactggctttttttcttcacctttcttctagatgtaatcttgtctacgaaatacggattatgtttcagttattataaatatggtttatctctcaacagtttcggcgcataactataataacgacagcgctacgacgatttaactaccgatggctttgtcagataatcataacataagacaaagccaaaagcatatctttttatatgaactaaaattgtgcaagaaatttcattattaaggtttaagttaaaacattatgttactatccatctaaatgaaaaaaaaaagaataggcaagctaatagattgagtggtcgactgaggtttttataaggttgtgctagcacatataattccttattcatttaatggtataaaacatattcatcgacagtaacacatccgtgataattctgtgaatctcaagatatatagatcggtctagtctttggaggtgtttatagaagtaggatatatgcatgtttatatgagcggttgtgttttacattgttttatatatatatatatatatatatatatatatatatatatatataataacttagttttatactagaacacaagataagctaattaaaacaagaaagaaataattataattaaggaggggagagagacgttaagcaaggacatggatactgtttaccagatgtaggggagcacaggatgtcatagggatcaggagtggttcacgtgctatgactagatttagtgggccttaatgcatagttaatagtgtaccagctagtggaggtgagtgcaacatccacctctcaacaaactccatcacataatctagaccttaattaacctttggaaccccttaggtttactctatgtttgcaagacaagatagctaactggaaattaataatgttagaaattagtgggagtaccttcaagtttacacaaaagatataaatgatgttgcatatcttatgcatatctatactactttaaaattaacaatataccaccactatcctttatcactaacatttgagcccctcaatatcgataaaatttttgtgctccctaattcatcccttttccatgacaatacacgggcaaactagctagtatatgaagtatgttccggtggcactataggtttatcaaaatatgccagcttttggctatgaaggtatttgacatgatttacaactaaaaattattatattttgggacgagacgacatgtgtttaggtgtattggcaggcatgccgtgtgtgaatgtattgatgacatcgtgagagagaagaagaaaaagtaactcttgggagaagattgctaaaccataccagtgtaaaaccgtgtattcttagcttcaaatccaagagcacggacagataacaagtgatgtaaaagttgatcaaggttgtgcatacacttataaaaagcacatgagctgcacatgatgacatgaacatatatatgcatagaaaatttcacaactcatgctagctccataattcttgcttaggtactatctccttttgtcccttctgttggacatttccacttcaatttggaaggtctataaaaaaaatgatgcaaatgtttatagcaatgccatgaattttactcagattatatatatacacaacaaattgaccatggatgccattctttttagaaccgttccaaaattaaagggacatatacaggaaagtcggagtcatggatgcatggattgatacaaatgagaaataataaacccatattcttagaatcttaatagcattttcaggtatagttatttttcctagaaatccaaatattaacttttgaagggccctagtacagaaattgctatagagcaacaaattaatacaagtcactttctaagcaatgtttgcttacaagataaactttctcgtcatccattaatttttttttaaaaaaaactactagtataatttatatattgacaattataattggtcaaaatcacggtgtgggggcccactcaacgttggcacgtgtgcttgtcccggtgtggcccgcgtgaccaaccagcctctcttctaggcttacgtggcagcacatatcgttgtcttcccaaccgacccgtcactgacaggtggcccaacaccatgggtcccacatggcatatgttaaaatataatttgtgagggataaaatgcctaaggctacacagattttccatttacaatgttattataatttcatacaactgaagttcatcaacttttctaaaagaaaacaatttacgacactttgttgtatgatattcacccttattttagaccgaatcatattcacttttttttgtactccctctgctccatattattataattaaggtgtcctagtttttgtcttaaagttacttttttctaacaaagactaaatttatagaaacatgcaccaacttctacaacatcaatttagttttattaaatcatcgtgaaatatgtctcagtagtgtatttatttgatattgttgatgttaaatatttctctatcctaaccaaagttagagaacttttaagttaggacaaaactaaaacacctaaaatatacaaggaagagatattataatggtaaattgactatttgagaaatatcttttgtatgtcaataaaaacttacaccctcttaaagagaatacaaacatatttgtctacattgcgagtccaagactaaacataaaaaataacacaaacgcatgatacaatcaatttctaacacataaaattcatgatacaagattatatcatcacacattttcatataatagatagagaaaacgatttgccacttttctttatctcattgaagtatgttaaggagacgtactcattaatgtgtgcatactacctagggaatgcgctcgtagtgatgtgtggtgtgttctctatgtaatcaagaaaaagaaagacaagcgtgaggtatatatattaagaaggcacactcgaggatatgtgttaaggaaatgcattcactgatatatatgtgtggtgtgcgtgcgtaatgccatgtgttcatacatgtgtcttccaagcactcgactaaaaccaaaataaattatgaggtcaaaagcgaggtgagcatagcaatattacaaatcccatggctggcgatgtgccacgtagcttaatatcttgttgatctgtggcccccacgcttggacgagaaaacccaacatcgccaggcgcacccaacttgttgtcactttggttctttctttttgcaaggaatgcaatggaaaaccagcctatccccaatctagcactgtacttacatgcagtagtggcaggttgattgccaatgtataaacaatgcgaaatagtgtatttcaattttagcccaatagtgtgttgattgatatcatttccgtggctagtcaaagctcatttttagctatcattttcacgactgttggtcgcgctttattgattgattctctatggcatgttcgatttttgtgatagattaatagcgtacggtgctttatttagtatgaagatatacactttctttttctttagtgaggagataatatacatattttcttaggtgttagtattaactagctagacatatgtgtataaaatggttatcaatgattgttttgtggatcagggttctctttaccacttgggaaggggttacgacatctcgacggtaagcttgattaccgtaataaatcgagaacaactgaaaaaaaataaatgtttatttcaactttttttaaaaaaaaacttagttgggttaccaggcgttatcacaagtcggattactgcggtaacaccagtaacgggtggcaagagaaacttagtgtggacagcattattgttcttgccagcataatgctttgtttataggctttcaattggagaaaaaaaatgtgactattttacatgggccttctttggattctccgagctattaaatagctctctggaatcttgttatttaggagtattaaacgtagattaccgacaaaaccgattccataacccctaggctattttgcgagacgaatctaacgaggtatattaatcccgagggctattaaatagccctccggatccaaacagggccatggacttggtatagtaaaaatgaatcattaagagcagactataagccagctgcaaacatattttaagaagataaataagaagagagaagagcagcgggctacatatttgtagccagctgtagtatggactccaagacgcagtatgtgtatgacaggtgagaccatatattaatagtgtagtgtctaactattgtatgaatgagctataagattggctatagatgaattagagctagtagttggctacactattaaacttgctctgatacggtactactgttaggcagaggtgagtggtcaagtaacgcttattttatttgttcttggatctgatcacagttgacttaatcaattaggggatggtacggatagctgctaatgtagctttgttaaaaaggaattaagtagacttaggttcacatgtcatgaaagaaaatgactagagaagccatgtcagttttgaataattgtccttcttaagatagcctaaaattgaatccgccgctaccgtaattttcttgatcgagttcaacttcagcctcatttaattttgatttcaaaacagtagctctcttgattctatcatcatgaaaaatctatttccttgaacacggtaatttcacagaattttcatatgaattactttagcttctccataaatcctgtaaaattcctttgtaccaaaagagaccttactatttttatataatagaacgaataccagtctttgcttcaaagaaattataaccacttattagttattacaagcaaatgttcttttagcatagatcaactaaacaattccagcaaacaagaaggcaaagaataccttactggtgctaagtggtgatggttcctattagtgatgaaaacggagcggatagtttccgtctgctctggagaaaaacgaatatggatacctttcggatcggataattctcagattgttcggatacggttacgaatatgaatattttctcctagatacggatatggatatggtatcggggtttccgttgaatacggataataattcggatatccggtgaacagtgctattcgaatatccgcagaagccgtgagacatacccaatttctttataaccctatgatgttcaatatacctttttagattttaatagtagttcatctcttaacactagtacacactattaatattatttaaatttttaaaaatatttataaattatactacattttatataaaatgagctaattatatatgttgatatttgtttctattagaagttgagttggttttcgtgttccaagaaaaaaatgtttcagtagtcatgtccaatcatattcgattcttattcgtatttgtttccgtattcgagctatccatatttgttttcttattcggcaaaaaatatgaagacaaatatggtatgagcattatccgctacgtttttatccctagttcctataaatgcaaatacaaatgtattcgagaagtctcaaacaccaaactaaaacattgtttttcctcacaaccaactcaaagaagagaaaaaaaaaaaccatcaagacattgttttgcttgctttcttgctgcacaaaacataggcacaccatcattcagcagtatctttaccacttgatgcaacctgagaccctcatgattttgtttgtttcagctgttgttctctagggtttcccaaaccgctggggctggggttaccgcgccccggcggtaagcacggttaccgcacggtaaccgcaaaaaaccgtacaaaaccgtgcaaaatttatcaaaaattcaaattattttttaaatttatttgaatttaaggaggttaccgcggtatttatattaccatacccccacggtaagcccggtaaccgcggtaaccgcgcggttaccggcggtaaggtaaaccctgttattctcctattgaaaaatcaaaggaaacaaagcatatgtgagaagataggagaagagaggtaaggtaacatggggcctgagttggggggacaatgcataggtgtatgtgttgggatgatatcaatcaaatcatgtcaccttcgatcgatgcaccagatgttccctcagcatccatcacggctgcatgggccttttagacccaagtgaaacaaagaatcatacattagagcatcatcgacatgattgtgtactactccttcagtacaagcaccacatgattttccttttaggaaagtaacataccacttgatattttttttctcggttacctggatgacacatatgtagacaccactatataagggtttttacagtgtggttaataatatctcagtccgagtgagccagatcggagatttgatgccacgtcaggctctctcgttgtcctgtgaagaacacggagccaagttgagccacacgtttttatcagaatttgcaggtctggcctatagttatgccccacaccactagagaaggaagaggaagtataggtacctcgtcgccatccctgtcctccatgccaaggggaggagggcaatgaggcgctatcctcgtggagcacttgggccgagccggtgacggcaatggcatggccgcagacgaggaggaggggtgcaagctcaatgggggtggcgatggcctcgatacgtccgcaacaacagcccgacggtggccgcctcaaaccctcgtcccatttgcagtatgttgtcatcgtcttgtggatctcgcccttgtcgtcgagtggtaaagaaggggaggaggggagaggggtgccaacggggagttgaggtgctaaatggagatttttttttcagtgagcgatggagatcagggatgggtcaatggagcttgctgggctgccgccggcaacctctcgcccacctcgatctgcactgaagaagcacgtcggctcgatggggaaggcggcagggtcgaagaagctcgccgactcatcctaccgtccctgaccaatgttgttgtgcttgtcgtcaacctccactcgcgtgtcagctaagcttttcaccagtccctcacgctaaactgccgagctcgtctatgcatcggttgggagaagtggagaggggaggcatcggttggggaaggagagggatagtaatctggacaggaggcctgtctagattcgtggtactatgaaatgtctaatcagatattaggcttctatattttgggacgagagagtacatgataaatcttaactatttggtggtttagttgtttaggcatagtcattctctcttttttttttgttttagaaacagaagacaaacacatgcgctcactacacgcacactcacccctataaacgcacacacgcacaccctatctctatgagcacctctaaaagactagactgacatatgttgagattcacgaagtcaccactaaagtctcgctatcgatgaatatgtcgcctaccattgaaaaaataattagctctaaatgtgaatacccgtattaagtctaagacttaaatccaagtgggttgattcgaccacagggaacctaaccagttgagtgacgctcacttcgcattcattctcatttaattgaaacaacgctaattaatcttattttctcaccgttcttgtctatcattttctagaaaaaaaatgacatataagttacttgattattgtttcacatgaataagattcattcgcaagaactaacaaccaaccaatttcacttagctttttgttcccaaaaaaatggaacatagagatgactccaagatattatagttgcatcacactcgtttaattttaatgggttgtgtactgttattctcttggttaacacaaaaatatcgagaaccatgatatgagcagggtgtacacattactcgaattaactagttaactgaactttctgacgcgttagcatctctatgtgcttaggaccaataacataggattattacagtacacatcaacgttgttcgttaccagtaattaatcacattgcacgaataaagaggtatacgctgacgtcaccaaccgtacaaaggcatgcttgcacgcgaggcttgcaaatgatgatgaattttgtttcattgtcacgatgatcacttaactctatagtactactttaatttgagtgtttttcgtcgcaagctttaagatcaaaagccactactcatattgttgcaaaaacacactattccaatatagtattatacgaattcctgagctctcgaataagtaggttcacagtcgttttcagattttaagttgggaaaaagttgcgacgctttaacgtcaagtcgcattcatccaaattctgcctaataatttctagtcattgatcattgaccggtcaacaacaatctgctgaactggaacatgcaaatgtgcagcctgttctcaggaacatggcctgaaaaaacatctcaactaaccaatgggcaccgttgatctaacaaacattgattggagtacacaagaaagggaagcagcatatggcatcgccaaatgcaatctttggatagttttgtcactgcaagtatcaggaggaattgctacagacttttttaactccctgtcaatattgctgtctgtcacaccatactccatacatgtcccccatacatcagatttagggctcctccaagggcgaaaatacggtgtggatcatcagcctccgcgagcctccctcctggtggcatcatggaggatgtcaatgtcgacgccatcctggggaagcagcacgtaccgcaccaccgatcccctgatgaagcagtttcgcacggatagctgccagagcgaaagcttgagtcagcatgctcaaatgaattctttgtaaagtgttagtgcttgattaatgtagttcttccatatagaacagtgaacacaggtgcgttgttgtatttttaacaatagaaattaacaggtgcaagtggtaaagcaatgagagtatgaagattgtttcagcaagcaaagataacaaaaggatatgaatctttccatcactatcatgacctacaaaacacagtatataacattgatctatagctttgctttcctttgggattacttcaggcatcatgtacttgtaacaactaacaagcaatctttagtaacctatgcagtacaaaagtacacccttcatacaatatcattggatggaactgaaggccaaataaatatctaggtacggatactggttgtccctgtcaagtaatgtgcttgcctggttacaacagtatttgcactggaattaccagtgcatcttaagctcctaattctgcaccagtaaggcatgtcacgaactaggtataccactatatgatctactccccattaattcctaaattcatgtcaatgtagcccaaagtttgttctacaaacatttagacataccgccttttatcattagctggtgactacttcaggacatttactacagaaccattgattggagtcaacacaccactgtgttatggattggctaaggtaagggtctgaagaccaggggatagggcactcgccctctaatagcagcggcaggacttctccctgctgagctgaaagactcattgattagaactctaaggcttagcgctaacttcagatattaattgattatagggtatatggggtccctttatatataggaggatagacttgacatccaaggaactaatctctagtactacagaaaccaatccaatatctatctataactttctaataaacatcatctctttcctaactagatactctcctatctttatttgactattcctaaattatcatgcctaaactgctgcatgggcctggcccatgcccaaaacaacagagagtaacaagtgatctaatgaagagtaatatctactatggtttataaagatggttattattatcttccttatgcatactcttggttgtgggatactgggatcctataactgacattttgggcctcactgtatgcccaaagaagaatcagctgctgccataatttgaattttagaactttttttttggagttgattttagggtattttcaacttagtttctttttcaacattggcttttaagttgctaagaagacatataaaagtttacccacaaatcaatttttggatatagtcagctcttggccaactgacggagctcctagttactaacggagagtgttacctgatccatatccatatcgtacttcttttacttatgcaactacatgtcagacgtgcaaccattctgaattgtgatacagcattcagcactaactaaacatgtaaggatcatgctaaaggtactcctttaacagattaataaatcaacagatgacaagtacatgctatgcaaacagaagagaagaaatctgaaatcatgtagaatgaggtgattttgaatgtatccattaatctgacacagaccaatcacaagaagcatcatgatctgcaacactgaatggcatggaagatgtagcacaggcattggggctccttcagaggatagtattctgacaagcccggggttagcaccgtgcatgaaccaatatctatgtataaatccttttgaaagaaggcagtgcgaccccacctccatgaactacattttaatgaatagccccttgaagttcttcaatactactaagtcaaaatatagctacttttggttatgactctggacaagtacttgtccacattcacagccaaaagtagttacatttcaagacggaggtagtacataatagtaattacaaaaaatgttatagtcctatttgaccattttgaccttatcaaattgactgagttgccacatgtacatgtgtgttgttcaagctaatttggaatagaaaaatgtgtaaacacggtaaaaagaagtgaataattaatcaactgaaaaaccatagcaaatgcacaaacgcacatgcatattgaagtacaaaaccatgaaaacttcctaaatctatcttgaacagagaacaaagcatacagagtcaatatatctacagaagaccaccgtaaagaaccaagaaacactgtgtttgctgcagagtcaatatatctacagaagtacccatgcaaacaagcggctaattgctatccatatttcaccaggacagagacagacagatagatagataaccagagcagcatcgcatcgcatcgcataccatgtgcgggtacttgtcctggtcgacaacccgagtgttctcgagcttgatgttgaggtattggtcgacggagtggagcgtgccgcggatggccaggtcgttcttgagctccaccgtcacctccttccccacgagctccttgaagtaggagaagaacagctgcacagcaaccaaatcaacagaacaaaaaataaaaatcaacacaaactaacagaacaaaaaaaatgaagtgggaagagaagaaatcaacgagcagttgaacaaaaaaaactaaaaaaaatattctaccatactggccgcagaaccctccccgccttagctccgaagaatctgcagacgcaagaggcaggattagcacccagtggacgggatccccaaacatttttgaggggcaaataaaaacaaaacttctagtcctattattaaggtttaaggctatcaaattaagagaaaatcagcttctcccagatctagaagagaagatacagttaacgcaggcaagcaaattggacacaaaagcgggtgggttggagagagagagggagatgaatgagaaaagaggatgcggatgctcaccaagaagcagcaggacgacggcggcgagcgcctctccccctcccctggtagcgagatggagatcggcgcaggcgcaaggagcggagaggatagaccggaccgccggagatggaagcgcggcagccggatcgggaggaggcaaaaccctagaagagcgcgagaaggcggaggaggaggagttgggttgggttgggttgggtgttgggtatgagataggaccaaaccatattattatgggccgggttagggtgaaaggcccatatagctttatttattaggaaaaaagtatactctgactccctcaactatcacccgagtatgattcatgtcctccaacttccaactattaaaaccggtgcaaacaaataaacaatatccctcggtggttttggaagtggttttggctgacgtggcggtcttgaccgagtctttatccaacatggcgcttacgtggcattagaacaaaaacaaaattaaaaaatgtggcgcttacgtggcattagaataaaaacaaaaaaaatatgtgggacccatatgtcattcacacaaaaaagtgggactcactgacatgagagaccacatgtcatcctccctctccttcccttcttcctcctatctctctctctcgggactcaggagcggcggtggtggcagtggccgatggggacgaggcggaggggagcgttggtggcggtggtggcaggcagcgccagcgatgacggtgaggacgaggtggtggggagcggcgacggtggcggtggagaacgcggctatggcccgcggccactaggagggaggaaggggtatgagaggggagccgcccccgtggggggtcggagtcagcgtcaccggcggctggctagcgcggcggcagcggcacgagctcctccctgaagcacgaagcacgccctcctcctcctcctcatcctcctcctctgctctcctccgccacaatcgtccccgtaaaccacctcttccgccttctcctcctcctcccgaccgctaccgtcgccgctcccctccgcctcgtccccaccgccaccgccgtcgctccccaccgccgtcaccgccgccaccgctcccctccgcctcgtccccattggccactgccaccatgagagagagataagggagggagagaggagagagagggggggaggatgacatgtgggtcccacatgtcagtgggtctcactttttgtgtgaatggcatatgggtcccacatgttttttttgtttttattctaatgccacgtaagcgccacgttggacaaagactcgttcaagaccgccacgtaggcaccacgtcagccaaaaccaccaaggggcattttttacaccggttttgatagtttaaggagtcaatatacccggttttgtggttggaggatatgaattatactcgggcaatagttgagggagtcaaagtatattttccctatttattatctcatgtgatttttttctcacacaaataaaaagggagtgagacagggatgcaagtggagcgggtaaacgggatttttccccctccgcttatctcacttctaatttatttttttttccaaaattaacatgtgggatttatttctgacacttatcctacttttaatttattttgcccctaaagaaaaagggagtgagacagggatgcaagagaagctggtaaatgggattatttttcctccccttatcccacttctaatttattttctttctaaaattatcgtgcgggatttatttccttcgcttatcctacttttaatttattttttttccaaattatcatgtgggaaatgaagtaacgagcgggttttattcgtgtagttggattagttgcatctctagagcgagatgaactaaggttacatacccaacttttggattttttatatatactagcaaaaatgcatgtgcgttgcaacgggtgaataaattctaataataatatacgtttttttatgcataattatgtcaatgataatatttgtattttaatgagcggcttgtttttttataaacggcgtattactttctaacagtttcttcttagcatgtttttttttattttttttactgacaacaaaaaccatattttcctccctttttgcttttcttttctcacgcgttttttgcttttttcttaacgttctttttttgcttttttttccaatagatgagaatatatgacgaaataaaagccgtgtaatagatggtaaaaaatcgatggatcctatccgactcaagcgtccatcaatttagcgttttttttctgacagttttttcagagcgatttattttttaatagacagttttttttcttgcgcggttttttcaaataatttcttagaaatggcgcattttttcttacatttttttccttgcatgttttttttaaaaaaaattaccgacgatggaaataatatttctcgcacggttttttatggaagatggaaaacctttttagcattttttttgtgcttttttctcacgcacttttttgaaccgtttttatttttctcgtgcattttctctttttaaatagttagattagattagagatagagaagagatatatactgataagaaatcggaatttgtttcgccctttccatttttttctcgcgtgcatttttattttttacgaaccattttttcgccactttcttagggaatcggacgaattttttttagatgttttttcagattttttcgcctttattggaatcagactttatttttctgtttttaaaggaatcggatctggcctttatttttcaccacttttttttgccttttataggaatcggatctacggtttttttcgccacttaggggaaacaaaattttattgttattgtttttctttttttcccttttttttgcagtttttctttttctttttatatgcacctttatgccctagttctctcccttttattattttttcttaaaaaaaagacctcaagtatcttattgcaagattataggaactcaaatgtaaatataaaaattatagggactcacatagaaaagtacaaacccaaaaattaaaattatataaaaatggaatgctctcgaccggtaggttccgtttttgcaaatagatcttcaatccggcacatcaatttttttcaccaagatatatgggatatcacggtatagattgaaactgagaggtgtgtgcctgggatctcggactcaaacttttttttttgttttgacgggagtcggacctgagagggagttggacttttttttatttttttcttttttttgacggacgaagaaaacatctcttatttttttaagtagtagagaagagatagagatagagaagagataatatatatatagtagtatataaatttataatttaacatagaagaatttaataggatgtaacaagatgattattaatacaagcagaattagtgtagtctattcgttgctccgacttcaagagagacgtgcatcttaacaaagctggagcccaaccgatggtttccttggatggtttttattgctccaaataattctagccccgtcccccgtgcttctctgtcttcttgaaacaaaaggtcgtcacattgttttacaagtgctcaggtgtacgttggattgcgttgttgcacccgactacccgagagtagtcataccaaaatttgaatatcataacagtgctccattccatcgactaggatttgccagccttgagcactataaattgtcctcaaacgttatcatggattatgtactaacataacatgaaaggatcaggaaaaatatctttgatcaaaatttacacctcagcacttcttccattaccagttcgcaagtacatacgcaaacaatgttcccttccgcaaccaaacgaaacctcatggtatatttgagattaattcggtataaaatgaatgtccattcgttctcagcgagctaaaattcctcagcccaaatgcatacagaacttgaggaccgatggcaaaggcaccaacaagtagtaaaagaaaaaaaaagcctacaatgagaatgccgggtgcttccttctttccaggagcaggggacttcaaaaacaaacaccgagctcttcctttcctagctgcaaattagtgtccgggacaaggactggaagctggatcaactttactacaggccggatgaccagtagccaatgctcttgtaccctcttaaaatctgaaatccgggtcgacgtccattgcccacgaaaatttcgcaatgagtgatttgttgaaaatctgtcaaggcgaacagtactgtcagttaatgtaatcggttcaatcatttgatttgatcatatgccaaatgaaaattttactttgttcaggatgcaatgacgacagactattatcatttcaaatatccgggatttcaaatcaaatgtttttttgtatgcacagttatagtttagttgaacagaatcccacccccaatataaaatgaagtgtaatctcgataagaacaatgaggatgtgcctgtcaactttgcataggccaattcatatggaaagaaaaatagagttgtcctaaagcactgttaccttctcgatgggtacttcatggcgtttgcaccatgcaacagtaattctgggatcaaggtaattgatctttgaagttcctagtgccactgtctttaaatcctctttaatcttcttatccatctccatcttctctatcttggtttcaatctgagatatcttcttttcaaacctgcaagcaaatttggtgagatttctcaacattgtttttttgtatatatacaaaatagagatctatctgtgattgagattattacgcttcaggggccaaatttctttttggtttcccatctttgtcattgcctagattctttcctttccttactttgctcaagtctgccttcaattcatccctttgggcctggagaaaagaaaaaaaacaagagagtttaccagaaaaggacaaaagaatgaaatggtacaatgttgggctaatcatttgcagtagaaattcaaccttcaattcatcaatcttctcattcaatctagtcatctgggaatcatgtgattttgagacactacgctgatggttacagattatagcaacctgagtaaacaagaagtatggttgagatcaaaacaggtcaaatataagttttttctatttcttaaagagaaacacaatagacctctttgttggctcgttgataaaccgcaattttttcaagaagagttccatcttctgtttctttgtgcaactgtaaaatcagcaccaatagacatacgttcagaaaacaactattgtgaaataacacgttacacacttgagcttcaagtaaacagaacggaacaacatatatactactaaaatgtcttaaaccattacaaacttcaatcaatcacttcatacagcagtgaaagtttaagaaaaagatgtgaagatctatctgaacttacaatatcatccaaggtgattgaagcattatatgtacggaacacttttgcggtaagcccaggcatcaagtcctttagatgagcatttagcctggttgtatcgagtttgtcaaagagatcttgtcctggtttcttgcctagaataaagattaagaaaacagaagtgattccactagtgcaaggtgaggatcggagggaaagaaagagttgcagggcagagttaccagcacggaattcctcaattgccttgtatacaagcagttcaacctctacagtattgaagtatcttatagaatctttaccaaggaagtcgaactgtaaaggttatggaacatcagatatcatctaaatcaagttacacatgcagaatttattaataatgaagaccaatacctgcagtttatttggaggaacacaagtaacattatcaaccttcagtgtacagcaaccaacagtttcagcctcatcttcatcctgaaaagaatttgaagtagtggctaagtatacaaactatgtatgtcactgtaattcaaagctatttaataaactatatgtatgtcattgttgaagattgtattctaacaaaaatctatgcgcattatgttgaccattatgcaaaattatgatgagcagccacacagctaatcctagatacagtcttgaaccaaaacgctatgttgcatagtgtaaatatccattcagaagagatgtcagaacagaaggcacatattccttttttttttgttattggttggttggtgggggagattactgtgcaatctgcaccgatagcagaagaaatatatcccaattcataaatgtcagtcagagagctcaggttagaaagtaccttctcattgcctgccctaagggctaacttatctataaggtatgttgccactgcaatttgtttctttgtcttatctttgcttctgaaatcctttgtgtaagtgtcacgaattttgtgtacgtgatgctgcaatgaccaagcagaaaaaaattatttgtacatgcaaactcaacatctccatgacacaaacaatgaaccctctcaccttcaattttcgagacttctcatacttctctttgtcactttggccctttaatgcactgcttgctgccaagaaaacatacttgaaatctttttggcttattggatcattccaaaaggccaaccatgtaactgtgttgtcgtgtttgacttctttccaactgcagtacacatgaccaaataaagagtgagcacatactagcaaccccttcacaaatataaattacacatcaaaggtaatgggaaaatttccagcgtacctttctccaggtatgggacattcggggatcggagccccttttccgatatttattgtaatatcgcttggtttaatgcggcgcttcagttttcccatctaaaacgatgtaataaaaaagcatcaaaatgatgtcgcttacttaaaacagcacgacgagtatatgtatccatatatataccttcggatgctctccgcgccccctgaacaagccaggtggttctactctgaaattgccaacctgaaaggaacaaagtactttaacccagagtaattttatgcgaaatgaacctagtatgcacagcagatagaagatgacacagctgtcatgtatgttaaaaaaaaaataagaacatcgaggcaacattacatgtcatgaagcaaactaagtataacacatggtatgcattgttgacatctggtgcaaaattattcacaaaattgaacgctagggtaaaacaaaacaattgctagattataataaaaaaaacatttacctaacaataacagaagaatggggaacaagagaaatatctacaattactagccataactttctgtaactacatttttgcagcacaaagaaaaataccttctctttaacaccatctacaatagcccacatgtacttctcctcttgtttcaatttctcttccttcaatgctttcttctcctgcagaagaagaattttaaagattgttcacttccgtagacaactttttatagattaccagcacaaaaactaaattcattctgctgaataagtcaaaacaaaacatgcagtacctcagatgtcatctgcttcttcttctccttctctcttaggtgccattcatagatcggggtgaaatcacaaagctcaaatttcttgatgacatggtttttaccaagaatttttctccaatcagtgaagaagttgtcaatgaatgtttgcttggatgcataatcagtgtctttcatcacagcaaacatggtggcaacctgtaacagagataattagtagaggaacaattatctggtagcaagatatggattcaggagaacctgattaaaatgtcactcatggtacaaatcaaaagatgaaaagtaaagtaaaaatcagctaatgttatatatctcacctcttcttgttctggcgtcagatcaacaggttgcccgttgtaaagcatcttgacaccatgaggcttgtatggaggggggaaaataacaccactgtgcaccaaggtagtccatttctgtccaccaccagatccaggagggaccttcattgtctttgagaactgagaatttttcattgttttctttgttttcattttcattttcattttcttgttgtccttctttaaagatgaaggactcttctttacgatattctttgcaggtggcttgctttttgaagactcacccattttcagtctttgtgaaagaggtacattgtcattgtcatccgccttgggttctcttttgacacttgcagacgcagaaacatctgaaggcctcgccttcttgagagctgaacttgtttgattattattgtcaattggccttttaattgaatttcgtgatgtgctcgcgtcattgttagacatcttgctggaagaacttgcttttatacttgcagacaggaccttgtcctttgaacttgagatacttgcagatgcattgccagtaactttcgaaaatcgggcagccaatggcttctcatcctctgaatcatcagaaacattacctccccttttcagagcagcattagttggcaacctgctggccagtggtttatcgtcctctgaatcatcaccaggttgctcaattttaggtgtagttttcagtacaatagccttatttgcactactcgaaggcgtttttgttgagtttatcttgagactcaatggtttatcatcatctgaatcatttgctgtcccacttcctacagcaggtttcttcaaatttctatcctcgacctttctccttaatccgattggcttatggtcatcttctgagtcatccgacttatcttccacgaaaggtcttttcaatttactcttatccactgagttactattatggctactatgttctttggaactgttcggctgacctgatcccaaaggtcgagggtttggactgcttgactgcggcctctgttgcaaaggcctcgaaacaccagtcagcccattcttctgttgattggaagcaacagccttagggctcctaataggtccggcattccctgatgagccctcctgctttgtgggggtgggcctgttcttcacagaggtgctcgacctcttgaaggagatcggaccttcctcgtcgtcgttgtcaaacataacaggatcgacaacagccatcgatccctaggggcggcggctggcagacggaacaaatatgctgagtcaaccacacctgcaaacaaagtaaactcatgtaagcaacctgaagatagcattccaccgttccagcacaatgcacaagtgcactataatggatcaaccaaagcaatctatgcgcaaatctaatcaacagaattcctgcttcaaagtaaaccatctccagaacagagttcccatcgcatcccaacccacgcaatcacccctttgagtcatccacaccgatgcacccgccacaaacacagccaattccagctcaggacgaggtttcctccctttgtgacatcaataccgcaatcaacactacggacgagaccaaccaaccaaaccaccgctcccccctcagatcggccgcccggacaagacgaaaccgcccgttcatccccctccccaccccgatccaccgcaccatccccccatcgcccccaccgccgcaagccctagggaggagacccccgccccgatcacgagcccttcccaacccaacgcgaggcaaacaaggaagcaaggagcgggatagagagagagaggaggggagatacccacctaggcgccgcggcggcgacgtcccgctccccggggagcggtgcggcggcggcggcggcggcggcggcgaggcggggagctagggttagggctgagcttatctgtgtctctctctcctcgcctctcctcccgctctcgtatttctatcgctcgctctcacctcgcctcgcccgcgccgctgcctccgactcctctccctccctctctcgccttgcgttttttttctctttcctttccttttttttcccctttctgccttgtatttttttccctctccttacagagagagacgggttgcgtcgcggacaggagaggcgtgtgggccccactggcagagacccgcgtgggtcccgcgcgcagtgaggtaaacgggtcgtggcgggccccagctggcagcgctcggaacgctacgtgtgggccccacgcgcagtgagagaggagcataggtcgcgtggggcccacgtggcagagggggtgcgtcgtgggccgggcgtgaggggcacgggccgtgtggggcccacgtggaagtgcgtggcttgggcttgcggcgacggaacggaacggaaggggaagccgacgtcatacgcggcacggggggatgggcccgcatgt

SEQ ID NO: 68258 - DNA, 553 bp, Oryza sativa
gcaactaagtgacttttaaatgctgtttactgcaaaacttaaccccgatattattatccccttgtaccccccttgcattaatcatgcatctgccggtgtggcttgctgagtactgtggttgtactcactcttgctcaatcttttccccccttcagtaagagaagctttggagaagaagtcttaggtggagtcctggcttataccccagttgagcgcctgtgaagatggagccgtaggcccgctagtccgctgctgtttatttttgattgtcaggccttaagtgcctttgtaataatgtaaatataatcgatataataaagatgtgccttttgtatcatgtttgtttggtgtaccccggcatttcctgggacggggattaatacactagcgttcgggaaaaggcaattttctcggtcgcgacacctcgttattatgccgaagaacatgggtgagctcaagtccgtcgaatttgtcttccaacttgcgtacctcctgccggtaagcggtcatattatcatcaaggcaggaccattctttcatgacttgattaaca

SEQ ID NO: 68259 - DNA, 26668 bp, Oryza sativa
  unsure (1)..(26668): unsure at all n locations
atctaaaagaagtcattagatgcaggtctaattcggcaacataaggattttcagactaaacatgaaaaggtttatatataaatagttgagtccgtttatacaacatagggttcaaaaaggtattcgaacattcaaaataggcaacgaatttaacttgggccgaatttaggcctccttcagtcctttggagtggatgaaattataggaaattactccctccgtctctaaatatttgacatcgttgattttttagcacatgtttgaccgttcgtcttattcaaaaacttttgtgaaatatataaaactatatgtatacatataagtacatttaacaatggatcaagtgatagaaaaaaattaataattacttaaatttttttaataacacgaacagtcaaacatatttttaaaaattcaacggcgtcaaatattagaaacggtgggagtaattaataattctaatttatgtgcaaatcctcgactcagtttaattactgattattgtgtgcctaaattattggcatatcaaccacgatcaaactttacattttaaacttaattttcatagttgattttagggatttttttcccattatactgtattttgaaacttaattattattttttagaaaaggctatatgtactaactttttcttactaaattcttactaacactgatgtgtcatgctatgagtgcatctagattttttgtaacttccatctacttaaattaaacggttgagatgattgttagtaaaagtttagtaagaaaaatttagtacatgtagcattgctcttatttttttgctttatttttagatcaaccgaccggccgtacttttcatgattgatcctatttattttttggtttttatctgtgttaaccgttactagcccaccgacaaagtgcacaaatacagttgtagtggtttagtccagttaatcttgcagtcaataatttaatcaagcagccttacatgtctgcccatcttgcagccttccacatgtacttacttcctatagaggttattttcttctttacagaaaccaaggcagattaccacgcaggtcatgcttgcttactgcatgaaaaaatagcatgaagacgactcgaatatattatttccaagtggagaaagaattctgcagaatccttcttgtgaactcaaggttgtttgaaatttcaagtagatggacacacatcaaaataatgataggaaaacagtatactgttagtatgtatttacactctcctagctttacaagagtagtggttacccttgccttccaaagaggcaagaaaacaaagggaaaatccataggaaaatgatcaaatgctgttacatgtcaagcttgattctcacccaccagaatggcagggtgaaaaaagatgaaaaatttgcaaacagaagagaaatgagccccctgatctgatcaaatgatcagtcactccagcagagaagcatgacgacgcagcgtcggatgatgtagagcctggccttctgctccctcaggacattctgcagcttccccctcttcttcttcaccttctccatggctgccaatgcagtggaacactgaaaaatgcaatgcgaatcaaggttcagagcgctctctctctctctctctctctctctctctctctctctctcgcttgccttcaggcgaatgccgatatgcgggtagagaatgagactgcagtgatgcaatctttgcttatatagaggagccaaaggatatctctagagcttgcaccataaccacccaccacctcacatgcaatttcagtacttattttctttttttgccttggaggagacacttccaagtctaaatgcatgcccctgatattctattgcttatgataatggttaaggagggtgagcacttacttaacaatgtgatcatagatggacccttgatgggtgctgaggcacagtacccaggggctgctccatgattgaggaccatgcgccgcgccgcggacaggatcaagtggccatacatgcctgcaagcaagaaaggcaaccatggttccattgtttagtgcccccaagggaggctgttcatggtcctcaaacagtcaagcctaccataatctctgcaattttggtatctcaatgcagaagcttagcccttaaaactactaaaagggcactggagacactgtagcaagtctgaaaatatgaaaaaaacccagtgaagggactggataagagatttcttttctccttacctgcagattgctcatgtgcattgctcatactgactacaacaactctaatcagatccatgcttgcaagttctttcagaatatactagagttttcctcgcactagaaagggacacagcacagcacagacatacctgggttggaaagaaatgagaggttgtcaagcaaaatcaattcagagattcatcagtcaacatttacaagaagagaaattcttgttgatagacctatcaatctagtaccagcaaaaggtaaataatacttattcatggatatgaaagatcctaatgtgttcattttttctttttgcaaggataaatactactgttagtgtccgtgctcgccatcggtatggtctattcttgacttaagtatacttccaagattcattccatgaaaaacaaaccaggttctttccatgacaaacaaacaatgtttggattgacattagctggcactgatgaacagatcaaggtggggggctaaactccaatcatgagataattccaaatggacaacccttgaactgactgaagtgacacaacccaggcccctacactagccctgcaactacttggataggcaatcacaaaagacagcaaactaacaacttgaacagtcaattaactacaagccagggcactaggcaacgaatcaaagcactaaactaccagatgaccaatggtaatcgtgatccagaacacaatttgtagatctttaacattcagatgccatgcttcatttcaaaccatccttataggtcataaccagggttcaactatcagaggtggtataaaatttcaggggtcactgaaattccaggggcccaaaataccttaagtctttgttgtcagtatacatgtaaacgaaacaaacatctcagagaataaattttgataattttcaagcagaagttggaaaatttgaatgcctaaaactttttgacctttatgaagttctatacggagggactgaaaagtcaaagtcataggaatttttcaaattccattctgaaatttcaaaccttggtccgaactgctacaggtaaataatgtaaattacatttttgtacacggcacacctataaggtagctagtgtgctccttttcctcagacaacatgggtactctgcatgtgctcaataactcttaactatttgtgttaaatttctacctagtaatgaggaagcagttaacagaggcaactaaaaatgatagtgaggttatgatcaactcattggtcgagaccaaaatgttggttaacatgagacagcgcctgtgtgctacacgaccagcattgagacatctaatgtcacatgcttgactagcattcatacagaagattcaatgcttggtcagacaatgttgcatgtgctaattattatcaatcatatatattcataacacattaaatcaaggtcaaaactaaaatccagcagccttaatccaacttggcctcaaaaaagaaaaacgccaacttaatccaactatatgaaagatacttcagaaagtttaaacttagcaacagaaaggtaattactaatcaactcatgatagaaaataacaaagagacacacaaatgaaaacatgggagctctctacaagtacaagtggcaagcagcagacaggccctatataacaaagtgcccagtgttttgactgggaattagggagacatggaaattcagtaaagaacagagcatcaaacggctacattgtccacaagacaagaacactccaaccaaagcgtgcgcgcacacacaaaagctatttcctggtcatctagaataagtacactacaaagtacttttcagtcaaaaaagatatgctgattgcacggatgatcagtgcactcgtcccatctttcctagcagcttccgaacgtatcaagaggacatgaggagatctctaagatgcttgaacactggtttttaagaacttttgcaactctttaaccacacaatctaccgacaagaggatatactacagtactaaaacacattgttaattctgacaagtccaagaagatctgggggatgcaacaaaaccataattaattcctccaacgaaatcagatgggcaaattacagtgcagtgagatataccaagtatctccatggagaagaaaagcaagataagggaatagtttacgataccagcggcgcatgagcagcactgccagtgccagataccaagaaccttcatcggagccatgctgaaccactgaatctgcagatttctacacgtatgcaggtggcagcaggatgagctgtccgttatctgaaatgatcatatccatcaataaaatcaagctttttgtcggcgacaagaacaataagctacattcaggttcagagatttgtctccctagattaaagaaagcaaaggaaaactaaagtattagcacgattgcatgggagcagaggtgcgacatgctttgcctcctctctataaatcattagcctccttccaagttctgtaccacagcagcaagctccaaacgtaatcatcagagagcagagacacctacattcatcaccattgtagcttctgtttcatcaagcaaaactgaagccatgaagactgtgaaccaaggcaagcagagaggaaggatgaccagagctctgaaagagcatagagccaggctctacatcatccgccggtgcatcgtcatgctcctttgctggcatgaatgaactccagtactgcatgttcttccattggatcccatcaaggatccatggagagtctacacacatagctagggaactatatcagttagaagtagaaaccaggaaggaactccatgtgctcatgctaggttgaggttgcattgaagcaagcttggcaagtctagagttcctatcatttgtttcttgagtttttttttcttcttttttttcccttttatccagttcttttgtcctgctgctatccctttggcagtgggatatggtaggtctagctttttgtacatgctatgtattgtagcaagcagtctacctaggaatgattcagcagaagaacagcaaagttgatcgaattctatcgagtgaaactgaacttttttttacatttctacatcaagtgagtctatatctgtcttttcttgacatgatgactaagcaaataacttgattaatggaatctttactgactataatgtcttaagcagaaagaatgaagcctactgaagcctatcatctgttcttaattacccacatgcaacactgcatccaggcagcagggctctagcctctagctaagacctaagttagccaccagatcatatgatattatcacccacagataggacaaaatcactaaataaccagctgcagtgcagtcacagatacagagagaaacagtgctcaccaggaatgcaggggccttgtcttctgggaagatctgagctcctcctgcatttcttaagttatcagaacaaaagaaaacaaacacaggatgcagaaccacagcaaatgcagatgtgaccaaacaaatgcagacaaaagtggagcaagctgacaaacgcacgaacacacgcacgcacgcgcgcacgcactgaggcacgtgcaggacatcttctgagcaatggccaggagggagtccatttagtctgcttttgcacccaggtcaaaagtgaattctggctactaggaatgagagcaccggtgcccacaatcctttgatggactgagaaaaagcattgctgatagtagcaaagatattccagtggcattgttcagtcaagattcagaaattcatattaactctgagtaaacttccactcagaaaaaaaaaactcgaatacacaggaggactgcgtaccattgcattaagaaggagcttccactcagcacaaagtaatagtgttctctttgtagattgctggattccatacctctgctacattggtcacacaaaacaaattgactgtatttctctaagacaagagaatcaggtgcctgagactaacatatgaagcaaagaattaggtaagagctttgtgcctccttactgtatgcacaatatattactttctcttgtgtatggtatacagatatttgtaatatgcatcaagttcaatggtgcataagacttcacacatatagatagagcattaatagtatgacaaaaagaaaaaactaattccatttttttccatcgaaggtgcaaagtacaaagcatctgatacaaatcactgcaaacatttaaaaagtgcagtttcgaaaaaagaagtaaagtgccatcactcaatttcaagtcttgcaacttgcaagtttccacagtggcgatcatcatcaacagcaaacggaaccatcaagttgtagggcaattaagaagtgattttccatatcaatttttctcaagttgtacaagagggggggacatctcaagactgtagagttggatctctcacaagctagagaaaaaggacatctcccaaaatgaaaccttcagactacagagcggtacattgccaaactatacagagcaactacacctcagttctagctaaatcctaccaaaatggcagagccaaaaaaaattccatccagaatggaatggaaaacaaggtccgcaatggacatcgatcaatcgctccagcggagcaacatgatgacgcagcggcggaagatgtagaacctagctctcttctccctgaaagctctgttgagcctccccatctgcccccttcggccttcaatcttcatagtctgatgagaatgctgggtgcagggcaaaggatggaagagatggagatagacaagttgtagaatgtaatggctagtgtgtggtatgagagggaagctggagtgaggggcctttatatagtggcacaggaggggatatgccatatcaaaagaacatcatacccccacatgcaggcagtttgtttatgcactaggaggcacacttctgaccctaaacttatcataatcactattctatatttctatctgtatagagcttaggagctagcaaaaacttaaaatatgcatggccactaacaagagaattactgtggtaaaaccagacaagataaagtggtcaggcaggtgcagattgtttactaaccccaagaatgggactccaaaatgtcctagctccttagcaggaagcttccaggaaggtcaccttgatgcatagaataaaactgatataagtgtatcaccaacagatgttaagacctggttaactctcattgcaaaatgttgcaccatcagccaagctggggtgaaaacttcagatttctatgagacttgtctgatttcactttccatgaactggcatggggctataagtaattaagattatccctgacaaacactaagaacgaagtattgcagctatgacttagaaattattatctacaagatcataaaaataaatcttggacttctaggagacctgtatgctaaaattcccaactccttttacattccatgcactgagatggaggtaactccaacgttatactttcatcagtaatgaatctcaggtaatggtgattcagtcggcaacttaggaacagaatagtgctataacctataaggaacttttgatggcagattgaacatatataccctggaatctggataatttttcagtaggagagcccttgaaaggtgttctctatctactcaggacaatatccttaaaaacaggccgttcagttgcatgcaacttaacaactgcataaatttgaaaagagcatataacttgatagcttctgtcttttgttcttactatgtaaatttttttcccatggaagcattagaatacagatttgaactatcaatgtccccagactctcagactgttctttgcagtacaaaacttgccttctggtaaggtgacaagttcccaaatgttaatatcactaattgcctttatttcttcttttcctgacagaatgttttaacctatgtgtttcataaattccagtgcctaaaatgtatttgcttagattttcataaacttggagtatatagtgattccagctgaaaatggcttgccttagctcatttaccatcggaaatatcttgtatagctcgtgtggttacacaagcatcatcagtgaagtcactacaagacattgttaagtccaaaagagtgcaagaggaaaccataaaaatttcaggattgaacaataatcatgcactggggaatcaaatcagaagaaaatctccatatgcactgaatctgtctctactactgaagtcatacgctaggaaaaaatgctgaggatgacaaggtagattgaacgggcaccagaaagaaacttcctattttgaagggtaatgcagcatgatctcagtctttagtttcaatcagtgaaagggagtggaaccttttgttatcagcaaaattaattcaagtctttgatgttcttttctcttttattgcggagattttttgcatactaatttattaagtttgaatccatgtttctagctgaagtaacataggcccccatgctcgttttctactagaagctaaaaggtgtgccttctactggacaataatgtgatcgagccttcttttagcaaacataacaaagaaagataaagtcctgacattattcaccaccttctagatattcaatattttcaggtatagctatatttggaagtacaccttagttcagaaaattgtaacctttcttaagggaaaaattaaagtcatgcatagactagaaaacgattagcacaagatgcatcattcataaactcaacagaataaaatctattctggactacagtccgaacatatcaagtcctatcaatcggagcaatgcacaaatatagtgaaactttctaatgcaaacatacagcatcttaggggaaaatcttatagctaatgaaagttttagccgtccatataataatgcagtaaatgtttttttcggacaatccacaccagacagcgcgaagattcattgaatagagcaggaaaaaaattacaaggctagaaccctgggaggccatagccaggaaagaagaaaaatatccaccagcgacgcaccgacagcacctacacacaggccaggagaaggcgcacctgaccggctgccgctaggccaacaaaggaactacaaccaagatcgcccaaaacccaaccctaacatccgaacaccgaacaccactctagccacctctttgggattgaggagagagggtgagaaagatggaaccactctcccctctaggccctccaacgtggccagcttgtgtaagctaggacgccaacacaagaggacatgacatctagagtaactgaattagtgattattttggggttgttcagattgatgccatttcaaaccataccattttttgataaagttgccaaatatgtgcatccatttagttttttaccaaactctagtaaatacataagaaatgctgccaaaacttgccaatgttgccaaaatttggtaaggtttattttggctataatctaacaagccctttgtaagttgttgctgtacggatggtgaacgacaaacaatattatttagagataattccttccagtaagaaaaataaataggaaaaatagacgagacaataatttgcacaaatcaagaacataacacacactgttccctgatactattccttaagaatatagtgcccttgttattagtaggaagcccgacaaaatgttaagtggaggtttcaaatgattccctctcaaaatgataattgtacgtttgtagagcacatacctgccattggagctagaggaacagcccatcgacaaaagcaggcaagttgcattactatcaccttagaaagaccattgagtccattcaatcctagttgtgtataatatccctgtactcttgactagcagtactgtcttggtaaaaccaacttttcaatatcttcaatgctacaacagaacatcattgccaggatgcatgcatgagaatcagaaatgagtgagaaccaagacagtccatgtttactatgaaaaagttccgagtatcaatactcaacatccaaagttgttctgaatatgatacattaatcggagaacgatgagacaaagatggtaacttgtgtatcttggagaacctctaaaagagctacagcatggaccatgctacatacaatttgcatagcaaaaacatgttatgttataacatcagatccatttggcaatagaaaatgtggaagcctagatgcaccgagataatttgaaagttgtacctttagaactaagaataatactcgaagggatcagtacatttttaagacaggagaccatatccttcagttttcgaggagttaaattaccgtaaactcacttacatagccttcatgtgaagtacttgcaagctgcactactccaaggataaaagaaaaaaaattaagcgaaacaataaagtcctcttattcctacacagtacacaagaagaagcaccaaatccttaaagctgctcaaaactgtcgaaatatgcataagatcctaccaacccttcatacagattgtaaaggtgagtaaacctccccagagagatctcaaaagtagctcagagaggaaaataaagcagaacaaacatataatttagctatccaagaacagccttgtctggtataaatgaactcttgtggagcaactctgtaggaatcatcaaacaattctgcacactgcaacttgcatgttattataaggcttttttttatggcaggaaagggtttaaacaagtccacctataatccaatccaaattgcctgaactaaaagcagcttttttgtgatatcatgaatgctcacatggtctgatgcacggtatatgcttatggttaacttcagcgaagtataagtttcagagtccatggcaaattctcaactctcagcatgagagagaataagacatataaagaatgtgagctttgtctcctaagttgcattcaacttattcaacttggttataatgcatatctgcatgtgaatgagttcacggagtgtcctataaaaggctcctacctcttcacatgataaccagatctacataaactcaagcagcaaactcttacattgcttcgccttctacttctccaatcaaaataagtcagtaagtcactatcagccttgtgcacatgaaagcagagaggaagaacataagaagtggaagattcattagaactcggaaagagtgtcaaactcggctgtacatcatccgatggtgtctggtcaggctcctctgttggcatgattgacttcaaatcttcaacgcatttgtcatcaacatttcttcaacccacggtctttttccttagcctatataaaatatttcagggaagtcattatgtcaaggagtcaatcgaggtgttacaacttattgaagcaagagctgattgagagatctagctgcaattacataactgggatttttgttggaattatgaaagcaacttcttctccagtttgttagttgagaaaattttgtaattcttatccttttcttgcctggttaacatgacattttgcttttgtattagatcacattggatgtacattctttctgctaattaaaacttagtttcttattaaatcacatcagttgtaaattgtttacaagggaataatgtttcttgtagcaaataatgaaaaggcgggctaaaggttctgaattatccggctgttgtatataattaaagcaattgctttccacttgatcagttaatgaggaaacatcaaacctgcttcagaatgcgtattataagaactattattcactttcatctcctttcatcatcatgcatcagctccacagatcaatgagaatatcagaaagtgacaataacagatcttctattgccattttcagagaaatgctattgtaactgaaatttttttaaaaaatcacttttactaacctttgtttacacaaacatacaacaacagtaacacataataacttctgcagtataagctacatgaagtatatcatataaggtaagcaagtgtgcatattatattacctgacataatgaagccttcaatatcttcatagatggacagggttatgcaacataaaagcataaagcaacaagtttcttatggcacctctagccttgtccaattaagagagagttgctacctatccatcaaggaattcagcatcataacagatctcaaataaacattataatctaaaaggactcatacatgcccataacgggaagaaaatcttttactgaaacagagctttaatagaatccaccttctattgttaaggaactgaaccggtttcattttacttgtactcagatatagattcatgttttcaaatatatgtcaaattactaaattgacattcaccagatgtgttgacttttgcaccctctgtaccgaacagagcttgcataacagaatgcacattctatttaagaatcgaactgcttgcattttacttatactcagatatacatattacttctattcaaatatatgccaaactactatattggcatgaaacagtaatacttaatgaatagacttgtgcactgcttttaccaaacagagcttgaataacagaatgcaccttctattaaggaactgaactacttgcattttacttatactcagatatagatcttgtttgtattcaaatacatgtaaattacttcattggcatggaatagtaatatttaatgaattgacttttgcactgttttgccagacagtcagaatgcaccttctattgttgaggaactgaaccacttgcattttacttctaatcagacatagatcttacttgtagtcacatatatgtaaaattaattcattgacatgaaacgctaatatttaattaattgacttttccattcaacaattggcccttttgacttcatgttctttgcagaccagtgcttcattttacttatacttaagtatacatattacttctattcaaatatatgccaaactactatattggcatgaaacagtaatacttaatgagtagacttgtgcactgcttttaccaaacagagcttgaataacggaatgcaccttctattaaggaactgaactacttgcattttacttatacttagatatagatcttgtttgtattcaaatacatgtcaattacttcattggcatgaaacagtaatatttaatgaattgacttttgcaccgttttgccagacagagtcagaatgcaccttctatcattgaggaactaaaccacttgcattttacttctactcagacatagatcttacttgtattcacatatatgtaaaattacttcattgacatgaaacgctaacgtttaattgattgacttttccattcaacaattggcccttttgacttcatgttctttgcagaccagtgcttctttatgataagatctaaggaccaccaacaaagagtcaaacattacaatttacttgaatgctgcagtcaaggagacaaagggtgtaacaaaccaggtattttggctttgcttagtggttaggtagcaatctattgagcatccaatgatgcctgatattcactttaaaaaatgtctcatctaggaacatgcagtcaacaattacttcaaaagtcaaacttgagaactgttttctggtatgaatgaaactgctgaagaatactgagtgtagcttgaaagataacaccgagtaccataggacctgcaagactgcaacactctcctaaaataagttctttttttttgctggggatcctcaaaaattgtttgacatcagcgctctccacaaatactgaagaactgatatgttaaaactaggacagaagaaacattatgtatatcatatcaagagccaacaaccacatttgattccactgaacaaacaaaaaaatacgatgattaattgcaaatcacggcatgcgcttgtcagatctttcaaggtgtataacatctagtgatttgcagtcttcatcataatccataagctatgcaatttaaaatgtgtaactcacaaaatataggagacattcctaattgagtcctagggagaaggaatttggtaggatgagatcaaacagaggggaggaagaaccagtataacgagatgaagaggaatttggtgctgaaatgtgttttctcattgaacaaatgaagccttatacttccaacagttagccagtcctacatattacagaactcaatactactcacactttgttaggaaccttgtagtcctctagtgtattacaatatggtcccaaaaaaaagtgaaatgatgtatattggccaggaaatcaacaatgtgctatatgtaccatgtaagtaaaggcacaaagaagggacagaaatttgccttattataaatctaatccttataattacacttaacaaatagagaaggaacagacaatgtcagattattctattaggttacttcaagtacggaaccaaatatgttgcaatcattttatcattggtcaatgcagcatctacccaagttaggtttattacaagatatgagtccttgaagagaaagtgactgttcattgaaccatggctgatgtattgaaaaaaattgtatgtggataagaaggataaaatagcacaagatatatggcaataataagctgatttagagtctttttggttcattttggtagggaaccaaacattcttcatctccaatttaccaaactttggtaatgccaaaacctgcccatgttttggcattacaaaatgtagaataagtagaatagatgcctctcacaaagtgtggaggtgaaatctcatatatatatagctgagttacagttagtgctacaaaagaccaagagttacacttaatgctagtgctgagtttacactaaattctataagttacataagcccaaaagtctagaagagaaacagtctaaggattaataaataatcctaatacaaaattatggtaaggtagaaaatcaaaccagcctttaagtacataagatctaacaaggtcagactatattagatggataagtatctatatttcattatgcttatcacatactccctccatcccaaaataagtgtagttttgcactgttcatgtccaacgtttgaccgtttgtcttatttgaaaaatttttatgactaatacttttgattgttattagatgataaaacatgaatagcactttatgcttgactacttttttaaatttttttcataaatttttcaaataaaacaacggtcaaacgttggacacggatacccacggctgcacttattttgggacggaggtagtacatcacaccaccaattaaaatcactgtgactaatatcccatcatataatgcacttatccacatgttattccgcaagcaagtgaagaacagcaattgtcacatgttattccgcaagcaagtgaagaacagcaattgtacaacttgatcataacttacaacagcaatgacctcaatggtccatatcatatctactgctatttctttcaagtgtccacagcttgtataatcatgaaaagaataatagaacaaactaacgccttacattaggagattatccagaccaggaatatcaaatggtagctttataatgccgagggcaatagacaggaggagcagccacagaggaaagatcttcatgcacagcagcaacagggacttttgtgctgaaaagaatagcattaagaaaaaattcagcctactttttgtacaatgactaaaaatggtgtaaaacaaagaacatcacttataagctgtaaacaaatctcatcgaaacgtatttcgtattttatttgtcagtagcacacaagaaattgtgcttcctagttgtatatgatggcctgtattgaagtggctagtatcatgcagacagtacagcagttagatagtaaaagttccactaataactgatacgcaaatagcaacgtagagtcttaatcaaaatggcaacacttacagccagcacatcttttataaggaaaaaaaaaagcgattacaccttccacataccatcgaatggtcacaatgtattgtctagtgactagtgaatagtgataattattgtacccaggcactcagaatatgtaacatcagattaatccaagttacagattaacataaacagtgcagcatattaggccctgtttgattcagcttaggattattataatctggattattaggagtaagctgaaacaaacaagtagattattatgctagattattataatctataagccagattactataatccaataatctcctctagaggagctttttccagattattgagtggctaaagacccactaccctcagatgcctctaataatccagagaaacaaataactcgtagattattttatgtcagcttattataatccagcttagagtaatctgatttaataatctagattacaacaatcttaagctgaaacaaacagggccttaattgtcaagtattgagtagattacccagcttcttttcacagattaagccttttgggtagaattgtttggcacgtatatgttaacaaataaataattcttgcaagctctactaccttggcaggcgcggtcctcggtggtgtcgacgacccactcggcggcctcccggaggcggcgctcggcgtggccctccggctgcccgatcggtgtggacgcgatgagctccatgaacgcggactgcctctccccgcggcgggaggacgccgaagggtcgtcatcgccgaggccgatggcgcgccgcacctccgcgacggacggctgggtgggtggggccgacttgaggggctgggtcggctgcgggccaggcgcgcgacggcggatgcggcggacgggctcccccgcggcggcaccggaggcggaggaggccaagacgacggcggcggcggcggcgaggcgcggggcgcggggcgcggcgacggcgaggtggcggcggcagcagcaggaggcggcggtggccatggcggacttcggggagtgtgtgtgtggagtggaaagtgtgtaaatggataaagtttagagaaagatctttcattttcttcttttttccctactgcgacacctgtcactatcacgtaatatctctccaccccacttcacaaatctcaaagcacatttgacacgtttggttcagtccgactaaagccattcacagtgcaagcagccaagcacccactgtgagttaccacgagatgacagctagaataaagaccctctcttcacagtgcaagcactgcgtgtgggactcagaaatatctgctagtgggacccacaaactcccaagtcccaactcctcaccggctcctcctccctcgtcatgcaatccccaaatccactcatccccgccggctctccccttctccctccgccggcgccggctcccctcctccctccgccggtgtcggcgccggctctcctctcctccggggggggggttccctcctccctccgccggcgccggctcttctctactccgggcgtcgccctcgaagaagcggcagcgttgtccttggggccgagctgcggcggcgccctcgaagacggcagtggcggcgtggatctagagcgcggaggacggtggaggcgcgggacggcggcggcggcatggatctgggctcttcctctctcggccggcgacgaggagacggagccgctcgtggtcgtcgtcctcctcgctttgtctccactttccgccgccgccgatgaggagaggaggacggcggcggcggcgcggatctggagcgtcctcgccgtcctcctcaccgacggcggcggcggcgccctcggcgacggtccttggcgacgtcgcatctcctcgccgtgtggggcccacgcccgactttttgagcgaggttgctcattcctctcctgggatgagaagaacccagtgtagctatgggccctaccaaacttttttcgccacatagactaggtaacgcgccatgtaggactagataacgcccactgtgaccggcctaagagcaggtacaatagcaggcagctataaacatattttaaagagataaaggaagaaagagaagagcagcgggctacagatttatagtcagctgcagtacggactccaagatgtaacatgtgtatgataggtgggaccaggtataatagtatagtaagcaattattgtatgaattggctattatattggctatagatgaattggagctagtagtaggctatactattaaactttctctaagggtgtgtttgcaagagcaagttccgaacactcccctctcgtttttccgctcgcacgctttttaaactgctaaacggtgcgttttttgcaaaaaagtttctatacagaagttgtttaaaaaaatcatattgatccatttttttaaaaaaaattgctaatatttaattaatcacgtactaatgaaccgctccgttttccgtgcatgggagatggtttcccaacacccacctccgaacacaccctctgagcaagtttaatggtatagcccactaatagctctaattcatttatagcctatttaatagccaattcataccatagttgcttactacttcctccgtttcacaatgtaagactttctagtattggctacatttgcctagattcattagcatctatatgaatatgggtagtgctagaaagtcttataatatgaaacggagagagtatactattaatatatggtcccacctgtcatacacacattacgtcttgtagtccatgctgcagctagctacaaatctgtagcccgctgctcttctctctcatcttttatctcactaaaatatatttgcagctggctaatagtctgctattgtacctgctctaagagcaaggttaaggtgttcacaacacgtcggctcagtcatttcccaaggaatgttcaataggaacacgtcatgttaggctcacccacctaaagttctcgctgctaaacttggtcacatgttcctcaatccaacctaggggtagcgccatgcgaaacgaggactgtaggcctgttgtggacgcttgtgacctcaccgtgttgcattatggactatgtatcctctgaaagtcctcggcctacttggcagcctaggcctagcaaatgcttggacacattgctattgcgctagtagcattgctggctgccagcggtagtatacgtctaagtcatgataatatagcagttagattatataacgagttgtggccatagcatatctctatagaagcttaagtgtatttaaatatttgtatggatgcattgatttaatttctttggtcaaatctacgctccatcctttcaaccacctatgttgaagaacaaaatgatgttagtgcacatgggatctaggaggagcgacccaagacccacaagctgcatcaattagtgctaacactggcggcaagacgatgatagtgtcctctttcacatgctactgcctgacgctcctgcaagcgcctcctccactctctctcctcatttctctctcgtccacataagagtacgttgatgtgtatttttaatcgttgttggtatttcttacgattatagataaatccgcaagcgcacggatattgttgtagcatttcactcatgagtattcccaaggatatcgtatttatatttccgcagggaaggcggcggtatgaaaacatacttatgcctccttaatcaatctatagtatcatccactagtaattataattattgtattttaaaacttatgcaagcatgcttcaaaatctatgctaggaagagaatatactatggttacaaagtgctaacttacgacaaaggcaaacttatatactatggttacaaagtgctaacttacgacaaaggcaaacttatctacaaatcatgacaatcagttttgcatgggtgagtatggaaagtatgataaatgtctcctttcgaaaaaaaaaagtatgataatgtcaaacttagcaggtaaaccagacaaattggaattcgcttgtactcatttttaaattggcaaatgggagctatgtggatgttgtctcatcctctatttatcctctattgttgtaacttgtaaacatggagatacaattatatgttcttaagtttgagacttatctgaacctaataaactcatgacttccctgtcatatgaagccttacagtatgaattgtataaaaagaaacccatctttcaaacacttttaaaaaagagagagagaaaatatacatacacaataatggaacatagggaatcaagagaacaagatagacatggattatttatttatttcccacgaatcttatgcacaactccatttgagtcccatcgtttcacctgcaaacaattataagctgcaatgtttattagaaaaaaaatgacggctattttatatatgtgttttagtgacataaaaactaatacttaaaaataaaaaacgatgaaaaaccatcaaaatcaactctaaagttatttttaaaaatttaaatcccggctgcggctgataaggtacactggtgaaagattaaaagaatgctaattttgatagaacatgcatacattaagaatctcgagaatccctccgtctgggcacctggccaaaccaaaataaatcgagcgctctgtgatccaccatgcatgtgcacacctttttctctcgcaagttagagcatgcatataagtactgcatgcaactctcatacccattcttttttcacgaggaatactaaccatttcattatcaaattttaaacattttttaaaccatttatcctatctacgatccatcattatattcgttgtaattaaacctttacaacaagataatacatggaaagattttgatgaaaaaaataaatgttccacatggttttattgaatgtttcttctagtattttatgatgtttcactagttcatttacaaatattgcatatggtattgttagaatgttttggtaagtatttttatgatgtttcagcagtcataacttaatatttcatatatgatattgttgatatttcttaacgacatttactagaaatataatttccagcaatggtgcagaaatacttctggtatattatggttatagtgttcatccgcaagcacatggatataccattgtaacatttcacccgagagtattccaagggtatcatatttgtttaatcccgtgggaagattataatagagagaaccgtactaataatttatatattacttgtaataaccatagtctaagagggattaatataattcatggggtagagtgacactaagcagaagcatttatactcttactcataattatctaagtagaaagaatatagaaagatctattcctatacttctagtatacatattatacatacatcctagttataatattacttagctaataccctctttccgatgctgtaacgccccgattttcgttcgggattaaaataaatcatttaataatgcattctctagaaattaaataaaagttaaaccaatttaatcaagtggaattatggaggaaattaaaatttcctttaaaaatctttggccgggaatattttgcaatattctttgtgccctaaaatactctccggatttttccgcaaattttcggagctcaataaataattttaaagtcacacagatcatttaaccaattaagtaaaaaggaaacaaatttaattctccttccttccccttcctccctttcgggctcggcccaaattcctccccctccttcctctcccgcggcccgcgcgcctcctccctctctcgggccggctcccttcccccttggcccgctcgcaaaagtctgttttgcgtccctccttctctcccttcgccgacaggtgggaccggcggacccacccgtcagctccttctcctacctctcgccggccaaccccaaccgccattgccgtccacgtcgccgcaaaatccggcaccctcccacacccgagctcgcatcccacgacgtgggcacgatccactccacgtcctccaccattttccccgctcgtcccacaaaaaccggcgccggccgagccgccaccaccccacgtcggcgccccacttccccggcggttggccgcccgactccgcctctcccgggctcgatccggccttccctcccctataaaaacattccccgcacctccctctcccttttcccctctctcccgagccctcccgtgcacgaaaaccaccccgccaccgtcgcaccttccgccgccgctcgccaacgaccctccagccggttgccacagccgctcccaccaccgtcgttccgcgcgaccgccaccagcggcttctccgcgtcgtgccgcaccccggcgtccgctccatttcccctccccgcctccgaagcaccgtcaccacgcgcaccaccttctgccaccgccgccgccgactccagccgccgcttggcgccgctcctagccaccccaagtcacgctgtcgccgccgctcgcttcgcagcgccgaggagcacctcggccgccgcttttcacggccgggatcccaccggaacatggttccccttgcgccggtgcgcatncgccggccgttctcacctncgaccagcgattcatgccgctgggagccctctccccctcctaacctctcccccatcctccccaggtccttccggccgccgtccgccggttcccgttcgcggaacgccgccgggccgccgttccgccttcgtcccgaggagcgccgacgccgagctcccccgcctttccccgccccttgtcgccgccctcggtgagcactcctcccctcttccctctttcttcccttggctggccgcctcccgtgcttgcgcgcgccgtgccgccgccgccggtggccgcccagcccgtgtgccgccgtcgctttggtccctgccgccgccgccgccagccttgtgtgcgcgctggccaggccgcgccgctcggccgtccccagtcgtccgatcggccctggccgatctgggccatccacgtggtggacgcgcacccgaggccacgtgtggaccatgtccaccgtgcgccctccccctttgactcgctgacgtgtggggcccacgtgtcggcgccggccgcccctttgctgacgtcagcgaagtccatttcctttgtaaaaataaataataattgcgcaataaatcgagtttaattttagaaattcatttaaatggctcaaaacttctaaaattcatatctaattcattcgaactccgaattgagccattcaacttgcaaaattcatctaaaattgagctctacatgtttgtttactttttatgtactgtttccttagtttttattagagtttttcctcgttttgcgtgccagcgtgtagttcccgtcgtttcggaagatcgcgttcgcaaggataagagttcagaagatccaagtgaagaagcaaggcaagtcacacattccccttgaacatgttgatcccaatttataaatggtttaccgtttacaaataaatatgcatgttttgctaattacatgggatccgggtattacctatctgcttgcttgtgccatgtttacttgatatctgttctttgtcaaccttgggtaataaatcgactagctcatattacttatgtgacctagctagaactatatgcttagccatgcttaattagcactagctcagttgatgggataattacagtattagacctttttagtatcagaatgagctgcgtgctcgagacatctggccatgcttcatggtcgtaattatccaactaaaatgcgactgaatgatgggctgtgggtgcatggttttgctagtcgcacccatggcaattaaggaccggttcgcgggatgccctggaagaacttatcgtacttaccacaagccagcgtgggcaacggctggacttgtagtgtagctttcctctagccgacgcatccaggcaagggtgggcgtgatggagcggggcgggccctgcgacggtttctgtcgcttccggattcacctaggcacgagaggggactgcccgttgcccgctggggacgggggtgaaacctgaggtgtggtgtgcttggctagagggggttatgcgaagggtcctgtcatggcctctttccggtatgtcgtggtggcatgtcggcacacggaaacgtgttgtggggctgtcttgtgggtatagttgtacacctctgatcagagtaaaactattcgaatagccatgcccgcggttatgggcggtcgaccagattcaccgtgattagtcccatcttaataaatcgacccaatacactgtagttcaggtgggttggttgggcctgttcaacgtggtgtagcgttgatcagtggagatttattgttactttaattactcaacagttttactgttttgcttaataaaatattttacaactgcctttatgcaaatagccacaaacccctccttgtatccccttgcacgtctgcatcgttggtgtggcttgctgagtacggtggttgtactcagtcttgctattattccccctttttcagaagtgtagtgcttctgagctgaagatggagttagaggaccaaggctcagaccccagttgagttttgcctgtggagtggagctgaagccccgctaggatcgcctttttccgctgctgtcgttctgtttaggtgtgaggactaagtgcctcttccgtaagtattttacgctttatttacgtttggaactgtatattacttgtcgttttgtgtaccctggctggtcctggacagggatttaatacgcaaaatagtctgggaatttgggttaaatttctgggcgtgacagatgccctcctgtacttcaagaagccacccctgattaccgagttccttacaacaatccatcatgaccatccaactggggctaaatacggaggagtaccctcctcagaaaattaacttaggattatatacacgcgcggaggaatacccgtactgagctgtcaccatcagcggcccgcttcgcttccgcaacatataaccccatataatgatatctagtaatctaaacaccacgcttaaattaccaaatactactataatatcatcgtcatgatagagtcatcgtaaatacccacactattgcatctcccagataagctagcatcataatgaatataacttgggtatgtaataaatctggtattcatatactcggaaagtaatacaataccaaagtaatataaagaagaatattctaaataaagtacaagtcttataaaagaaggaaaagctactagagccatacccaaattcttccgaagactccgaggactgaagattctattctatttctattccactatactctagaaactatattaaacttgatagatgaaatgaatttcttgcttgtggtgtgtcttgaaatggagagagtgagctccttgtatagcctcccaatgacggttgtgacggttggaatggtcggaaataccctccaaccgtcattgggagctaatccataccgtctagccgcaaccctgcatccaacggcgccaggatgggttcggccgaaccaggggccgacccattttcggctagcggcctcgtcttctgttgctcacttcagacttgtgaattttggcccaattggtcatgtcatttttgcattcttgacctattcattgataggtctgattctcgacattgtctgattgaatgatcacttgttttgatgtcgattcttctccacttagtgttcattctctgcaagaggttagtaatcctagtgccagtggaatatttattattttgacataaatatgcattgcaagcataactagttctcttttatttaagtagtgttgacggacgaaactgatcactaacgaccgtcaacaaatataaatgtgttttaacaatatccatataagtatatcgtttatttcgtacgagtctttatatgagttcactggttgggacttgatgtttcgtgcagaggttgatgatattgcagtcattatattttgaatgttgcatttatctggaacatttttttagcgaattgaaacaattttttataagtggtgaaacatcattaattttttttatatgtgagatcttgtttgtaaagatttgaattacaagaaatacaacggtgcaatcatattatagattggattaataatttaagagaaaaaacatttaaagtgtgttaagaaaagcaagatttgtatggagagatgagagatagggaattatggaatattgcatgtagctgatatgaggcaaggaagtagttgacatacatgctgcatgcaacaaatatgtagggtgcaacacacgcagagatgaggcaaggaaatactccctccgtggttgctatattctgagacggatgaagtagttgacatgcatgatgcatgcaacgaatatgtagagagcagcacacgcaggaggtgcaggaggggggcacccgatttttctcttgaaaatcgggcacccgattcttagttactccctccattccataatataagggat

SEQ ID NO: 68260 - DNA, 24715 bp, Oryza sativa
ggggggttggaaagcggtggggatgaaccggtaaaattacgtttgttggaacggaaagtttgtggatcatgtgtgtacttgaatcaatggagtgtgtggattagtgttcataattattgtgctttgtgctttattactactcctactttgaattagcctttttaggcaagggcatgtacaatagttatcaatagtggtctcttagcgttgctaattagaaatacttgttgacatggaagaaagagaaaggggagagacaaaacatcgttgttatgcatgacaacgactcttaatcactataatatggaagtatggttatataatatggaaatatggttgtatgagggtaaaaagatagaaagaatattaataaaaggaatattttttgagttaatgattagagcctttgtcgtctcaactattgtaaagatatggtctcttaataatcttgtattgtttaagagaccatactcatctctaccattgaacatgccctaatatgagctctctatattaattaatgtcactagagactaccatcctacaatagtagagacaatatgtaacgtcccgccttcccccaggccgggccgaccaacacatgtcttttctgcacactttgtcctcactcgtgtgcacccgggaagaatttcccggtcggtcacccatcccaaattgctctaggccaagcatgcttaaccctggagttctttggagattggattccggaaaagaagttgcaacttgttgatatgagtattctattaatcctattaagccctaggccgggatgttacacaataagatttgtaaatcattaatgcactaaatatttttttactatacttctttccttttatacaccatcatgcagcaaactttccgttaataaatgctaagagtcgactctaagcagttgtcatgcgtaggaacgatgtttctcctttcttccctctctttcttccacgtcaccaaatttacttacatgagcatgactaggggtgggcagaaaaagaccgaaccgaaaagatcgagaccgagaccgagaaattcagtaatcaattcggtcctaggtagtgaaagaccgaattttgttcggtcaattcggttagtctcctcgggtaaccgaatagaccgaaaaaaccgaattatcaaaaaatgtctaaatacaacctacaatccactatatttaataggattaaactctaattttcacatccctacttcttctaggcatgcaacctaataagagtctttactcataagtgcttacgaatttttttgtgatttttgtgttgaaaatttccattatttctttgcatatatgaaaatgttgttgaatttcggtcaggaccgagaccgaaaagaccaagaccgaatttgtcggtcctgatattttttcactgaaattcggtcttcacttttcaaagaccgaaaagaccgaaagaccaaagaccgagaccgaaattttcggttagaccgaatgcccacctctatgcatgacaacgaagagagcccgctattagacactatattgtacatgcccttagcactcaacctaacaatacatgtttacattcttcacattcctaaatttctaatgtttggtttacttgtcaggcaaactagctatttttagcagattgcttttatcatttagtattaagtgtattgcaattgaaagcgagacttggctctccttcgaaaacgaagttttacaaattgagacgaattggctcctgaaagttagattattttattccaaatatcagacatggcttaatcaaatgcatgtgcaactaaactaaatctagcatgccattacgtagacttagttagggcttcagtgccaaatacatgattggttacaaatttggcaagtatatgcgttcgagtaaaagaaacacaaccaaatttcaaaatatattttcatcggaaacttggatggtacttaaacatgaaattatgggatatttagattgctacaaaataacctttttcgaaatttggaataacaaaaattttagtaattggtaatattgtcaagttttggtagggtttcttttttggatgtgtttagcttggtacccacatataggctaccaaatttttgttacatttggaggctgccagattttattgtgatgttaccaaatttatgtgggtgttaccaatgttcgataataaaataaatacattcatatgtttttttattttttaaataatattgtctaaaatgacatcaatgtggacaagctctatgttaatttatatcgcccttaaccgttaattgaaaaatgcctagttttagagtatcacctaaaaaatccatccaaaaatatctttggaaccctaaataaaatttgaagtgtgaaaatattcatctttctaagagatgatttattattgaattcctacaactaaaatattgggaccatgtaaaactaatactaaagttctatagaaaagttgctttaacaaatcatatcaatctatttttaaacttttttaaaaaataattaattaatcatatgctaaacttacttcgttttaagtatctttttcccttctaggatgctatcaagctacctttcttcaaccccatatttgactatgttaaaaaacacaaaaaaaaatccaatgtatcaccgacgtgttgcccccatgccccacatgtcaccctctaattgtacaccattttacattgcattttttttatacgagtgagttcattatctcaaaaaaatatgagtgagttaaagttttcatatatatcatcatggtttgagtttgaccatatcccaaaaggaagaaaacaaaaagaagacgatccaattgccaactcctatgtacacgtcacaaaatcgtttaatatcgcttcccttggagctgagcctcgttggtatcgaaacatcgacgtaggagcctcgggatcaaattaacaaaaccttagtgctggacaagtgcaatgactaatatgcccttactagcacctagtatcattttctttttttttaaagaacaatatcatttttgataaaacatttgcatcaccggagtaagcgctcttggaccttacagtgaatttagaggtattatttcttcaatagtatttgctaacgaaatattaaattcttactcataaattttttttcaagggtttcattatatgtctcggcttaggcttagccaaccaaatgcataaactaggaaactcaatttcttttttttaaactcttggagagcttttgtttctcatcaaacatgttttcataacatggttgataatttcataagatcatttgatgggctagatggttgtgaaaatttggatttgacatatgaaggacttcctagaaaaaaaaccctcaaaattagttcaatttatgtaaaatttcaaactttttcccaaaaggaggcccaatgagaacttgtatagtcctatcagacatggatgctgcttaaaaatttagcagagttagtcttggttgggaacctttccctccaacacgaaaatggagcagctcattaacacataattaattaagtactccctccgtattttaatgtatgacgccgttgactttttgaccaacgtttgactattcgttttattcaaattttttgtgcaaatatgaaaatatttatgtcatgcttaaaaaacatttgatgatgaattaagtcacaacgaaataaatgataattacataaattttttgaataagacgaacggtcaaacgttagataaaaaattaacggtgtcatacattaaaatatggaggtagtattaactaaaaccaacttgaaaaatagattagtatgattttaaaatagttttcctatatatatatattttaaaatatataccatttagtagtttaaaaaacgtgcacgtgaaaaaagagtagaagagatgggaaaacaaagaacgaaaaaaaaaccttaacattttctaaaaacctgatgaaaaatctgcaattttctcaaaactcatccaagggcaaaatagtcaaatcatcactattataattctcattaatctttctcttccacagttccactcctccctcactctctcccacagttagcatctcgccattcctccgatccccacctccaccaatggcgctctccatctccacgccgccgacctcctcctccctcctgccggcctccctccaggtacgccctcccgctccgccgcctcctcctctctccgacgagctctcatttgcccggttcggccgctcctcgcgcccgtttcacccgttcttggtcaccgccgccgcttcttcctcttcaggtcggcaggtggagctcgtcggcggcgatgtcggccaggcctgtggcctttagcctccggaggccggttcttgcggcccgtgtagccgccggcggcaacgcaccgtcttcctccgtggacggtaaggatgctggccttgtgcttgtcagttgtctccttcatggcttcctgtgtgatttgagttactgattttggtcagcttggttgtagaggtggtcactgagctcgatgccgtggccagcttcagcgagatcgtgccggataccgtcgtgttcgatgacttcgagaagtaatactagtagttgcttctttgctgttatcccaccattgaatttagttggccgatccaacttaatggaatgatagttcataggctgctctgttgattgggttcaggtttgcgccgaccgccgccacggtgagctcgtcgctgctgctcggtatcgctggcctcccggatacaaagttcaaggtgaggtgctgttgaaatgtgaagccaatcaaagcactggaagtggaagagagacagttgactaattttcagacttttgtttcttatagagtgctatagatacagcgttggcagacggtgaatgtaacacaatggagaagcccgaggaccggatgtcctgtttcctaaccaaggtttgcatactgcatttcagtttcaatgtaagcagtctgtttgttggataagttgagcatggaggaatttggcaggccctggcaaatgttggagctgaaatggctcatctagtccctggtcgggtgtcgactgaaatagatgctcggttggcttatgatacccaaggaattatccagagggtatgagcttcttccttctgtttgttgtttcatgctgcttgcctgaaatatttatccttaggggaaaagaatcctccgtgaattgtgatctgcagttgcagtcccatgaaaataatttgatatgcgtatgttcaggtgcatgagcttttgaagctatacagtgatcatgatgtcttatctgaacgcctgctgttcaaaattccggctacatggcaagtaagtagaatgcaacacagtagttggcaagttgcctggttgtacctgctgccatttcccatctttgtaatcgatgtgttctccactagggtatagaggcctcgaggttgcttgaatctgaagggattcaaacacatttaacatttgtgtacaggtatgtacatatgctttgcctaatttgatcatggccctatttcttatagtgggcaatggtatagatgctgggtgtatggcaatacttatcttttttgtggggttagagaactgccttcaatttgtttagtcttaagatacttcagtaagtataagggaactaataaagattgtttcttattatcatgcatcacttattaatgatggctcaattgcattgtaagtatacattttgcttttatgtcagcagaagaagaggttttctattgaatttacctggtgaattgtaattactcaattaggcctgactagttactgttgataacaagcttatctataaaggacttgcactattgcaggtgcataaaagccataaacttactcttgcaatttacataagatggtattgttggagagagcagactgcaggatgtgtagctcacctagtagttagtaactgagaactcgtaatcatttttttttgtgtgcctgatcattcttcttcagttttgcccaagcagcagctgcagcacaagccggtgcatctgttgtacagatctttgtgggacgtgttcgggtaaattcatcagacccttaccttcatgggtttatgctaattcaaaaaaattatgctgaccacaaattatgcaggattgggcaaggactcactctggcgacccagagattgatgaagctttgaagaaaggagaagatgctgggcttgctttggttagcactaaattaccttttaatttatgattgttcctacagaattctatcaatatgaactaaagtagccacattttgataatcatgataactgactatttgagctcaactaaaatatatttagttgattagaggttgtgtacttaactatatcaggtaatatgaactatgcttgggttgattctaggacttggcatattttagactccatttggttctcatcatcaacaattttgagcaaaccatgtgttaatctggcatgttgcccatgttatagtgtaattgataaaactcatataactgaataatcagtgacaattatcaaggttttcattaataaagggactatgaatgaagaacattatacttatcaagcgttcacgtcttctcaattcgatactgaactaaatttccgtttactctctacatgttttacattccttactttttctgcagttgcataagtatttagttctccatataattctatattgtaatgcaggcgaagaaagtgtatgcctacattcacaaaaatgggtataaaacaaagttgatggctgctgccatacgcaacaagcaagatgtgtttagcctcctggggtatttttcttattacagatcaagattgatcgcaatggatgttagtttgtacagaactaatatttctgaaatgtaggattgactacatcattgcacctctgaagatattgcagtctttggaagaatctgtcactgatactgacgtgaagtatggttatgtcccaaggctgactcctgctcttggcaaaacgtacaacttcactgaagaggaggtttgctcacttatcctggattttgtgcagagtcttatatcatgcattctgtagctccaccaaactactcgctataagagactcctattaggggtgtgatgttttatctaaaatatataggatcttcacttgtcatgtgctttaacactactagagatgaaataaggaaggaaaataatatttggactgtttagatcacccttaaaaggtcatgtcaaagctcgtagtaggtgtaatcatgattcaccaaacagttactagaacaatacaaacaagtcattgacatcctataagaagaggaaaaataaaacaagagaagataagtgattatattttttatatggcaccttcatgctaactgttcatatttcaaatgataccacgaatgcagcttgtgaagtgggaccaattgagtctagcagctgcaatggggccagctgcggaagaactacttgcttctgggttggaaggatatgtgaaccaagcacgccgagtggaggaactcttcgggaagatctggcctcctccgaatgtttgaacacattctatgatgaggaccagaccatgccacagtcttctattccaaagaataataacaacagccacggacagtgctggccagcatttgctcgttcccttcaaagaatacttctcttagcctgtctgtgtttgtactttgtagttctctagctatctagcaaatctcacgatgacatgtcaagaacatctttgttttcttttcgcaaagattggatacggattttctcgagtatttcattagcccgtgagatgtgtaccatgaaatgtcacccaaatgctctgctggattgttctgaagtctgaactgaatcttcagagttgcagttacttatcactacgtttttttataaaaagatgggtgccatcagctagtactgtgaattcccattttcagtaaaatggaagaaatgctgatgaaaaaaatgctggtcaaacttgctctcacttttcagagtaatcctctgtttcttttctttcatggacctgacatccctatcattccaaatgccaattacctaatactactaggatgctggatatgggttctggttggatgctggttagctcaggaatcacactgctggcatgagcttactagtttttgttatacagttatcattaacatacgtatttattttatgccaaataggcagatattggaaacgtttcagtagttcgagcaagatcagttggacaggccggtggttcacgcccatccagtgatgatgaagttatcatttaatttaaaaaaatatcaaaataacataatactctctccatatataaaagaaaagagtctcggatgtatttcttttgtcaccgactatcccgtatgtgactaagaccaaagactttaagcatacatgcaactaatgagtattaagatagcaacttaattcccatcaacaatttaatataacactgtaaaacaacaatttaatatagcaccataaaacgaatagacagtctctttgatgcatggagattacaaatatgtttagaaaaataaaatatgcttaagattttgggataaagggagtaaagagtaaagtgcatttttgtcctattttccactgcaaactacaaaataagttattattttacccgcaggccgcaaccgaaacatagaccatgcttcctccaaatgtagttttaacataagtttttgtcccctaaaacccttacttttagagtgggtccgtattaatgaatgacatagtggtcttttaacctcttgctgaatactccatctgacctaaaataaatgcaataatgtaatttgaattacactgttgcacttattttgggacgaacagagtatgtctttgactatctaatactccctccatcgtataatataagggattattcccttatgtgcaagattaaggatatcaccaaaatactagaatacccttattaaatgaaatttgcttataggtgaatgggtagttgggagttaaaataggtagaaattaaaattagagttgatggatgtgacaccaaaatcccttatattaatggacaactagaagaggcttttaggcaccatcttttcgcttatacttatgcttatgcttatcagtcaaaatttgaattttcaaccttaaatttgaatctgattttgaagtttttcatcgaagtttatttttcaatctttgcttttaggtcgctaagaacacgtatataaaagttttattcacaaattacttctcgtttacaaatatgccgtttacaatggggcctaaagtctagagtactatagtcttacaagtacaaaggaagaatagttttgatcgatgtgacagtggtttccactagaatgaacttcaattaaaagttggcatctgcatggagtgaactgaagaaaaaccagttcaaacgaaactgtaaaaaacatgtcccaaggtgcttctggtccggttttgtatttttcacccaaaccgtctatagttcagggtgaaaaatagatcgagtaaagatcaataattaaaaatgaactttacacccataaaaactaatgaggtgtcccttgtttgctctatggcttgataaggtatggaaaagagaaaacaagagtagaacttagtgatttgaaagccgatgccaaaaaaaaaaaaacccctcaaaatcaactctaaaattaagtttgaaaattcaaattttggctatggttgataaactaaaaacaaccaaatggtgaagtactaatgtttttaaaaactattttattgtgtttataattttgtaatatttcatatattaacaaatctacaaaactccatgagtataattgattattattttaaaataaaatggcgtgttaggttttcactttacatggttttacatgttgcgtaagttacttgcgagaaagtgtttgaggttagataaatatctattattaaaaggaaaaaccttttaggttatcttttaaaagacgatgaagtgccgtatatgatgaaaacactcctgtcattagtatttctagcaataaaataaaaaccgtacaacaatataactctagcttcaccaataaccataaatcttcatcgaatgcccttgcattgagggtaacatatcatatgaccagttcacttgagagaaataaatacttaggtgcaatgtattgagaatttagctagttcgtaccaatatacaaacacatggcggcttctatatccgtgattgttaacactattatattgttatatagcactgccatacaacaatatatgagcaagttcatatcgcccttagatcattgtgattggctggattacatggacccgtacaaaagtgcattggttcgcccctagtgttatacagttacaactacaccatcgtagcacgtgtaaaacatcacacgatataaaagttcacgtggaaaaaaacaggagacgccagtttaaaaacaactaatatttcactgctgcaacagttactaaaaacccatcaataatgaaaccaaaccttaggtggactagagtgattaacttaatttggaagtaaataaaggctcctccaaaacttccttttttttcttttacattcctccatgtaaaaatggtttctctttcctctacacccttttgctcttccattcttttgcccttcactcctctctcatcttttcaccctttttccacattttttttcacttcaaaaccccacacaactgacacaagagagagagaaccaaaccaaaaacccctcctttttcttccttctcctgcagcgagagagaggatggcggcggcggcggcggttgcggcggtggtggtcgcggccgtggtggcggcggcggcgtccgcggcggcccccgcgtcggccggcgagcccacgcgcgacgtgcggtgggaggtcggctacatgacggtggcgccgctcggcgtctcgcagaaggtttggtggcgcgccatggcgtgcgctctgttcttgatttcttccgagaaatttgggccgccttgtctgatattttcttcttctttttttttgttttctctccgacatgttcttcttcttctctgtctccgttgattctgcgcgagtttctcgggtggtttcaaatcgaaaaacgtctctctctctctctctctctctctctctctcttgcgtggttttgaggtttgtttgatgatgaatctggggctaaaaaatgcttcctaatttttttttcgccggtttgcgtgggcggtttcgatcgcaccgatctcgtctcgtcgtggcggtttctgttccatgttcttgcaggggttgtaaatacgcgttgatcgatctgtcctaataaaagacgacgtaacctcatttcctccgaaaaaaataaatcggatcccgcaaactttgcaattttatcgttgataaaaggaaaaaagatcaacattgcgtacaaaagagaggggaataatgatatcatcttttctgggttggatttctgactctgtttctcgttgattttgatccttttgagtttttgttcatctgcgaaacaggtttgttgttgaaaattgatccatttcgagataaaacagaacacatttacacacaccagatttgagatttacagatagaaaatctggaaaaggatttgcggacacaattcttgtgcaagaatttaggggtgtcatgctcttgtttagttacagtcttatatttttttcttaccatatcaatatgaaacattgcgctatcttatgcgtattgttttaaaaaaatctagtgtaagaattgttttctgatggcatgaatgcaaatacttgtttttttttttttgcaggtgatcgcgataaacaaccagttcccgggcccactcctgaacgtgacaaccaactggaacgtgagggtgaacgtccaaaacaacctggatgagcccctcctcctcacctggtatttactaatcctgcatttcaattgcatagatccaaaattgactaagctggactagaaattttcgttaagatatttttatataaaaaaatcatgtattaatgaaaatttgcaccataattttcagtttctgtttctggtgaatttaaacagcacattcatagtgggattttagctgtacatttccattctgtgggggcctcttgggcttcacattaggcatgcatgctgcatttcggggaatttatgggcttaattagttgtgtcatgtagccaaatattcttatgctatattgagaatttgagataggataggcacaccactgtacttatccactggtttgcccattttctcaagttcatccgtgcaaaatgatcagtttcatcaacagttcattatgttgacaacttaatacattattatgtcaataatgcatttctaataagaataaatttcacttcaatacatgtgttcttcttgaattactgtactactagatcgattactagctaataaaatttgctgtacacaatctgtgttgcactttgcaactgaaaacaaggttagaaatgtgaagccatacataatagtaacatgcaaaatgccaaacactagagggtccttctgcaaaatttccttttaaaagtgagcctaaggctttgcctgcaatgggtgggtgggagtcattggcgccaaattttctctgcattggagtcttggagagctcagagctcacctccctcttggccatggcagggatggcatccagatgaggatgaactcatggcaggacggcgtcgccggcaccaactgcccgatccctcccgggtggaactggacctaccagttccagctcaaggaccagatcggcagcttcttctacttcccttcgcttggtctccagcgagccgccggcgggttcggcccggtcaccgtcaacaaccgcgccgtcgtgccggtccccttcgcccagcccgacggcgacatcaccttgttcatcggtgattggtacaccaagagccacgtcgtaagctccgagctctccctctgtctgtctgtctgtctgtctgtctgtctgcgattacattttagtttacagtgtcagtgttcataaatcgtcgaggagaatgatattaagttgctttcttgatatctcaactgtatactattttttcttggtttatgttgcaagcatggttatatgtagtaatgtagaatgatacttagatctgtactctctgaaaagtaagagaattcttgtgttcatcatttaagaattgtgaagtacagtgattttttgatctatggataagctatatggtgcattatatttgaagaaagtttttatctgttcttctttgaatgtgagaaggtatctctgcccaatgtaggaattgaggaaaatgctagatgatggtaaggatctcgggataccggatggaattctgatcaatgggaaaggcccttacagctatgacaacacattgattccagaaggccttcaacatgaaactgttggagttgagccaggtaagcacacttagttttcttttccccatcatatttgccttatcattagttttctgcatgacctattaagcctgattcagtttttacagtgatgcaattgcgaaacattatagatatgtagtcaaaatttggaaaaagtaaataatcatacttcctcagatgaaaaaagacatcatatcaattaccacctccatttcatattataagttgccttgaatttttttcctagtcaaacttctttaggtttgaccaagtttatttaatagaaaaatttggcaacatctacaatatcaaattagtttcattaaatgtaacattgaatatattttgatactatgtttgttttgtgttgaaaatattgctatatttttctacaaactttgtcaaacttaaaaaaaaattactaggaaaaaaaatcaaaacaacttataatatgaaatggagggagtagtaatcataaatagttgaagatcagctttcatcaattctgttattttgtagcagcaaaggacagaattttctgtctgaaatgtcttgctgcatttacatacagatatcaggatgtgaataaatgtctatcactgatcagttatcaggattactgcaaaaatctttcagtcatgccaattttaatgatctgaagatttctgactagaacaatatttcatatacttgttacaggcaaaacttatcgcttccgtgttcacaatgtcggcacctcaactagcctcaacttcagaatccagaatcacaatatgcgcctagtagaggccgaaggaacctacacttatcagcagaattacaccaatcttgacatccatgttggacagtcatactctttcttggtgaccatggaccaaaatgcaagcactgactactacattgtggcgagcccaaggttcgtcacgaacgagtctcgctggcacgatgtcaacggtgtggctgtcctgcagtactcaaactccaaaggaagagcttctggtccccttcctgatggtccaaatgatttctattacaagtcctattccatggaccaagccaggtctatcaagtgagtattaaccactagtactgttgtgctctgtactaacaaatatccttgcattattagtaactatgatgctgttgattaatgatagttttcttgattgtaagaatcatctagtttcaaggttgtcatttccagtgactacatctcaagatgacatgttctccattgataaccattgcaattgtatttttcagaatgaatacaactgctggtgctgcacgtccaaatccacagggatcattccgctacgactctatcaacatcactcagaccttcgttctcaagaacgagttacctttgctcatcaatggaaagcgtcgaaggacgataaacggggtctcatactctccaccagagactccactgaggcttgctgatctccacaacttgactggagtgtacaagactgacttccccacaatgccaggcaatgctccaccaaaaatggcttcatccacgctgaacgcatcgtacaagggcttcctcgagatcgtctttcagaacaatgacactggtgttcagacctaccatctggatggttactcattctttgttgttgggtatgtgatggaaaaccaaaacagtttcttttaccatgtgatcatgtgttatgaatttctggttagtcatgtaaaatgacacagtcctgcatcaccattttgtgaatttcaggatggataatggtgattggactccagattgcaggagtaggtacaacaaatgggatgccatctctcgcagcactactcaggtacacaacttcatgaaggacaatctgatcatatgtcaaatttgtatacttacaaaacatgtgcatccttgagtattctgaacaatgcaaatttgcaacatttttcataggttttccctggagggtggactgcggttctagtctcgctcgacaatgttggcatctggaatctccggtctgagaagctggataactggtacaatgggcaggaggtctatgtgaaagtggctgatccactgggatacaacatcactgaaatgatcatgccagataatgcattgtactgtggtctactgaaagacttgcaaaagtaagtttcaccggatcatttctgttttctctttgtttcactgatagtagtacattctgtttttggccacttaccttgtgttctggaaaaccttgcaggccacagattcaccaggtaaacagcaagtcatcggctcaagctgcagatcgatggggcgcgcgagttcttgcaatggtgttgctgatcattgcagctgtggtttccatttaaatttgttggaatcagatgaggatatcttttagttaggctctgtgggtgatagaaaatcatattgttctttgagtacagaacaacttgaggaagctgtctgtgcaaagtgcaaaacttggattctagaaatgaaaaacctgtcaattttcctacggtttttgttctggctttcacctgagattgcattgctcatgtgcagtaagcaggttttacctccatgtgatctaaagcctaaattgtccgcagtactgttgtaagtcaggaagtacttcattatctaattagttttttaaaaatataatacatcaggaaaattccattaggaatgcattcgcgcacacatacacacaaagatcccactggtttactggactcctcgtagattcaacagaaatagctcaattctagtgctccctcggtcttaaaatatagttatttttaatattttaaacttgtcttatatcagaatactacttcctccacccaactacaactgattttaatttatctaattttaccctcgactccttaaccagcccctcatataatgagggatactatgatattttccttttatccttagtcccaaaaaatgaagattagaagctcttatattttgggaagtcaaaaaagatggagggagtaaaaatcaatagaaattcttggctaaacaagctttcagtctcttcgaagacgtctttcaattttctcgttattctgaggtgtagggtccccatcttattattcaatttcctaagaatgcatcatataagcttaatataagaggacttttatggtataatatactgctagtatatttactgcaagtatatatgatctaacggtatagattgatttgattttttagttaattagattgcagtataaagtttgaaaaggtaattttgtcttttcttcattattctatcatcaaatcgtgctatcatcacgtgcttcgtcatcaaatggcgctcaggatactcctcccttagtgcacgataagatccagtaccgggtactcccaattagattcaatctgaacaaaaaattactaaagtgttattttattttctatcaaattcctagcatgcccttctatatactgctagtatatactagtaggatattgtaccgtaaaagttctctaatataaggccaccgctattaatagccattaaccggtagggcccatttaaacataaaataattctattcaaacatggcctaagtaaattcacttggtactaggccctattagacccgtgagagagtaaatgcaaccaatactataattcattatgttgttccattcatgttattatgaacaaaatgccaagaaattatggagaagtgaatgggagagatgagcttgactccttttaagttgaggttgaagttaacccaacttaatgtcttgcccaaatacgatggcacttatattaccaatatggctctttgcctcccacgagaaattgatcatatcctaggcctagccatctatatgccacggggacaataatatggatggtaaataatcaatttgtgatcctaaagggtatcagtagtagcgtttcaaatcataggatgaaagtgactccaccttatatcgatgagtttgcttaggtttgctgtggtgcgcatggtgagaccatcaaatacttaaaatgtaaaaacaatatatacataggtatgccaataggtgatggcaaaagtgttcacgagaatttccaaaggtacaactaatgtggttgatttttttttaactattgtgatgcgaaagttcaaggtatctatatttttttcacatgatcgagcgatgttatttcgtacttgagatacttttgcatgggaagagatgtagtttagttgaaacaaacgatcggatttacttcaagatctagtctaccagatgttttagtaccgttgctgctactaagaaagcagtacatcgtattttctataactaagtacattttgttacttatttactgaggttgatgagctctactaataggcgagcacctggtgaaaaatgctggttgttgacgagatcttactcatataagttagtgttcaaatacataaatgcaaagttgaatcatacacatgtgtgagagtttttatgtgtgaatacaaaggtagcttgttgaaataattttgatattttgtttcaaccaaactctatctcctcctcttttatacatttccttatcacacaataacataggagtactatctattgagttacatgcactgatcagttcaacccaaaagcttaagttgatggagaaatacagacaattcactttatattccaacgctatgatttgtttcaattttgaaaatggcatgaaaggctaatctagcaataaacaaagccaagaaaaaagaagaaaaaaaacccatggtaattgcgctcacccaaaccccaacacatccgccgcgtctagggcttcctcgcgctcgccgccggccgccgccgtgaacatgggctccggcgacaaggccatgttacgaccccgatcgccggcggcgctgctcgccggagatccgatagaataggagtagagacgggaggaagaagagaacacgagaagcagaggaggggaatcttttcttttttcttcgatagttttggacgcggtatccccctcacacacgcgacacatactcctcaggtcccaccacttagtggcttacaggttacataaataaattacgcaatcttattgagaaaacgcctttcctctgtacgttttccacctctgctctgattcagcacagcgattgttgctcatcagacaaccgctgtgacaggccaccacctccaagcaccaccgccgcgacaaggacaaggaccccgaccgcgagcgcccctcctcctctcgccaccaccaccaccaccaccaccgcgacgacaaggacggcgagcgtgaccgcgaccgcgatcgccaccacagggagaaggagcgcgatcgcgaggagcgcaaggcgcgggagcgcgacaaggagaaggagcgggcgcggcggcgcgaggagtcgtcgcggtcgaggaggcatggggcgtaggaggaggaggagggagagggggaagatgaggaccgccaccgcaagcgccgccgccggtcctcgcaccaccaccaccaccgcggcgacgcggagccggaggcggcggctgccatggaggaggaggaggtggtggtggtggtggatgaggaggagtccgagaggcggcgtcagaagatgattgaggaggagaagaagcggctcgacgaggagatggagctccgccgccgccgtgtcaaggagtggcaggagcagaagcggttggaggaggaggaggcgaagcgccgcgagcaggaggcggcggccggtgctggcactcctgccgcggccgctggggccgacggcgattccaatgccgggaagaagtggactctggatggtgaggagtctgatgaggagggatacaaggaggatagccaaaatgcagaagatgacggtggcatcactgccgatttgccgagtgaggtgaatgatgcaaatgttgctgctcctatggaggaggatgagattgatccgctcgatgcattcatgagctccatggtgttgccggaggtcgcaaagctggagacggctgtggcatcaatggagagcatgcctgcttccaacatgggtgataagaatggtaaaagtgcaaaggatgctgtgagtaatggtgataagaaagggcaaaagaaggcaatggggagaattatgcaaggggatgattcggactctgattatgatgacgacgacgacgatgagggtggatcgaaagatgaggatgatgaggagttcatgaaacgtgtcaagaagacgaaggtagaaaagctggctattgttgaccattccaaaattgagtaccagccattccggaagaatttgtacattgaggtgaaggatatcacaatgatgacaggagaggaagtggctacctacaggaaaaatctggagctcaaggtacatgggaaagatgtgcccaagccaataaaaacatgggtgcagagtgggctgaccagcaagctccttgacaccatcaagaagcttggttttgagaagccgatgcctatacaggcacaggcattaccaatcataatgagtgggcgtgattgtataggaattgcaaagactggatcgggcaagactctagcgtttgtcctgccaatgctcaggcatgtcaaagaccagccgcctgttgtgcctggagatggccctattgggctcattatggctcctaccagagagctcgtggtgcagatacattcagacattaagaagttcgcgaagtcgcttggcatcaactgtgtagctatctatggaggttcaggtgttgcccagcagatcagtgaactaaagaggggcgctgaaattgttgtttgtacaccgggcaggatgatcgatatcctttgcaccagcagtggaaagattactaaccttcggagagttacattcttggtgatggatgaagctgataggatgtttgatatgggctttgagcctcagattactcggatagttcagaatacccgcccagataggcagactgttcttttctcagccatttttccacggcaggtggagatactggcacgtaaggtgctgacaaagcctgttgagatccaggtgggtgggaggagtgtcgtcaacaaagatatcacacaactggttgaggtgcggccagaaaatgagaggttcttgaggctgttggagttgcttggagagtggtttgatagaggcaaaattcttgtttttgtccactcacaagataaatgtgattctctacttaaagacttgtttcagcgtggatatccatgcttatctttacatggtgggaaagatcagactgaccgtgaatcaactcttgctgatttcaagagcaacgtatgcaacttgctgattgctggttgtgaattagatgtgaagtagcttgagctggttgtgaattatgatgtccctaaccattatgaggactatgttcatcgtgttggacgaactggtcatgctggtaggaagggctttgctgtgacttttatttctgacgaagaggagcggtatgcaccagatcttgccaaggctctggagctttctgaacaggctgttccacaggaccttaaaggcctagctgatcgtttcatggcaaaagtgaagcaaggaacagaacaggcccatggaacagggtatggtggaagtggtttcaagttcaatgaagaagaggatgaagctcggagatctgcaaagaaggctcaggcaagggaatatggatatgaggaggataagtcagattcggattctgatgaggaaggaggggttcgtaaggcggggggtgaccttgcagcacaagctattgctgctgcccaagctgccgctactttggctgcagccaaggctgctagtaatgccaatcagcaagtacaaagcaccaatgcagggtccttactttctatacctgtcgtagccaatgctccaaataatgaggccacggcacgtgcacttcaggctgcattgaacattcagcaaaatttagcacggatacaggcacatgtagtcccagaacattatgaggttgaacttgacattaatgatttcccacaaaatgcacgctggaagatcactcacaaagagactttgggtcctattcaggattggactgaagctgcaatcactacaagggggacatttattcctcaaggaaaaattgttggtgcaaatgagcgcaagctgtacctgttcatagagggacccactgaattatctgtcaagaaggcgaaatcagaattgaaacgtgtccttgaggattgtgccaatcatgctctgaaccttcctggttctgcccaaactggaaagtactctgttatttgagctgcggattgctaacagaacagctaattcagagatgcagggttttcttgtgaaggtatgcgagaagagaaaaaactcatagtccatatatcaaatatttatctgcccttgtatgagcacagtaaacaaaatgttgcttatcagctcattacttcattttaccatggcaatagtagttctataacattgaaggtcgcaactttaaaaatatatcataagtatatcggtgctctttagtgctaattatagatcacccggtttccttatttaccactgtatccgtctttcatactgacagcttgacctcttgcatagctatatgttatgcttgtactgttgatctataacaaattccttatagaatgtgttttataccataggttcgaaccacacaaaattgatatgatacttgaacattctgaaccatgcaaaattctgatattctcaatgtgaccaggtctttcttggaaggtggactgcgattcttgtcttccttgatgacggcgttatctgcaacatccgtgctgagaagctggataagtggcaggttagggtgttctatgtgaaagttgctgatccactaggttacagcatcactgaatgatcatgccagattgcacactacatattgtagcctaccaaaagacaggcaaagtatgtttaagctgaacatctcttctgtttggttggttcagtcatactccctattgttgataactttaccttctgttctaaaaacctttcaggccacatattcaccagccaaaaaaagaagtcatcgtcctaggagcttgatggagaaccaggctcctcacaactgcgttgctgataattgcagttaaatttgttgaaatccaaggatttgttaggctttttaggagtgccaatcactcataacagggattaaagtgagatcgttgttcgttgagttatacagaacaatgaaaagctgtttgagcaaaggccattaacttgatgcaaaaaatgaaattcggctagctttacctgcttttgatttcattggcttatatcatttgaggtagcaagttaatgtctagactctagaaagcaggttttccataactgaatgattcattatgtgataaaaacataattagctggcactgttgtttttcattcaagagattactcctacaggattcacattgtcgcacacaaacaaaaatcaacactgacaacttacaaaaatgtataattaagctattctgaccgtgcttacacatgccagcatttttttttcgggaatacgcaaggagcgcattttttccattaagagaaataaaagttatttacaaagataaaaggaaaacaagcaggggaccgatacaggacgctatggaaaactataggaatatctcgcgctaaatttggctaccacgacctcgtaaaggccaaacagcggggatcccgtgattagctgacttctaaagcatggcctcctccgccattgctttcaccacttcggtccaagacctttgttgttgattgaagattcggttgttccgttccttccaaattgtctaagccaccagtgtcacgacagtgtcgaagcctcgacgatgccgctccccaatcttcatttggctctcacagagccaattgtggaaggatggctcattgacaggtaagcagttcggcctccttatcgcctgaagcgtccaccaccataattgtctcgattcagggcatgctaccaagatgtgatcaatgctttcctcctactgatcgcaacgaacacaacgatccgggtgtggcaaccctcgactgcgcagacggtcagcagtccagcatctgttcattgcgaccaaccacaagaagaagcggcatcgaggcggagcgagtgacttccaaattggggtggaaaggaaggtgacacgaccaaaaaacaaggccttataggcagattttgagctgtattggcccgaactctcccatttccagatgattgaatcaggagtagtaggatcaagatccaccatttggacaagcgaccaaagctttagatattctagaataggttggatcccaagtgctcctcggatgtctttgatccattggcgacctgttagtgcctcagccaccgtccgacaccggcgcacgcgtggtggaattttatcatagatgttcggagcaaaggaccgaatgcaaccctcttgcaaccagctatcttcccagaagaggatagtttgtccgtctcttaattgacagatggtagaggctgcaacgaagttcctttccttttgcgaccccggaatggctagcccctgccaaggtttgcttgaggaggtccgttgcaaccatgtccacctggaacgaagagctatacccataagctccagattcggtacacccaaaccgccgtagttacacatgccagcatcgatcacctttgttggatttagagtttacacggacaaagataagatgatacataaaatatgatcagttctcctatagcttacagtttcatcatcattcaaacatctatccattagcctgctcattgtgcccaatggatcttcttggcctattcaaaatgaaagaaaggtaacgacattcacatattaagttttcaagttccaaccaagaaaggagataagagtgcaattaatcagttaaccttttggttatagaagtgttcctctttgtcacctttaaatatcttaagtttgcagatgaataaaaacctgtatgattctcaaggaaatctaatatatatgcaagaactaacacatgcagaagatataatctggcacaagcagaattcattttcttttttcttttttcttttttcaaatttcactaacttgcaacttcatattggggataaagataagcataatgctgatcgaatcaaactcacctgtatatatatttatgactcttgaaacaggcgtttctccatgcctctgctcctgtccaagaacctgacagtggagatgtgctggactctctccttgtcctcaccctgtatac

SEQ ID NO: 68261 - DNA, 7888 bp, Oryza sativa
ccactaccccctaacaaaccattagagcccccataatacctaatcctaagaaggggctgagatagactttgtctgagatttttagaaggccctaaaggcttagaagtcccataatatccccaacaatcccacccaaccctaatctccttcctcctaccgaagagaggcggagactcacggagtggcggcggcatacaagcgcgagtgcgcgtgcgacggccgacggcttccagttccagccttccaggcgaagttgcggcgaccggcgacactgcagcagttagggcacgcggcgcgccggccgctggccgctggggcctgggggccccgagcggcaacaagggggtgggtcgacgaggggacgcggcggcgcggcgcggcaacaagcagggaagggggcaagggggcaaagggcagctgccggcagcagcaaggggcaaggcaggaactcagcaattgaggatttgaggaagtgaggtatataaaatttctaatttgtcatttaaaatcaatttcaattgtcaagtctagttgttattaatagttcaagttttcaagaaatcagagatattgaattgaaaattttgtttgtgattcctagtttgctacttgttatattgctagattgtgaagatgtcaaaaagaactgatgaggacatcccttccaacgatacatccatgcctaagcacagcaaggaccaatgactagagctcgagcttgtgaacgtaattatcaggtaaagtcattcctagctactcatataagttcttctcagaattgggtgctactaagtggttgttatgatctacttgttgttaggaatatgggagaagatctagatcacaaacaacactagcagcgctgatttgatgaagtcaatgctcttcacttcgatggccaattggggcaaatgagtacttgttggaaagatcttgtcgtctactttcagctatgtgtggtctcaccatcagattcgacccaagctgctcagaatgacgaaaatagttttcacatcagaaacttgggcttgggccttgtatctttacagcccattaggggtccacaaaaactagggtttgctcccacctcctctcctagtcattcctccacctatataaacccctagcagccaccattttgtattttgagttttgtttagatgtaagtttagcttcagctacgtccttgtactcgcgtgtaccagctagtaaacccgaatacttgtattcagaaccccattttcgtttgtttcaatttcatcatttgacaagcgccgtgagctatttccttgtcaacttgttcttgcttgttcttcgattgcttgtaggttcaaggttgttcttggcacggcaagaacaacaacaacgtggagtcggtgcaccggttgctaaggcgtagcacccccgtggtagttgtagtcggaccaccaacgtcgtgtcctcctccaaatcgaagtttatcctcgtctcatcgaaagatcgagaacccccgttgctgcatcaagtggtatcagagctcaagttgctcggtgagagatttttcaatcctttgtttttacctacagcccataaaaaaacctcaaaataggtcagatccaaaatcaccaaaacaagttgagcctttgttgttctacttagtttttgcttgctgagttttcggttgcatcgattggttgagttactggttctggtagtttagtcctttagagtttcatgttctgttgacaatttcgtcaccacaaacacttccaccatcacctctttcatcttcatcccgctgccaccatcatcaccatattcaccacgaatccaccttcatccgcaccaaattttcgtccaccacaaccaacagcaccctcatcactacatcagccacccccaaatgcatttattgctacctccaccaatagccaacccttttgcaactttgtaaagtgaattagcccttccaaagaaagcatttaagtgccctcacttttgacttgttggctgaaccaagtaactccaaccagcccatcattactccattgtgttgacatgttggctgaatgaaaagagaagaagttgttcctgttcctgctgttttgagtaatttcgaaattcattgggaaaaattttcagctttgaactagtttaaaaaaaggaagaagaaaaaggaaagaaaaaaaatcagaagtgaaaaacaaggagaagaagaaaagaaaaaaatagagaagaagttgttgctgttattttccttgtgttcttttggtgcaattttgagtggctacacttgtgagtaggttcgtctctctaacagggttttacctaggaccaacacaataccatcattgagcgattattcaacttgcttgattaatgtggttctagctgtaccttgacattacttgcagtcacctatagctccacaattttttatctactaccatcacaggatcgtgcttgttgtcggctctggtactactaaccattgttgttgttcttgctagttgccaacgccttttacatagcaaagtaagaacatgtaagaactcgtttgcacaagtttggtagaaatggagatggataacacctagctccaatagttgataggacatatctcttgtgaattgttgcttcctactccctccattccataatataaggcacaaccactttccttagatgttccataatataaggcatgcatgcaagcatgcaattaactatgacatcttctccattaaattattattttttaaatcctccactctcatgttatctaatcctattggatgcatgcattatatttattaggatgattcaaactacaagatgataataattatttttggtctttgggttaagggtggttgtgccttatattttagaatggagggagtattaaccatgacaggaggatcaggggagcatcctcaacattcaccacgtacgaggggcatcatacaacattttgagcaccaagtgagggagcatgctgaaggccttgatgaggatgttagggtcgccaatgatcgccttggtcaattggaggctactcaaattgacaccaactccaagctttcctcattggagacaccccttgtggctgtgaacacttctcttgcaggtatcttgaatacgttgaagagaatgagccaagatggtcatgatggaccggctaggcgcaaccacattggccatgaagctaatagcagcgtcgcagcaagggaagaagtggactacgctgctgacaccgagcttgatgaggaggtacttggtcgtccacaacgacaacagcgccaacagcgccatggaatgggcgctccaccacggcaggaggtacatgataatgacgattctttaggcaagatcaagtttaccattccttgctttgatggaaaatatgaccctgatgcatatcttacttgggagttagccattgatcagaaatttgcttgttatgattttcctgagaataaatgtgttagggctgctactagtaagttcactgattttgcatccatttggtggagtgaatttgttcgttccaatccaaataacactccacaaacctgcgatgcaatgaaaagagtcatgcgagctagatttgttccttcatatcatgcatgtgatttgctgcataaattgcaacaacttagacatggaatcaaatatgtagaagagtattatcaagctttgcaaacaggaatgcttcgttgtggtttggtggaaaatgatgatgctggtatggtgttgacggtcgttagcgatcagtttcgaccgtaaatattaccaaaatagaggagaaatagttatacttgcaatgcatatttatgttagaataataatattccactagtattaggtttactaaccttttgcagagaataaccataaagtggaggagaatcgacatcaaatcagacaataaatcaatcgaacgatgtcgagaatcagacttatgtatgaatgggccaagaactcagaattgacacgatgaattgggcaaaaattcacaagtcttcgcagagaagcaatagaggaggccacctgccgagtttgggttaggtcggtccagcccatggttcggccgaacctcccgtggcaccaatggatgtagggttttgatggatggctgggattggtccccaatgacagttggagggtattactgacctttccaaccgtcataatcgtcattacatgcctataaaaggagctcctcttctcacttcactcacacacctcaagcaaagctctctcatattctctcaagtttagtttagtgttcttaagctagtagagcaggaatagagtagaaatcggagtccggaagccttcgggtatggctctagtagctttcctttcctcttttgtaagctttgtacatttattagaatactcttctttatacatttctggtattgaaatactttccgagtatatgaatgccaactttactttatattcatgttatactgattgtactgctagcttatttgggagatgcataggtacaagtatagtgtttgcttatgcaattgctctatgtcatgacgatgatattagagtagtatctggtagtttaggagtggtgtctagattacgggatatcattatttggggttatatgctgcggatgagaggtggaccgctgatggtgacagctcagtacgtgtattcctccacgcgtgtatatagtcctaagttaatttccaggggagggtactcctctgtatttagccccggttgtatggtcatgacgggctgtcgtaaggaactcggcagtcaggggtggcttcttgaagtactaggaggacatcggatagagggtattagctagttaatcagataactagaatgtatgtatactatgtatactagaagtataggaatagattctctttctattttctttccacttagcttaggtaatttagtatgagaatgagtagttcctggcttgtgtgtcactctaccctttgattatcttaacccctgcttagactatgattattatctctctactatgatcttcctacgggattaaataaatacgatatccttggaatactctcaggtgaaatgctacaatggtatatccatgcgcttgcggatgaactctgtaaccataatataacaggagtatttctgcgccattgcctagtaatgtcgttaagaaataccaacatatggctagattcatgggtgggctaaatcgagaaatttagaacattctagcctacaaagaatataattcaattaaccgtttgtttcatcttgcttgtaaagctgaaagggaagtgcagggacgaagagctagcttcaggactaacatttctgcaggtcgtactagctcttggacaccttccaacgctgttgcaccgtcaactcgagcagcagcaccatcgtcctcaagcaacaagctacgttcctccacgacaaactctacaccatgcctgagtgaaccagcaagaggggttgctgctacaccttccaagagttcatcattagtggcatcatcaggaaggacaagcgatattcagtgcctacactacaagggctttggtcacatgtgcaaggactgcccaagcactcgtgtaatgatcgtgagagctgatggtgggtactcctccgctggtgatttagatgaagaaacctatgctttgcttgcaactaacaatgcaggggaaggtgacacgccccaccaagatgaagaacacattggggccgaagctgcagagcactatgagagcctcgtggtgcagcgagtgctaagtgcacaaatggaaagggctgaagaaaatcaacgccacaccttgtttcaaaccaagtgtgtgatcaacaaacgctcttgccgcgtgatcatagatggaggaagctgcaataatttggctagtgttgaaatggtggagaaacttgcattgagcacacaaccacacccgcagccctactacattcaatggtttaatagcagcggcaaggtaaaggtaacacaattggtaagagtacattttgtcattggttcttatcatgattcaatcaactgtgatgttgtgcctatgcaagcatgttctatgttattaggtaggccatggcagtttgataaagattctttatactttggcaattccaatcagtacttctttgtgcataatggaaaaaagcttgtgttacatcctatgtctcctaaagttattttaaaggatgaacttgctagagctagcaagcaaaaacttcaggagcatactaggagtgagcatcatattgtggctaatgaacttgagaagcataagaagaaatgcaccaactctgttcaaaataataaaaatgagattaagctgaagggatcttgtttcattgcaacaaagtcagatttggacgaagtgatcctgacacttctatttgcaatgcttcggtttgcaaagaaactttattttcactcgaggatacttctatttctttgcctcctccggtcactaaccttttgcaggaatacgccgatgttttcccaaaggaggttccaccggggctgccaccaattcgagggattgagcaccagattgacctcattcctggggcctctttgccaaactgtgtgccatacaggaccaacccaaaggaaacaaaggagatacaacatcaagtgcaagaattactcgacaaggggtatgcgcgtgagtctcttagtccttgtgttgtccccatgcttttagttcatggctcatggcgcatgtgtgtggattgtagagcaattaacaacatcacaatcagatatcgtcatcctatccctaggctaggtgatatgcttgatgaactgggtggttcacttgtgttttctaaaattgatatgcgtagtggttaccaccagattcgcatgaagttaggagatgaatggaaaacaacttttaaaactaaattcggcttatatgagtggttagtcatgccctttggtctcactaatgcgcccagtactttcatgagattaatgaatgaagttttacgtgctttcattggcagatttgtgatggtatattttgatgacattctcatatatagcagatcaatagaggatcatcatgataatttgcgtgttgttttttatgctctacgtgatgcacctttatttggtaaccttgagaagtgcatattttgcacagatcaagtctcttttcttggctatgttgtgactccgcaggaaattgaagtggatcaagccaaggttgaagccatacatagttggctggttccaacaacgatcacacaagtgagaagctttctatgacttgctgggttctaccgccactttgtgaagtattttagcaccattgcagccccactacatgagcttaccaagaggaatgtgatattcacttgggctgcagcacaaaggaatgcattcgagactttgaaagataagttaacatacgcaccattactccaacttcctgatttcaataaaacttttgagcttgaatgtaatgctagtgagattggattgggtggtgtgttgttacaagaaggcaaacctgtagcatatttcagcgagaaattgagtgggcctagtttgaattattctatttatgataaggaattgtttgctctagtacgaattttggaaacatggcagcattatttatggcccaaagaatttgttatacactttgatcatgagtctttgaaacacattcgaagtcaagcaaaacttaaccgtaggcatgctaaatgggttgaatttattgaatcttttccatatgtcatcaaacataagaagggaaaagaaaatttcattgctgatttgttctttcgtgagattgttcgcttgcatggagtgccaaacaccatagtttctgacatttttggaaactatagtgccaaacaccatgcaaaaattagaaactatagg

SEQ ID NO: 68262 - DNA, 14162 bp, Oryza sativa
cggagtatattgtggataccagcaaaccaaagcaccacagattcctcttcctatccatcaattaggcatgggagccatactggattcatctgcctctccgatgacaacgccaagttttatagtttgttcctcattgtgagtagcaactgcagcccatagtggtccattgtgatgtggacgagggttaccgatcttccgaaaggttctaataggcagtcaatttgagcggagtcgcgacacagcccgatccggcttctgaacgaacacgctcttgagccccgcaatcgtagcaccacgtctcctctggttatcacccgtatcgaaacgcggaagacctcgccgaaaaggctaatccctgtttgcgaatcgaagaacacaaacaagaacaaggaagaatacaactaaaattgtagatgaatgattaagctcacaagttggtgtcttacaaaccgatctagtggcgaaagtgttcttaacagaataatctaagaaaaacctaaaccctaaaggtgacggctggtactgatatatagagtttacggtcgtgcaaacaacccttgatgcaaccctaatgggttccaatacgatacacggcccaaatgcccaaatacggtgacgcagcaccgggacagattcttgacgtcaaattgttcggtcgattcctgttgacttggaaagaatttggacgtgggactagaaccattggaaatattatcttcttagctttccagccatataaagaacgccataatccgagcatgtatgcgatctgggtgcccgttttagtgcagagggtcctggactccgaatcgtactcgaagtcgacttggtttgggcctccatcttgacttggacgtccttgatgatcctccgcgcctctaagtccctctctaagggtgtgttcgctggttcatgttcccatccggaacaatagacacggaaaacagagcggtccattagcgcgtgattaattaaatattagctattttttttaaaaatggattaatttgatttttttaaagcaactttcgtatagaaactttttgtaaaaaacgcaccgtttaacagtttgaaaagcgtgcgcgcgaaaaacgagggagatgggttgagaaaaaggggttgcaaacacaccctaagtgtctctttgtcctctccatgattcctataattattaggtagcaatatattctcaaaatcatacaaagaagaataggaacgagcttacctctaaattcaattgtctcgcgcgagctcttgttattggtccttgaatgaccggtggaggattgttgtgtgtatccgaaggagtgatgtccttatcatcctccctctcttgaattagagtcgtcctcgactcaagtacatcttcttctctcaagtatggttttaaatctaaatgttaaaagtgggactaaccccaaactcaggaagcaattcaagtttatatgcattatcattaacctcctcaataattttgaaaggaccatcagctctaggcattaacttagacattctaaaatctgaaaattgatcctttcgcaagtgtaaccaaactaaatcacccggttcaaacttcacttcttgcttacctttactaccagcaattaattctatactttttagtcatcttttcaatgatctcatgtattttcaaaataaattcagcatgtgccttagtttcagtgtgaaccctctcactagtaggtaaagactaaactgctccatggcctgtccctaatcctgttacgttcaacgcatcaaaaacatcaattttgatttgatgccacctctcgatcagttctgtttcttgttttggtatttaaagaaaaacaccgcctgatcttaccaagcctcctccctctacttatggatggaagtgtgcaatctggttacccaagtaaaaaccagcttagtagtttagacgtgttagtataaagcccaatgtgaaatttgtataattgacatcccactgtgcctgatgtgcctatttgtatcattgcttcctttggaatcctctaataatccattatgtttttttatggtaaagagtggacgatatggtcttatattgtggacacgtaaaatattatgagaaattatacagtatttgagaaagtatctcaaggtatctaaattttatattaaattttttggtacttcattcgaggatatcaaaattaatttatatatattagaaactatggtatctcctggtatcttttgaaatatgttaaaattaccaaaatagtatactgtgcatacacatataagaataaataaaacaatcaaacagaactagtcagaagaaagggatctacgtgtaaattgattttgaggcaaaatatttatccttggctatttgaacgagcaccacgaatcgaatccatgtctgaaaatgctcttcgaattgtccgatgatggtgtagagttttctaaaaccaagttcttataaacttttacctgcttcatcctaaaaagcatagattatgtttcctggtatcagttaggcatgggatgcatacaggattcatccaaaaaggaattgatggttcgcagtgttttgtagtttgcacttccttgtcagctggagctagcagtgatgcccagcaatttgcgatacatatgtttcgctttgatattatgcgaagagctagctatcgcttataggttcgagtttttgtcacaaactgatcaaagaccgcaaaacagctaacatgtatattttagctttcagatctgttatatctgaaaaggaataactctccccccgcgtcgccgccgcgcctccgtcgccgctccccctcccccctccccctacctcgccgccgccggagctctcctttgccggctggcgagctaggatggcggcggcggggccttcttcgcggcggcgtcccttctaaggcgcggtggaggagacgttcgccggcgtcggggagtggtggcggcgaggcctctgggctaggcagtggcagatccggcgccgccgtcgccggatctggccagcctctccggttttcggccggagtactggcggcggcgccgtggggcggcgtgtgcggaggcggcaaggttggcggcggccggtgcgcgcgtggcggcgcgaggcggcgaagtccagcgcgcgcgtgggtggtccggtgcgcgcgtggtggcgcggaggacggcgcttgcgaggcggcatggcgacatctgctggctcccgatcggcgaggcgcgtcgctgggggcgtcggctacactggctcgccagccgccccccatcgccacacctacccctccggtgtcgacagtagccacaaccaccctcccctctcttggcttcttcctctttgcaagcagaagggggtgtccgccacccttgtctcccttcttctcgcttcctccctggcagctctgctgcctagttgtttagttgctttgcttcttacaccagtgctcctctctctgtgctagtggtgaagttggaggtggtttgtcgcagctgtaaggggtgtcctgcgaaggccggggtcctcgccggaaacatggatgacaccgatgccttcgatgccttctctcctccttgatgctcctccctttttttggccgtctgcttccagtctcggccgtggagtctttcggtggttgaggagaagtgttcgtctatgaaggtggttcagtctgtctgtagtcagggctcttgggcctcgcaagtgcttctagtgtcctgcgactaagtgaacctatcgtagtgccgagttggagcggtgtgcttatcttcagtgccagagttttgtgtttggcggagtcggagctgctgcatcgggcttagccgatgagctgggcaacgataacacaacacttttgctctggcccattgtagatcctcctttggagggagtctcgggtgaaagccctgtcttgtcttccagaatcggcaacatcgacgcttgtgggtgtcgtatccttcttggaggtgctgctttgtggactctctccccctttgggtgaaaactcagtccaatttttgggcaggcgtcggcagcggcttctgtcgttgttcccctccttggaggcttcgccttgaaggtcttgctcttccctcggtcacttttgtggttcggtcgtttgtcccaggcttttttctctgtcttctgtgtaaggtttcgtcagtttccctttagcaaactatgcagttgtaaggtttttgagcccggtttttcttattaacaaggtcaactctcttcttataatattccggtagatctcctaccgtcggtttcttcaaaaaaaaaatattttacctttcagtttataattaatgcattgtacatttcctctcaatactttggagttcctttagtaaaactggataaaaagtttgtttcattgacacatgtatacgaaataattaatttaacccctcctcccaaaaacaaacaaaaaaaaaccagatgattccttcactacatatataggctttgtttattccaaatccacaaaatcccaatccctaaaagtcactctcacagtcacacttgacaaattagacaacatccttcgaggtgttagtacgcacgcgtaacacacatacaaaccctcatctaactagcgaccgtctcaaaaaaaaagaagggaaataccatgtgtcaattttaggtttaggaggcattgggaattgatttcatccggtttctggtgatagaactagcgctgtggagattatgggtaccccatacccacacgacatggttatccgactggttataggggataacttatatctatgaaatatataacggatcatgacttgggtattacgtttccctgtatattatggaacggcctaaagtcctggtttgataagattgtaaagtagatttaggaaaccgataccgtattggttaagatttctatcttgtaatcctgccccccatcctatataaggtgggcaggaggccctctagggggcatgagacaactagatcgtcagatctataatacacatggtggattcaaatccccaaacaggagtagggtattacctctcatcgagggggcctgaacctatctaaatccttgtctccgcatccatccacttttaggtctcgtgcgctacccttttattattgctgaattcatgtttcgacagttggcgcgccaggtaggggtgcgtcaagttttccgtcaagaagtgtgatggaatcaagatcaggagtggccggattttccttcaccccgaaggctggctttcggttttgacggattcgtcttctttgatggtgactccaacaatctctccctcttcgacttgggttttaaccagtcgagagaacggcgatcaaagatttacgtcatcaagttggaggcttcaatcgtcggggtcaccgatatctcctgtgcatctccacaaagatctctgcttcaggagctacactttgtggttacaagaataaccaggttcgtcgttccaatctactaatcgttattagattggtctctgatataactactaattaaattaatctatgccttgcatgtactgttgctggttctgacctccgagtctttcgatcattgtcacgggagatcaagacatcagctcactgagcacacatctctatatgggtagatcgtattgatcttataccaggcgtacaatagaagtccagactcggatttagctgattggatcattctcggactcggctgactactggatgatcaggtcaaaacaaaaatacactcggcatgcaaggaaagcactgggaatgtggtcggcacgagccccaacacttaccagtaccccagctctgggaaaagcaacgaacgctatgcatttgatcaattccagagctattggttttgcatctacatcccagaagaattgccaggcatacacatcgttaattggttgtcatgagctatcctcaataagggacaccaattaatatttccatccagctcatacgcatgtgagcatatatggctaccttgccaactaatcagatcaggagtcctagcaccatactcctacgtgaggatatatgatatattggctgacatcatcaggagatattatctcggactccatcaaaacatgctccggttttcccttcaagcactcctctgacatcatgagcttgagttataaaccactaccggatcagtacaacatggcgttgagtctggaagggcctatgtcttcgttattaccgctggcttgcctccgtcgtcgccgactagtgttctcgcctatacggttggttgatcacaccaccgttgatgggcatcttcgtcttcaccgactggtcaccttcgtcgccgccgattgatgtctttgccttcatgactggcttatttcatcgccattgacggatgacttcgttcctatatcggtcatctctccgtcaccaaggagaatattacaaagctaagtcatcattaattttcttctttatatgatatttttcttttcctctaactcactacatcaattggttcgccattgactagtgagtcgggggctagagatgctatgtcatattttttcaacaattttcataatatttatcttgattgcttgcgacataatctgagtacaaaagtgactatcgagttatggagttctatcttcctatgctttccgtttggtttgtcgatggatagttgcctttgggccgattcctagcacccgggggctcgttggatggaccgagtaacgcaagatgctaagtattatattcggaataaatcaaaagcatagagataagataaatttatttattttcttctcttaacaattgcaaaaatacccgagtagtaaattttgattcgtgaaactttgttccattaatgacgaactcatgtcactcatatgcatgtttgggaagtgcctaggccgactcccggtgcttggtggctatgactagtcaggcagagtgtttaaacgtaatgagtcatctgctcggggaaatcaaaattgacgagaggagaaatacatatttataaacacttttaatacttgaatctttctcaagtactgtatttacatcagatactactcatcctatatatttgttctgcaggatccagatccagatatgcatcaaagggattcatggctttaagcttatctcctatgttacaggaatggatcagtcagaacatcaccaccggcttgccgtcgtcgccgccgactggtgtcctcacctatacggttgggtagtcacaccgccgttgttgggcgtcgttttcttcactgaccggctgcctcgtccgccgtcgactggtgttttcgcctatatgattgggtggtcacaccgccgttgttgggcgccgttttcttcaccgactggctgcctcgtccgccgtcgactggtgttttcgcctatacggttggttggtcacaccaccgtttgttgggcgtctacgtcttcaccgaccggcttgccttcgccgccgccgactggtgtctccacctgcacgactggcctattatgccgtcgtttgttgggcgtctacgtcttcaccgaccggcttgccttcgtcgccaccgactggtgtctcagcctgcacggctgacctattatgccgccgtttgttgggcgtctacgtcttcaccgaccggcttgccttcgccgccgccgactggtgtctccacctgcacggctagcctattatgccaccgtttgttgggcgtctatgtcttcaccgaccggcttgccttcgccaccgctgactggtgtctccgcctgcacggctggtctattatgccgccatttgttgggcgtctacgtcttcaccgaccggcttgccttcgtcgccgccgactggtgtctccgcctgcatggctggcctattatgccgccgttgttgggtgtctacgtcttcaccgccggctcgccttcgccgccgccgactggtgtcttcgcctgcacggttggtttattatgccgccattgtaggacgtctacatcttctccgactggccacctcatatgacgccaactggtgctatcgtcttcacggttggccacgtcgccaccaccgcaaacaggcatcatcaccttcaacgcaagctgtctacgtctgctgccgactggtttctttacttccatggctacatgattctgccagtgttgattggccttatcgtcttcaccgccggtcatctcgtctgctactgactagtgcccttgcctctacggttgatttataccgctaccactactgatggacgtcctcatcttcattgctggtcgccttgtctaacgccgactggcttgttcgcctccacggctgcgcgtcttcatcgtcattgactggcgtcatcgtcatcgccggtttgctttcaccgccgcccattgtgacttcaccttcatggctggcctattttaccaccgttaaagaacatctccgttttcgtcattattctacttcttccgtcgccaactggttctgtcgccgccgactcgtgttcacttcatcacagctatgcaactttgtcaccatggtggagctacttcatcttcattgtcttcggcaccggcaaactctattgccgctacttcgcaagttttgctacttcactagccatgacgtctacaagagcttcgacatctcggtatgcgtcaccaaatatgatgccgtgttattttactacaacaagtggtgctccaatattcaagatttctctccggacatcctcaatacatatcttcactcaagtgatggctactcgacgacaagaagctacagttctcgactctatgttcagttgtttcccaactaatcaaagagttgggggctacacaaatacaagactctcaaaatttgacaagatgaagcaatcaatcaatcaacgagtcaactctgggagttattatcttcgtctgcgcttcagagctggcattttacttcagcgactccaattattacaccggtaggtcaagattaaatttacatgtctgggagtttggagtcatcaaacaatcaactcagatcagattcaatgagttgaacaacagcatatactttcctctaagtaaagcatctgcaacagttatagcaccaagttctactgccatctttataaatcaaggggcgttgcatcagtcttcattatgcacatgcttgcatcaaggaaactattcgagcttcgacatcttctcaacaatttgaaggattattgtcactgacatcatcaacagaacctctacttcatcggccctgacgtctccgctgttgctaaggggtgactacgtattcaccttcggttgcttctgtcatcacctactttcatcgccgacttgttatttcatcttcacggatgacctactatgcaaacgctgatgagcatcttcatcattatcatcagttgctacactgctattgactggatcaccgacatcgtcatcttcatcaatatcctgtcaagcctcttcaacatagcctattctactgctgtttgatgggcaacttcgtcatcatagtcaatcatctatgattgctacttatcatcattactgtcggttgcgtttgtcgtcgccgactattttcttcatcctcatgattggtggatttcgtcatcgcctttgatgcgtgtctacatcttcaccgtcggcttgctttcatcgccaccgaccggtatcctcgccttcatggatggcttattatgtcgccactaatgggcatcttcatcttcttaaccagctgcctcatcagttaccgactgattatttcgctgccatggctacacaactttatcgttgggcgccttcatcttcattgctggctgacctgactgctgtcgactggtttcttcgcctccacggttgtacaacttcatcacttttgattggtatcactatcttcaccaccaccaatatttttgccacctctggtgggcaatattatctctatattggtcgtcttgtctctatgccaactgcgtcagctactatcaatggaccattgtaactacgacaaaaggacaagctatatgatcaggggcttactagctcaaacacaagtattataccttcaatttggacttgttccggatacatgcaacatgaattcatgatcatgggtctattttctatgctcaaagactggactatttattattcccagtaagggttatcaaccgaatacttgcgccagtcgggattcaattattatatctattttggagtatcccataagggataatcactcagattagaagctattcatatgagctacacttggtctatatcacccggaagatttattactcgagagcatgttacatgcgtcatcctttaaagggtgtcgaaggcatattttttggcctaggcctaatatgtctgcagcccatattttcaggtgtgacctgtcacgttcttttagggacttaggcacttttttcttaggtcaaagtgcgcgtgatcaagtgcccaataccttaaaatccttttataccacagttactcaactttttaggagttggtacaatgcatcttaaaaggtgtcgaacagtaaagctttatatagctgtcccgctgacttttttatatagtcaaggtgttgtttgggtttatcaagcaattgattggatacaatatcattgctttttgtcacgtaagtgtgcatttttatttaccaatattatggcttaggctgattatatattttggtcattttccaggcggttggtaaatcctttatgagtttatttactcggatgttacactacatatgccatatatttccatgtgtggtgaaaccatgtgtcttttagggacttaagcacatctgttaaagcagtgtgcgcatggtgtgtgcccaatactttggaaatttctttattcacaacatacaagcttctttataactattttgctatgtgaattttcaatgatgtagtcaactttaggttgcacgcatcatattctacaaagcagtcggtatatcacttggatcatgttatttagggattcacaccgtatatgctatcaagtcacttagttgactataattatcaagaatcactcagttggttggattatttactctttgactatatgttcagtttgctcaactaaccacatagtcgggggctacacctattaggtgcatctagtcgatgcacctaaaatttcatttaattatttttcagccctccacagtcttctgatttggtaaaagtactcgggagaccatggcgaagatgattgaagcacttatctttggagtaatctagttcgagaaaagattatcttttcgactgtgaaggtctcaggggctactgtgaagattgtgggtaccccatacccatacggcatagttatccgactggttataggggataacttatatctatgaaatatgtaacggatcatgacttgggtattatgtttccctctatattatggaacggcctaaagtcctggtttgataagattgtaaagtagatttaggaaaccgataccgtattggttaaggtttctatcttgtaatcatggcccccatcctatataaggtgggcaggaggccctctagggggcatgagacaactagatcgtcagatctataatatacatggcggattcaaatccccaaacagaagtagggtattacctctcaacgagggggcctgaacctgtctaaatccttgtctctgcatccatccacttttaggtctcgtgcgctacccccttttattattgccgaattcatgtttcgacaagcgctgttgacaacatttaacacgcatgatcaggcaggactacagcttctccattgcttgtccctaatcacttcacagtggcacgagaaggaaaggtgaaaccaacatctgtggcttggtaagggatgaaaacggtcagaaacggtcggaaaaaccctataccatttccattttcattttattttctcgaaaatggaatcggaacggtctactcggaaacagtaacgatatcagtaatgtcggtatatctgaaacggaatcgtcggaacgggaatctaccgatatcggtcggaagtcaaaaattcatgtcggaaacaacgaactgtggtatcatcccacatttaactatgtatgaagatgaccttataatttcacccttgcatcatcacgctgccacacaacaccgttatacgatgattaataagttgacaataaggtcgacaaacaatataaaaagttcaacgatatttcaacatcaatatggctaaagcatacaatgtggtaactaccattgtaattaagttttttgttgacactatataactaccattgtaattaagcttcatgctaaactagactttttggtagtttccaggtaagggggtcacggagaagagtcaagatagtggggcccgccggtgggtcccactgtctttgtttttctctctttcttttcttttctctctctcttatccttctcttctctcggttccttctcctgctctctcaatttcttctctgttttctcacccgttctcttctctgccttcggctccttcacgcgcgcccgagaggagagaggcgccggagatggcggcctggcgcagcgcggcggtgggggaaggagagagaggagaaaggggcggtgccggtggggaagaggaggccggggcggtgcggcggtgctcggcacgacgtcgctcggcgcttggcgcggtggcgcttggctcggcggcacagaggccggcagtggaggatgggggaggaaaagagggccggcagcgacggaggccatcggggcgaaggaggctgcgacccgcgtcagcgatgtcgactgctttagtctcttaatgcctaatgggctgctcctgctcctgctagccaggcccagtcggctttcttcttcggaattttgttggaaatttgacggaaattaccgataaaaaacggttaccgacaaaacggtcggaaaaaaccccatatcatttccgctaccatttccgaaaagcgattaccgtttccatttccgataccgactgaaacggtcggcgcaaaccggaaacggtagccggaattctcggaaatttccgtaccgttttcacccttactggcaacgctttttttttaaaggcaacaagacgaaacaggagctgatggcgacgtcgaaggcggagagcatcgagtactagagtattggaggggtaccaggaacccggtcaagaaattttttttaagctatatctcacttattttcattatgtgtgtatcccactcaatacaaatttagacacccgcatcaggttaaacttaatctaaagagagtaaattaagcaagtgtcacccttctctattttattttagctctgcccccgtctgattgtacgcattgacgacgtacactgtcctgtagtatcatatggcatgacaggacctacaagattataaattaagtagataaattatgcataatatcacggtgacggtgggaagacaatccataaaaatattcctgtaaaaacgatcagaaaaatgtacattttcgaatttttacatttcagtttataattaatatgttgcacatttactttcaatactttggaattcctttgttgcctagaacctcaatcgaacaccttgcgggtgaatgtagttgtcctgcaatggcaaagaacaaagggaaataaaatgtggaatgacactcaatctggaaattggggctaacctggtgtgtttcttattgcttagataacaggatacaaaagtttagaagaaaacttcttctatttatatacaagtatactatgcgatccgggttctcgggactcccgttcacttgctctatggcgattgcagctggatttttcacattttggtccttttaaaaaaattatttcacaaatagacctctaaaaaaacttataccagaaatggtcctttttgggcgccagaatggctggcgccgtcatccaacgggacggcggctggcgccgtcctcctgccaccgtggcgcacgtgaaccgacgtggcaggaggagggcgccggccatgctggcgcggccggctgcattccgtgttctctggggagcactggcaaacagataatttttattttattttttcggatgttttttcacactcaggatcacaatacaaccaaccacaaaaaaaatttaaactagaactaccacttagctaagtctgaaaatatctagcataccacttagtct

SEQ ID NO: 68263 - DNA, 26287 bp, Oryza sativa
ttcagatcctcaaaccattagtcttaaaagacttatctcatttcatcactaaaatgagaatagggaacatagagagtaatgcattccatcactatcatataccacaataccatactgttgtgcaacgcaatctatttcatccttcagaaggattatggggataaataagtcgcaacggcacgcacctcctcggcgtgactccatcaagaactaggtcttgatcattgcaactttctctgacgatgtcaacaacaattggggatccacaagatcaaccacaagccttccaaagacatgttgtaacgatcagagtaactagctagtctgaaaatttaagcactgtggggataacacacagccaacaacaccaagtatacctcaataggtattagaggacaccactgttcctaccatcgggtagaatagatatcacgagtgtacacactccagtgataatcgtgagatgcacatgtgcttacagaccccgtctgtttgatctcatcgggttcctcatttcaatcttatcaggtcataaatgggtcatcatccctccaagggattatacaatatggtgtgttcagacttactaattattttgtatctgagaggaaaattcatcaatgaggtctccccctcagagaaaattccgtcaatgtgattttctcccaacgggagatggtactcttaccggaatacccattggtacgagatttgcatgatggaacttcactaccgagtctattcaagacctcacggatttcctaaatccgttagctgcatatttaatttcatgccattttgccaatacctttatttagcggaacattcaacttacgtgggagaggtctcatctaggacctacttgaaccatcgcgcatcaccacctcattatattaataatgacccataaaaatccgaacaacgttcgcgattttcaattggctattcggttcaacctcaattacatttccatttgacccgatttgagcatcgtatgctcatgccatggactttttccggatccgggttctctcagagagaatcattagcaagaggcgacatagtgtcgacacatttattcccacttacacatttaaccagatctttgtcatttcccaaaacgatcgatccatggttgttccgtattcctagcaccatcatatgcgcgcatcgctaggaatgtcgtctccacgacgaccatcattatgaggtatatcaccttccaaaggtgaattctccaccaggagaatcagaggagtatgctcacatcttgtgagaactcttatgctttgactaagacccacggaccgtgttagcaggcgtccccgcagaacatgatcaaatgccataagtcttatgtggatacgatattattcccgggtctatccacatttaccacaatttggagcattactctatttaacaattatccaattgttcctcatatgattttgttggcaaaaactccgtgcaccaagcaaccaggagtatgaactaaacatacaagttcagctcatttagtgtgttcactcaaagaaatctccaggcattccaaaatgggcatttctctccccctaatgccgagatgtgtttcaatagcatactaccaatccccatatcgtggcataggattaaggaatttcacctcgatcacaaatgttctcccacgaatgtatgctacggtggtgatatatttgggaaatatttacgcactttaataggagagatttttcattatatgcagtgagcctggacatataccaatacagtggcatgaatattgtattcttccttcttccgaagggttatcctcaacctcctagttaggatatacaagtctgcaaaaaccaccattgctaccaaatgtatatgcaaccaacatgcaaatactttagccaaatgcactcgccatggattaatgctcacctagtgccattcaaactcacaatcgattctggatcgacgtgcattagacatcgcatgtcatatgcttaagaaggcaacctatggtggcaaaacgcattccgatgcgctcaacaaggagtatgatagcaaagtgcgcggccactagcctgctctgccaagcagatttttgtggtgcagagttgtgttaaagtccagctcgtctaatgcccaagtttgaccccaattactcataccaaactctagaattgggtcatagttaagtagcatgtattaggtacgatccacgagcgaattatcaaaccacatttgctaatgtcccctggacatagccatcgagagataatccatacctccgacaatggtaatattcacaataaaaccattatattcagacatatccacaaaaatagtggaatgtgtcggtgcaaccgtcgttggcataacgagctcaacgcatgcaacacgacgaacctttgcatggccggcacaagtccacacgcgaaaaacgccagtgtgcgacaaacatggtcatcaacccgtgggtgatcaaacaacacaacctgggagtagttatcgactacgagagcgcgataacacgcaatagtgcatagccaacatttgtctgaaatacagttacgtcgaactgtgtgagtggttgtaactcctcggattatacactaattgttcttctaaactaaagcattttatcaattccagcataaagataagctttagaatagaacaggaaagaccaagaactttatttatctgagaaatatcgatctaatgcaaagttccaaactaagcaaatgataaactgcttggcaacagtatagtcgaccaatgtcctcctaggacatgctctaaactagccatacaactcccgttgtcaaaacaactttattagacaaacactagcaacaattggtcaacaaccagaggtggccatttagcgctagatccacccgaggaccgagactgggtcaacacccaagtcaagctgttggcgctatggtgaagtgggaatcatacctattctcagcatctacccttgggtttattcctctagatttgccttctcttttccggtgtcctcgcaagacatcaggttccaaataatattgagaagatatgtgcacaccaagggcaaccatacgaacagtgtcattccaccacatggaaaacactttatatctttcaccgggctaggtgaaaaatatctcaaattattgaacctcgcaactccacgttgccagaaaattgaggtataatcgtttatctccaaatcagaaaagcgtgctctcaaccattgggaaagcaaaaaaatgtcgaccgtagtccgaccatactctgattgagatgttaagccattaggggaaaggcacaatgaatcccaaacacattgtctaattccacacatttcaacgactcagaatcccattcttgagtgtgatcatagggatagagtgatctacattaatgcccaaagccatacaatagtcattgaaggcctttacgtgaaatcacccacactatcatccgaatcgtttcatgcggttctcagagaacgcaacacgcaaacggatgatatgcgcagtgaaatcggcaaaagcatggatctcgtacaacaagtatacgtgactccatcttgtagacacatcgatatcaccatttatgtatggaggagtgtatcagtaaagagtggtcttatccatagccatggatatttaatttcccagaatttccatgcattaggtgattttctattatttacttggtcttatttggcattatattcccaatatttataccacacagaaaaccatcacacataaatgcatgaaaataaacccatcataatgcttccaaggggggattctacactatgtgaacacaatttatagaaacatcataacctagagaaccatctctagattatttagttggaattgcattaattttaaaagcaaagcaatgcttaaaaaacaccattacatggttatttacgagtccggagacccacatgcaaagccgaactatatagggcctaagcaacaagacatagacacacaaacaaaattaatataatctcttattaattacaaggttcaaactataaaattccattaaacagtgaactatagcgtaaaaacccaacactccaggggcttaaacgcaagttaccaataaaccgaaattaatcaggccgaattaccgttcaggccacgatcttatttgggctagcaagcacagtgtagcccaaaatgcctaatgggccgaatttcccaaactctaggcccatgaggatttccaggtttattatttttattaatttgtttgggttgtcttgttactgttgggctttattcggtcgggcggaggcagaccggcccagccggttcgcctaagtgaccgagagagggaaggggagggggggaattagggtttcccctttcccattcattgtccgcaacgacgtccaccgcccggcgcaccggcccctcaggcacggcggcggcattggaggccattgactgtcgactttgaagggatttagggcggtgcacggcgaggaggtcatcgacgacccatccactacaccgattggcaggacggctatgatgacatcactcctgtgtggcaatttggtgcggcggcggctcggtggcacacgacggagctccgcgtcgacccgcgcatcctcatgacggcggcgaggcgaactcaacgacggcaactgtgaccccaacaacggcaaccaaattgcatccggccatatcgtctcggcggaggttaatccggtagcagacagccgacgacccatcatcctcccaccacggctcgacggcagcgtcgatgggaggtcaacggcggcggcgcctcgcttcggcattaactccggcggcaacggcgatatgggtttagggctttttctgagacggcggtttcccgcgacggcattgacgtaaggccgacggcgtacccaacagcgacggcgaacgatggccaacatgtctctaagtccgactacacaggctgagaatatgtcaccgtattcccggtgtggcgtcatcaaaagaaagagagaaacagagatgcaagggaggcgggcgagacggccgattcggcccagccgaattaggtacgtctccagtccagggtttcccatcaattttaatgatttctctcacacggttttctctagttttcatcaaataaaatagatgcatatagatcaaaagcaggaaattaatctaccgctagatcaagagcaggatcaaaaatctactgcaagcaaagcatccataatatgataaaaacgagaaaatataatcaatctataaaaacagcatatcttaatagacacatgcctggatatatgtatctatgaattagtaaattagtttagaaaccaatcttactaattacccaggttcgcatgctcacaaaaatctttcacgtgcatgccgcctcctgctgcgtcgcaggtcgcctcaggaacggcgcggcgtcgatcggtatatcgcacgcatctgtacgtgcatgtgtacgacaacgatgacgacaggtcgtctcgcaagatacgctagctgcttagcacgcacagcacctggtgctcgtctcgcaaggaggcgcgacgatgattcagacctcgtcgaccggcggcatacatgtatgcaagcaaaacaaccatcaaccattaattaattaatttgtaatcagaaatcaatctactgatgtaagtgcatgtgtcgatgcatgcatgcagcatgcgtattggttgatttgccatcaatcttgtgcatggacgccaggagccaggtccatccatgcttgcgtgtggccagcacatgccatcgcgtggaggtgcggcgtccagtgtagccgcagccgcgtggcggatcgcgtggggacgaaccgacgaagaacgggccggtgcactaggagatcgagcaccgacactccctacgggcgcgctcgatcgtgcgagggcggcgggccggcggccacatcggacgacaggagtagtgcacgctgctcgcggcgtctccacggtttcccggctacctgctcggtttcccattgcgatgtctccgcagtcgcgtgatctcgcaaaggaaaccaggacaaaacaatagatcaatctgttgacaaaacaaaatcaacagattggaacgacaaaccggtgaacggagagctgctgataacgtgttgtaaaccaacgcgcctattagcggatcaccggatccgttccatatccctcccacaatagtataggcgtgagatgatgtagaacacctgcgcccatccctttgccctcaagaatattgcagaagtagacaatgaacacagatatagggtggagctctctcttcattatagatcttatctggagtacaagccaaccattagccatagatgtcacaccctccctctgtatatataggggtcttaggaggagatagatcttatctctactccggttcggattggtccacaagaaaggatctttatctccccaggagataatattccgtaacaacgtgaacctttacctgattagatccgataatcacggtcctatactttctttttttctcacgtaacattgtttttcttttttactaaagatttgaaacctatcaacttgaattttaaaaactttcaactacaaatttaaatttttaagtcaatttgaaaacatttaagtcagattttgaaaatttcaagtgggattttgaaaatttttgacttgatttttgaaatttttaggtcaaaatttaaaaactttcaacttttcatctcaaatttgaaaaactttcaacctagatttgaaaactttcaactcaaatttaaaaactttcaactcaaaatttgaaaactttcaacttttcatctcaaattttaaaaacttttaacctaggtttgaaaactttcagttcaaatttaaaaactttcaactcaaaatttgaaaattttcaactcaaatttgaaaactttcatcacaaaatttgaaaactttcaacacaaaatttgaaaactttcaattatacatttgcaaagaggtgcgtgaaagattaaaagaaaaataggaaaggaatggcgaaaaaaaaagaaaaacgcgtccggaggcgctaaaataaaaaaaaaaagtgtgaacagaaagaaaaaaaaggccgcgggaggaggcccagctagcgccccccgcgcaaacacgccagctccattccaggcgaggcggtgagcgcgtccgcgggagctggcaatgtcagccccagacatgtttttttttttgcgtttttgttttattttatttatttttaatgactttcaacttaaactttgaactcaaatttcaaaaactttcaacttaaattttaaaactttcatttgcaaattcaaaacttgagctaatgctaatcttgacctaaaagttttgaaatcttgatttgaaatttttctattctaagtcaaaagttttaaaatttgagtcgaaagttttcaacttgagtcaagagttttcaaatacaagttaaaacgtttcaatctagattgaaagtttataaatttgagtaaaaaactttcaaatcttaagtcaacagttttcaaatgcgagttgaaaagttttcaaatcttagcatcaaagttttcaaaatataagccgaaagcttttgaaatttgagtcaaaagtatttgaaatttgggttgaaatttttagaatttagttaattttatttttacttttcagtttaaaattgtaaacattttaggagaatttggtccttttttttttaaaaaaaagagttgttctcacttctcgtgtgggctttcttatgtgtgatttgcctgtggctggagaggaataggccatttgggtcacatctatgcaagtgtacaaaagctaccacatactctttttttttttttgataggaaccgaaactttattactgaggtggtccagccaaatcgctggtcaccaaacgctcaaggccaggtggagtaccggcccagctacaggggtctagtaaattacaacccaattttgccaactcatgcgctaccttattacattccctgagacagtaatgaaccgagaaagaaatgaaactgctagaaatgacattcttgatctccaaaatcacaccccccatggcggaaagattgaaagagttctcctggagtgcagatttcagcagcatcgagtctgtttcaagctcaatcttcatcatccccctttcacttgccgctcctacagccgctgcgcaagcaagaacctcagaatggaaagcatccatcaggtgattagctccgccagctccggcctgaaccaccactccattatgatcccagataacatatccccatccaccttgtttggtgctgcagtggaaagccccatccgaattgatcttcaggacatcaggaatgggttttctccattttgccgttctcctctccttcatcttttttttttttgaaaccgtattctcctctccttcatcttcccctctttccgattcaactttaaatattcctctcgctaaccttcattggatactgagccagctcggctcggctcgttctggctcggtatgttaacgagctgactcggctcggctcattatctcaacgagctaaaagcctaaaagtgcagctcagacttggctcgttagaaagctcgagctagctcgtttagctcgcgagcaaatggggacggaaagcgatttcgtcgcggccggcggctagcagtgcgcgtgaacaacaaggagaggggaggggactcacaagcataggacggggaagaaaacagcattgctcacgagcttgtccacccgtttcaagcgttttggaagtggatccagacagccatcaccgacgctggcgccggcatcagcttcggtttcgacggcttttggcggtacattcggtccttcttcgccagcgtcgtggccacgctcgccggcgcagctcacgagctcgtcgggtcgacggcaacaatggaagcatgcggccggccaacaggacctatgcatatgcgggcgggcggccggcatcagcacaagcgtgcgcaggcaagcgtccggtcggccgatgggcgagggagcgccgcgggatgggaaggacgacgacgcatcgctagcgctctaccgcgtacgcaagggaagcgcggcggcgctttgcggcggcgttgcgtaatttgctatgtgcttgttttggagaaagtacaccgaaggtccctcaacttgtcaccgagttagaaaacgctccaaccgcaaaaccagatattcggggtctcttaactaatcaaaaccggcaaaatgggtctttcggtgattttgaccctggttttaacctacttggcggttgaataggcgtaggacccacgtgagctccacatgtcagcgtggccaagtgagcctctccctctttcccctccattctcttctcccccccctctctctctcttctctcctcttctcttcttttggctagccggccggcagttgaggagcaggccactgggcgaggcggcggcggcggcggccggtcgcgaatggcgtcggcgacgctgtgtcgccgccgtcggtgaagcggccccgcgcggccgggcgccgcggcgttgggcgcggaggcggaggcgaggccgtctcgcttcgtttaagtccctgtctcgggcggcgaggaaggtgaggacgaggttgacgtcgaccgccgcggggtcatcgccctccgtcttggcggtggcgcgcgcctctcggagtcgctcgccgctcggcaccggcttcatcgacaacccgctcagcaccggcttcagcgccgcgccgtccctcgccgccatccccaccaaccagtccgtcggccaggcgtcgtagtgcaggcggcgacggggaaagagaaggcaggcggcggccggcgcgcgagagggcggcggcggtggggaaagagaaggcaggcggcggggagggaggggacagctatcgttgcacaatgtttttctggtgctggatctgctggaagacgcatgcgagtcattacttgacagcatcgttgcagagaatgcaaagcgtttctgctcgatctgaatgaagctatctggaggcaatgtaagcatcatttttccatgtaaccatgttcagtatctatctactatgttaccccgatacggggatacggacacggatacgcgacacggcgacacggggatacgacattttccaaaaattgaggatacggggatacgctaatatatatatatatataaattaaaaatacagaaaagtagtaaattgaacagggcaaaaatagattgtgaataagtgctagaccacaaatagtgcatagaccacaaattaatagttcaacggtacatccaaactcgcaatgaccatagaagttcacatccagcccacagggcacgggcacacaactagtttataaataacaagttcacagccacaaatagaataattaggatagaccgataaacttgttcagtactctaagttcaattcaataataactagataggtagatcaatttaattgctgcttgtatcaatcatggtaactgaagtggctgaaggttcagcatcagcagacagatccaatgcaccaagatcttctagcaccctctcaaggtcaggctcatcaagtgaaagagcagcttcttgaagaaaatcagcaccaccctcgaacatctcaaagctgtctcctccaacatcccacattcttgatggaccagtacagtactcttcagatttcctggaaagaagacgcaaattctggtgcacaaacaccaaatcttcagcacgtccagggtttagcctacaataaagcaattgtagtcactgatcagttccatgcatttcaaacatacaagaaatttactaagtaagagaaggaacagaacttgtttctcattgaattatggatcaaaccataggtgctccaatttctttcagcacaagatgatgatgttggttgtccaagtaattttagcgccaatttttttaactcaggggcagagttaccataaattccccaccattgctttgcatccaaatgagctctatccttgattgagtcaaaggaattaaacccatttccaaacagcgagaaatctgcaaactgctgcttgatcttccttaattcatcaccagcaaaataccttctgaagcatttgtttctcatttctgaaatttctgcatccatgtgaggagcttcacgggttggaacctcagccaaccagctttcgcagtagtacctacattttataaaaacaattaataggctaacaacgactacaaattatggaaacaaacatttaaaagtagaagcagaacattacttggggttcagtgagtgtgccaagcaatgcaggggggtattactttttgcccatcgagagtacaagatctcttgcacatgaaagaaaaaggaggaatgctcatttagttctttcccttcatgacgataaactatttttttcaccttatctatcattgaatcccacatctcataaaccaaatggaggcaaggtttgtcggtgtcagctgcacgaatcatggaatagataggatcagtgaaatctaggatatactgcaccttatcccaccacacatcatttagaaccttctctttgacttgctgtgcttgaacttgattgtcttccctaataagaattccatttttcactcactaccatcaagattagagattctttgatagcacggaacctctttaacattacaatggtagaagcaaatcttgtatcaacaatggcaagaaattttagcttactgaactcattgaacatggagagcctcattgagtggttcatgatgaagttttttatgaaagaagaatctgctgctacctcagtgatccactgaaattcttcataagcatccccacttgaactcttggctgcacatatgttcttcaaggccaggttcaaggtatggacaacacacggcgtccaaaaaatgtggctgtacctctgttcaactatcaacccagcagccctgcaattagctgcattgtcagtgataacctgtaccacattctttggtccaacatcctcaatgactgcaatcatcttctcagcaatatattccttcctcttaatttctccttcagtgttgattgctcttaaaaacattggcccatcttctgtcactgctagaaaattcaagagtgggcgcctttgagcatcagaccacccatcggacacaatgctcacaccttttacaggccatgtcgacttaaggggatttaacaaccgctcaacatgtgtcttctcttgaacaagaagagtagttcgtagcttgttgtaacttggaggggaatagcccccaagcgcattgttgcaagcaaacataaaagccttcctgaaatatgggtttcttgcaacattgaaaggaatgcctacagaccaaaccaaatgtccaaatattagtcacatttgtaacacaaatatgagaatgtatgagttaataaaacgtactaaactctagtctaacctgctgtgtagaacattctcgcaatcaaagcatcaaggttggaacgagtatctgaattgaagctagactcaatagctgaaacagcccttctcttccccctactcgcgccctctgctggcagtgggatgtccttaggcaagttcctttcagcaactgctgcagctctagccatttcatcatgaagttgactaagaacatcgattgttacctttggacagggagctacaccattagatcccaccttcaagagatgtgctttaactcttgagtagctcccatgcataatattaccacaaagcctgcatctaaaccttacattccctccctggcctttacctgttttctccattaactcaacatacctccacaatggcttgttttcattgtcattgggaggaatcacacggcaagcattcaagaggttgcttgcccttgctggaccactagttcctcttgataaatcagtagcagaattaggagccggactaccactaggatggctagatgcactagcactagcacttgagcttccagttcgataatccatgggatctaacaaaaaaaaagatagtacttatactaagaaaagatgaagggcattgcattcttgcagatccactaaaactctaaacgaaataagaagagcattgcagtattgctctgctgcagtgcatagaatgctaaaagaggggatttattattcacctcaacaagggaacgaacaggaaaacagatcggcgacgacagtgttgtgccgacgtcacagtaggaggcggcgaggcgcagcccagtgcgcggcgccggcgcagctcggcggcggcgacggttgacgaggcagcccggcagcagcgacggcactggagcacgtgaggggcgttggtggtgacgctgttgggccagcatcggaggtggagagcagcgtggcggtgccggcgcagcccgtcggcggcaatggctgatggggcggcggcggcgctggagcgttggggaagagaggcgagagtgagagttgagaggcggcgcaggctgggtggatatgctccccacgcgcgcgcgggttttggtaccggcggaatattagggttaaacgtatcgggaccgtatcagaacgtatcggaaacgtattaggaattattttatttattttaaaatcaggataaataccgatacgtcctggacacgtatccgcccgtgtccgatacatgtccgtatccgatcgcgtgtcggacacagacacgcgcctgctttgccgtatcagtgcttcatagtctatctatgccatttgattgcgattcagaaaaccagaaaacactcacatcagcatgcatgtacccatgttcatacaatgtcaggctgaagtcatacttatcctatcttactataaagttattcccactaactaattaagcttaacatataaagataccacatcattatccactaacaagatgtcacataatcatctactaattaataagatgccacatcatcatccgctaacaatcatcacatttaaacattatacaaacttgctatatctttatagtttttataatttaagagagcttttcaaatacaaacatgttaaattatcatccaacataattcacataatgtttcaatatatatctttattatgttttatgatatcctattacttatatagttcatcctcacttagttagtgcttaaatgattaaactatggtccaaattatctttctcgttttttcctctaattaagtcatcatatcaattgtttttatcctttagatgattaatctacggtccaaactatctccctagttttcttcttccataaaatcataccaacttactttttacgtttgaatcaccattctacatactatttaaatttaaattatcataaaccatattaatttacttaatctgatattatatagctatcttacacgttattttttttattattatcatactaaattcccgcagcaatgcgcggggtttaacctatctagtatctttcgtgtacaccatgatttacactgtaataaaatcaccaactcgaattagagaagctgaactgttttgttagtaacacattgcacatgcaggaagaagccaagccacccctcgctgaggagcagcgcgacctccgcgtcagcgacgacggcgaggtagtagtcgccgcctcgccggtaggctcgggggacgacgaatccgacgcgtacgtggcctcggcggtgtcccagtggatgcccacggccgtgtcggcggcggtggcgagggacctgctcccgcgcttcttgtgcagcacatgttgggcgcacctcgacgacggcgagagcgcgtcgtcgaaggcgacggcgaggcaggtggctccggcagcgttccgcgtccacgtgacccggatgaggagctccttcccggagtgcagcgaggcaccgtacaccgccgtggtcgccgcctgtagcttgcgatccagcgcgccgccgcacccagagtcaccggcggcggcagcggcggcggcggcggcgatgcctaccgagctgtcgccgaagcacgacagctcctgcgtcgcctccggctttggtttttcttccggcgagattagctgctgtttgctattgctgctgcaataaaagagagagctgacgtggcacgctgacacgtggggtccacgtgggttccacgatgactcagccgtcacgtaggctaaaaccgaggtcaaaaccaccgagagacctaaagcggacggttttgttagttgagggatgcccagtatctggttttgcggtttgaggacgattttgtatctcgatgacaagttgagagaccttggatgtactttttccgcttgttttagcctagcctagggtttggcatattaagggctgtggtgggcctcgtggatgattaagctgctactataggccttgtttgatgggctatccaccggtgggcttcagcttgttttggctcacgtgcagctcgagctggctcgttatgtctaacgagctaaaatgctggctcggctcgttacgaaatttaaacgagccgaaccaagtttatcacgagccgagcgagctaacgagtcacgagcttcctgtccacccctaatgacataggccaaatcagctgggtctgtggcttttcctccttccctttctccgcctccatagtatttaatatggactgcattgcactcaataggattccataaggtctcttaagttctacgttgcaaggacctttcaaattaatttgaattatttttggattttggctatctgtcagtaatccctttttgatattgtcttatggagattggaattcagtatccacatgtacagtttcaattatgatggtatcagtttgctgtatgcctttcttttcagtgagatttcagttctgtctgtatatgtgaatctgatcttgtgctgcaagaaaataatgcttcgttttgctaatactgcagctgaaggctacacacatgacacatgtgcatatttttgtacgagaaaaatgggcacaattgatacctgataattgcatgcattgatctataaatagcctattagtactggagcaaaataaaaaatgcataacatagaaggctgaagctcttatatgctctcacaagtgtatggtggcaaagaacacatgaattttggaagtgattttagaactcacagataatgttagatcaaagaacactttcatactatatatgagctcacatactgaacaattccacatgcacagcatgtcacatttaacaaaaaaacaataaggatctcgttactgcacaggttcaactaaaacacagctctgtttagctcattggctgttaacaatcagctactgtccacttctctcatcatttacaccatgcgtactcttaactggtttagctcacgcccgtcagaaatcagcagcaggtcacttcttctccttatcaatttacaccattgtatgctcaagttgtaagtcagcataatacgtggcaatgaacatcgcttcaaaaaattcatcaagaagcccagaaaattgttcgttgaccatattcccgaaatctttttcagagaagagtagtttcctgccctctaccaccttcgacatgaaatgctgataagtatttcttaccaatctcagcaaggagagaacatcatctccgtagatgattggtacgcccgtgatgggatctttccagtaaaaggtctcaatgaaataaacgttgtgaagatccatcgggctccaaccagagaatatcttgagacgttcaagcacaaaattgtatcctgctgggtctgttgttggcaatactagcagtttattgtacaatgatgtaaagacatgcatcatttggtgctcttccatcaaacagtagtgatagcatatcagatactgataagcagttggatctctcataatcatacttagccatctgtgaatatcttcaggaactggtaaagattcaaagagttcttcaatagtcttcacatattgataaaagtcaacctctgcattggcctttgtataggggtctaaatcatcagcttgaaactcatccatttcaatggtcatctcgtcacttatcagaaaatttctcaatgagaatcgaccagcgagtgagtttggctgactgtgcaacttgtaaagggacctaacacttcttcgtaacacaagtcgagtgctcattcttgtgatttcatatttccttgtccttccgcatccaggaggaatgatagtatctgttaacctcgttcttcttcttctagtatcaactaaagttgcaagagctgaggactgcagaattcagtaaattaggggtatgaccagattgattccaggacactatctactatcacgcccaaaccaggaactaagttgatgaaaatacactataagaaaaaaaaaatctaaaacagaaaactgagaatggaagatttcatatcaacaagaatatgccacaaagaaattaaaacttagtgaccgcattagtatcttactgaaaacacaagaacgatcataggcgaaaagaacaatatatgcagtagatgcacggatcataggcgaaaagaacaatatatgcagtagatgcacggtgatattattgaggagcaggcagataaaaactacaccctccatcccaaaatataacttttaaccttcaaaatttgtcccaaaataacaacttcacaagcattcctttcccaaccaatgacaaccctacatcattcaatttttccaccttcctccacttctcatccaaccccattaaattatacctactttcttaatgactgtatccaaccgtaaaaatccttatatgctgggacagaggtagtaataacttaactctaaagcttaacagcagcaagtaatcgcttcatttttgttggttgttcagtcacaaggcaggatagatacacaaaagtttcctaagttcagcaaaaaacagtaggacaattacagaggccgtcacgatccaatagtgtcaattgcatgcaaaacataactacaatccactattaacttatgatttagtacgcgcgtacaagaaaagatattctgctgaacagctagctgtacaagaacttgtgcgtgcatgtacacagtattatctgatgatctacaccctgaatttcataattcatatacttccatatttcaacattgttgaatgttaaagggaatcaaaccttatgatccttgcgaagcgatgattttgacatgcttgctctaggattttgattggagcagccaggtcgctttctttttctacctgaacgctgtttacaagagaactggttaaaatcatatatctaaccagacttggtagcaatgtcgagaatcaatataacaatcaaacatttcattcaacctaggaaacaaggttgaattgggaattaatgtattctaaaaacaagggaatacatggcactattaaacaagaaacttttgattcgacaattgtttcaactcttcttaaccacactatgacttcaggggcaattataggcagcaacccagcaaaaggctgaatcttttagaccaaacaagtatggtcagtagtttgcatctacgaggcctgacttaagagaaaccatgtccggtgatacaaccccaaatacacatccagacaaaagtttcctataaacagtccgataacactgaaagctgctcatatatctagcttcaggatttcttaccaaaatatcgcactagtcataatatcggcggaaatttcctcatattttcgcagtaaaaaaaaattgtgaatgtacacaaactgacaaacatgtggtccagattctgattttcaacattataaaagattacaaggagtcaagtctggtgatccgcatgaaggtgacaattgtgattacattcttttttatggatttcaattggacaacacgttcaccttcatcttatatccaaaagttactccacaacaaaacgtgttaaaattaattcatattagcagacttaaacccaattgcagggaagtaaaaataaagatcaagcattttactaggaaacaaggaaatatgggatgtatggagtttttcaacaactgattggcaagaacacaaaactggtgcttctgcaatttgtctactcttgccaattatgcttcgggccttcatagccaattccgggtgccaaccagccaaagtttgaatcttttcgaccaaacaatagtgcgtgataagtgattttgcatgtaagtggtcctttatttagtgaaactgagcccagcaaagcaatctctattccttagtacacatctggatgaaacattcaatgaaaatgaaagctcatacagtaggaatgaaatcaccaataaatcccccacatttttactgtcgattaaaatgcatcacattaaacagaaaatcagattaacacgagcaggagcaactaagtctcaacaattccaacagtcccagtgtcaaattccatagaagatagaaagaagacctacaagtagttaggaagtatttcgcaatgcagaaagccaaatttgcccccctaatttgcccagtcgattttgattctattctaagatgtcacaacatttcaaccaagatttcttcactcaagtacagcaaaaatcagccaagactttcacactggtaaatacaaataaagaatgccaagatcctagttccacattctaatacacaagctgattccctaaaaaaaaaacttttttttactgtaaagcaaacagaagaactccccatgttcctaacacaaaagatggcacaagagttaacttatgatttactgtgcacacaagaaatattgctctgaacagctagctgtacaaaagcttgtgaatatatatatatatcatgtgatctatcatcctgacatttcataattcatacacttccattttcaacattattgaaggttaaaagcaatcaaaccttttgatcctcatgaggcggtgattttgaggtgcttgctctagtattttgattggagcggtccagatgcttttgttttctatcgaaaatctgtttacgagagaaccggttaaagccacacatcttaccagacttggcagtaaccgcagagaattgatataaagatttaataattcagactagcaaacaagttagatagggaatacatggtattgtaaaaaaaggggaatatatgcgacttttaaacaacagactagaatgcccagaccagccaagaatgataagtaaacgtctccttacctttctcctgtcatacgcaagaatgctacttgggattgggagtaacttctcctcatgtggatttgaactattaatagaactaggagggagtgggtagatgatgtcatagtgagactctatgcgcagcaaggtcacgcaaggagcgccgcggacaatgtagtgcgtactttcgcaagttccatcatgaacgttctccacttggacggtcaccctgagagcttctgcacaagcttttactgcagcagaggttgcgtacacacgaggagcaattacgtgcttcgagcaccactgcatgcatccagagcaacaggtcagtcaggtgaaatgagtgtgaagaatatatagttgcattcagtttgtaacaggtcaggtctctaagggaagtgatgctgatactaacatcttccagattctgattttctccacaattagttgcacaccattcataattccatatgcgcgtgcacatccaggtagctgctactaatctgaggaaagcaaaaactgatacagaagaaagcatgtcagaatcaggaaagtggatcagatggaaggaatgaaggctcaaggtgttttctcactgtcatccgttgtatcataactgctgaagaactcaagaatcttccccctgtcatgagatgaaaaaaggcgcatgttcagtcagtgagatgggatagtacatttagaaacaacactcttccggaattgcagaaaaccaaacatttcaaaacctgattattgatattgggtgctcctgcatgcgcttccatccctttattttctctatcagcctctcaaatgcctgcaagaatcaatgatacaataaatcataacataccgctggcatctagcacccagagagtttaaccagcgtgttacaatggcgcttacagaatgatgatcatcaataaaacatgactagcataacttgtcggacaagcttccatagttaaacatcaagtatggagataatcattagaaagaacatttgatgagatagtagtaaggaagacatttgtgatttaggatcaagatggccaaaccatgaagcagcatgtgtgcagcatttcagtcttgaacataagacacctataatatttgttcttccccattatattttatcactattaatgtccaactgcaaaatttcttgcaaggttgaatattgttcaatcaggaagttaacttcacaaatttataattagaattaatgtcaacagggtaaaagactgcgatgtcatgccactattgtgaaacaatggtgtgtatctcctgcaaatgataaaacaaaggaagtaaaatgatggatacagattggtttgtacaatacaaatttagattagaggaatcatccattacaagcatgtttatgtcagaaaaaccaatataggggaaaaagcaaatagggaagacaagagattactttgtgtttctgggaaaattcagaggcccattgaagattttcagctttggtagccaatgctctaacagcagcaagaaggcggtcttcctcacgtgtgcctatactatcaacaacttgctcctgtcatacattgtcaaaactaagagagttataataacattgaacatacatcctatgctagggaatagggaggtggacacttaccaggtaggaaaatatgaaactcctatagaaacattcctcatctctatgtactggcctaaattctgaatagtgatggctgagatactttaaacgcaaaccaacttccggttgctggaaagaattatcaatgttcctgaaataatgatttgcagcttctcccatgggaattttctgcatcccacacacaaatacacaaataagggaactcaactaaaaatggtatatgcataagaaaacaacataactagaataaaatatattttatgttttatatgctccacttttctggtgtttatattctctgaaaaatgcttagaaataattagaattatcacttcgtttttattgattggttgttgtaaagtcataaaagacggaatatatgcacaagatttcctaaattcagtagcaggcctattccagaagccatcacaatccaatcctttaattgcttgcaaaacataaccagatttaacttatgatttagtatgcatacaaaagagatattctgttgtacatgaacaattgaatgtacagtgtcatgtgatctatcatcctgacatttgataaatggtgcacttccgttttcaacattatctaaggttaaaggaatcaaaccttgtgatacacatgagcaggcagttttgatgtgcttgccccgcaattatgaaacgggtagttcactggttctccttttctatctgaaagctgtttacaagagaacaggttagcatcatatattctcaccagacttggcagcaatctcagagaattagtacaaagaataaacactacagactaggaaacaagggaatatatggaacatttaaaaaacaggctagcaagattggaaaactagtgctttgacaattttgtcaactcttttccaatcatgctatgggtattctgagaaaattctaggcagcaacccagcaagacacggaatcttttagaccaaacattagagtatgctcagtgagtttgcatatacaaggcctatgatttggagaaatcatgtccagttatgaatcccaaatacacaccaagacaatttttttcatatatcactgtcctaagactgaaagcacatacatgcagctgcaagatttcttaccaaattatcacattagtaataatatggtgtgacagttcctcatattttcgccgtaaaggaacttgtgaatatacactagatcatgaggtctaggattctgaccctaattttatatgcccattttcaacatcatcacaggttaaaaggagtcgaatctggtgatcctcataaagtgaggataggtacttttttttgtggaattttgattggacaatgcgttcaccttgctttcatgttcaaaagctattccacaacaagatcgattacaggatagtaatatcaggatcaaacatttcacactaagaaacaaggaataggggatacatgaaacttttcaattacagactagaaatgtcacaaaactggtgcttccacaattttcctactattgctgattacacttcgagccttcatagccaattttgggtagcaaccagccaaaggttgaatattttagacccaacggtagagtacaccaagtgatttcgcatgtaagttggtcaattatgtagagaaattgaacacggtaatgcaatgccaattccaaatacacatccggatgaaccattcaatgacaatgaaagctcataaattcagctttaggatttctgagcaaaaaatcacactagacatgacatcacccaataagtcccccacaattttacagtgtgattaaaagtgcatcacgttaaacatcaaattacattagatcaagcaggggcaactaataagtgtcgacaatttcgatagaagatagcaagaagacctaatagtagtcagaaagagtttattcccaatactggcaatacagaaagctgaattgccccccaacatttgcccagttgattcttttttttttctttcttttttttttggtcataaggcctagttgatttcaactctgttataggatgccacatcatttgaacccagagttctccgccccaggtacagtaaaatcaagaaatcaaagattgccaagatcctagctccacattgcaacacaagaatacaagatggcacaagaaccgcatctaaggaacaggatagcacgttcgcaacggtgaaagatgatcccaagatttcacacgaacgacaaaaatgcccagccccagaccaatcaagaatgacaagtaaacttctccttaccttctcctcggcgtcgccatgatacgcacgaatgctactcctgagaagcttcactttgggggaatcagatgtcctctcctccttccttcgtgcctgcaagaacccaagaaatgctcaagaacaaatccaaaatactccaaggtacccaacacaaacgccatgacagcacaaatgcaagatgggaaccattacctgttcccgatcatcagagactgtaaaagatccttctccgatctttctctttcctttgcggtccaccaatgcagcggcggcgctcaaaccgtcgatgccgcggcctccgcctccgggctgctcacgggcccgcccctgggtgaagcgctcggtgggcgagcgaggaggcgagcgcggcggccgcgccggcccagagacaacggcgccgccctgggctgcggtggcgcgggagctggactcctgggagtgggactcgcgtcgcccgcgcccggatcgggattcggtgatattcccggtgatattacattgagtcactgacattccgagaatgtcacggagaatgtcaccgaatcctagtcccccgcgcccatggatcggtttcgtcttttggtgggttcgacgcggacgccatccacgcggacgggaaaaacttgtgggaagggcggaggggctgatttgctagatcccaattatgagagggggcggaccagaaatgtgtggaggttgtttcttttaattcttgaaaggcaagaggcttatctataaaggtgaaagtagttctgattcgtgagatggagtagctgataggggtagggacctggcatttttccagtttaccccttttaattctaaaaaaaagtttgccccttttaggggaatttaactatttatcactattaggtttaggggctgtttggacagtactaaaaattattttttaagtccctgtcacaaaattattttttaagtccctgtcacattatatgtttgaacactaattagaagtaataaatatagactattagcaaaactcattccatgattagcctggactaattcccgagacgaatttattgagcctaattaatccatgattagcctatatgatgctaagtaaatatgtgctaattatgaattaattaggcttaaaaaattatcacgtgaattagctcttatttatataattagttttgtaagtagtctatagttaatattctaaattaaagtccaaacatccgatgtgacatggacttgaagtttagtccctagatccaaacaccaccttagcaaataaccaaatagctctcttagatttggacttacaagagaggtgaattattaactatttgccacttttgatgacgtggcatgctaacatgggaaataaaattctcacccctttctatcttttgttatctccttcgtcctccatcgctgtatcgccatggccgacacgcacgctcatcttcctccttatgcccgcacagtcgattgcactaagctgtccacgtagctacctctagcatgcccaaggctcacgactgcttgcaaaaaggcaagaccacgccctacgccctatgccgcagttgcccccgtcaaacgcggctggcctcctaaggtacgctccatcactcttatcgagctagcctcctctaagagcaagaaggccaagtggacacttcccgaagctctccagtggcgatgacaagcttgttttcaccttgtctccctactttgaggccgagtgcaacaacagccagccaaactaaatcaccagattcaaaaggaacatgtttctttcctttgcttccagcaagtttacacctagtattcatgtgctctatgttctccttagtggtctcatgcagttttaacatcagttcatcacattgttttgcatcaaagttcaccctctctgaagttgggaggggcaaaagatcaataggagcacggggtagaaggccataaataatctcaaaatggcacttcttagtagtagaatgttgcgaacgattataagcaaactcaacatgagacaaacattcttcccacattttaatattctttttcaaaatagctctaagcattgtagataaaattctattcacaaccttagtttgtccatcagtttggggatgacaagtagtagaaaataaaagtttcgtccccaacttagcccacaaggttctccaaaaatgactaaggatttttgcatggtgtttggcactatggtgttcacttgcatgga

SEQ ID NO: 68264 - DNA, 502 bp, Oryza sativa
gacatcgcgggcaccgtgttctgactctgagctagggtttcctcttcctccctctcgattcgattcgatgcgagttgtagaggcttaggctgctggaataaaataaaaagaaaatcagaagatgatgggccgggcctacccagacagagttaaagcccaaatccatcgccacctcttgtctctcaagagaaacggctccaagttcttttcctttttctacttactattattattatataatatatataaataatcctcacctacccgacaatctctctcccaccccacccctttctcgtttcgttggaagaagaagaagaagaagaagaaggtggtttcgctggaagaagaagaaggtgaaaccctagatctgatctcggatgacggcgcgatcgttgttggccggtaggatggtggcggcggctcaccgcgccttccgcagctggcccctccacacaatcacaaccaccaccaccaccgacgccgccactgccatcgccac

SEQ ID NO: 68265 - DNA, 7383 bp, Oryza sativa
ttttaaggaccacctcttcctagcataaggttgcaaatagatcaaaatctatatcaagcaattaaaaaatgggagtactgaaatcagactaaccatttcctcttgggttaagatcattctctgagtcatggaccggagggcctttgtttcagtctctgcttcctttagctgctccatagctgttacaacctcttctttggcacactattcaaagcatgagaagaaaacatggtcaaataaaacaccatatacaaaccaacactacttccatattttgattggtaggaagtatatttacatccagttcatgctttagtgttgtcacttccccatctttaccatcttttgattcccttgcagccttcagtgcagcctgtagacaaaaagcattatataaagtgttcgttgatgggtaagaaatatcctctttatttttctggtaaaattggaaggtatgtactccagcatatccttcaggttcagattttttttttacaataagaacctagcatgactatagtaccgcatgtgcatttcaagacaaataaagcagaaaaaagatcaaatgaaattccaaaatgtttcatccttttgttttcacaacaagaaaaacactaaaattctaacacttccaaattttacatataaattctaagataaaaaaaacagtactacaagattggcatgccagctatccataggtaaaacacaagaagaaaaactaacctccctctgtttaagggcagcttctttcctgccaataatcatgacaatgttaggttatgagtctatgatcagttctgaatttgtgaaacatgcatatccaaacatgatgcaaacctgctcaagaggcgagcttctaatgataccccttccccaagggcagctacctgcatatcaacaaatataaccttagctaaccaaagatacaaaatgctcagtgtaatgaacacctcctcaagtaaaggagaatattcgttccaataattcaaattcaagtttaaattgtagtgaaaaattcccgccaaaagaaaaactgtagtgagaactagagatagactcaatgtctagtgcacatgtccaatttatcataatacaaaaaaaaagataaaacaatgtttaatataagattatctcacctgtttctcaagctccttggctctagcttctgcttcttcacatctttcttcagcaagtcgtagctgtcaatcaagattcagaaaataatttgttaaagatcagtataaaatcaagtactagattgcctataaaacagctctatggttgctatttcaccttttctagaacactctcattctcctcttgtagtatatcaagctgtaggacagcattgcattagtcttaaaaacatctgataaacactcctcaaaaagttctaggtcaaagttcgtgacagaaccatgagctaaaatatattatacgtataactagtttatagagaataaggaaaacctcatcttgaagtgcagacgcctccctttttggtgttgattctctggagttgagatgccctgtatcaaacctgaggcaaaaaaaaaaagtaaataacttacctgatgcctatttttaggaacatttgaaaaaatgggaaaaagaaattcaagctataagaagtggccagatggtcataatgtgattattccaaaactttaatgcaacaagcaatgtggtgcccctagtaacatacttaaaagagaaaagggtgcgtttagcatggtggacgactaaagggcactttattttactaatcctagatatattaactagtcagcaagtaaacgtgcttgtagcatgatggtaaataccttccagtgggaagctaacgaccagggttcaaatcttggtcttgcaccaaaaaaggtcactcgctggttctaccaaaacaaggttaggaattgatctatcgtccttgtgtagggggcaagagcctcaaagcatggattaaggcccgatccatagggggcggctccccatgtaggaggaccagcttttgtggcctttctggggcctcggtttcaggtgcttcttcttaattgaaatacctcaggggagatctttccccttggggccgaattttttgttattattaataactagtcagcaatgcccttttcagcacaataaaagaaatcatttgctagaataggtaaaaattatgtataatttgatagattctgcggcgcagttcagcaaagcgcggtaataggaaactggccaagaggcacacccacaaccccaagatgctgaccaattgattcaatcaaatatcagatttcacaatttaggtaagcgattaagatttcggacgcataataatttactacccatccttaataagcatgtattattgaactcaaaacttttcaatccattacgcccaagataagagggctctccactataccgaccaaaactgaacacatagtttggcatagggctgttggttcaaccttatgatatcaatgcatctttttttactaacaacgccaccaaccaaatacatccctttatcaagagcagtttagttaatgttgtgaactaccaacatcacttcttctgaaaaacagcgcaagcagtaaaaataactcatttctgctcgatttggtggggttgctagtacaattaaccatgcattcattttaatatatcctaagagaagtagaacttaaggaatgctattttaagtatagaaaacacagagaatgctgcagaccatgcaacagatctggggaatgtcattgacgtaccttttctgccgactgcggtccactggaggctccacagccacaggtggaataggcgatggtgtccgcaatgtcgtgctggttttgatcggtggaaccaccgtggtggtcggccgtgaagcaacggcaggcctcccagctgatgttgagcggacagtaggaggtggctctacaatgttcctacctaactaatgaaaacatgaggagatcaaattagcagaagggcacaggataagcggtgatcaaatcacgaagcagccagaagtcccaatgcattcatcacttctcccaatttttacaattcagaaggcatcgctatagaattggactgacattggcgagatgtaaactagcttcactagcaaattcatctgctcaagcatgcttcagaaccaatttgacttccgattgaccaactatgactcattcgtgcaccgcgacagttcaaaccatcgaaatcctaagttgagacgcagcgggtagcgagatcagcgagagatccgggggaagcagaatttaccgcaggggagggagatctcgcggtgcggccgagcaacgagacgccgttgctgccgtgcgccgcggcggggcgcgcggagccgaacctcgcggggggaggggcgggcgggtggtcattggcgtagtcgtcgtcgtcgtcgtcgtcgtcgcggcccgcggcggccgcggcgctctgtgacgccatgacctgggccagcctcgcggcggccgcccgcgccgcgacgttctgcgtgcggcgcacgttggagacgccgccgcccagccccgcggcggcggaggcggcggaggaggtggaggaggagcggtggtgggacggggagacgccgcccggggaggaggagcccgtgctgctgccgctccgctgccgcccgtagacggggctccccgcgcggaggcggtccatggcggaggcggtggcggcggcggcgctcgccggagggatctgggccgcggcgcggagatggcgaggcgaggttgagaagtgggaaggaggttggaggagagtacgctgctcgcgactccagtagagtttcgctgttttttttttccttctgttttgccttctcgcagtaaaccccctcgtcttctcaatttttaaacaactacgcgtacttgtacatttatgtttgtacgttaggagtacacctagtagtatttgattgatttgtgagtgtttcttggatataataccacatctgttttatattataaattattttaattttttataagtcattttatatttttaacataaataaggaaactatcagagaatatattcaatgttaaatttaataaaaccaatctgatgctataaacaatatttttcctataaattaggtcaaactttaataagttaaaattttagaaattcaaaacgtcttatatatggtatgaaacggaaggattatttgcttttttggataatggggttgatttcattaagtaatgaaattacaacatgcttatgcactttatgtcaatattttcttatataagagaatatattacatgtttactgtaggagaatattccatattctattaagtgatactactattccatacttattacaagataatatttcttttttaattatagcagcaatattctctcttatgccaaatttgtgcgaccatgttctgtttgataaaatatggagaaagacacggtatgatactatagtacttacatacttagctggcacctgtcatgttagaaaaagatccgcaagccggttatctactaagtcatatatttatgtcgtatcttattatactccctccgtttcaaaatgtttgacactgttgactttttagtatgtgtttgaccattcgtcttattcaaaaaatttaagtaattatttattcttttcatatcatttgattcattgttaaatatactttcatgtacacatatagttttacatatttcacaaaattttttgaataagacgaatggtcaaacacgtgctaaaaagtcaacggtgtcaaacattttgaaacggagggagtaatttaactggatgagcatgtgcctctggggcctttatgtatgagtatgacgaatcaattattatatatgcacattaaagagataattatatgccaagtaattagcattgatatgtaactatatatggtatagatcaagatttaagtggcatgtattaattaatttccaattgttggtgccctatagctaacttttattgtggttatccactttgttttgcttttaataataagaatcttccatgttcctttcgagtagaagagagtatctgtataccttatggattccattatggaacataacccttattccgcacatttctttccatacattatgtgtcccattttagggtcaattccaatgacaacgctatgcgctagtacatggatgggcttatcttatacggagtatatgattatatgtagaaatcgcacgtcgaaatttcatcatagatgatactacaaaaacagaagaaattaacaaaaagaggcaataataatagtaataaacataaatacctaacaaaacaaatggttgatgtagaaagaaaaaatagagaggacctaggtgtaaaacaaaaacacatctactccgattaaaaagcgaaattccactctgggtgctcgcggacgagagcgatgttctcgctccgtgctggcgcgcatccgatccgatccgctgcggcgggtgagccacgcggggacgcctccatccgccgtccatccacgcggccccacacgatccaacggccagaaacgccacacgcacgggctgctcggtgttcggggcccccgcagcggatcagcggggagcagtggttagttggagaaaatggtgggggcatcaagcccagagagcggagaggacgcaggttaattaccccaccttaattcgcagccacaggtttggttagatctgagatccaacggctacgattcgagagggtagtgtccctcgaaaacttcttgggctctgtaattaattaatctccaaaatcacagttgatctcagggggaaaagaatctgcccatctgggttaactgcagctttcttgatgcagcctgcaggtgcaggcaaaaagcaaccttgttagttcactgttctaattgataaaaacacattaaagatctcatgtcaccttgtacccgagctcagtttttttactttttcatgtgttgaatcgtgattcaaatttatttgcacttagtaaagaataacttctgctgtagcaaagcgtaggtccgttgccggaggcttgggggccaggggtgcaggggcggagcccccgcggtacaaatcgtcatcccttttaggttccaccatatatatatctcttgtaagctgccgtgcggcgttgtaacctcaccctgatacagtgaagatattctgctggctggcgcccgtggttttttttctctcctgctttagaagggttttccacgttaaatcttgtgtcttctgtgattgatctattgtttattgttttttattgtttgtttgcctatcgcgcttcctaacatcatcgaattattaaagattatttgctttatgttttgaaaaatatattttcacaaaaaaaatattgtattgcttagaaaacaagttatctgttaagattatttattaaaatgtttaaaaactttttttaaaaaggagggctaagtccttgcgttgcttggcttggcattcacttccaaataataacccagctggcgaagctggtgatcgatgagatggagctagcaaaataattatgattggcaacgtacgtgcacgcagtacaagctacagccaaggatcacttgattatggggcttttaactatttgacacttttagatttgacaaataactatttaccatccctatctcaatgacatatgggtccacatatgtctatgacatgtgggcccagtgataaaaaagttaattgccacatctaaatatagtaaatggttaaatatctccttgattatacacctgataaatcacagctagggtaggcttcactgccttgcattagcttaggccgagtttagtttcaaattttttcttcaagcttttaacttttttatcccattaaaattttctacacacacaaactttcaacttttctatctatcgtatcgttctaattttgacgtgaactaaaacacgcacttggttaaatttagagtactacgatatacatacgaccatatcgtacgagcattcaaccacgtctcatctatcgatccttgcattcggcatctttcatgtgtgcctagaaaaatactgtaataattgtgtctgtgcaagtgaatcgtacacacacatatagctactctaaattactccctgacaccattgatttttcgaccaacgtttaaccatttgttttattcaaaatttttgtgcaaatatgaaaatatttatatcatgcttaaagaatatttgataacgaatcaagttataataaaataaataataaatacataaatttttgaataatacgaatggtcaaacgttggaaaaaatcaatggtgtcatacattaaaatatggagttagtatcatctttcggcacgttgacataatcagttgaaa

SEQ ID NO: 68266 - DNA, 56500 bp, Oryza sativa
aaaaaaaaaaaaaagcgttaaagaatgtgttacatacttacattgctttgccacctttatttctttttatttacaaggcaggtggcaaaacgaaagaatattatgaacacaaaaacctacaatacaccactaacttacaaacaaaattgtccagcaatggttcgaatttgacgggtgtatcacaaggtttctgcaacgaacagaaaaacgatggttagatggttcacaaaatcttctgagaaagaactaacaaaaacaagactgaaaatctacaagatctgtgacaactatagcatatatatatacttgccaaggactgcacataacattgaaaatgtcggaattcttgatggcatgcagaaacacatgaaactacagaaactaaattataatatttcaatatgtatataaagcagcctaaatctcctttcttagcacattgggaaacaaataaaagtaccaaaagattatggtaccatttctcatttagtagtacaaggtgatgcaattctccagtttcaatatattattctattttctgcacgtcaatctgttacatgtttattttcagggaaaagaacaaaggtgcatcgctaatactagttcataaaccagaaggatagctgatgacaaacaaagagaagcccatgcaaactaatgtcagtgctaaatgtccatgtccttcataaaactcaatgaagaattgaagatacaggcttttgtctaaactctaatatcgaggaaatatgtataaaaacaaaaaaaaatcctgtgtgacgaagcaattcaactattcaagcaatacaattttgcaaaaggaaaacaaaaaaaaggcatcatgagttgctagtcacttaccctttctccttgtgttgcctgcagctgccttccctgccttctcctggtggcacaaatcagacaatgacaatggagtcagtggtggggaagaagcatcactgccctccctgctatgcttagcctccaagagcttattcacagtgatgatgggcgtcctctggctgttggaaggtatggagtagctccttgccaaggccgcaggcggcctaggcagcggcgacgccgttcttgacgccttcggggaggcacgggccggcgtcggcgcgcgcttcgacaccagagggccggagtagccgaccagaccagaaggccggacaggatccacattggctggaggcagcggcagcaggtggagctcgctgatcttcagcgacgatgctggtggcaccggtgacatctttggggaaaccttgggtgacacagacgacgacgacgcgtgccggacgtgcggcttggccgcaggcattgcaccagggtaagccatggtgggcgatggcctgtggtcagcctgagagaagggcttgccgcctgacccggccttgatcgggatcggacctgaccatgactccctcttcagcttcttcagatcatcggtgcttgatgatgacgacggcttggtagcggcgttgtgcatggcgccattgtagtcttttgtcagaggagacgagtgccacagattcgtcggggcatggggctttgtttcgaagaattgcgcggaatgatgcagcctgtgtgaacctgatggtacggggttgtcagcaccaactggggtagggagcctgtacgagtgtttggttgaggatggcctcatttgccgaagcctgtcagtttcatcaagcaaattgccagcaaaaagtggagctgaatgtgtagcgaactcgggcttcaattgcgggaacactatttcggcctctgcttgttttgcctcttcctgcttattatgagataccaatcagaatttcagaatataaatatatgtactagcattttgttaacttggtacaaaactggagatagaggggtagaggctggtgaaggtgcatcatacatatatatttttttcgcttgaataattgctctttgagtagtgatagatttgggtgtaaacactcatatcaaccaccacattgaaaaataatagtttttccaaactcagtgagtgcatcaaaataaaacgtagtgaaatttggataagagaaataactaactaacgaaatcatattagtcgacccagttagaacacttctaatatgagtattatggagtggcagcacacctgcttgttttctttgattggctttggtgaagtagtctgatcacttttatcaaactggacacaaaataaaagaacataaattagataaaaatataaaagacagatcatcagtattctcagtagaattttatgaataaaaatgaacagaaaataaagtgagcaaattccagagataatcagtgcaaactatagaaccttagtgagctgattagacaaagaaagcataaagagttgaagcttatgccagttcaaatgctaccattgatgctgatttataagatccatatattgtaaaaccaattaagaggaaaaagctgaaactaggctatatatgtatgaggtggttaagtagaagcactagatgagaggcagcagcattaaaagggctttttttattatttaatggaaatgttttacatccatggcctctgctgtaaggcacacaaacaaattaaaagacagtaaccaaatataaatggaacttacatccattgaacctctcgaagtaagaaaatcttggtctctatcgtttatttcatagtcgaaactcagttctccgtcatcactacaagaatcgtaagtactgtagccatcattgtcagaaccatcatcctctagaccgctgaagttatagtcaatgtgatgtttctcagatattgctttgacacgaggttcaagtgcttcgagacatttgagtcctttcctgaaaaaacttaactgaatatatatacagttaggttatgtggcactcaaatctcagggaaatagttaacagtttcattgagttacctgagcagcatgatggcgagcagcctgtgttaacaggctctggaattgcccttgctttaatgatttcaagcgaaatgtgaaaagtgctgaatcctcttggtattcaagaaaagaagcgtccagttgttctgtggagaatgattcggttttggaatgccttgaccctcctttgtcactataggatgccctcatggtttcatatgcgtccctgcagggaacagaataggattgttcaagatgcgtctcagtgagaaatgaccaaaaatgaaaatgaacttgaggtgtgtttgaaccttttcatgtcgcattgttgtttcatttcctgcgcaatgcaaacaaaatgtataagcatatcatgctacattgatgtaaacatattgtttttcctgtggttcacaggcaatcctaattaaccaactaatgagtagccaataaacaattggtataaagtggtagcagttgttgttttcaattataagaatacataactgagcaaagatttcagaggaaattttgtatatcaaacctctaaagtttgcagctccttaagaagagattcagatggggttgtgattgtgtggatgatatttgttcgctggatagccaatttaaaagcgtgtcagcaccaacagattgtaacgtggtaaaaaaatttaaataactataatgaattccaaattgttgttttaaaaattcacagtaacaacaaaagtaacttacgtatctatccgcagatttctgtagttcatattgggccttaccgagcatcatcaacactctgcctgaaggtaaaaaaataagcataaaaacgattacagtagtcaacaaaaggaaactttggactgaaggaagtacaagcatacatggttttcatagtggttagaatctagtaacgcgatgttttacaccatgaatttctatatggttaataatggacaactcaccactatcgtcgtcgtcgtcatttagcacaggttttgcaagtaagcaacttcccagttcctctaaagcctcagcaaactctgcacaatattacactatgatcaacttaagaaatgatgtatagacaaacatgctatcaactgttgacagaaaccatgttaagcattagaatttagaaacaggaggtaccatatacgccattcgttgtagcagctgctgctgaaatgaagccatcataacagttcctcatttcttccacatcctgagacaaacgcaaaaccatatttcagttatgaatgcaacaatgcaaaggaaatatttcccattaccaatagactagtactatttaattgctggccagcaataaattgtaggcagccacaatcctaagaaagggtagaagtaccaaatacagcaagctgaacccattagaaagcagaataaattataagctgcccagtaaaacatggatcacacagtcctcttagacatatatctgataaggcgaagtaaagggaaaaacagtttctgtcatatcactgtcattgaccaacagtagcagtaggctgttgagaacaacttctccagcttaatggcgcattacattgcaagtgcttctcagtgtcatcattcagatggcacaaaagatatcaagattagttgcattgcctgtcactctgtccaataattggtggaaagtcagaaattgcaactaagctggcgtacttcagaaactcctctctgttcatggttcaactcccaattcagcaccagagaccgacgcggaatcggaacggaatatctcgtgcgtgttcttggataagcgttcatactttatccagagttccagtcaagattacgtcgaacagctgaccgagattatattaaatataatcgattgctatcttcgcagcaactttctccgatggacgcgtcgtcctctcctatcgtagactttgaccagacatgacccgcgagcagaatggctcccgggcaaacacgtaaagggcaaaattgcagagaagttgcacgtcgttttcgtggaggttagcctaacaactactctactttgaacatccgatatactaatttaaacgaggctcctactgtttggatcagggtttcaaaaaccgccgggggcccggttaccgccacccggcggtacggcggttaccggcggtaaccgcggtaaccgcgcaaaaccgcgacaaatttacaaatcgaaatttgaattcaaaaattcgggcaaaccgcgcggtttggcgcggttaccgcacggtttgacgcggtaaccacgcggtttggcgcggttaccgcgcgatgtgtaatgggttgcacagtaacgggccggcccatttttttttctttttccaattttcaaatttattctccgttttgctctcaaatttgaataaatattactcttttttgagaaatttcttcaccataaaacactataaatcaagcactaccttcactattttttttgatttttttctttttttttaaatttttaaatttggatgaattttattaaaccgtaccgcgcggtacgggtaaccgtacccccgcggtacgggcggtaaccgcggtaaccgcgcggtttccggcggttattcacaccctggtttggattaaataaaagtttagtccttctgcacgcttgaatcaacacggggcaagttcaaagctttgattattctaaacgaccaccaatgaccatcagaaaataattaaaaacgaaaattgatggatcaatttctatttaaacagttcgagctctgttcctccagccgcattgaataaccaaaatactactagtagtaaaatcattttgagcatccacacctaatcaataaacgagtgcaccaaccaaagaacagcgcactccacctggaaaacaacgcggggggtggctaaaaatcgcaatttcgcatagggctcctcccaagatccgattttgacgccgatttgatcacagaaatcccaaaaaaaaaaaaaaaacaggagatagatgggaggaggagaggaagaaatcaataaatcaatcaattaatcaataagtcgatggactcgcgcacctgggcggcgtcggcgagctcgtcgagcttggccggcgtcggctgcggctgcggctgccgcgacttcctctccctgtgctgctggtggtggccgaagcccttcagcctcagcaacggcgacttcatcgatcgatctctcttccctctcccctctctgatcgattactcctcctgtctaacaatccttataattttgtggggattaagcttatctaatcttttgctttgggcggcgatggtggaaatcgcaagaaaagaaaagggccttgatttcgcctctctctctctctcttgatctttcgttgttcctctatgaaaggtagactaaaaatggagggagattttatagttatagctgctgctgcttcttttataactttagcctaatggaaagatatagtggggcccccatgcccttggttgaccaaagaaaaagaagattagacaaaaagcagtcttggatttgatatagtagtataataataattgtagactgactgagagaaagcttagcttagaccggcaaatagtagtagtggtagcatcaaggagattttgctacgaatttttcttgatttgggttggtttttcgtcggagaaaagattaattttctactgtatttgttgttcccctttgcttttgaatttgatgatgacatctcgtcagatactaacagcggctgatgatacagtgatacttacctaaattaacactgaaacctgtggattattattttggtttagtaactatactactcctactttttgtttcagtcataccatatgaactaaataatgtctcacgctttgctgcgagatatatattgtataatggagaaatgatgaaatcatttagattgaaatattataaaaatgatttgagaatggttatttagcatgtgtatgtttaattttagaataaaataaattataaatataattactatatacttacatgttgagctttacgtgtttactggattgacgtggcatgcttgcgtgtaggttttagaagtactaataaatacaatgattgcatgttgagatttaggtatttagtgggtattagctttatagaaagaagatattaacattgaaacctgtggattattattttggtttagttaattacttctactagtttttatttcaagaaaattgcatgtgtaccctgaaagtttacctaatcttttctattcttctgagatttgctcgttcccttccatacttctaaatttcagttttgaccccttctatacccttttcgttagttgaccgttaaattcctacaataatatccatttttccatttggtatcaagaaaatataattttataaagtatattgattgagtgtataaatttattgtatgcgactattttatttatgagtttattttgtgggatattatttaacaaaaataatattttagtttcgcctccgtgaaggaaaaacaaaaaaaaatatctatgacaaagtttatttttagaaataacaaatataatatattttttaccattaaaaactgtatatatagcatattttgttacagtagtacaatatttttataagataaatctatttatgttcgaaataaataataaaaaattatttttatgtcatatataaaaataaattatcataaatattatttatgactttgttatgcaagatattatttatgataatttatttttttcatacaagataaaaattatttttgtaaataatatctcacaaaataaactcataatagttgtatataataaatttttatactccatcaatataaatcataaatttatattttctcaataccaaagggcaaaatggaatttatggtaggaatttaacggtcaactaacggaagaggtatagaatggatccaaactgaaatttaggggtatgaaaaagaatgagcaaatctcatgggtatagaagagattggatgaacttttaaggtaaacaaggaattttctcttctatttcagtcataccatctactgttcattagttaataggtactcccttcatgctaaagtctaagttatactatttcttttatcttacctcatccctcatataacaaagactaataaattataggcatacatacaaaccaataaatatattaagagcaagtacaatagcatactataagctagctataagcatatgcagaaaaaaaaagagatgagagagaaaaaaagtgtgttgcaaatttacactcagctgcagtacggattttaagatgttgtgtttgtatgagagatggaaccaattatataatggcgtagtatatatttgtagtaacttttgtatgaatagtctattagattaactatagatgatttggagtagttagatatactatcaaacttgctctaagatgattacttgggcggtaaaatgaaaagacgatccattcatttaagtattagatgtataatgactaaaaaatatgtccctctcattaaataaaaacaatgcaacaaataaaataggataagacttttggatggagaaagtaacaacatattatctctaatacacgaacctaagtgattttatcttttgttaattcactctcgtactatctcgctctctctttgaacttaccttagaatttatatagaggttgttatctatacgaagggtggctcgtcatttctcttcttcagctaattatctaatgttctgtgagtgtgatatttttacaggcaacctatttgctatagggaatatatactatgcacacaagcttcctatgaatactccgtgcacatcaactaataaatatcacaaaaaattttaaaaaaaattgtacacatacttcaaatagtattaaacctacatgtgaaattttatcttcaaattcattatattttagccataataaaaaagacaagattctgacatatttttacccttaagactgtcagattttcacctttttttaggctaaagtataataaatttaaatatgagactttgtagatatgtgtaatactaatatgagtaaatgttcaacttctgctaaaatttttcgtggtattttttagttggtgtgcacaggaaggttatgtgtatttctggtagaatttttcgtagcatttgttagttggtgtgcacgaagtgtgcacggaaagtttgtgtgcataggatatgttccctctgttctatgcctctgtaactcacccttttttttttctttccagaaagtgtttaactttttttaattatggctgcgaatgttaggttgatggggtgtgatgccctggttgctcggatagatacgcgtgggtgcgtgcaagcgcaaccgatgaatcaatgaagtggcctcaccgtcaggtcgatcaggaagcacttgcaaaatggcaagggcaccgtgacatgattcatgaccacccaagttgagcgagacatgaccaccaagcaccaacccaaaccgaggccacctgtccactttttaatggtgttcttttttccccccgaaccttttcaaaatttgtttatttttttctgaaaaagagaactcagcatacttatttattaaaaaaatattgtaatgccactatttattgcgtgacaatgataaataaattttaggagattcttttttatgttgtatatactaaatagaagtagtttttttgcgggatatatactaaatagtttaaaacacataaaaataatcattgttttttttttattttggggatttcctattgtttgcagtttacataagggcatacgggtcttcttcttaaaagaatataacgtcaaactgggtaatttttttttttaaaaaaaagggtcaggaatactagcagaacagtagggaaaaagagaagcgcaagaattcgatggcaattaggacataatatattttgagtaaattatacctctatttagacataatgtttgactaataaggagaatatttcaattgttcatccaactcagcaagattactcatactgtgccgctttggccttaagttaatttgcatgtaccatacaactttgtataaattaatgaaatgaacgttttacaactttatgtattaaaataattatattcatcttacaaattcatttactatcagtgtaatttattcatatatttttaaggagtgacaaaaataaaggaaaatatattaacatatgcccatgtgtacatttgtaggcataagtttggttcgtcatgcatggtttcacgagattggtccattattaaatttactattattctagcccaagattatagtgaaaatgatgaattacacattgaattgtgttcttgttagaaagacaaacataaaataattggagaagcaacattagtgttgtggggattcactgtttgcttccatctatttgagagtgggcacatttggggaagtatgagagtgttgtggtgcgtgcatacgtcttatgcataataaaaaataaataaaataatgcggtgaatttatacgtttgttgataaagatggataaactagtactatatgctgcaacactttgtttggtacgtacgaatataaaagcactcatttcatttgacaaaaaaatacctagaatattgcaaaattaagctaggctatctaatagtttcgagattcgtactgctacagtgattctacattatcatctatcccccaacccccttggttctttcctaacgctctttggatgtcatctgataatgcctagcgcaccgctgacgcctccccacccaacacgtcatcgctcggtcgaaagacgtcaacagcgtcggcgaggcctcctgaccagcctcctcctcaatctagtagcagcgaaggcctatcaagtgattccttgctaccggatccgccatctaggccaccgcttcctaccacttctttgctttgcctccgccgccaacgtcgactcgaccaccgccttcttccatcctcatggctttgacaccgacgcctctcatagccatcgctttaaatccgacaatctccctctacataccttcctaccatcatgtcaatccggggtcatggtcaaaccctaactctgggtcgtcgtcggttgccaaactagagaaaaagtatctagggttaccggatcacgaattgcaaaacacacaaatcatgagtttagaaatttacagatattttagccccaataatcgcaaagagttgcgaagaacaatctgagatgatctcgctcgccatacagcactttgtttggaaggcacgaaacatgcacgctagtcatgcatgcctgggaagaaaggaccatatgctgatctgcttcgttggaccgtgttaattccaaacgaccagcggttgctcagccacgaagaaattaaaccatcatacgtaagctatgatatattggtactaattaaacgacctaattagtatatatacttcttctttcatatcatgtcaaatccttagttttttaaccagtcttccgagtaataagactttctagcaattctatatgaatgcgaccaatgctagaaagttttataatatgaaacgaccaatcctagaaagtttataatataaaacggaggaagcaattactcgatcccttgatctcctcgatccctcgttgtaagcgaataagcgattagcgatcaaggtcagacgtgcggggttttgaccgtggaccgaagaacggcccaacaggtttaatttcgccggtcaaacggtggttagctagcgtatacattactagtatgtacgtgcatacatgtctcggcgtacatacgtacgtcgtcgtcgcaagtgcagcgccgccacacacagtgtgaactaacctacgtaagagctgacctggatgcatgggtttctgtgacgcaacacgtgtcttgtctgtgtgccagttgtcaaaatcaaccttaagggtgtgtcctgtcgtatcggaagagaaagtatatactacggccctgtttagttcacactaaacttccctcaaactcctaacttttcatcacatcacatcacatccaaaactttcctacttacataaacttcccacttttttttccaatctaccaactttctccaaacttctcccaatttcagaaactaaaacacaacctacgtatcatattggaggttttagatatatagtctatagttcaaggtggcccttcatcatatatctggtgacggagaggcacaaagttcaaggttaattaagctaataagagcttaaatattttcacaaattacaaagtatttttcaagattataatggggattatgaagctaggtgtggggcccaagctatagctgccccatgcatgtttctgcccctgattatattgttaaatgtgccacttaggttaaagctactgtacatggcattccttctcaatgcacagtggtttgaaggggaaaaaaaccaccatgatgatttatggaagagaactactggcataaccactactacacaaactagataggtattggttgggaacctagcatagatgtcaaattttccaaccggcacaaaggtgctggctccaaaaccggcacctttgaggtccaaaaatacaaacaaagaaaaaagctcgtagctgccgtcttcaccccaaaaaaagcggctcaatgcatcggctcaaagcatcgagcagctccccttcacccgatatcacccaacatttaattcatagaattaatcggcatcaagaactacccaaagaacatcaactcaaacacaaaacacaaagaacatggagaggatggatgacggcctccatggagaggatggagcagcagacgagcagcacatcgggtcccatcttgcatagctcgtcggcggtggcgaagaagcagatcccacagcacgtccgaaggcgccacccgccaccgccgcctcccctcccgccgtcgcccacaatcgcacgtcgctattgtcgcctcccctcccaacggatctggcagaggggaggggcgccgcctgcctcccaccgtcacctcccctcccgacagatctggcggaggggagggcttcacccgccaccacacgccactgcgcctgagagagagagagagagagagaaagagagagagagagagatgggagaggatgcggtggagaggataaggacatacaagagataaggaggagaggatatggatgacaaggtgcggtgtggtgcggttcgactccgctcaatataggggtgtcggttcttctttataacaggcacctatagttacttaaaggtgtcagttttttgtgtttttagtctacggagatggaaaaaggtctacatatgtcggttttcgcacttcaggcacctatagcgccgatctctatgtgccttttttagtagtgaacacaactccctccacaatagcttacgcatcaagtagtcttttcaagttgcttaaaaaaccgtatgtgtttttcatgagacatgtgcgcctctagaggccactctttaggctaaggtggcgacttggcttcaacataaaggtgcggggtgacttaccatgtcaccacacaatgtaattgtgcttatgttatagggacgccctctttgtttaggctaaacttattagcttaggcttttaagttagcttatcggcttatgatttataccaatggatttaatatcctaagtttagtggtggagtcgtacatctaccttatataagccaaaaaagcttctccaacttaggttttggcttaatagtgttagagtggcttaatagtgttagagtggcttatggcttaaaaaaagccaaacgaaaaagctgcttatttgtttagtattagactttttagcttataagttaagccttaaaaaaagagagaatatttcaagagagtagaagagctaatttttctcacctttgaatgcgtggacccttttgggattttggcagcttctagtatctaatcatgcggtcacgaaaaacctttttatgaataccaaggtgtgcctcgagagttgagaggatgtgctaaggtgagcatccgttttaaggctttttcggtttctcggatgttcggtttctgtatagtagaaaatcacaatatatagttgtgagaaaaaatgttgctttggtggtttattgtcaaagaggagcatgtctacagctaagccgagccactcccaagtcccaacaataatcaagtgcacgaccaaggttggatacttggtgttatgccactcacaagacaaaaccgcgaaagctatgtgtgccctgtctacatcaagcaggtgaaagacatctactctaaagatttaatcttgcatggtgtcggtttcttcagtaagtttgattcacactagaaaaaaggacatacgactacaaactaaatactgagttacatgaaaatagaaactgaggaaccaatcgaaaaaccaaaactttggttcggcattccgttcgtggtttgtttttgcccacatctactgctaccaatatgcgtaagagatactttggtcgtttgacactctagcttgatgaagagttggatgaattgtttttgaattcgattcaaaattataaatataaaatttatatatgtataaaaatttatatgtgcaaactttatatacacataggtacaaaacatatatgtataaattgtataaacttttttatgtgtaaagttttatatatagtctctctattccaaaaagaatcaaatcctagaggaaaaagtataccgaaggtccctcaacttgtcatcgagttacaaaatccattcgctttaggtccttcggtggttttgaacccggttttatccgacgtgatggctgagtcagcgtggaactcacgagggccccacatgtcagtgtggccacatcatctctcttttcccctcttctctcccttcctcatctctctctctctcccccttctctgctctgcaaggcaggcaatgcctcggcggcgggcgtcggcagtgatggcggctatgggcaacgtggcggcggtggggggaggagctgttggcgggcggcgggtggccgagctagagcaggaggctgacgcggaggaagacgagtgtgcagcggccggtgacgcgaacgacggcggcggtgtggagcggctgaggcggcggctcgcggccgaggggaggtggagaaaggccacgctggaggagctggagaaggataggtgcgcggcggccgacgaggccgagctggagcaggaggctgacgcagaggaagacgaatgcgcggcagccggtgacacgaacagtggcggcgcagaggagggcgacaacgtggagcgactgaggcggcggctcacggccgaggggagatggagggaggtcgcactggaggagctagagaaggagaggcgcgcggcggcgtcagcggccgccgagctggagcaggaggccgacgcggaggaagatgagtgcgcgacggccagtgatgcgaatggcggtgacatggaggagggcggcagcgtggagcggctgaggcggcggtttgtgacagaggagagacggagggaggtcgcgttggagcctggaggagctagagaaggagaggcgcgcggtggcgtccgcggccgacgaggctgagctggagtaggaggtcgacacggacgaagacgagtgtacgacggccagtgacgtgaatggcggcgatgcggaggagggccgcagtgtggagcagttgaggcggtggctcgcggccgaggggaggcggagggaggtcgcgctggaggagctggagaaggagaggtgcacggcggcgacgcgcggccgacgagaccatggccaagatagcatgcctccgccgtccgcgcgccgcctgccgacatctccttcccccactgccgccgcgtcccccgtcatcgccatcaccgccgacgcacgccaccgaggctgccgatcttgcagagtagagaaggggggagagagacaaggaagagagaggctgatgaaccctgagctccactcgagacactcaaggctgttgttggcccgatctttcagtgagttgagataactacgatttgagagaaatattgacgacccgattacaaccgtactagacattgttgtcttgcgccttagcgatcgatacacctctccgtgggttgttgatcttgccggtgcagatcaacgttattcctgcaagcaaatcgaagaaacaagcaagaataagataaaaacaatctgaattgcagatatgaattgaatacaaatgataggttggggttctgtaacgagtaaatcggcgatataactgatcacgggattacacggcaaagtaacaaagctaaactttaatctaaataaaacccaagcaaccctgaaggggtatctagctacttataggggtgggagaacaaccaagaggatcctagggtcgtgctccaccagattggggcgcaccccacataggccccacttgggccggggtcccaaacgaaattacaaacccaaaggcccatgacaggtgatgcagcacattgtttcttcatctgcggatgacttggatggaatttggtgatgaggccggatccgttggaaagaggactccgagagctttccatcaagtattcatgggccgaaaacggaggtcgtatgtagattcggcggccatttgaagttagcagggtagcaggtggccgaatctgattccagcacttggaagacttgatcttaatatcatcttgttcttccatgatgtgagcaatggttatatctgtagtgaccatagtcacatcaaggggaaaatagagatgatgtggccacgctgacatgtgcgttccacgctgacttagccaccacgtcggataaaactgggttcaaaaccaccgaaggacctaaagcgaacggttttgtaagttgagggatgccatatatgttttataagttgagggatgtcatatattatctggttttacggttgggggatgatttcgtaactcgatggcaagttgagggaccttcggtgtaccttttccaatcctagctaccaatgtggatgaatgtatatattttgactgggccaacatgcatgttactagtgggctcaaggcccaggaaagaaagaagacacacctaggctgtgtgggcgcacgttgactcgctcttatcgcgtttagcaactcgcgcgttagacctccccccaaagaacttgactcttttccttcggaagtacaaactgataataaggaatgacaattgatttacttataattaaatgatgccaacccatagctaggattggatatgtatataattggtgcaaccgcgaataaatatgcaaatgtctaaattgaaccccgtcagatgatcgagtgacaaacatgaataaacagttcattactttagcgaaaatacagcggtttagatacatatatatggtatacaacaaggtagttgccttctctatgtacagagcagatcactcaagaacaatgcatagttctcatccatggaaacggtttggatatcaagagggtatgttcttacgcaggcacagcgaagctcggttcagaccagcgagttggatccacaacgaggcacggatccgacttcttgaactcagccacctgcagatcgagtgcattcaaaagaaagttgaaaaaaaaaactgaaagaaaaagctcaatgggagaacagcgtttggacaagacgatggcgaaccttttccccacagctggggcagtagtggtatttgtgccagaggcagtccatggaaggacaaaggaagcagacgcccatcatgaagggcatcatgcaagccacaactgatgctagacttggcttcgacctgttcaaagcaacaacagccatgagtgtgtttttttaagtaatgaagcttcacctaatgatatgtttggtatggtattggtgctactggtcttgaggtgtggagtaggaaatcataacacacaaatcgacagctacttacaactaaaataatgcactaagacccaaatttatagtatcaatatggggctcaggcttaactatggtgtgccagttcatttccctatcaggaaaataaatacaagaaatgtgttattcgtgcccattcttgcatcgccaactttagcatataaaaccattactcactactcagcagtcagcagtcaaatcttgcatcaccaagctgacacatgattttcggttcacaaaaaaatctgacaaattgtctcaatccatagctcatgcaaccattcagagttaactagaacagataatgcaggcaaatatttagatggtctttggttcttttcaaagcccaattcaaaactagtaacaaaactcatatagtgccacttcatcatatttagtggcaccatctgatttgcgcctcataaatgcaaatgcaattacgaacataataataataataaagggcagaccccactagaaaggtatactgcgcctctcttgtatatatggttgaaacaagtagactgtttttgatacagtttgtcttctaatacttgtttctatataatcccaaaaataacacctttcaaacataaagactaatatcgttcaccaaaagttgtttcagatgtaaggacttaatgcaacagacacttagcaatgtgggcagcaatattgccaggaaacatacgaaagacggtcatttaaaaacagagtaacactcaattcagatataaagctgattgcaaacaattccaagaatcatgcaagctcagatgagcttcagtaagccttagcacagccaattagatggtctcggcagcagttcaaaaacagaaaatgagcttagctcaagatgtaatttggttcctttttttcgcaatgctataaaaatatgctataatttggttcctacagtggcaggagatatatacctgtcaatagaggtacaataccttccaattaacataaaaaaaatacctctgccacacaatacctcccatggactgggaaaaaaattgtatcttcggacctgttcattgagtacagaggctactaaataacacaagtgacaagttagtggaagtagatggctaccatgttacaattcacaaacatccatatatatagatctaatctaaagtagtgaaagaattattctttctcgagtggaggatttgccacatcatcaaaagactaatggccgtcagatacagctttgaaacaaaatttaccgttggatatagagaccaacaaagaatcaaaaggtcaaaataaagaaggggttgtctggaggcttcaagaggcttccaggagaaaaggagagggaagagttccaccagcgatggaaacaaagcaatttgttggtggctctgagtaatcgatggcccaaacagaataatgggcttaattgaaccattataaattccttcctaatagcagccggaaagcagaaattccatcctcttttcttcatgtgactggagcttaaacagactgatgattatccattataccatgaaacccaactttaaaagaaaaatcaaaataaacttttctactaataaaatatgaattctattaaaatgaatcttcttctttcaaactgaaagacatttatacacttgataagttaaacatttattcaatttaagatgaaaaaataaaatgaaataaaatccatagtagttctttatcaagttcttcatataaaaattgaaattccgcacatatatccaatagacattactcatagaacttttacatacttgtcaatgtgggcatcaaagtcacgcaacgtgcgacaaagtggctagtatatatgactgccaatttctgttattgtgttttattacgatggtcatgttatatattagctaaactaggtgttacatgtcctaagtgcatgattaactctagcgctcgagactcttcattagaagaagaaagctaaatatgttcgtgtaacttttagcttccagtacaagctctgacatgttatttcaactgacctagaagggttcagaacacaaggaactcttcaaagtgttttctaccagatggaagaatgcctttcttctactctctccgtccctaaatataagggattttagttgggtgtgacacatcttagtacaacgaatctagtcaagctcttgtccagatttattgtactaggatgtgtcacatccaaccaaaatcccttatatttaggggcggagggagtagtatttgtaagttcatgttttcagataatggaatcttttattgaactcatccaattacatcaagatgatacaaaagcactggtaaggattatgttgtccaagcagacttaggcccttgatttgcatctgttgtaaaccttaaaatgggagagtaattacaagtttgtaactgatatactatgaacctattatattctcttcctcatatcatcagattcataatttaacaataactcaaattctcacctcccctatagaaactcaacttaacagaaagccaatcgtgaatgcgacttggataagagcaaacgaataacaagaaacagatgacatgaaaaacatggggaactccaccagggcttgagcttctctggtttcgacaacctagaaagtatcgatttcttcttctcccttttcacggtgcagattagactaccgaacaatctagtactcgttgcagatcaatacaccgaatgctggcaatctcgacctatcaaccgctcgaattccacatctatcccttcgaatcgcaggtaaaggccacaataaaaagactgcaggggggcgagtacggcgggttctcaccggagggaggagacggccgcggcgccgcaggcctggcagtggaatggcgcgggggtgtcgcggaacatggtctgctgcaggggcacccccttgggcgcgccggcgtagatcgcgttcggcgggggcatccccgccgcgtaggggtccggcgcgtagtagtaaccgccctgggcccccgccgccgccggatggtacgggatgccgatcgccggctcgtcgccggccggcgcggggaacgccgccttggccgccatggtggtggtggtcgtcgtcggtgacggcggttgggttgggttgggttggtttgaatcttgacttgtctcgccgcggctgtcaggttgtgggctggaagcctggaaacggagaagatatttatatgtgtatgcgtttgtacaaggtctgaaaaaaaaatattttcgttggaaaattttataggattttatgtgtaatcgttcgtaatactccataaaactcttctagaaaatgtagttagtcaaaaacgtaacaaagcaaatgttgaagataggagaaattacgagaccttgtttattaccggcgcattccacacaatcgggctttttttttctaaaaatgctcgaaattactttaatccgggcgactggcgcaggggagcccgatctggcgctcccccgcgtgcccctcccccctccacatgcgtgaatgcaggccctaggtcccaccgcatcctctactttcacctgccattgaaaaaaatcctttggatacctcctattaagggaatttgttttattttttccaccaaaaatatttcatctagtgtattcacaatatttcactatgtatagttctaatgttacaaactgaaatactccattgcaaccaaaaaaacccacatattttggaaaccccctattaagggatttcattttattttttattccaccgaaaaatatttcacctagtgtacttataatatttcactatgtatggatcaaatattatagtgaactgaaatattctttcgctatttgctgaaacattgtttttatataaggtgaaacaacaccagatttaaacgggtgaaacattttcgatctacttagtgaaacaattccgatatacctggtgaaacatcgtgcaacatttaaaaaaaatcaataataagctattttttttcatcggaatatatccatatgtggccttgttttgaagatttaattgcaacgaatttaatggtgcaatcggatcatgatttagataaataatttaagagaaaaatcagtttaaaatagttttgcacgtaaaacaggtgctaacgtcagcgtccgatttttcgaagatttggatcgggcgaccaatccctagtcacctccagaaatgctacacatcacacgtataattttagaagagaaatcatatgaatttctagccttcaattcgcttaagccatgtcgagacggccaccttggcatggccaagagtcgaccggcctggcctatttcacgacagtcattctaatcgactttagatgaaattcaatgtttgtaatgttcatcaaagatgatataaggccatttccaacccaataactaggatagtgtccataacattaaataaactgctacctaaaatgaaaaatgatgtggcaaataaataaatgagaaaagataatgaaaccatgtctcgcatgagatatggtttctacacaacatttaagacattatgtgagataagtaacattaaatttaagtatggaatagtggtgtttgcattaaaagagtaatgtcagtttatgaaaactatgttagtgtcttgtgttggaaatagcctaagacatcaaatgagtccgctcactaaaggagtgctggtcgttgggaccacgtgtccaggcttggcccggcccatcctatttgcctggccgacctgcgcgccctttttccacaattatattatctagatacgacgatacagatacggatacgccatcttcctaataataaagatacggggatacgcgtatatatatataaataaaaataaaaaaaataaatcgtaaactaggcaattagcaatttagcatagcagagcatgccaacaccaagtcaccaaccattagattcatctcaccaaaatacaaataatataaggctaaaccagtgcatatgtaagtgcaagatttcaaatagtacgcaaatcacaaattaatagttcatcaacatgcatagtttcacacatcacaaccagttcacagagacggtagataacatcaacatcatcatagagctaattcaaatagaattgtttaggacttcaaatacaactcaataaatcaattgctgctttcatccattgtaactgaagtggctgaagcgccattatcatcttgtatatccaatgcaccaagatcttctagcactctctcaagatttggctcatcaagtgacagtgttgggccctctctaggcagcacccgacagtgctgcgccctctggaggcggtggcgctgtgcccagcggatggcgccgctgctaggcgatggcaaacagcggaggcacggcggtggacggaggaggtgcgacgcggcggcggcggggaatggcagtggcggaggatggtggcggtgctgtgctacgacgcaaggaagagagcgagctgagttggggttggggaagcagcgccgttgatgttctttggcttgctcagtgttcgatggttttgatcgatgattttagggttagaacgtatcgcgaccgtatcgggaattttttttattatctgaaaatcgtgaaaacaaccgatacgtacgagatacgtatcggggcatatccgatacttatccatatccgatatgaatacgtggcctgggaggcgtatccaggtaacatagccccacgacacccctctcgtgttagaagctccactttgtttatttttatttgctagaatgtcaggaatagtatactctagtttgtagaggagttcggttgggaatcggcaagattttgaaggaatgtctttgggacttcagtagtgattcttgtatcttacaagttatacatttaggctaacatatatttgctttatattttttagtatttattttccgcaattacattcactctttatttatgttacagagtatttctctaatcaacggattggtcactcatcatgtggaataaactagaagtctgtggtgtagagtttgcaggtttcttggttggatttagttcacctagctggatttgagagtgctctcttctaaccagcgggagtattttacgagtatacgacctagtccgctagatgtggtgccttggatgtatagttcaaggaaagggtagttagaaaaattgatggatgtaatcgtacaggtggtgatagcccaaggcgtccttaatagtcgtccacgttagttctagtgtgttggtgttagacatcaagaagggaaattccttgatagtgagaacatgcgccctgtgccttattagtacaagccatgctgagattttctcatgctgaaatacatctactccttagtctcctttgaaactcctaaattggataggttgggtccctaagtgtcatctgtagtttaacttcagtcatatcttttattagatcttacccccatctctaattagtgtagatttccttacacaagcaacatagaatgaagaaaacattttgtgccagcagtgtgtcctttggaaaatataaatacaataccctagaatactccgagataaagtactatattgataattccatgcacgtgcggaactattttgtgagagcataagaaattcaacaagcactttttcgcgtcgttgctaagaacgcaattggataaaactttcattctttgtacattgtcttgatgagtggaagtttattacttttctaagcgggtttgcatttcctcatgttttttgttgatctgaagacatgacatgtttatggtcaattttgatctcccaaaaaattgtcaaagttatcatgagttgttcatgaataagtgaaaaatatcattatcataaacacatctcatcatcataggccaaatcataggagaatatcctgttagttcttccttcaccgcctctaactcagcctccacggatcattatggccgagaggaaaattcaggactattccgatcctgttagcaaagtcccgcaaaggccgaccatcaatgtcaaggcagagaattttaagccaaagctgatgtttattgatatagggcatatttggcagggctccaactcctaaatttaactccaagagctaggtctagagtggagttgtggaacagccaaaatccagctcctccttcaagtttattttctgaaagcactccagctagctccactcccattttggatggagctgaaactgttttggctagctctatcaaacatgcccatagttgctcatagttcatgatgtgaccatgcctactgtgcatatatataaccattattcacattatgggttaactgaaggcattgagatcaactcgcccaaattctggaatccaaattgaccgcctctaacagcgttgatttcaaacagccactaaatgtgcatacgagctccattttgagtccatgagtacttggtgaaaagctcttgaagtactctttccaacgtatctagccccatctccaaattccaaatgaatcatccgcaattgaataaacaaggtgtggcaccacctgtcatgggcctttgggtttgtagcttcgtttggggccccagctcaagtcctcccacctctgtaaatagctatgtacccctttagtgtttctcaggttttgtttagattaaagtttagccattggtactttttcgggtaaagtcatgatcggttagatcgttgttttctcattacggaaccccaacttatcgtgtgtgtattcaattcatatttgtaatgtcagattgcatttatattgttcttgtttgtttcttcgatttgcttgtaggaatagggtcaatctgcagcagcaaaatcaacaatccacggatagatgtatcaatcgctaaggcacagcacaacaacgtctcgtacggttgtagtcggatcatcagcgtttctcccaaatcgaagtattatcatcaactcaccaaaagtcgggcctatcagagtcgtgagcatatcaagtgaagctcagggttttatcaatccattatgtagcaaaccattagtaatatggttgctcataatccattctatagcaaacctttgaagatgcaacggacacctccaacagttcttaaaggtttgcaacaccttcgcctattccccattctctggttgagaaggcaaagtggtgttctatccatttgatcaagaggctatctttatatggatgagatgctccaatatatttctttctatatacttgtccaccaaaaagccaaccgcactgtggaacaaaagattgggatttcaacagttgtatgatgagtcaattcccgatgcatgggagaatttccaatagtgcatccaagcctgcccgcatcacgacatggaacaccggcttctcatccagagtttctacaatgtggtagtgcatccacaacgtgggaactgttgtatttcttaatgtcacagataaattccgcaagtgcacggagaataccgatgtagcacttcaccgggagtattccaaggtattgaattcatagggaacgtgtgtgttcagctcctcgtcaggttcatccaaggacacgaagcagttgtaggcaaaggatagagaggatttttctagtgagaagcagtgtctacggaaagcttagtttaattctaacgtggtactttaggcactagctagttcgctgctaccagatgtcgctctactccgtacccggacagggaggacttaaagtgattctgagggctgttaccacctctacatccacctctaatgtactgtggggtacgtagcaaccactgaaaattaactacctaaacaccacgtttaagcaattaataactactctagtgtttataacttactaaagcaataactatattttaatggactatagtgaacaatgatcccatatgctgttaggaactaaccaagaataattctcacaaagtaaattgtaattaatcggaaagatatttctattgaactagagtaattaacaaggtacaaaaataaggataggattaccgacaactcctgaattcctctggcttcttctaccttactctctccccattctagtatacaataaagtacaatagagtctcttataattctgctcaagcttggagtgtgtgtgtgtaaagtgaaggagttaggtccttaaataggttggtatgatggttatagatatgcgaaatgtccaaaattccccgcaaccgccatcaagagagcatctggagcgtccatgccaaaccccagaaccaatggtggagatcagggttcggggcttggcccaactagcccaggatttggcctgggcctcctcctcagcttcctttatacatttctctggtagttgggctcaatttctggtgtttcgatggagtttaggagcccaactcttatgtggatataattccccttaattttagtctagatttcctcctaactttggcggtttattacctgcatctaaatatacaccaacactcgtggaatatgttagaattaagccctaccactatgttggatgttttattatctaagttttatgcaagtattggcggcataaaatcggcattcaacaggcgccaacaggaacctcgacatagatgcgggaggcaccatcttctcactttatatcaatgttgcccaagcgttgatcgagaagatggctgcccaccaaggttgaggcaaggagcataatagtactagccctaggccaccaccgctgccatcttggtcgccatggtggtcgtcggtgggcgatggtaggttagttggttggtatggtttgaatcttgactcatttcgcaatggctgtcaggtgggctagaagcctagaattgagtgacaagatatttatgtatatgttgtcaatgttagaaagtatgacgctcatctagaaaacattttttaaagtaccattacctccatcataaaataaaaaaagaacttctaggattggacacgggtactgaggaagtaaggatattaattgagtgaatgttgaggttagatgagaaaagaaagtaggtgaagaatttgaatgtcagaactttgaatctgtatgttaaattgcaacttattttcattcatttgtatccatttttactgttaacatgtcacgaactccctatgttaacaaatataaacactctaaggatttaaaattaatttgtttcaaaatattaggattcttatagtactggtattttttttacttaaagtattgccagggctttgcctcgcagtgtaattttcatttaaaacaaaaatatttacaaattacaaggaagaaagaatagaaaaacattaggaattacaaaagttataaccgataaaaaaactatatgttttaaagggtccattctgcacatatgcagaagaacttctttcttgaacaggattctccatgatccaaaggaaggttgctcatttcgaaaatttttcccattcctttgcttccagatatgctaggcagcaacaaagaaaaatttcatgaaacctttttgcctaaactgcaggcgtgccgatacaatcatttgaaaaaaagttgagattggatcccacagaatgcccaaatactgctaacttctctgactgaatggacaaaagaggaaaacatgctctcttgtttccctaagattattaacacgaagttcacaagtgaagtcatcgttctcctttgtatagtgatgacgatcaagcatatctctggtgttcaatctatcattgaaaagaagccagacaaagactttttatcttcaaaacacatcgtattttccatatccaaacaaaaggtctaggtgtttgcacagtcatgaaagtgagcttgtaaaacttattagcagtgtatctatcagaattccatagaaaactccagtcatctcccttgctatcttgtaaattaagaaaggaaatctcttcctccaaattgagaaattcttcataagattgacttcttaaagccaaagggaaacaatcttccaaaggatgagaggacagctgctgcacggactactttttatccaaggccacactaaacagatttgagaaagtcaaacacctaacctcttcattccaaggatcatcccagaaaagagctgaagaacctgttctgacagtacatcttgaaattcctctgaaaatgtctgacaaagcaataatatctcgccaccagaaagagcctttattccaaatcatatgaggcaccttaatgccatagtaagaattccagattaattgaacccaaggcagatcttctcctttgtaaaacttcacaagatgcttcagtaaaagagctgtgttctgaactctcaaattaataattcccaaacctcctttcacctttggtctacacaccatttcccatgaagcaagggattttctagatgagcttgggttgtttcccctccatagacaatttttccttgcagtatcaatagctttggctacagaaacagacaactgtagggaacacatgtaataagttgggattgaagataagacatagataattaaagtgagcattccaccctgtggcaaaaaaaagagaactagctatcaatcttctctcaactctgtcgaccaaaggagcaaagtccacaactcttggcctagttgttcccatgggcaaacccaagtgggtgaaaggcattgtaccaatagagcacccaagtaagccaacaaagagcttagcattctcttgggggagattgattggatataagctcgaattatgataatgatagttcaccttgagtccaattgactgagcaaaagagttaagcaaagctttgaaacaaaatacttccctctaagatgctttaagaagaaccaaagtatcatcagcatactgaatcacaggaaaacccttgccatcttgttcattaattggtttggacagcagacgcagagaaaaggctctgttgataactctttgcaacagcttagcaccaagaacaaaaagcaagggggaaagggggtccccctgtctaactcctctcctacatttgaaagaatttccaggaacaccattgagcagaacagaagtatgagatggagaaaacaccatctgaacccattgcaaccacttgttattgaaacccatgctttgcatgatagaaaggagcacagagtgctcaatagaatcaaaggccttttcaaaatcaagcttcagcaggattatctccctcttggattgatgacactgatgaatatattcaaaagaccatgctaagcaatcttgtattgttttgcctctaataaaaccatattggttttcatgaacaagcttgagcataataccctggagacgatttgccatcaatttaattaaaattttcaaactgacccccaccagagagataggcctaaagtcattcacagtttctggaaggattttcttaggcactaaagtaatgtaagagctgttaagaggctgcaaatcagtagaaaaaagcatggaaatgggctgccagcctgtagaaatcttgagaaatgataggctaatatttctttagaaagaacccattaaacccatctgaaccaggggccttctctaggggaattatcttaattaagttgtcaacctcttgggtagagaactgatctaccagacaatccaaattaattggataagggattaaaggccattgagggagaagaagagatccccattctgttcttaaagctttggaagaaaagacttgccttttggtcatgcaaagaaaccacttgaccagattgatcataaatctgagagatggaattcaatctaaatctttttgtggcaatagactggaagaatttagtgttctcctctcctaacaacatccatctgtttgtacatctttttttttccagtatagcttcttgaattctagaagctttatcgtctgcaacttgataatctctttgaaattccattaatatatacccaagggcctttgttcctctatcaagtccaaaaagttcaacacattattacagttaactagaagagtagttaactttgacaaatttttactccacttcaacagacttttccttaaaaattttagcttaaaactgatgcacttagctggattatcaaaaccaggatccacagacaaaaccctgctgacaagatcagaaaatccctccatttcaaccccaatgttttcaaatctaaagattgggtactttggaattcttgtatcaattttaacagcatagggaacatggtcagaaatatttcaagcaagaggaagcacagtatttgtctcaccaatcactctcccatcaccaaccgtataaccctcatttaatgtggagcatcaacattttttttttcattttccttagtctctccgaaaagtatctagaaatactttttatatttgtggatgaaggaactattgtattatattgttttattcaacatggacagatttcccattttctccccagacaagctataagtaaagaaaagattgttggcttcggttgacaaaaaaaataaacaatgcaacggaaaatgattttagggtaggattttgtatattcattttcttagtggtaaaaaaaccaaggctgaagaaaagagaaaatgatgaaaaatagtctagaatcatttaaaattaagtttggatttaaattttaattagttacggcaacaagctccaagcgatgagagcacatcttttttcttcctcatgtgctcttaggatagatcttttgattgcttgaacgacaagatttcccagcgcagttagttaaaattggatttgttataaaactcttagatcctatttacatttatggaattatattttgtaacaataaatattaaaaataggattggatttcatatacaaaccattttcttctgtttctataggtagtattaaaactacaactattgcaattaagctacaccattataatttgatatcaccacgatctaagtgttttttctaattaatatgttcatttctaggccttcatatatagtacgtgaatatgatggcttttcgagctcttgcagatagattatatgggcagccagagagatccataggtgtagactcacttttaagttgtacacgggccaaaatagtctaggttggcctaggccttataggactggatccaacaccgtacgcactctccctttttgcaagaactgacatgatacatgggctgtaaaccaaacttttttaaaaaaactaaaaacaacggcggaacctaacggcgaacatcaatgtcgagatgctgaaaaggcagcacaaagctttgactttgacttcacgaggcacgtgtcatcgttgcggagcttgccgcccagcgacccagcagcttcgactccaaggcgatcccgccattggtgtcaaaggcacgtggagtcgttttgccgtgaaccatggttcacggcgatcccgccatcgttttgtctgcccatgtacgccgtcctcctcgcacgtcgccacatccgccgcctcttccgcgctcctcgttgggcgctgcgcctccttcccgtcaccaccgggtgaggcgcctgatccagccatgcggggaccggatccagtcctaccgctcgagcagcagcaaggtggagggaaggagaggaagagtttggcagcggcgtgcttgcttgatcgccgcccgtgccgccctggggctgagcggaacgagggccctctgttcggagacctcagagctgaagctagcaaactataacaatactttgagatgggtatcgttagaagttctcaaattctattagtctttgatatcagcctcaaggcatcaaggatttgcaggggtatctcaggagcagcgaggcatgctgccaaggctcctggctggcctatggcgagagccgagagggggccttttcttcaggtgttgtgggttcacacgagagagatatatatagaaacatgccgtcatgttttttttttaacgactcgcactagacggtgtgaaattctattgatagagcagaaaaaaattacaagattacaaccttgcaaggtcgtaaccagaaaaaaagaaaattataccaccacccacacaccgacagcgccaacacacagatccaggagaaggctaacaccggatcggccgccgctaagcgtgaccgaccgccgctaggccaacaacagaacactgccgagatcacccaaaatccgacccatacaatcaacacaaagccaactctatccaagacttcaggattcagggagagagggtgagagagaagatggaacttgtagaaactaggacgccgccacaagaggatgagaatctagagtgtgcttgcaccaattgctcggggggtttcggcaaggggatgcctagacgacgtctccaacgagagaagcgacggaacaccaccaccgccatccgtcaaggtctcaaagagaaccaagactaagctttcactcggcagccatccttgaggggcgagacggcacgacaacgccctcaggaggggaatgacactcgaacgtcatcgttgcctgtccggccaaggccgggctgggttttcacccgccgtccaccacctgtcgatctaccacacatgtaccattgctccaccgccatccaaaacctccgccggagcgtgggcaccactgcaccggcgccccccaccggccagtctccgcgcgctgccaccggtcgtgcctcaccgggccactggcctctcctcccgccgcatcggccactgcctccacgccgggcagcctcgtcgcgtcgcaccggcacctcgaccgcacctccacgcaccagggccgcctccgccgccacctgccgagcctcactggcctctgctctcgccagtcgcacctcgtgcacgtgctgccagccagccgacgctcctcctcccgccagcgccgcaccagccatgtggatgtcatctatttgaacattatattacgggtctagattaaggcgtagcctcattattctccttaatggtgatggtgattgataaatctatcgtcacccatatcacgagaacgtgggttactagacagtgagatactccctacgtaataattataagtaagtcgtttgggataatatttaagtcaaatattagaaatataaatcatgaatatttctcaagttgttgagtttgaaaatataaaagttatatgaatagatttgttttgaaaaatactttcataaaagtatacatatatccatttttaataaatatttttatataaacaagaagttaaaattgtattttagagaccatgtcgctatacaaaacaacttcctttacgagtatagagtgagtacgtggacttttgactgttccctgatcctaagttataaaacaagaaaattttattttaacgtgggtataaaatgatgacagctatgacataaagatatttttatggcgattattttattttatttttttgagactttaaagtgtacaattggattctatttttggaattgctcgacaattgtgacaattttttcgcaaaaaaaaactttcacatttctagccattggatctcctcgagattcatgcaaactttctcatttctaataaccattggatctcctcaagattcgtgcagagctgcaaaaaattcagtcgcgcgcatgagtcagagtggagtcgaacccacatcctgttgaacacatgcttgcttgatttgttaaccatctcacctcacacatttttcatctagttacattaagtaagctatagtgtagtcataatataattgcacttaattatactaaagttatttttcaaagttttcatcaaaataccgtcgaatgttctatatagctgctcccttctaattgtttttttttcgaaaattctcattgcaaagtaggggtattgagctagtttaccaaaggtataaaatgatcgtagtagatggccacccaggggcatgcaaggagtactcctttcatcctataaaatgacaagctattatctctattcagatttatagtattaacatatgttatatttagtattaggttggttttttaataaaatgtggaattaggatacttcttaaactactgctacgtggcaattgggaggaaacctttttttgggggcatggtgagtccaaggctaaacacctccggtcaaagcagagagcacacacacatgcattataggccagaacctagctagatagagtacgtagagagagaaagtatggctgtgtgtttagttaagcgcaaagtttgaattttgattgaaattggagatgatgtggctaaaaagttatgtatatgacagattgatgtgataaaaaatgactgaagtttggatcttaaacactaaacacagcctatgtgtcgtctcacatagagagagctggcatggcaatggcacaagtgccaggccagctgcgtggtggggcccgtggtccatgcagggagggagctaggtaggtagccagcgtgattcgattcctacaactatacagggctcgcgagagacagccgggacgacagtgaaagaagcttaataagctggacatgcaaacagtgcaggccgggccttagttcagctcatcaaggccctgaatcataaggccatgatgccatattgcccccccccccacccccccaccactttccatgtttagctggatgcttgcgtaccatatgccatgccatgccatttcacaagcacaagcaactgcatgctaactgctgtaaaattgagatcaatataattaagcttattcctgtaaaattgagttcgtgccaaattcatatggttgacttagcgctgcactactgaccattcagcccgggtcctacttggggagctttcggtagtagttcctcacagaataaaaactcctccaacaattcggtttttcttttagattctgagaagctgtagttgtagaaataaaaaaaaactactacttccgttttaggttataagactttctactattgctcatattcgtatagatgttaatgaatttagacacatatttttttttatatctagattcattaacatttatatgaatatgggtaatgctagaaagtcatataacctgaaacggaggtagtagaagtcaggaactggttgttccagtttcttcagattcttgctaaccggatatattactaccagctgcttatcagaaactaaagctcagatccccaaatagaccatatgcgttgcatgcgcacatgtatactctgataaaagcatgtacatacatttgatggcagatgaagcggcagcccaatgtgcatgcacagtatatatgcatcaggctgttcaatctttcactgtaggtaacgtacgtacgtgatctatatatcgtgtccggccggctcagcatgcatgcagggctgggccggacggcaaccaaacacaagaccaacctagctagctagctgctagtctatcatctactccctccatcccacaaaaaaaagacaaacctgagtttttgtgtttaattctgactgtccgtcttatatgaaattttttcataattcgtattttcattgttgttagatgataaaacatgattaatattttatgcgtgacttgtctttttaatttttttcataatttttttaaataagatgaacggtcaaatgttgagcacggaaacaaggtttttttttttttgacagatggagtacttcacattcgtggttaatttgctgcaatatataatgtgtgggccttaatttgcttgaaatctcgatcgattgatagatcatagatctgcaaacattaattgtttgttagggcctagctagcgaccgactttcccatgcagagcttgcaacaactcatcacacatctcatgcacaaacaaaatgtacgtacgtccatgcaagctattctctctccatcttaaaatataagcatttttagaatagtatcaagttaaacatttttaattttgatattaatagtaaaaaaataaaaaagatcaatcatttaaaattaatgttactaaatttatcattaaacaaactatcataatatgtaattctttttatttaaaatgtcttattttttatagatattgttagtcaaagtagcatatcaaaaactatgtcaaaatttaaaaatacttatattttgatacggagggagtagctagctgtccaaggtgtgttgttggctggacacctctctaattaacatgctaacatgtacacttgtagggcacagtttgagtcaatgatcaagagggaaaaagtgtgtgtggcactgtatttgcataggaggatctataaaataaatatatataattgggatcactgatgaaatttggaggtgataatcgatttgggacaattcgggtgaaagtgcattaatcctcctagtgggttttggtgattaatgacaaatgtggttaagtgactaatgagttcattaagtaactttcaggtgcattagtccaatgtgtgaaagatggatgcttggagaccccccccccccaaaaaagtacaaaatcaaagcggaccggaacttgagaagtgcataggatagtttatctattgaaatcaagtttttaggaaaaaccatactattaagaggggttctaggtgatgctctgatatatgtcaagtgctcttagtataaaccaagtgtcaagtttccctaagagtaatttttgcaaatactccatatgtccaaaagtgcaagtccggaacttcctgtcttccaggtccgaaagttccggtcttgtgaaaaatattttcctaagtgtagtccggaagttcctgtcttccagatccggaacttcctgtctagtttccagtttaaaattgtgagtaacggctagatgacgtcacctagccgttatacatatacagctcgtttccagcttgttctttggccattccactttcacttttcgaacctagagctgttgctagcctctcccaagtgtttattgccttctccgctcaatctagagcctaattcttgtgagaaagagagattgagagggagagaagaagatttggagaggtgtgaagactaggatcttgggtgagcacttggagtatctcgtgggctgtcatctcggtgcttattactcttggagatgatctcctagacggttagtgtcgcccgcgagaatccgttgcatattgtggatgtcccgggtaagtttgtgaaggatctcctctcctccgaaagggaacaaggtaagttaatgaagttcttatgctgagattctagaggttttccaagtagagcaacctacacttgtgacgaatttctagaagtaggttgagttggatcttggtggtcactcaattctagaaatttgcctaggggtgtttgtggttgaaggctgtggatttcctctagggtttttgcacaagtaaggcaaggggttaattgagacctagctctttggagctcctcaacagagagtaggatcgcaagatccaaacttcaggaaaaaaaccgctcttgtctctttctgtgatgtttctatggatgattctgtgatatatctcctgcttagaatacctgtgcatcatcttgagacgattggcttagtctcctgtttcgaaatttgaatttcatctttcatctgtaacccggaagttcctgtcctaagaacaccagaagttccgggcctggcaggccggaagtttcggagttccttaccaggaagttccgggtctgtttgaattttaccgctgtgatttgtttataagtttttagggacagcctattcacccccccccctctaggcttcatcagtgcgttcatcggggatgattgatttgagatctgtggacgggaatggagtgaaatcaatatattacaaacaatgaagaaaagaaaaaaaaataaaggagcaaccggatctagcccggctccatctttagtcctaaaaagggcttcatctttagtcccggttggtaacgtcaaccgggactaaagatagatttttactcctgattatttcacccgggactaaagatagcgatttttagtctcggattcgtagtcagggtgttactaaccgagagtaaaaaaccacttctccaccggtgaaatatatgatggtgtcaatgcctgatcacaagagaaatttcttcattctgtaccgtacttttagggtgattggtagagagtcagtcattagttcgttcatctgactccgaatgcatacatgcatgcaggatccactatgtatatatatttgtttcaattaacgaataacaactagtaatttattactccctcccgtcactattatttatcatttccaacaatgaaatgatgccaagtgtaagttcgttttgctgtctgaaacgtcatttatttccgtccgaagggagtagtacatgcatgtttgatataaatgccacgtgctaaactgctaaggcctttcacagtgccacgatgtggtgagttacctcgttgctgaacaccgaccgacgtggaggagaaaggaggtgggtcccgtgccttgcaaggttttgcccctcatatagctagggtctgggtttctcacgcccgaaaaagaaagtgcgatgcggtcccctctctgctgctcctccgaaatcctccccattcttccccccaacccgcgcttccaggccaagatccgagtgggcttggagctcgccggtgacactgccgagtgccgacgagaaatgggacattacaaaaaaaatcaaatagatgtcgtcactataggtgccggtagtgctaaaaccggcatctataggctttttcccacctttgtaggttgaaatcgcaaaaaaaaaggcacctttaagtaattataggtgtcggttctaaaataaaaatcagcatctattatactttgtgtcggttttctaaaaaacagcacatttaatatattataggtgtcgattaattaaaaactgacacctataatatattataggtgctgttttttttaaaaaaaaccaacacctatgtaaatcgagccgagctggccggcatcggatgagccgaccggtgcgccccaccacgacgagacgagcattggataaggttcgatcgtctcgctctctcccttctctctcgtcacgctctcttcttctcgtctcgctctcttctctctcccccgcactgctagcgactagctggcggaggcggtagcggcgaccgcgccctcccctccgccagatccggcgggaggggaggcggcggcggcggcggtagaaggggaggtggctgcggcggcaagtggcatggctcatgggcggcagcagcagcgacctcccctccgccagatccggcgggagaggaggcagcggcggcggtggagccctcccctccgccagatacggcggggggtaggcagcggcaacgacggcggcgggcccctcacaggcgacggtgagcacccccaaccgtctccttcgcttgcggctgcctgattcaaatgtttgattcagtgattcaatgatgtttgatgtgagatgaatattgccagatttgtttatgagatgaatgttgcatgattcaaatgtttgattcactgattcaaatgtgattcagtgatttattttgtgagatgaatgttgccaaaaaatttttgttgcggatgtgggaggggggactgctcggctcgatgcgtcggctcgatcgatggagccgatgcatcgagccggcttttttttattctacgaacctaaaagatgccggttctacacctttttgatttccaatcagtgccgcctcccttgtgccggttgggaaaaccggcacagaatacctattctgtagtagtgggagaagccgaaagatcagaaaaagcggagggaaaaagagatagataaccagcatactccatgcggcggcggccggagagctcgccggctacaactcggggggagcgccgcctctcgatctgcgctacccaaagctcgccgaccacgccgcccccgatctggcctaccggagctcaccggccacgccgccagattgatgaagagtgagctgataatggaatttttcttcgataaataggaaacttaagattaagatgctccggaatggaaatgaggtgcttcgacctctctttctacggttggtttctgacatcaatcttgatctatttcacaacaagtgaagtgggagattgacggttggtttacagactgcaatcagctcgggagaaaaagaaagaagtatctagctaaacttctatctgagcctttacgagcaggatccggagtgggttgcgttcattcagcaggagctgaatcacaacacccctctggagccatctgtcaatcaggcccctgctacttcggagccgtctgtcaatcaggcccttccttctgtcaaacaggcctttgtcttgctaaacacaaatccttcttttcttgtatagacgaaatacaaataagaactaagtagagtcccagagctttttctggtccatatgcagcctgaactgtgctgctctagctaattgcccaccccttccacgtgtgatttctatgttatgtatggccgtgcctaagggcatatcggttgaagtagattcttcttttctctcaaaaaaacccccctatccggacgccattgatataccaattccattgtataccatcaaaattgttagggactggcgccatttgttagacacggtaaaatgacaaatgctcccctagttaccataaaactaatgctacctatagctccatggcacaataaaaggtttcccttttgttttaattacacaaatgattgtgcaattgaaaaattcctcagtttcatgtgcacaatttaaaatccttccttgcatattggcatcgaggaaaaactcacttccatggtcatttatgggaagaaaaatagttacactcaatgctataaaattacatttgccgttgtcattgttgaatttagcatataatgatttaacttattccataaataaattatgacactgcatatgtaaactagcataatcgcataataagatctacacatgtaaactagacagtaaagcatgaacatatcaaatatgcgcaacatgtcgaacacgtaccgagggttttagaaaactggttgctcgtggtactgtgcattgacgatggcgtgcagcacgtgagcgaagaggaagacgagccgttgtggacgaacagggagcagtcgcataaagcgtttcccaaaaaccttattgccaccttctcccggtgtaagacgtcgaagacgaaggtttcggagacctgctcccccgatcaccggtgtatgccaacgagcgggatagagtaggactacgagcggtgggcatctgtgcaaggatcaccggtgtatgctgacgagcgggatagagttggactacgagcaacggatcaccggtgtatgccgacgagcgggatagagttggactacgagcgacgggcatctgtgcaagggtgaggaaccaatttcggggaccattcgacgtcgtcgtgcacacgcgccgccatgccatgccatgtgaggcgagcgagcgcgcgtgtattcccccctaatctctccacctcacatgtctcgagcggctatgagagtatcctcccttataaggaggtctccctctcatagaatacgcaaagtggtactaagctcttcatccatattatcccatgaggtgagcttttatgattttttaaagaattaattttcgaatgggctaaggcccatctattaatttcaacaatccctcaccaaatttcaaaatttcactgaaatttgcctttttttttcaatgtattgtttatataccagtggtttgatggagaacaattagggttgaacatctacctagaactcaaaactaaacttactcacaacttgaacaattaatggactacgctttgaattgcaagtcttgtacaagccagtttcactcagagtgttatctggtaatagaccgtcagtagactactcttcgggtgaaacatataagtcgtactccttgatctcttaataagcttcctagaagattcacccaaaatgaatctcttatatttatatcaactttttcctgggaaatctaaaatgaatcatgttttggttcgtctgctaggtggatccatgaggcatatatatatagcttcgattgtgaatatctatcatttgatggcccagctatatgccagcttaattggcaaacattttgtttctagctttacacatggactgcatgccaactatgcatgccaagtggctcagtcgtcgttgttcagtataattagtcaggattattcctttggtccatccatgcataatataaggtatttgttctatttaagctgtttgttctacgatgttaattgaatgaaaggatttaagattagtaaaattataatatgggtccttgatttttctgtactagatcttaggtatttgcatacatagataatgaaaacgagaatccttcgcctcaggcgaccggcggctccccccccccaaccgcgcacgtgaccccctgggccccaccatgtgtcctgccctcacctaccacgtgtctcaaaaaaatgtttcacctagtgtacttataatatttcactatgtatagatctaatgttgcagtgaattgaaacattcttttgtaacaaatcacccacatattttggaaaccctctattaaggaatttcgtttcattttttgtttcacaaaaaaaatgtttcacctagtgtactcataatgtttcactatgtatagatctaatgttacagtaaattgaaatattcttttgcaacaaatcacccacattttggaaaccccctattaagggaattcgttttattttttgttccaccaaaaatgtttcacctagtgtaattataatgtttcactatgtatggatcaaatgttacagtgaactgaagcattctttcgctatttgctgaaacattatttttatataaggtaaaacaacgcccgatttaaacgattgaaacattttcaatctacttggtgaaacaattctgatatacttggtggaacatcgtgcaacattttaaaaaaattcaataataagctaaaaaaatttcatcggaatatatccatgtgtgatcttgttttaaagatttaattgcaacgaatttaatggtgcaatcgaatcatgatttggataaataatttaaaagaaaaaatagtttaaagtggttttgcacgcatacatcatgctgacattagcgcctgattttccctctccccgtcgagcgtcccatcctgagttgtgtcctaattaaaactctctagttctttaaaatattatactctgcatgtgaatatatatggcaatatgttttgggtatattaatagagtttctgaacatttatttcaaacatactgctcaatttgtaccatacttagctatgggtccacaaaacccaacccaaggactactatacactcacccaacccaaggagcaagtagccgatcctcacaatttggagtctcggaacgaaacaaaaataaagacctttagttaaatgtatgagaattttttaaaatttacagcatatgaaatattaaacaatatagtttacaagaattagctagacttttatgtacaattagccacattatttatttttgaagtacttgttaacacccaacagacaccaagaacgaaaatagaaaaatatagccaaatttggaaatgtcacggtttccttcacggggccggtctaaccgccggcatagtgttggtcataccggcagcatatggtcggttagaccggctgagtccgactccgagttcaattttatcgggtcttaggtttccttacttggtaaggtattattcgagttctaattagtctatcccccgagtaagacatggagaggatcatgtagaaggcaagaccgatctctttataagggctatggccaattcaattcaaacctaccctatcgaatcattcttttacattacttactttcagtcatgtcttttactttatcctagtttcatctatttttctcgattttcatcataaatcgcctgccttcgctacgagagtacgataacctttgtaggtttgtctcgtaaaccttccgattcacccatgagatgggtgattaactccatattgacctaaatcaacctagagaccggtttacatctctaaatcggctccggtagcaggtttaatcttcaaaacccatcttgctttagagttttctatcaagatggttggcgactccattaatgcctcaaatatttagatgagtccgtgttgatcagaaaaagcacctgcagtactatcgtataattatttctagagtgaattgtacattggaccacctattttgacctaagttgcatatctttctgttcaagcaagtacacatacattatctttatctttgattaatctacaatatacatataaattatcattttcaatgaaattcgatgcatataggaaatacatgataaaaacagtatgataacatgacatcatacttcatccacacaccacactgcagattaatttactgaaaaaagtggataaacttttggataaaagtggcacgcttttcaaactgctaaacggtgcatttcgtgcgaaaactttctatatgaaagttgttctaaaatatcatattaatccatttttcaagtttgtaataattaaaactcaattaatcacacgttattacctccttattttgcgtgaaatatttaatctttatattcatctttatgttaaggagatttaaacaccacctaaatgtaccatggtccctctaattttaatgctctgaaaagtataactcaaatttgtgcattcctatgtgatatacattccctaggtccatactccatccacgccacactgctgtgtgtactgtccactgcctacctaccctgtaccagtacatggaccatagctaggacagtatcacagacggtacaactgttttttcatggtgtccgtatgcccttgtccgtttacatacatgcttgtattcatcagggagaaaaaaaagatagaaatacggctaaaagaattgaaacaagaaatccatagacgagaggaatttgaaagagagaatctctgccagggcccacacatggacaaccctccaaagcccctggtctgacatgtacaaatccctggacggccttggggggccacagagagagagagagagagagtgcatatgactgatctgttgagctggagttgcttccaactttgagaattgagattgaaccagtgtgtgtgagagagaggaagaactagtaagtacagattttaatgcggactcttgaaaatatactggctttaactttatctcactggtaaataaaaggatccacacactaacactaactatctataaggtggagttttcacacttggttaattatgtaaaaaaaagctaatattatgatagcaacaaccagtagtccaccaccgtaataataaaaatgctatccattaagcggagtcgtcctccttccctccccttctctcacacacgtggcacgtcatacgctccgtgcacgtgagtaactaccgtatccaatattatattcttaatcatctttctagtctatctctaattatataaacttgacctattaaaaagtacagatatattattagttttaaaatagcaccgtcactactaagaattcaccaataatttacggtttcatccaagagaatgatcctatttttataatgtactatttctagaatgaatagtcaattagatagttgacagtgtaatgtagcacactaggttataagtcatacggtttattagtgattaaaaatattataaaagtaaaacttttatatctatgttgttattgatttaaaaaccaatgctataaaataaatttacatgaaaaaaaacatgaaaatcaagttatagaatttatatttcggcagctgcttgtaagttgtagagcaaaaaaaaattccctcgtatgatttcaatcctttatattttcttcatttttcctttgctacaaagaagctataattaccattacaaggtactaagagcataatgagatagatatcttcagtgcatgtagggatgtaagtgggccgatccgcaaatctacgtatatagaggtcaaataaatgggtaatccacgggtttctgcgtcatggttcaactttaccgtacataaggatgcaagtgggtcgatctgtgaactcacttatagatcaaattattaaaagaacgcgaatattagagaatagcctaacatcaaataattagaaggggtgaggctttgaactcagatcggctagcccaccaccttatgaaactagccgaaagacccctagacgtttctcgtagatcaaattattagataaccagatgacaaatgacaaatccattagttaccccctacttttatctatatataagttcgcggatcgacctaactgcatccctaactgcgcgcatgcatatccctcgatctcagctcgatcgatcgatcaaactggctcttagacagcatccaatgtacgcgtagtttcgccgtaccgcaggtagataggtactgtagtaggtacgacgcgcggggctcgcgcgatcgaacaccacgtcgtcgccatcgatcgctgtccacccagctagctagctcagctcgaccgctgcccacggaggaagaatcgaacgcggccggggggcgccttggctggatcacgcgagaacaagagagcgagcgtcgtcgcagcacgtacgtcgcgtgtcgcgtccgcgtgcatgcaactgcgcgacgtacgtaccgcgggggccggggaaacgatggacggagttagttagttgaaattcccctgatggtcatcaatcacatcgatcgacatcgtccaggttgggatcatggcgttgcctgcgtatacgtacttgcctccccagaccacgcaattccttaactgcaaagtactgatcacaccctcctgctgccaacctgcatgccattgctagctagtagcagatgcaaggttggaattaattgaccttacacacgttagagcatctgcgagatggcctctcaaatgacccttgctaagccaaattttggtaattttagaaaattaaaaaattcgtactccaacaacctctctaattggattggatagctaaaccatccgactgcccaaatctctcacctcattggccaaacttgtctatccaaaatcacttacggatagtgagccccacgtactattccttctccccatatggccactccactccactccactcttaattctctctcgtgctgcagcgtctgctataccattaaaaatcgttggagtgaatgttaaatttggctcttgtaaattttttttgacaagctaataaccaaataaacattcgaagtagagccgataatagcaaactctgttggagatgctcctagcaaataatcattgtcaacccggctggtcgtcggtgaaatatttaaccgatccatctaacttggccagccggcagtccggcacatgcaagcattatgcatatacgtacgatatgtgtacgtggtgcttaagtgcttaactaattccagatagatcatcgatatatacatatattctgatgatgaagaagaagaaagaaactactttttgcccggccggcccctcctcgcaccctgattcaaacagtgtataccaattatattggcgcgcgtgatatcgagatcgatcgatatgatatacatgtagggctaagctagtactccctccgtttcatatcacaatattttctagcattgcccatattcatatagatgttaatatatttctagatttatatatatatatatatttggacaatgctagaaaatcttataatataaaacggatgaagtagcatatgcatatattccctccgtcgcaaaatataacaacttttagcttaaaatttgtcccaaaatataataacttcttcgcccacattttttttctcaaccaattacaagcctccaccattcaattttcccacctaccttcacttctactccaatcacaacactctcccatttaatcatacctactttcttaataaccgtgttcaactctaaaaatacttatattctagaatagagggagtatatgcggccccagataaatgggagatggatcgatcggtgttggtgtacatgcatgttactattgctagccactgtgtgtccggtctgcgtgatgcatggatggatgcaaagcgcagaagagaggcagagagagagagggggggtcatggatgcatggaaaatggatgggggatatatatgctatgccccatccccatcatgctgccctcccctgtgagacacagtgccctcttgtctccccgtgacacatatattcgtcgccgctaaagcatgaactgctgaagctaagctatagcccctcatgcatctgagcgaccttcaccaacctcatacccatccatccatgcattgtacgtaatgtccggccatggcgagagatcagtgtagtcagtcatgagtcagtcgtagctgatcactagctcgagtgagtcgcgtcttcgcacgccaagctgccaacccatgatgcacccctagctacaatcgccctggcccctgtccatgcatgcatgtactctcctatagtatattggaggtacatggaaactgctgttagatggacaaaattttagggcatttttgaataacatgagtggaaaaatgaggaatagaaaaaagaaacatatgattctgacaggaatgcaagtgtaaaacagatgattagaaaatacagggaaaacaaatgaatgaccgtttgatttgatagcaggaaaaacgtagaaatcagagatagactcaaaggaattttttaagaggttgaacctcttgctaactttcctccaaaatctctataggatttaggatttctcattcctactaattttaaaagataagatatgattcaatcctatcatcctatgtaaatccttcaaatttcctacacttttcctacaaattcaaaggggctgctaatagacatgcaaattaaggagatttaggttcaattaattgtttgttttctgccatccagcaaatattttatctctagagttgaataatatacaaatggttttggtcaactgtagcttaggggccgggggtgcaagcccacattgtcgcccgttgggatcgtcactctgcgccacgcctaaccgtacagaaaccttatagctaagataataatttctattctggataagataataatttctattctggatatagacctactctaaaattaagtgatttttaaattagcagttatgtttatgcatgtgtcacgctttgaggatggtctatgtcactaccgaattatagacctacctataattcggtagttcaatcatcaccgttggctcattatcactgtcaaatcgtgataagaactgtcagtgatactcaacataccagacaatatatatacctccaaatcctatatcatgtacagtaaaacaatttaatcgaattcacactaagtcattccaaaaaaaaaatacaaataagtgactatatattaaatttgttgctggaaggcatgctgactatatatagatcgcgattaaggaggagtatatggaagacgctgtagagagggaggagaagcaaggagagggttttgtgggggtatgggaattggcggcaaagatgtgtcaaagatagggatggcaaaggcgtggggcatgggcgggttggacaaggatgtccccgcccccgctccccgcgttctcccccccccctcccaactaccaaagaacatgtgaaaagtgtgggtttttccaaccggcactatgaaggcggcaccgatgagtgctccggcaccaatcccattttaaaaaccagcacctttgagaccactcgcgagccaaaaaaagctcgacatcgagctcatccaccccacatcatagaactccaaatcaatcacaatccccaatccccaatcaaccaacatcacagaacaagaaacactgaagaacatcacagaaatcattcactaatagggagggctccaccactgcctctcgtcccgccgccgggctgccaccacctccccacccgccgcctgccctccttccagatctgatggaggtagggcgccaccgcctctcgtcccgccgccgcgtcgcccctcccttccgctgccgcatgccgccgctaggccgcccctccacggccgccgctgggccgcccctccctagatttggcggagaggagggcgcggccgccaccgcagcctccgccggccacgggcaacgagagagagtcaagaggggagggtgctgccgccaggccgccagcgcctctcgtcccgccgccgcatcccccctcccttccactgccgcatgccgcctcccgccgatgacgccgctgggccacccctccccagatctggcggatgggatggcgggggctgccccgccgcctttgccggccgcgagcagtgagagagagtcgagagacgaggaagagagagacgcaagagatggaagtctgtggatgccttatctcgtcgactcattcggctcggctcaatcgccctataggtgccggtttttaatattaaaggttttgatttttttgaaaaaaaccgacacctataattgcttaaaggtgccggttttttgcgatttcaaccagcggaagtgtggaaaggcctatagatgccgattttagcacttccggcacctatagtgctgacacctatttgatgttttgtagtagtgcccggctccggccttagccccgtagagtcatccaaatggaaaacggggacccggcaggtgagcgaggcctcgcatcgggcggcaacatggagaacatggtgacatcattggatggcaacaagcacttgtttgcatggctggttgtcgacgaagggatggaggcacgcccggcaacccttccttggctgggaacgaagcaagtgacgggaaaaaggagaggacatgcggagacatccagcaaggggaacaagaagtcgatgacctggcatggagggatggaggccggaggagaggacagtagacgacgaggagggagagcgcttctcgctccaacggtgtgaccgcttctcactccaccgcttttggctcatgaatctgatgatgacttgcggcacatgtgttggggagaaatttcgggataggataaggggagagttccttcttaagcctgatgggccttattttcataacgggttatcactattgttgaatagtcccacattgcttgtggaagggcaaaggatctaagatataagtaggggagcccctcacctcataatctagctttttggggtgggaaaggccctttacgatcctataattggtatcagagcctggctagttcaacatttctggcccgagggacaaagtgtgtaaaggcctgatgaaccgtgggtgcctgcggggcccgtatacctgagggaccatggggaaatggtgaaggggcggtgaacggctaagggacaccaatgtgtgaagggggagattattgagtagtcccacattagttgaggaagggcaaaggacgtaaaatataagtgggggagcccctcacctgataggctagcttttggggtgggaaaggccctttatgatcctacaactatattttcactctataatgtaatcctaaggccccgcgggtggagatgtttccctgcccccggctccgcatgatgtcggggccctgcccccgtatcacctgcgagtagcatttcgcccccgtccctggccccgtaggggcgggtacccgcgccccccacccccaaacggggaaattgccacccctagtcaaagaggagagctaacgactattgacggtcataatagaccaatttcgactgtcaatacatccggaaataaaagagaattagcaatatttgtatgcatatttgtttaagaataatttatttccacttgtacttggcaacgtatttgtatataggcgatcttcatataaatggaggagaaacgatggaaaataatcgttcaaacaatcaaagctcgacgtgtggcagacttaatggatggatgggcccacaaacccattagaacacctgtaatttggcccaaccatcatgccactaagctaaggatccatcaagcgaagtccaggagaaaggatgtgccagcccaaggttcagccgaaaccgccaccagcgccgttcatcctggccttccacgtggacatcctaaattgcttcccaatgatgtttgcagggtgtttaggacattttcaactatcataaccatcattgagcctataaaaggatcactacatctccatttcaacacacaccaagaaggatcaatcaagaaactctctagttatttactttgttctaatgctagtggagtagaattagaatagttttcttagttcttcaagtcttctagagatttcaggtatcgctctactagctcctctctctctcttgtaagacttaattcaataatgaaatattcttctttatatagttttgttcctttacttcatttatataattattcgagtaccgactttagttcatacttgtctcgtaataattatgtagctagcttactagagatatgcaatggtattggtttggtaatcaattatttgattgttctatgtcatctgcagagatatagagtagtatgtagtaatgtaagcacaatgcttagattattagataccagtaaatggtgctatatgtacggatctatagaggtaggctgctgatggtgacatcttagtacatgtattcctccacgtgcgtatatagggctaagagattttcctagtgtgggtactcctccgtatctattaccaattggatggccatgacggataaggaactcggcaattaggcgtgatttctcgatattacaggagggcatagttaggggtattggctgcataattgtataatagaaagtgttaattaaaatgactatatactataagtacaggaattatgcttttctatttctttctccaattagcttagactattatttcagtgagagtattttggttaattctttttgtgtgtcaatcaacccttgtccttaaattgattaacccctgtattagattttgatcaacataagtgatataattgttattataatactctcttctcatatctttccttaggactaaataaaatacgatcccttggaaatacttccggatgaaatgctacagcagtatattcgagcgtttgcagattatgtctgtaactataaagaataataagtaatatttcgggcataattgtttggaattatatttctagtaattttttaagaaatattaagaacgacaaacaagaaactccttcacctgtgatttttgttgtgtgctgagctggagggaaatgatacttactaataagaaatcaacttattttaagatggaaggtgcatattaataccatgatcatatccacaaagaattgtgaactataatgaaaaaggaaggatctttcgatcttagcaattagattcacttgttaggtataggcctataatccaaaataaaaacagacaaacatgcccttagtatctcataatatctttgtgtttttttaaagaaagacacagacaagctggttttcttaaacaataagctgttgcttatgtgttctacccacgtgctcttaattatatggtgagcatggacactcttgattgtcttaggaggagtgttaaggctgtgtccgggaggtggaatttggaactccatctccccacactgaaaatgtggtggtttattaatgtataattaattaagtatcagctaaaaataacttaaaatagattaatataatttttgagacaaatttggtataaaactttttttaaaatgtaccgtttagtaatttgaaaagtgtgtacgtggaaaatgagaaagattagttgggaaatagaagaaaagaacttagagcaactccaacagtccccttatcccaatctccaagttaaattttagcaagtttgaagaaaaaaaaacactccaatagcttctctatttgactggccaagccatctagctggccaaaatggctccttggctggccaaacttggccagtttgcctgcctagccaaacttggttgctagctgtgggacccacgttgctccccacctcaatatctctttcccctctctttcaccgcacagatcgatcgtcgccgccatcatcgtcctacagcgccatcgtcatcctgcgatgtcgctggctcgcacctgcacagtcgtcgccgtctgatttcctccgtcgccgagggagctccgcgatgacgaggcaagagcgagggagggtgtgttggcgacggcgacgagggaggagcgatgatggggaagaagcggccggatccatcatcgctgtcgatggcctcctcctccggcaccactgtcgtcgtcgaggtcgccgtcaccatcccctctgcatccgtcgtcttgagggctccgctgtctcctaccccgccggattcggccggcggcgtgtaatcgccggggggtgggggtggggggcacgtgtggactccgctgcctcctcccctacgcggatggcggcgtggattcgccgggacgacgatgtgtggactctcgctgcctcctcccccgccggattcggccggcggcgtggattcgcgagggggggggacctctgccgtcgtctggccgccaacctccgcgcatccgccgtcggaccaccggccgctgaggttgccatcgccatctgccgcaccgtgctcgtcgagccattcaccgctgttgccatctagaaaaatggtgagaaaagagaaaggggaaaagtagggggtaggaatagcataggctgacatgtgggtcccatttgtcatagatttataatggagatggtagataaagagactgatggagcaagcaacgagtttaactagtcaaatcagatggagagttggctatatgggtatttggagagtgggatttggagaagctgttggagatgctcttagcctaattagcaatgctactaatgctatttaacactccctcccctctctatctccctctatcgctctctctcgtatggagtgttttggtgttgcatgctgtccctgctgtgcataggctttgttagctagcaaggcagctgcagttgtaggtggtgcagctcagctgggggctgggcatacagccccaaaacactgtccttggcccccctcctgcacagattcccccttctgccaaacccagcaaaaggttcccttgtctagctcctctcatcacacacactctctctccctctccaatgcacaagtaggagatgagtaccacatgcatcatgaccactttattcctcccttcccagagacacagatgagaacaacgctgtctcacctttcctgctctctcacctcctttaccacctccccctttgtctttttcttatcgaaaaagaaccggtactatatagggcgatatattagtataacaagaaaattataagattacaatcagtattagaaaaaacaatacagattaattaaattttaactattaaaaacttgaaaaacctagacttatctgatattttaaggtaacctttatatataaaaaagttttcatacgaaatatgttatttaacagtttaaaagaatactaatgaaaattaagataaaagaaaagaacggagtctaagcgtgagggtcgggggg

SEQ ID NO: 68267 - DNA, 50234 bp, Oryza sativa
gcagcttggtcgctgcaccattcttggttgcatctgattctctggtaatcctcttgcatcggcttgctctgtcatcttcttcccctccattctccatgcttggcttcaattctcttggggtggagaagagtggagcttctctcttgtctgaatgggagttgagaaaagcttcgctttttatacttgtcctgatgagaggagagagaaagagcagcaacaggttatggtgattaagagaccccactaagtactaactgatgggaaaatattttaatatgtacctgaatataagattaggtgcataagatggaaggtgaactccatcaatcgcacaagtgacacaatcagattagtggcagcatgacaatgggaatctactgttccaaggtcctccattttcatttggttgaatggcaatatataatgtcagttgtcatggagactggtggcaatttccactagtaagtggcccacttttgtattggatccctgagcctttttttcaccctgtccacttcgtgttagaaacaacaaaccaccgcagtagaggttacttgcagtaggctccaattcaaaggtaagcattacaacagttaaatattcaacaaacgttgtttctatgcaagcatttctgttaggatttggtatatttattttcttgcagacaaacttttgtgtttattctactatcatgtaaggcaaaatagttcaagttcttggcaccttctagcatgccagattaaaaatgcaatcaacggagttggtattgataaaaaaaggtgaaaagaaaagggattggagcaatctaatggaagaatcagggtgctgtttaggtatacctccggctatgttttattgtccttgagtatatccttaaaactatgaaaaaaagtcagaacaagaaagaacaaaatttagggctcttctgtagagtaggcaaagaggaactgtcaactattacacctctcataaacactagaattaaaccaaaaaaacaagatcatcactggcatgcattcagtgtccacctgcatcgaaagtgcggtattgtttgaatcaacaaggaagtctgtggtttggtgctcttaattaggttgttatcattgttgatagacagatctcaacaatccaaatggctctggtattgcttgacagtcaaacagagagctacatgagcccaatccaaaccggctcaaagcatttgaatcaagatatttttcaaaaacgtctaatgagaggctaaaggattctaaaagaagggatctaaagctcatcgaatctttgtggatgatcctcattgacagacacacgtattaaatccccctttattttcttgatgtatactgtgcttaacatccattttttaaggacaatctgacatgacacctaacagctttgaaaacttttggttgcacattagaaatgtatggaacaaatcaccatatatatctgaagtaccaaagagaaatgcttagaagtaccgaatgttaaaaacaaggggcatgatatcttcaaacattctgctctttctgagcacgctagtgaccaagattgccctctcaggtttcaacattagcttgaacaatcatttccacttcgagcttacccacaacttgtagcttccagagtgacatgtttccaacgcctggaatggatagtacatgaagcaattgacctgtaaacttgcacgttagtacacgcctcttcaatcatcataaatccatttctctctgtaattcataagtgtatatctccacagttcgaagccaggaaacttcagagttgcatgtatcatgcaaagcttcaaaaaacagttgcgtttgagcacaaggaaacacatagagcaccatgaattcaactacctctgtctttcttaaatctctcaaggcagttggaagtaggaaacttcaggtttgcatgtaaagaaatatttaaagccagttgcactcgagcacaagaaaaacaaatacttcatgtcaagaattcaacgtcatcagtttagcagaacagcatgttagtacttgctggacaaaaataatggagggaaatagtaagttgaatccataagcgtatgtggacgtatgtggacaacaataactagtagcatacttccaagacgacagtacagactacagttaaactccataaaagtcttgatagcaaaaggagaactatatgttattgtctattttaatctacaatttcctttgaatagaaggaacaaccgtactaggttgaaattgagcaagaaacccatgatacaaaattcagtgccttttatgcttaacgattttatcgcaaagttagaaatacaagtaacagtaaaaagatttaagcaataagcatagaagaatatcatttgatttaagtaaaacaggcacaggtacacaacaaagcttatagcctacaggtaactaatggaaataacaggtcagctcaaagggaatgttctttagtatggttctattaacttgatgtaatcatctgaaatcaataaaatcttccttttatcttaaacaaaaagtactatcgaaaaaggacctgttgcactcgaacaatgcttgttcgataacacaacaaatcaaataattgagctgacctccttaataagcaataaggtaaacaagtctgcagaaaacgatatttgtttctctaagtttaacaaaccagttagacatattttattgttcctagcagaactgtctacaaagatatgttggatgccctcatgcacagggaacatcgacaggcctcttatcaattggtggttgtgtctttgctttcttaggcaaaaaatgcaacattagcagagtccagcacaccaccgacatttttcatccaatcatttatgcaagaaggatttttcatccatcggtttttcacccagaagaagccagaagaatagaactacagaagggttagtcctcaaagaaagatatctccccactggtcagcctgttagtagccattagaaataacacaagaacagtggcacgggaaatgcgcagttgatggcatgcgaagggaaagatgatgctgcagggtacaaatacagagtcagttcaccaaaaaaatacaatatcaattactcagttcagattcaagaattcggtggcacccagatacaagaaaatgcttcaatatttgcattcaggaggaatgcgatttcagttatatcggaagatttgctcaataacaatacaaacatgtatagtaaattggaaaccagttatgtcaaatgactgtttggtgtcattttgtcagctcatttccaagttctaagaccaatcagttctgatctgtgattactaaattaaaatgcagaagaaatgtccactgtgccaggatacaaaatgcaggaacatctgaacaaacagctcttttaacagacaagataatcatgacagacacagatagaggcaaatgattctattaataacagggtgaaagaagaagatctggtcattacaattatctaaaactctaaacattttttgctacttcccatatatattaatctatattcctgagaggaagggcatttggttccagatgccatgacccttttggtatatcacggtctttaatttcaataactacataagcaggaacacgatgggaaaagcttagcatttcagaccttgaaatcaactttgtcaaatggaaatcttccactattactctctggaaaaaggttaaacagccttttacccgagtcagcctgcatacattgactccaatttcatctgagtaatcagagaggatctcaaccatgcgaggttcacatttgtcgatgtcagcattactgaaggctatcttccagtttttgtacattgcccatatttctcctttctttgggaaaattcggtagaaagacctctttgcgctccagtcacactccaccggatgagagaattctgatatctctttgcaagcagtctcactaccagctcgaaacaccccacaagcaactggtagaccatcttcaacccaatgtatttcttcattgagcatagggtgaggttccagcttcaacacagaaactgcagtatgggataccacacggattactctgacatacaaccttggcattctatccggagcatcatatacagcccagatctgcccctccacaaaatgctcaggtgataacttattattgtagttcatcattccttgttgggggttacctaaatccattttgctggttgaaggatttgataagtgtgtggcagcaacttcatgaaaaccatttgagtcatcatgtaaaccttgaagagggtacaaaggagcaacacttgctgatgtattttcatattgcaagttttctggaacagcagaatgttcaagctcaaacaccgttccaacatcacaagtaaatctaaatgaaggaatcctgtgagaaaacatgagcagattatgaatgtggacttgtaataactgctctctcccactcctcacgtgcctctggaaaacgcttctatatccatctacctttaccaattgtgcgacagtgcagcctgagccttttaaataactgttaagaatttctacaacataaaaggtgcttttcttccgcatcccagggtcattgcaccacccaatgtcccaatcactgtagattgcccatacctccccttcctggggataaactttaagatgatgattccaattgtcagaagatatctgatgacataacatagttggacaagttaccgatattttacattcatccgcaataaaaattccacaaacaaatggcaagcttgcactaaaccacctgttctcgtcatgggattgtggggatggtttgaaccatgaaacatataagtgctctttgtcagccacaatcttgttaatccgtgcatatctgcgagggaacttctcccagtcatatgctgcccaaatctgaccagcagcgaaattcactatctccctatcattctcaaagttatgaacgtcatattgtgtaatagagcaaagctcgtcttctctgttatccaatggatcagtaaacctgtcatccaaatctacatgtggcgatgacacacaatgcacatccttttcgcacacactcttttgcttcttgtcaacatggttctcatcaggtaactgaaaaccatcatcagctagaaagcatgaatcagtcctcttagttttggaagagctagcaacatttgaacaatcgcccacatccaaacatgatctgtcagtctgttgagcatatgaaggcacattgtttgagatgccagccaccgcattacagtctgcctcaaggctgcttaatctacccagttctgcattcggataatcatgagttgatctatcagcagcgcaaatccctttcgtttgtaaaatgtcttcgcaccacagctcaacatttgccaccgtagaatcataccgcaccttcttcgccggatcagacagcacggcgtacgcatcgttgacgagccggagggcagcctcggcgccgggcaggtcgtccctgaccggctccacctggcgcacgatgctcctgtactgcgcgtcgatcttggcagcgtcgtcgcgggggaggacctggaggatcctgtaccaatccacgccgcgcccgcggccgaggccggggcggcgcgcccgcgtctcggcggcggcgcagaggacctcgagcacggagagcatctcgaaggcgtcgtccagcctagggttggtctggagcgtctcgagcagcagcgtcctcgcgccggcgtagtcctccccgcgcatcttcgccgcgatcgcctccctccccgccgccgcctcggcgtcgccgcccatcccctccccgccgccgccgcctcagaatcctccgcgagcacaccacctgtgagacggaatccgattcaaacgcgagcattccgtccccaaatccagatcccggtgaccaaattccgccgcatttgagcccatgctgcagatgtgaggatggatggattcaattcgagaggaaattgggaacgggctcttacccaaactgatttgggcgaaggttggattcaaatcgatggctcgattccgagaaccctaaaccctagcaccgatttggatttagggacggtggctacgcatgaacacggcaatcaatctggaggtggaatgctgctcctccagctggtgagtgggttcttctacgcatgaacgctgcggcttcgtgggccgtgtcagtggcatcagaagaaatttctgggcctttggggaataaatgggccggtccttgtgtattgggtctagccgcggcctgcgagaagaacacggggggcgaggcgacaggcggtgggcccacctcctggcacgtggggaggggagtgtccccacatgtcagggagaggacgcgtggcccgaaacggggcaaacgcgagcggcgggaaaaaggggagtcatcaaagtacgggcccctgtttggttgtggtaattactcatctcgtctcctccgctgtttttttttttcgcggcagcccctagaaagaaaagcaaaggtgccaaaagaaaagggaaaagaaagacccaacaacaattgtagtatggctgaatgttgttgtatgcccgtaggtgtatggctgaaaagcagtgaaaaataagtaaaagaataaaaaataatttatagatatatttatctattatcaattaaagtaaatgtctagaaaataaaccgtggtgtaaaatagctaaaatcaatttaaatatattttaaaattaaaatttgactgtaacaagtactactaccgttgcaaccgcctcctgataatattcgttaagcactgaatgcaaactaaaatcttgtttgatataactccagatcttaattcacgttggatttaaagtttgtgtgttataatatagcgttttaaaattttatatttcttctaaaatagaaataaaaataattttctaaatgttactccgtattaaggtaactatagatttatagagttagaaatatccggttctaagaaattttggtttaaataggacctaaaaatctcatatttgaaccagaagagagcaaaatgcgtgcattttttgcagtgttcttcacagcgggtgaaactaaaactggactacggccctatttaatttcctaaattctcgacttttctcatatcacatcacatcgaaaacttttctacacatataaattactaaatttttttcaaactactaattttctcctaacccccaacttttccacaatccacagcctacatacaccgagcaaacactcctatggaaaaaagaagttactgctatgctaccctcgcagcagtagcagcagcagagtgagcgtggaggggaggagatcgagatagttctcactttgaggagggacagaggtaaaaaagaaaaaaagaaagattggaaacagtgttgggtaccgtacgtgcacggctaccaacacgagcccctgctcagctgctctctcctctccggtcgctctccgctaaagccaccccctttgctgctgctgctgctcctgctctacccaagttcataatttcagtaaaaatcggtcgaattttacgaaattttgatattttgatacggctcggaattaagttttgattagaatttcgaagattaaacagtaaatttaatcgaaatttattaaaatcgattaaaatttatcgaaaaccgtaatactgatgaggatcaaaatttagtgatcaaccgataatgtaagcactagctccaccctccggatcgaagcggaggaggtggtaaaagaaaaaggggagagaatgtctggcccggtcagcgtgccgcggtttggtttgggtgcgtggtgaaaagtctcggcttttggatttgatttcggctcccgcaccaatgcccacgctagctgctgctgttgctcctctcctctcctctcctctcctctgctctccgagtgaaacttgcttctagtaccagctgcgagcttgttatgttccgtttcttccagctttggtgctctctcaactctgaagaagaagaggttttctctgtctaggagggagagattgtgcagcgaggtttctttctctcactaggaggtttgaggttgctgggagtggttacgaagctaattaggagctttgccgctttggttgagtttcttggtgagaggtgaggagagcgtgagcgagctcgctctcagtctcacgccttttgtgttgtgttgtggaggaggagaaaggaggcggttttttgttgtttctgtcagcgttttctcgtcaggtacagcctactatacttctttcgagttcatataccgtgctgctctcgaattcggaagcccttttttttctgctatcttgcgaagctcctgtgtgcaaagtcgaaaaagtttgccgaagatgaagtcttgctgaagctgccctgctttgcagctgcagtttcttgtcagtttccatggatgagtagcatgaacaagacgcgagcagaaaatggcatcttcaaccagtggaggaactcgagctcacccatttgatcctgttccttgagcattctatctcccaaaggagcaatcgcttctcctctttccatggagatgatggcgagcaagaaccctaccaaaaccctcctcctcctgctcctcctcgtcttcttcctctcgctggcttgctcccagccgctccactcggagcccatgtccaccaccaccaccgccacccagcccgcgccaccgcctcccccgccgcaatccaagattccccacgcggaggccggcggcgccgcccgcctccgccgcatcgtgctcggcgtcctcttcggctccctcactggcttcctcctctccctcgccttcctctacgccatccgcgtcgccatcctccacgccaagtacgccccggcaatcgtcaggggccccgtctccttcaccccgcagatttcccccaagaacctccactccgcgctcccctccgcgcagccgctcgcccatggccccaacggcaagtattacaagctggttcttgacaacgatgtcaccgtcgccgtcaagcggctcgaggctagccgccctgaggcctcgccgtcgtcgatgcccaatgtttccaagtctgacatgaggagggtgcagaggcagctggagttgctagctcgggtgaggcaccagaatgtgatgggattgaaggcgtatgtccgggaagccgaccggctatcgctggcgtacgatttcgtgcccgggggcagccttgaggatgtgatgaagagggtgaggtctctgcaggtgaacctcaattgggatgcaaggaacaggattgcgattggagtggccaagggattgaggtacttgcattttgagtgcaccccccggatactgcattgcagcctcaagccgtcgaatgtgatgctagatgaagatttcgaaccgagattggcagattgcggcgtttcaaggctaattgcatcaggttcagctgatccagaactggccagcagcctttattctgccccagagtgctaccaaagcagcaggtaaaatccatacgttcacgatttctgatcatattgtttagtctaacaagcaagtttattctctgaataatttcatcaatttttagtttattcttgacaatataactgaatgtgtttagatcggtctatgtggtttgcacatttgaactattgaggggaaacttaaacataaatcattcttaattttggtattttcagttcacctgcttacaagcttcgacatagcattattcttgaatgcaagctaatattcatatcttctcatttgtttatattatgctcgcgctgtaaaagatagacctgagaaaatctttagtaaaatctggttgtattttttcaaaatgatcgttatggcattggaatttttatggtccttgggaggtagccataagcttatacttccttaggttatttagagattcctcctatcgttaggcagtgagaggtctatagactaattaaaactaggaggtataaatgcctcttgatatctgccatgaacctctgtgaggatatgaaacaaacaactcatggtatttcatatttgcagaactatctagtgtatatggatgtttgcttacttgcattgggtaccttagatataataattttgataaccagcatggagtgatacatcagattagttggttctacaatcgcaaacaatagtacatttgttttggcaaaacaaccattcagagactctttgattatagcttacatctgcagatgcattcttttttccacatttggctttctttcccaaccagcagtatcaatccttaccttgttaatactgtccttttttttttcttatatgcatctctgttgcattttgtttcacaagtcgttttctgataatgagtagtcttctaagccattaattaatgaaaaggctcaaacagaagacataaagcatatagataaagaacggccccatggcttaatgtaggtatccgacttttgctttttgtaacacaagaatctttgctttattagagaacctgcatttgtcccttttgaaatgcctttgatccttatgcttttcatatattcctacgtgcatgcatgtggtatttggtctgcccccaaattttaaattgttctttttcattctgacctcccatatccccatcagagaataaatactttcaggattggcgttctgattctatattctttttctgttctcttttagccaaacctagatacgtcattactatatttttgaaagttaatttctcgacaagtgctttgtaaccagacctgattcattcaatgcccaagaagggcctggttagtgctttatctttgtcaaggtggatattatttccaccatatatttttgttgtttccaacggatccagcgttagttccagttaaagtttttccatttcatagaggttctgcttattaggtcttactgcccccttttaaattcaaaatatttgattgtgcagatacacagataagagcgatgtctacagttttggcatgatccttggcgtgttgctaactgggagagacccaacagatcattttttctcgggagaaaccgggcgcggtggattagctagatggcttcggcacatgcaacaatctggtgacgcaaaagacgcactggatagtagtgtcttaggagaggaaggggaagaagatgagatggtgatggctgttagggttgctatcatctgtctctcagatttaccagccgatcggccatccagtgatgaactagtccccatgctcacccagctccacagcttatgatctccgtcgaacgcttcttcgtaaagtactaatctctggatgttcttcatccatggcacagtttctgaatcatgctggagggtcaaaactcaaaaccctggatgcacaaactagtgtagctttcagtgtattcccttggaagagcccatgctaaatggcccacatgggaggggagctaacagttttcagaggccaatgtaggaaggaaatctggtaggtcttactagttcagttgtcagttatgttgtgtgttgcagctacatgctggtggttgagtgagcctcattgtcatgtgatgcttctttgcccttacatgatttggaggaggtaggcaaggaagatgtgaatattgtggtgtctttgtagagagaaagctgtctttttcttggatctattgcagacctgcagtggtggtggtatgatgatgtgcttctgcattgaccgatccatcaattctatcatgtactagcagtacatcggctccaccccttgcccatgacttgctgcaggagtgtcggggtccaaacaccattttgatggcatttttctcttcagttcacatgctcgcctgtccaacagcattttgatggccatgtatcatgcacagtcacattttgtgtaaaatgtaagggcctgtttggagagtttttggcagctgcggattctgagaaatcatagttgtagaatagttttcccaacttctcacaatctgaaagttgcttttcagaatctaaaactcccccaaattggctctgtaaatctcctttggcatgggaaaatttcattggaaacctaggagtactcttcctatgcttagcttagcatgtctgcatgtgtaacttgtgttgttgagcatgaggagaggagcctactactagtatgttgacaagaatccaatgtgaaatgaaattgtgaacctgaacaaacgttgagcatctttttttttcccttgcctgtctttctcttgcttatctctaaaactctgaccaagggttgcaatgtgtagtaagcagtggctatatttagttcgcgccaaaattgaaaaattgattgaaattggaacgatgtgatggaaaagttggaagtttgtgtgtgtaagtttttatgtgatgaaaaagttgaaagtttgaactaaacacggccgaagtttttagagtagcatagtactagtaattgagagagcttttactgcaacctaacctagtaggagtagttcactattttgcctgcatcatatcctgcagcttgcattggctgggcctgctgcaatgcgatgcaaggcaggcctgtgggcctctcatggcagaagaagaaatgaagagagagtggtttggctgctgtttgttttgcggtcagctttccattgctttggcacttctgctgttctgcattgcagtgcaggcgaaggcggcagaaagacggaactccacagtgaaaggcaggcagtccggagaagggcattgccgcattgccattgacatggagtagtacgttcctagtactggtagtacttctctttctttgcattgggggcattatgctattgagatagtaatggagatgtgctgatatatgctcactgggaaaaaaaaaactgcacggatattaaagctgatcagtgttgcagattaaaaagttactctagtacttagtacgtcagcacagatattaaagctcatcagtggtgcagattactcctttttcatactactttacgttttagttgttttttagggtgaatagccatttcacacagtttcatgggagaatgacttggcatacttacgtggcatattttgtgggtcgaaggattatgttaacctaaataattaatttggatgacttgttcagacgatttaaaacctcatggactaaattgttcgcttcaggaccgtattagctattcacccttttttttaagtcaaatttttctaactttaacaatcgattcctaaaaaaaattaacatgtgaataactcatggttacaaatatatttctcatagttaatctaaaaacataaattttacaatattaaactatacaaacttctaagaattgatggtaaacattagtaatgtttgactcgtgacaaagctaaaacaataagtacttttcttctagaaaacacaacacaaatacaagtgcccacaacatgtgtacgctcacccatgtggagacgtacatacacacatcctatccttataaacaccttcgaaagactggaccatcatatctcgagattgatgaagtctccacggatacctcactatcgacgagtatgtcgtctaccaaactaccaatgaaagaataattaaccgtaaatgcaagtgttgatctcaactgggctggttccaaaaaaacctaatctctactacttaaaaaataagaggtgcttccatcgtccgtcaaaaaaactgagcgaaaaaaccgagcgaaaaaaccgggagaaaaaaaaatgtccgatccaaaaaaaagatgtccgatccaaaaaatatgaaccgggcaaaaaaaaccgagcaaaaaaacacatataaaaaaacgtctgatcaaaaaaaaaggagaaaaaaatgtccgatccaaaaaaaagagcgaaaaaaaggacaaaaaaaaacaaatctatccgatccaaaaataatacggggcaaaaaaacgaaacgaatcagtaaaaaaagcatttttttttaaaaaaaactgtccgattccaaagaaaaaggaattatatgtgacgcggtaaaaaaaatcgaatcctattatacctagaaaggtccgacactataataaagtggtgaaaaaaaaccattcgtaaaaaaatgcacgataaaaaaaagggcggaaaaaagcgcggtgaaaaaaagtctaatttatatttatcattttagtagtccgtttatatctcttctttatctctaatctaatctaatataactatttaaaaagagaagtttctaccatatattaaaaaataaaaaatgcgcgagaaaataaaaacggtttaaaaaacgcgtgaaggaaaaaatgtcagaaaaaaatcgcaaaagaaaacgcgctagaaaaaaagttccgtagtccgtaaaaaacacgcgagaaaaaaaatatttccatcgtctgtaaaaaagcaaaaaactattagaaaaaaaggctaaattgatggacacttggtcggataggctccatcgacttttttccatctcctacacgacttttgtttcgttatctattctcctatattagagagcctgcacatctttgtaggcaattatcataatatttttgtgaagtatagctattattcttgataacatattatatataaataatcttagaaaataaatatattctaattgttatttagagaagagtgcatagtgactctattttgtgtagacttgaccatacgagacagtgtatgatttgattggttgcaagaatgagattaaaagaatattttagattatatgcatgttgttatatgaataatccaattattttaggtaaagcaaatatcgtaaggttgccatcatggaggttgggctattacatttaagctgttccaattttctaattttctaattgtcatcgacatggttatgcatgaacaacgtatattatcattacgttttttcacccgttgcaacgcacgggcatgtttgctagtagaataaaaataagggagtaaaagttaacccctatcactttatcagatagtcgaaaatagccctgcctcatatgttttctctgcttttttaaagaggaaaagaaaaacgttcggatagtcgaagaaggtttttgctgcagtacagtagcgatggtacacgaggcacagcgcaatgggccaaggcagcacagcagcgcagtgaagcgagcgaggaggggggcccacccaccggcccaagctaagcgaggacggcgtggcggtgagctgcagcgtgtgtgggccagggcctcctccgcctctctcccacccgtgactcctcctcgggcgtcgcttagactttcttttgcttttggatggtgtacggcccaccacgacccatccggatggacggccccgatccaccaacgcggcgcgaatctcgaggccgatgggcttttcggaccgtacgatggatgggtggtcgacgaggtgactggccttgtcgcagagagggggtgtgggtgtgtcagtgcaactcagtagtgggcctccatggcccatgccagatggggcccatctctctctctctcactcactctctgctacgactgcaagtctgcgatgcctgcgtctctgctcgaatcgatggatggatggatgtgcttgggcgctgctgagctcgtgatcattaggctccggttaattatgacaaaacactattactgtctatactgattagtagtactacgtactcctactaagtagtactcctatggtatttggagtattttgagagcaaatcaaagccattttggaatcaagaatagatccaaacttatcgctgcaaattgacaaccacctgtgagattttcttttagctggtgcttccgtgaacttatctgatgcagacgtatggagtattggagcactactgtactatacaactacagtactactgtagactgtagtaaggccggcttgtttgttcatgtagctacaactttctcattttctgttagcagggttcctaaattgctaggtcaattttttttaaaaaaaaactttttatgtagaagtctttttttaaaaaaaaaacgaacatgcactgatatcttaatcatgtttaatgtgtaatccagttaaaaaagctaaccgccacctctcgctagaactgagctagtgctcccttccagcaagacgcgtgatctgatgaatgttctttgctgtctctgtgttcttgcgtgtgaactttcacttcacggggaggaggccgtttttactttaaccgctcgacgaccactggccggggaattatccccacgcggtcaattcatagatttcgagtcgccacctcaggcgatccctccataaaatttttcaccacgtcacatcaaagatttaaacacctgatatttagtattaaatatagcctaaaaagtaactaattatacatattgtgattaatttaagagacggatattttaaacctaattattctatgatttgacaatgtggtgccacagtaaacatttgctaatgacagattaattatacttaataaattcgtctcgtgatttacttgcggattttgtgattagtttttttattagtgcccgaacaacccatacgataccctatataatacccaatatgacacgtcaaaactttacgcactgaatctaaacacccctcaattttccataatatatactcctacttcagcattatgtatctgggtctccattcctcctagtcgtagctgacttaaaaaataactactaccagctgttatttttcctttttataagtgtatttatcaaggaaaacaccaagtttattcctttcatgttacagttggtcagaaactggtcgttgaaatagagaggacctaattgagctatagctccatgacttgcagttttcacaacacaccacacttctctgtctgaatgaaccttcctaggtttagacctagtcttcatctaaagctcaaacctacaaatgatgaaagtgactttttttaacgtttttcattttttttttctttatcgaaggatagttttgcagctagcaaatgctgcatccattcccaagtataagggttttggctacacgctattttagaactaagatagcaagtattagcaagtacacatcaaccgagaagtcatcgtgaaagtacttagaaaataatgttgtgtcaatccaggtgcataactaaaatatctcatatttccaaatgttagacggtgataagcactaagtaagtatacatcaaccgaggaggtgtcacgtaaaagctttaaaaaacaaagttgtgtcaattcagatgcataactcaaattttttatatttccgaaaaaatagtaagtgctagtttttcgcatattccgcacataataacaatattaaaccagaaagattagaatactcttactttaaaaaatccaaatacgattatttctctctttatatactcttgttgtatttattccttgttttcataaaatccgatgcaataattgtttaaaaattagagttatttggatacaaacaggagaagccgtcgcgaaaaagcctcagaaaattacagagtgtgaaatgtccactacgatccatcagcagagacagagatcgccattcccaaccggtcatgccaattaagcataggaatcagggagcgtgacagtgtcatttactccatttagcagcaacaacagcaacaacaacaaaaaagaaagcgtcgtcgccgatgcaaataaaaagttctggaaatgtggatctcctctgatacccgctgaattaattaattaatcagccagagaaaggctgtccgtgttagggaggattatataagagcaagtcatctataactaatataatagccaattcatactattaatatatggtcccacctatcatacgtacagtgtgtcttagagtatgtgctgcagctggctacagatctatagaccgctgctcttttctctcatcgtttatctcattaaaatatgtttatagctggctaatagcctactattgtacatgctctaatctatctccattgtcaaggcagcattagcatccactaatttaattgttaatttaattgaagggaaaaccaatgaaatgtcactggattcagtattgttcccggtcagagcccaacagcgcgatggcggagattaagatgcctgcaattacgcatgagtacaaatttgttttcttttcaataaatggagcctaagtccaacaaactcagcatggttcgtcgcacattctttgattatttttgttattgtcatatcattttccacatctgatagcaatgcccttgccacgtcaaagacctagacaaaaacagacaaaatgtcaacgtaaaccaattaacagattaaacaaacggacatgattttcttttttaaaaccacacctgcttatcctatttttcagctgtaccgacagagatttccatgaaattgacacacgttacatagccaaggtgaaatttctatcctttttttttctttttgataaccaattatacaaaatttacagtcaaaataaccacatattactgcaaaatataatttgtaataaccgactaatacaaagtttgtaaccaaaacaattacatattattgcaaaaatacaatttgtcaggaaacaatagaggttgtgtttagttactgaaaaaaattaaaagtttgagaaaaaatggtagtttagaaaaaaaaattaagagtttatgtgtgtagaaaagttttggaagtgatgtgatggaaagatgaaagttggggttaactaatcacggccagaaataaccgaaacgccagtctaaagactggtataacaatctggtgaaccttcatcctcgattggctaaagacaggtaaaacaatccacggctaaacctttatcttgatttgtaaaaggctgcacaatctttttatataaatatgtactctagttcttgtcccctattccttttcctttttccttttcaatttttttaagaagcagtgtgaaaatttcaccatctgtccgagtgtggaagccgggcaggtccacgtgtcactttcggatgatccccatcaggtgagctggagctgctcgacggcagtgactcgccatggatggacggcagctggctctgtagggatggaaggcaggaagcagctgcagctggctggcctgcatgcttgccgtgtcgaccagctacaggagaggcggtcaaaattagtgccgtgaggacgaaacccacatcattagagcaagtatactataaacctactataaacttacgtaaaggagagaggtaaacaaaagagaaatgtgttggctctcatacaagagctaacttaacacaagctctaagacaaatacattaaatatataagtgagagatagagatagaagaagaaaattatagctaaccttatagctaatctattatatgtgttgactttagtttaggctaatagtaggaagtgggctatattagtatccttgctcttagcagcatactaatcagcccagccttttagggccccgttgaattgtaggagtaaaaaaatagcggaataaaaaatacaggattctgacagaaatacaattgtagaacaaaagattacaaaacacaagaaaaacacacgaatgaccgtttaattggaccaaaaaaaaacacaggaatcagatgagagagatagactcagaggaaatgttctaaggggttagacctcttgcaaacttttctccaaaatatatataggattacctattgcatagtaattttaaagaattggataggatttaatcaattgtttcaaagactttcggtttttttctataggattgaaatcctccaaaattcccgcaaatcaaaggcgcccttagcttagcttccggagcgttcaattatttaattaccgcctcggatacacaactaatcggttaattaattattagtcgagatgagatgagattccttggacgactcagcagcaggatgcacagtagtagtgctaggtcttcacgaccggagagagataagctaaacaaatatactagcgccactaccatagttaattaattattatttaattatatcgtctctctaatgacccagtaatgatgataaactttttagtattttttctccatttagttttgggctgcaaagcaggagacatatgtagtactagtagagcaagtttaataggatagctaaatggtggcttcaaatcatctatagctaatataatagcctatttatataatagttaactataaaaatatactacaacattaatatccggtcccatatcatacacacacgtaacgttttaaagtccgtgttgcagctggctataaatctgtagcccatttttttctatttattttcttttttcttgatacgtggttatagcggcttatagtgctactgtacctcctcgtagtagaagactagaagaggcaatagcttagagtaggtacaatagcagtctataagtcagctataaatatattttaaagagataaaagaagagagagaagagtagcgggctacagatatgtagccagctgcagcacgggttctaatatataatgtgcgtatgacaggtgggaccagctattgatagtatagtaagtatctattgtatgaattggctattacattgactatagatgatagtagtaggctatattattaaacttgctcttagccacagtgcaggcccagcctgagccagccatcgtggccagctcgcgattagggattattaattagtgggtgcaatcaattatggtggctaatgggaggggattagtagtttaatcacgttcccccgcggccgcggccgtcgcggtggaaaggaacaggagacgcgcgcgttgttgccgtcggatgccgcgacagcgcaggccctgctccccgccgtccccgcacgccgggctccgtctccctcgccgttaagcaccgcaattattgcacccctcccccctctcgccgttaagtatagttaattagtggatcggattcgatttgattaggacagtcccaaccttccatgtaggatgatgtctatggtattaactacattgtcatataggaattttagcttatgtgtcactatattatttaagagagagtaaagagagaaagaaactgagtctcatgcaagacacaactttaacacgagaaataaaatgtgatgctgctgctttttcctctgatttggtggtgatcgctccatggtgcggtttcttgttatggagcaaacaccaaagcgttggtcgtgtttattgctgcctttttttagctcttactttgagtacgagaattcgtttctctttcttataaaataatcaacgcgtacaggttcttttttttatatatatgaaaatctgcgtttctggaaaatgctccatgcttgtttgttcatataagtctctgaatcgtggagctttgaccatttcaaatttacaaggaattcataaatattctgaaatattttatattatcatcaaattttgtctgcgtgctaaatacagccatacaattttctttccaatcaatttaataattcaaaataattagcggtcaacatcaaagcaacaacgatcagcaagtaaacctgtaaacggaaaccaggggtaatgttctttctatcaagagcaatcagtagtttctacgagccaagttacgtggttgttaatactcgaattattccatcaaacaagttaataaagctgggggggggggggacattctttttttttttccagaaaaagaaggcgccggcagaggggttgggcaacccgttcaagggctcgttttgccttgccttttccgggcgagacgaaaggatccatcacacggccggggggctctcattcccaaccccgctttccacatttccaaatctagacgtgctttgcttcgccggaaatccaacccacttgctcccaccctaagccccttccaaacacgaaaatttttttatcccgtctcatgtaccgtttcagtataagggtaacggtgggtttccatatttaatgtttgattattcgttttattttaaaaaatataattaatatttttattgttattagatgataaaacattaatatactttatgtgtgactgattttttaagaaaagtttataatttttcaaataagacggacgattaaacgttagatatgaaaacttacaaacacacttatattaggacggagatagtatgatgtatacaaaatcttggatgacgtttgtgtaaatcgtatgcgtatgatttcactcgtcgtaaatttaaattctactagtgtttaacaaaaatcacataacatgcgggtgtgttttcaacggaattacggtgagaatagagagtcacagctactctatgtctgtttgttctgtttgtttgcatgtgttttagcgcatattcgtcggtatgtgagcgtggtgttgagtgtacagcagagtgtaagcgtgaattgaaaagaaaaagaccaatactagcactagaataatgaaattgtgaaaatgatcgaaaagaaaataaaggaaagggagatcacttgcttatcacctgcggtccaatgggcgacggaaacatggagcccgtgatgtaaaatactcgagagaaaaaagaagaattagcaggaaaacacgagcagcggcagcgagcgatggaacggagcaagtgggggagagaaaaacagggaacgggggtgcagcttggtctctcgggtcatcaccgtccacatcatcacgcgccacgaaatatctcccccttttggtaaactcgaaattaggaggaaactgtttgggttctgtagcagttagtgacctattagagcagatacaatagtagaccataaaccagctataaacatattttaaaaaggtaaagagagagaagtagtatcacggactccaatacgtaatgtgtgtatgataggtgggaccggatattaatagtatagtaagcaactattatatgaattggctataaataatttagagctaatagttggctatactattaaacttgttcttgcttttagtactagtgctctgttttaacaccactgctgccaatagttttactgataccgattcttcatgtctcagtagccatcaataccagcggcttgacaaaatttaactctacaaagataaaacgcaccttcaataatgcggtagagtggagttttccatcatggttgtacacacgaatcctggtgcagtaactctgtgtttaagcgcgcaatactacaactaattaagaagtcttttgagctactccaccggacaattatcgtggactaattttttgatgcctccatttattataaaagtactatttctattgtagtactgcttagggctaaacacactttaaccgtttatcgctttatcaaattttaaaagttctataagttttttctcttaaaactataataaaatttggcaaaaggcatgaaagtaaacaaaaccaacactaaaatgtgcttaaattttcgtatggttgattcggtgaacaagtccttgttaacttgatctcagcatactagtatcacttatctcctcctgtggcatacatgttagggtgacacaccactgcttgcccgtgtgttacgcaacagagaagagagacaagatagtagtaaaagaaaaagaaaatatcctatatactccagcaaggggagcagcgtgtgtgcacgtagcacgcacagcagtaggtgcgcgaagcaatggggcatcgtccaagccaaaaaaaaaagaaaaaaaaagaaaaaaagaaaagctgtccgtaggtgagggtgtgaggcgagagacggtgctgcatccaccaccccgctgcgcccgctgccgctgcagcctggtcagccagccagacagcccgcacccacgcggacagggcccaccacgaaccaaaccggcccggttcggttcacagccacacgccgcggcccggtttatttctcttgatttatttaattggtttaacttctttttaatactaatgttttagcgtgtggttttttggtgtactccctacaaagagaccaccaccaatccggctaccccatcccccctcctctttctctcctcttctcctctccacaaaaacatttctactgcttgctcgtctagtattccccacctccctttccttgccttcctcgctgcctcctcctcttcctcctccgtctccgctagggtttccgcgccgccgccgccccgatccgagatgccgccggccgccatggctccccctcccccgccgcagggctcctccacaggtacgcgcgcgcgcgacccgccccgcgcggtcagatctggtcaacacagctctcctcgcttgcgagcttcgttggggttgggtttcgaggttgttaatggttttggtggtggtgcaggggatccgctctacgacgagctgtggcacgcctgcgcggggccgctcgtcaccgtgccgcgggtgggcgacctcgtcttctacttcccgcaggggcacatcgagcaggtggggtgaagcttccccttctgattcggcaattttcggcttgagaggttgctttttcgagcgctgattttggttttttgatttgattgattgtgctgggttgctgcaggtggaggcgtccatgaaccaggttgccgacagccagatgcgcctctacgatctgccctccaagctgctttgccgtgtcctcaacgtcgagctcaaggtgtgcttcctacttcccctttgatttgcttgctcttcaattccggagctcaccgacgcgacccctctctgcttcatctgtttgtttgtttgttctgcttcgattttgactctgttgctttgttatttttttttgttggggaattttgtaggcggagcaagacaccgacgaggtctacgcgcaggtcatgctcatgccggagcccgaggtaaatttcccgcgtgaattcttcggaggatgagtaatttttgccgtctcggtgaagttgtttaatttctttctctgtttgaatttgtttaatttctttctctgtttgttcctgcagcaaaatgagatggcggtggagaagacgactcctacgtccggccctgtgcaggcaaggccgccggtgaggtccttctgcaagacgctcaccgcgtctgacaccagcacgcacggcggcttctctgtactccgccgccacgctgatgagtgcctccctcccctggtatgtgtgtcttttaaccctggagtagatgatcctattaatgttcttcatttgaagtgtgtttaagttgtaattgatctgtgctactagctgacctgatctgcttgcttgtcaggatatgacccagtcgccacccacacaggagctcgtggccaaggatctgcacagcatggactggcgcttccgtcacatctttcgcggtaagttgtgtgcccctttgcttaccatggttcatgccatttttacaccgtcttgcatacacctgcggctctgcagaccactagttgtaattgctgttagttctttgtcaattgattagaccactgtaccattcaagcatttctggcaatgttacacatcaaatctttcaatgaatcgcaaaagttttttctttctgtacttgatgttgacgatgatgatgattattgtgttattgctgttgaatatcatcagggcaaccgaggaggcatctccttcagagtggttggagtgtgtttgtcagttccaaaaggcttgttgctggggatgctttcattttcctcaggtctgttgtggtaccctctctgcccagcatttcaattccttgatcaagtgttaactttgctgtgctctacgcagaggagagaatggtgaactccgtgttggtgttagacgagctatgaggcagctgtccaatgtgccttcttcagtcatatctagccaaagcatgcacctgggagtccttgctactgcatggcatgctatcaacacgaagagtatgttcaccgtctactacaaacctaggtatgttgagatgtccactacaaatctattgttttatctggctgttaggctattcttgcatagttgcatgatctgtaacatatcgaagctgttcctgccactgtgatcccatctaattaaacttctctgaatgatgatgataggacgagcccttcagagttcattataccatatgatcagtatatggagtccgtcaaaaacaattactctgttgggatgaggttcaggatgaggtttgaaggagaagaggcaccagagcagaggtatctgttgtcttgatattctatgtaaatatggttttatgtggattattccaagtgattgcttgattaaacttatttccattatgtaggtttactggtactataattggcagtgagaatctcgacccagtgtggcctgaatcaagttggagatccctgaaggtaggttcttgtttactactggcattttatgtggctggagaagttatgtattgatgggaggagtttttcaataatgtaggtgcggtgggatgaaccatcaactattccgcggccagatagagtctctccttggaaaatagagcctgcttcatcacctcctgttaacccccttcctctttctagggttaaaagacctaggccaaatgctcctccagcatctcctgaatctcctattcttacgaaagaaggtaactacacaatcttatagatcttaagaggaagggtgatgataatgcgtgttcaattaatcctctgaaaactgttggtgccatttgcagctgctactaaggttgacactgatcctgctcaagcacaacgaagtcaaaacagtacggtcttgcaaggtcaagaacaaatgaccttgaggagcaaccttactgagagtaatgactctgatgtcactgctcataagccaatgatgtggtctccatccccaaatgctgcaaaagcccaccccttgacatttcagcagagaccccctatggataattggatgcagttgggaaggcgtgaaactgactttaaggatgtccgttctggctctcaatcttttggtgattccccaggcttctttatgcagaattttgatgaggctcctaaccgtcttacttctttcaagaaccagtttcaggatcaaggttctgctcggcacttctctgacccatactactatgtatctccacagccttccctaactgttgaatcaagcacacagatgcacacagacagtaaggagttacatttctggaatggccagagtactgtgtatggtaattcgagagaccgaccacagaatttcagattcgaacagaactcatcaagttggttaaatcagtcatttgcccgacctgaacagccaagagtgattagaccgcatgcatcaatagctccagttgagttggaaaaaacagaaggcagtgggtttaagatttttgggtttaaagttgatacaaccaatgctcctaacaatcacttgagctccccgatggctgcaacacatgagcctatgcttcaaactccatcatcattgaatcagttgcaacctgtacaaactgattgcattcctgaggtatcagtaagcacagctggaacggcgactgagaatgagaaaagcggtcagcaagctcaacagagttcaaaagatgttcaaagcaagactcaggttgcttcgacgaggagttgtacaaaggtatagtattgttttcttgatggtcatgacaatgtgcatgtcttttctgttgcacaattttcttttacttaagaattactgaatgtttgttgtctagattatgctagctgttgagaacaaactatccagtcatatcagagtgaattgattctggtggtgttaaagcacatattgttcttttattcagcacatgaagttttttcttctcgtagttgacatgctgaagttctcgttttgtaaatttcttgcaaaatctcagttttatcccctttgtggtatggtaaacccaattttgctatttcttgtcccaaaaaaaaatcatgagcaatattattcagtgcagcatgagtgtgtcaagtttgactattggtctgcactatgtaataacatcatgtcattgattcttcatgcaggtccataagcaaggcgttgcacttggcagatctgtggatctttcaaagttcagtaactatgatgaactcaaagctgagctagacaagatgtttgaattcgatggtgaattggtgtcttcaaacaaaaactggcaaattgtttatactgataatgagggtgatatgatgcttgttggagacgacccatgggagtaaggcttctatcttgggtacctgcttgatgttttgttaagctttccttcctaatactgattctagctggttcattttatgagcagagaattctgcagcattgtgcggaagatttatatttacaccaaggaggaggtccagaagatgaattcgaaatcaaatgccccaaggaaagatgactcttcagaaaatgagaaaggtcatctgccgatgcccaacaaatcagataactaggtatgcctgctaaattgccttatctggattaatttattcaattgtcgataaaacttgaaaacaagaaaggaagtcgtagattggaagtgtagccgtaggatagtaaaattcggtttctgtgaacttttattctctttccattgcctctgcctggcttttacttattcttgatctgcaagcatggtcacgtgatattgttgtttgctatgaagagcttgctccgaaagcgattcacctttcagttgctgtttttggcgtttgtgcaggttcagtgaagcgagatgatacaagaggtagatcgcatggagtcttgagagagagatgccattctgcgggtcccagtcaagtaaaccccctgatgtgttggtgatcacccctgcccccccttttgcttatctgatggctgatgcaatgcaaaccctatggctttagctagtatgagatgtagactgcctattgtttatccttttgttcctttttcttctcttggcagaaagatttagggccaagatttatcattattgctattgcccctctcaactcctcccaactctctgatgtaaatatttatctacgtagccagccacccagccagaagtagagcagtagtagtagagttaccccctaccttgtattaaccagcagcctattcccccggataaatttgtgtaagctctgtagctcgagataaaaaaaaatggcgatcgaacgaacgaacaaatggcgtatgtattgtctgatctttgatataaatatttatcaatgaatgtatcatagatggatatagatgaaggcatgctgcaacgtgtttaatttggcaacgttggtgtggaaaagcagaaagctgagagatcattgttttgttgtatatgctcgtccagtaatcgattggtgatttggcagcagttgattgcgtggtcgggggagggggatggggatggggatggggatggggatggagacgcggccgtgtgttgggggtgttggaacaaacaagacttggttggaattggatggccgcgtcgtgagtgctggtgggcgcccactttgcctcctctcccttatcatcatcttctcttcttgttgattcctacggtaggtactagctgatgaggaagtcttgagtggtgcggtcttgcagtgcaaaccaagggaacaggaaataaaaggggaatagtagtattggcatggcatatgctgcaacccccttgtgtcactttcggtgctcgtgtgtttcgttgactagagagaatggcaggtgctctgtccgtcccataaaaagtctcataaaataaaaaaaaacttatactggatatgacacattctattacaacgaatctaatactagaatgtgtcatatctagttctagaatcgttttttttccaaaaaacatttagttttagatttgtttttttttttccagatggagggagtactccagaaagctgcctctactagtgtgctctcaatactgcgctacagtagctagtaccactgctattgctgcagtgcttacctgggacattttgttgcgatacttagtgttgcgaggacttgatcactcgtcgaccggctttcccatcgatggagagaggagaatgaatggatcaatcaatccctctatcccttcctgtgggggagcactgaagaagtcgactttgaccgagtaattgactgcatcgggaggtcgtcacggggaagatgagatgcgatcaacacgagccgacgccgacggccaccgagtccaacgccggtgctgagcctcagcacacaaataattataattgagtattaattattactccctccattctaaattaatttacatataatatttttgagattattcctaaatgatctacatatttgtgttcatttattaagtctattcgttatttgtgtattggagtaaatggacattaatacatgcatccatgcacacaagtatttataacccacatgcaatatcttgatttgctattggctaagaaatagtgggaatggtgcatgcattgagtttgttgctaaagtaaatatagtatgagagagttattagtttttcttggtcttggtgtacctatgaaatatgtagatcaatttggaatagagggagtacaaattttagaaataaatttatttgatttttttgaaaaaacttatatatatatattttaaaagaaccgtgcgttaaatttgaaaaccgtgtcaacggaaggagctgaagtttagttgaagaaaagaacggggcttgcacggcactggcaggtgggcccgtcctacttcgcatagcaggcgtagcacatgctgggccggcccgctcgtggtggcagtggcactgacaaggcggggccactgaaagcgaggtggggggcccatcttggttgggcctgacaggatcgagtccacgcaggcgggcgagtccaagcgcgtggcgacaaggcctctgctttactcgtggccagcagccagcagccagggccccacgcgattctctgtctctcagactctcactcgtctcgtttttctcatgctactcctacatttgcatcactaattcactacctcctctgtgccttttgttgtacgaccatggcctggatcgatgaatcagtgatctccgaatcaaagtccaagtcttctcgacttctcctctttagaagggcatccacgagaatattctattcaaccacctattaccattgtgcaactagtccatatagaaaaatagcaaaagatacccatatacatatggactatccatatggaataaattatattatctatctctactcctctctcttctcctaatgataccttgtatctatatacattgtggacattgccatatggataaactatttatgtgggttccatttatatggatcactttgccatatacattggtgatgcccgaactagttcaatactaatacatcaaattactaacttcatatatatatatatatatatatatatatatatatatatatatatatatatatatatatatatatatatatatatatatatatatatatatatagtcagttcgtacattagttatttatactagtagtacactattaatatctggtgacatctatcatacacacattatgtcttaaagtccgtgctatagctgattataaatatgtagcccactactcttgtttttttatagcttcatgtaaaagaaaaaaaatgtttatagctgatatagagcaagtataatagtaggctataagccggctaaatgctgagttggaggaaagaagagaggagagagaggagaagcgggctgtgaactaacagccggcttggatgcaagaaccaagaaactctttgagagagacaagtggactctgtattaattgtgaagagctaactattatatgggtaggttgagaaaagtctataaagaaccttatagccagcaggtcggctgtattattagccttgctcttataatctgttatgttatggtaactactgttactagttttgaatcgaaatgctagtgagtactaatgcttcgttgacaatccaacgtgaccaatgctcctaataactcatcgagtcgtcatcatcatctctcacatagcatctttgacaaaaacactttagttctgcacggacgaacagcagcagcaagcatcgaatcgttttcgatgccgtctatcacgctgtcattactactccactttaggatgcgcatacggtgagacatcttctgaaacatatcaggaactcttgtagttcatgtgaaagtcctgcaaaattcctacagtatattccaaaggaatcaagtgttacacagaacagaacacaattgtattgctagcttcaaatttcagtgccattgatcttaaacaagttcaggcgaggcagttgtcatgcaagctccagttgcttgcatcctgagtacttacttgccagaaccagaagagtaaagacagatcaatgtaccaaacatcaaactaaaccaactgaatgagagagaggcaacgcctaagcatcgaatgctggtcatgcgagtgaagtgataaactggaggcgatgctagaaggatgcaacaattttcaagtgtgagaagagtcttatcaaggactaccttggatgcaatatactcctagaaactgagggattatcttttgtaagttgatacaaccaatgcttgtaagttgtaacaatcacttgagctccccgatggctgcaaaaaacatgagcctatgctacaaactccatcatcattgaatcagttgcaacctgcacaaactgattgcactactagaatcagtaagtagtaaaagtacagctggaactgcgactcagaatgagaaaagcggtcagcaagctcaacagagttcaaatcaaaagatgttgaaagcaaagtctcaggttttctctgaagttcatgacgatgtactacatgtcttttctgccgcaattttccttttttactcaagtattattatgggccgagaaatgggcccaaatggcagcctgaatcaggcttgccaagacctaaccctaccaagtctcgcggatgccgccgttccttcctccctcggtaaacaaatacgaatctttcctgtttttttttttgattttgacgatttcatcctccttgttggtaaaaaagatctttcctgtttagtttttgattctgattagctcgaatttcgattgattttgaagttacactccgacaagagtacaatggccctctcacggaggtttctgaatctgatcgtggacaaccgcttccctggatccaaatcgctgcgctgcatcgaccttacgctccagaatttcttcaacatatcagattccaaagttgtcgcggctgatgcctccgcagccataagcggcagcatggattggatccaacttccaagcccaatgttcaacttccaagcttcaagtgtggcccatcactgggaaattagctgcttcccgctaagaggtcgtgaggtgctctgcatcgaccaggatgaatgttgtttgatcttcttgttactatgcctgacctctatcaccccaagggatgccccatctccctattcgttcccagcaccaatgttgatgatgatgatggtgatggcaccctcttcatcatggagagggtcgttaaaccggagtcgccgagaagttcaccgtcgcacagcgatcagttcgaggctgttttctaccgaacgcagagctctgtccgcagtgtttcgtccacctgcaaacctctacctccaccgcctttcgtcagagaccccaaattctccaacacacgcaccacgatcaactcgtacgcggtggtcagtggtggatctgagatctgcatttcggtggagggtgctggcacttactgcatggacacagtgaagcatacttggaggcatgtaggtcagtggacattgccattctatggcaaggttgagtatgtacctgagctcaagctatggtttggcctctctgacaagaccaatcacttggctgctactgatctctccgccatggatgactgcttccagaggccagagctagtgagagcttggatggaactctcaccttgtcagcctgggctccggcaggttctgcatcgcaaggttcttctacactcaggcattttgcgggctactatcgtgatcaaataattgatgatccctttgttgtcttgactggtgtggatgttgtgccggatgatgctagtggtgatgcaaatggcagcatgggggaagtccagctccggatgatcaagtattgagtctaaacttgccagcggtgcgatcgagagagtgttctgaataatttggatctttcgttcaactctatctgctagcattatgtaatttttggtctagggctgtaaaagagatttggtatctttcgtaacttttgtgacaattactaaagttatttatccatgagatattgatatgatgtttagttttgtttggtaaacaataatcaagttaataacttttgtgactgttacaaaactaactgacagaaagccttttattttcctatttattatatctagcctagatttcattgagttttatttcatattcaaattctcccatttaaatttctttgcaatgttataaacagctcaatttattcctctaaaatcctattatattagcacagctttttttcctaattaattcctatgacctatattttttttatcctacctacacataaatttcaaagttcctacatctatgacaccccttaacctaaattcttaatcaaccccttctagatctctttatttaaattcgtttgaaatcctattcttacaaatattctgaattcagacatctatcttgttcaacatcttccatttaacaccttcccaattttataaacatctcgatttattttcttttggctaacacttgttcttttagccatatccctttttccataacttaaattccttaatttccgcctccatagacattctgaagtatttataccaaaggctcgactctaaattcaaatatttattcttctatccaaatactcttcctttacaccaaaaacccaaataaaatccctatgaatttctccctcctccacctaggccgaccaccagcccatccttcttatccagtcctcagtagcccatcaggctccaggcccagagtcgcggcccactgatccgacctcttctcctcctcacccccctccgccgtcacgactcacgagccctcacgagcaaaaatctttcctgcttgattttgattttggtgagagctcgaattcaatttccaagttgattccgacaataccgaatttcatccttcttcttggtagtaacaagtacgaatctttcctgtttattttgattttgatgagctcgaattttgattgaatttgaagttcaccccaacaatggccctctcccggaggtttctgaacctgatcatggacaaccgcttccctgtatccaaatctctgcgctgcatcgacctcacgcaccactgcaatctcttcaacgccacaccaccgaatttcttcaacggatcaaaatccaccataatcagagtggagaacaggattcaacttccaagccccatcttcaacttcgcagcaggtttcggcgaagctacacgtgcaggtttcggcgaagattggaggatggattgcctgccgtttcttgatcgcagggtgatctgtgcggaccagtcgggacgctgttttctcttcgaggcagacaggagccgcgtggttatgctgcctcgtcttcacggacccaagcaggtgcccatctccatcctcatcccctgccctgaagaagaatccggtgaattcgacggcggcaacttctacatcatggataagatgagcagagctggagtgtcgggaaccaatcagttcgaggcgttcgtctactgccactatcgtggaagtcgcatcatgaaatcatggacatgccagcttctcccgccaccgccgtatgtttatgacagaacatacttgggccgatggctggagatcagatcttatgttgtggttgattatggctcgaagatctgcatctctgtcaaaggtgttggaacctattgtatggacaggaggagcctcacgtggagtcacctgggaaaatggatgctacccttcattggcaaggttgagtatgtacctgaggtcaagctctgggttggcatttgttcaagcacccatgaactggctgctgctgatctctcatcgatggattcgcagccacaattagttggtacttgcaaggagtttgaaccgccggaggaatggaagcaatgcagggatcctcaacttgtcaacctgggttccggcaagttctgcgtcacaaggttctttcgcaatcaggctcccaaaggggattctgatgatgagttcattgggaggaacattactgtcttgaccggtgtggaggtgatgcagagtgcttgtcatggcaatggcaatggcaatggcaatggcagcagtggggaaatggaactccagatgatccctcacagatcgagatggtatggtggcgataccatcgggacagtgtgctgaataaaatgtttcatctgggacaactcagtatcttgtcggacaaattctgctcttctgtgctgcccatttcatacttcgatgtattttggtagtatcctctgcagtggtttgtaatgtagcacgggtgtgtttagtttgcgaaaagaaaatttttgggtgtcacatcagatatttgatcggatgtcggaacgagttttcgtacacgaatgaaaaaaattaatttcataacttgtctggaaaccgcgtgacgaatcttttgagcctaattcagccgtcattagcacatgtgggttactgtagtatttatggctaatcatggactaattagacttaaaagattcgtctcgcgatttccatgcaaactgtgcaattagtttttgtttttatcaatatttaatgctcatgcatgtgtctaaagattcgatgtgatgtttttagggaaaaaaattttgagtactaaaccagaggccttagttagatgagtgatgacatgtcttgctgtgacatagaaaggagaacgcaaactaagactttagatcaagtttttttaatacttttaaggcactttagatccaaagtgaaagcacattcaagcgaggaacttgtgacgcatgctccagtcgttttgcatcctggtaaaaaacagatcgagctaccaaatgtcaaactaaaccacctgaactagcgaggaaacaacgcatcgaatgctggtcatacgagtgaaaaaataactggaggcgatgctagaaaacctgctccaggttgcaatatttgtttttctggggttgtacggactaagctgatcagctcatgtgaagggcttcttcctcgacttctgtcaggacatcgtcctcgaagaacgcctggtggagggcctttatgcactgctttgcctcgctatcatgaacaatcagagacatgttaacctgttgaaggcggcaacattgatatcaggaaccaggacatggatacagcgttgtcaagtgtgagaacagtcttatcaaggactaccttggatgcaccttgcgagatcatctggacattcaccccgcttttcctcaacacttgaaaggccttcaagaccagatgtgtaggtgtgttcagtgtgagtattgcggctatcctatggaaagaattaggtatgcgcagaaaatcataccttttccagtataagagatgatcgccgtacgtttccaatgagtgatattattgccctctgctgaagtagatggacaactgcaattttctcaagctcttcaactacatggtcaagttcctggaaatttggcaacaaagcgaacaagactgagaaggcaatgatcagagcagaatgattctgagaatagctacatgccacaaaactatggggaagctaacatttttactacctatatatgccacctttagagaatgagcagtccaagtgcactaatgaacatttaccatcacaaaataccatagtaagttccatatttatcactaacatgcaattagaacctaaaatggtcaaagttgcggactggagaccgtgttgatgtccaaaacaacacctaactagaaactgagggagtatcttttataaggcaacagccaatataaacaaataataagctcattttttgcaattatatagagttagttttaccttgaaagaatgtactagtttggtcagaagtaccggcatacagtattacaactacttgattttgcatgtagataggtgcacttgcctgttgaataagttccctgctccagatctttgatggatcaagcgacacagaaatactaacttcactagtagccacacaatctacagatatccctagatcttcgaatatagagaagaccttctcaagcgcatacagagagcgatcagaataatgacatgtgaattaaaattactggaccaattgctgaacatacctttgccagaaaaccaaattgaccaagcatccgagtgcttactatatccaacatagtgacatttgacttgagcactatgctagttagcacaacctatccagagaaaaataaagaacaatagaaataaaatccatggcccgagagttgaatggtactgatgtgagaacatgttttaattaatctgctacagaccttatccatctctctttgtttagtgatcagggtgcctggagctttagggttgtacgaattcttaaccctgactggtatatcaccttctctagcaggtctcatagattgtggatgtaatacctatcatggagcacaacaatgcattactatcaactaaaagttctcttttctaaacgtgcgaagagcaacttaaattgacatagtgagcaaacccttatcactttgcactttgcatatatagcatttactttgcagtttgcacttcgcacaaatattttcatttacatctaactgtgaagagcgtaagccattcatgctccaaatgaatacatacctgggcaccaaaataagcaagttctgctgcctcttcaaatgttaagtatggcacagtggttgcattcgggtagatatttggatcacaggtcagtacaccatcaacatctttccatacctatgacaggcagtggtatgctttcagacaaagtaggtagtgactttctgctccactaagctaatcagcatgataaacaaattaaaatagcaaactgtaggctctaatttttgtttgtgaagagcaaaattatatttagacttcaccatggacctgaatttctctcaaccccagggctttaccaatggttgtagcagtcaagtcactgccacctcggcctaaagtggttacagcgcctgatttccagccctgcaagtgatgacgattgacttctaaaagaaaaggtaataacaattacaatgaactaatagtttgcttcataatgaataccctctggtgagaataccttcccaaggaacccagtaacaataggtatcgctggatcacgaatccagtctccatgtaatctcttcgcaacagcaggataagttgcctccaagatgtccgcgtttccgaaatcgtctgttgttatgaaaccaatatcaaatgcgtcgtactgcaaaagcattggcaaatacaatttaaaaccaacaaaatttcacattacgattcacaacacgtatagctgaaatttgatctacagggaatttagaaagctgctaacgttaggggaaggaatcacagatgcaatggaggatctaataccgaaaagtgaaacacagacagacagtgagatacaactaacaggcatgagtttagaaaatgtgaggaaaaaaaaacagcttcagaggctatcaccaaactttcaatacttccttccatagtaattaaatacttatatgcttgcaaattcatgcagattgataaaatcacatgctctgaagaacaatggttcactgcgtagacaaagaatatgcaaagaagtacctgccgtgcttttactccgattttgttcaaataagcagcaaaaatccgtgtagacatgcactccccaaatgaaacaaggtagtcagtggtccgaagtgtcagctctttcatcattgcaatacctttcaagagctgctccagttcatccagcatagctatgagttccattcacagggagccataagattattgcattaatggaacgaaatctagaagatgttattatggtagtggagttactgtgtattacagatcttggcagtgcaagttcctccacagttctggattgatagcaaagaaaccatcaagtgaaattagaaaacagtttgaccagtaaactgtttgaaaagtagactcacttaatgtgtagatctttgatcaaattccactcttcaatttccgaaacacggatcacgccgcatcccactgccttctcaccagcctacaaggatcacagtaacatgtgttcaagacttcaaagtagtagtgctaaacaagtaaagattctttaagtcgctctgcgctcgaatatctcggctacaatgcaacaatgaattctgaaggaaggtttgccgttaaccaaattttcatttacttacagctaaagctactgtgtactatcgtccagagagcctatatatatagtcaatgttgagacactgcaatagcaaatgatggatagaaatgaagctttcacctagcaactctaatgtccacatattcctggtcagttgcgatcatcattatggcagtagaggtgcaaaattcacttcatctaacactacccagtgattacattgaaatgaatgctcatggattcaggaaaaacttggtaaagcagacacatattacagagaggcatatctatagcctagaggaggaggaggggaattggaaggcggaaacagtacgaggaggaggagattggtggtcttccccatggcggagaggacgacgacggggcgctcctcggggaaggcgaggatgaggcccgccacctcccgcatcctcgccgccgacgacaccgacgaccccccgaacttcatcaccacgctcagctggtccccacctcccaccccgatcccacctagggtttccgccgcggcggcggcggcgcccactcccttggcccgacagcgagcggagtcatcggcggccgccgccgccacctccagtctcccgcctccgccgcggcggcggcggcagcgagccctgcccaggacaccgatacgagctgctcctcctcctcctcgtcgtcctccatctcccgcgccgccgatcgccggaggggccggcgagacgaggcggaggcggagcggcgcggccgctaatcggagagcgatcgccattctcctctcctctgcagtttggtagagtgagagagggagaggggagctcactgtactgggtagcgtgaaggcggtttttcggttttacgtaacaggactctaaaggcggaaaacgtaattgcgagagttcgcatggatggagaacggtgagaggccctccctgtgctcttcccccttctttcctaactgacatccatcattttccacgcgcacattttttaagctgctaaacgatatatatttttttaaaagttttctatagaaaatttacttaaaaaattatattaatccatttttcaataatacttaattaatctcgctctgatcgcttgctttgattccgtgtcaagaggggaaaccttgccttctgaacacatcctgaagttgacgagtgataataaacttataagcttactagaaatttagcattgattctttttcttatcgaatatctctcgagctaacattggcacgttgctaatgggatctaagagaaaaagaaaatactccgtctggtcataaatatttaatgtttaaaacaaaactcggtcaatcttacagaagaataataagtatatgatttcaaaagaaaagaaagagaaaggaataagtttatggtactactatgatagtgtactaacttttaagaaaaatcttgaaataccattttttttagtttttaaactatttaaactaagtacgtacttgaaaagttattgatggttaaagttttaaaaatgtttgaccgaatcttatttaaaacgtgaaatatttatgaccgaacatgatttttctactgattttgagcataagttaatgctgcatttcaaatctggatttggtccgggaggctgatggcaggaggcaacaactgctccaacctgcatgtctgcatcctgctttgccaggttgggggacagggatcactgaaccagcacagggaagcagccaatccaatccaatccaatccaaccaaatccctaactaatctcttcatttgtgtaatgtattagccagatgtgcatatgagcaaatcaaatctagtatgaatctagtatctatcacctcagcgttgcacataggcatgattcagctggcaatggcttcctcactgtctgcaaaaaacagtttgcataaataataagaggccagagaattcaattgtgttggatcaaggaccagactgcctgcccgctgatcagtgacaaaatcattgttggattcagaagaggctgaatctcttgtgcataagcttctttattgtgcatcaagctgtgtgtgtctgcatgatcgatgtcatggaattcattcaaaagacactgggttcatattctcatcatgataatggacatggtttcaatggacaaagatcctattacatcacaaacaacattcagaaaaaaaaacgacaacagaaagaaagaaacccagttacatcatcatcatcacacatgtctctagatggcgagcctcatctcatcagttctcctagataaacagcatatatgccatacttactataactttttgataaaccagatcatctgatgcaaatgatcactgatcaaatcccagtgcattggtcttgactgctttctgacttgctgattacattgcgttctgaaggccagcagagtgcaggagcacggtcttaatttcttcaggcccgagtccaggaccatccctgcattgctggcaaaacagaagtacagagcaagcattaagagagtgaacaacaacggtaggatcagatcgaacacaactgaaaaaaaaccctcagctggaggagaaaaatattatgatgtggagaatgcaaacctcggcgcggaaaacatccattgcaaacccattgaaacagctgatgaccgcctgctcgatcccgaggccaaggctgtcgagagccctcaatgtggacatcagaatgccgggcctgcgtgcgcagaacatgtggatattgactgcatgaccttccctcatcctaacttcgacctgaacaaacaagagaggtgaatgtcacttggttgctatacaccatattgttaccgctacatgaatcaacaaggcctgaatgatcaagtacttgtgcagactgcaaagtgcaagtaccgcgaaataagtaatattccctccgttccaaaatataagcatttcttgtccagatacatagcaagaattgcttatattttgaaacaaaaggagtagctcccaagtgcgttaatcttgagcactaaagcatgcttaagcatataagtatcaagggccaattgcataattgccactagtgcaaaggcttaacaatcatggtcaaaatttgactaaccgtggcttgttgaccactagggcttggaaatgaggttgggcaaagttcctccttaacgcggccaggaaacgtctgcaatgtgggtgttgatgggtggaagctagccgatgatggtccagtaagcgaagagctaggagcagactcaagttcattgtgaagatcgttaatcctctgcaggagctccttcaagtactcaattgcatcaccaaggatagaagctctgtccatctgtcacaaaggagaagaaaactggtaatgagatgataaactatagatattaacatgaaacgagtcagacatagttggcattaagaacactttgacataaattgttttgtactgctacactaaaaaacggcacatcgtacatggcgctgaattgttagactgcaacttgtcataatatcccaagaactgtagtacatcaggtctttctttattgttcaaaaccatcttgatcgctgtgaaggaaagtagtaagttcttcacacgaaaggactgcagagaactgaatatgcacttcgcatgccgaaacttccaaagtgaacgacttttttcaaggaaaccaacaaaagttaaagacaaaacatccaacacgaagaactacaaaaaaaaaacagaaagaaaagggggaaaagaatttgtgagttatctggtatctggtcactttcaactacatcttgtgcatggcactgtgttaatcatgcatcactaaatctggccatggatcagaatcaaagttccccataatatgtgtaatctcaagctacgacaaattataaagtcctagaaaaaagacattgaagtataatttcagaactgaaattaccataactgaactgtaaaacaaccatccagcaagctgaataggaactcctcatgttaccatgtgaacatgacaaggtatgacatagatctaatgaaaaaaggatgtttttttggatctgaagtggagccaattcaagaattcagcaccaaaattggaaccaatttcagtgacaaatatcatgacaaacacactcctacaggacctacaccagtatacatcactcaagaactgaaacatgttgccaaaactgaaattagaaaagtagaaatagaaaatgctgattaatttaattaataagatacagtctagtagaaactggagctgctgattaattaaataattagcaatgaacagtgaaaaaatagaaatgaggtcattaatcaccttgctgatcttgggcaccacggagcgcagcatgtagaggcggtcgttgagcttcttcctgcgccgccgctccgccatgaggttcttggccggcatccccttcttcttgcccctcccaccgccgccgccaccgccgccgcctcctccggccgccacgggcgcggcattctccagcgaggccgagacacccatggacgaggcgtccacgctctgctcgatctcgtcgtcgtcgtcccaccccatcccgccgccgaacgcgccgccggggggccccaggaacccgagcttctgccccggcggcgcgaggaacgggggcggcgcgtcgtcgaacgggttggaggaggcgaagtcgtggaacggcgggagcgccgccgtcgtcgtgggcggcggcggcgggacggaggacgacgggaaggccgcctggaagtcgaacatggccgcggcggtggccgcgtccatgttgaggagcagcgacgacggggtcgacgccgagagcacgtcgcggtggtggtggtggtggtggtggtggaacgggaacgccgtgaacgacgccgccgccagcgcgtccgccgcgaggtacgaccagtcgccgccgcctcctcctcctcctcccgccagctcgtccatcttcgccgccgccgccgccgcctccgcctcgtccatggcaacctcgccgccgcttcttgctcgcctccttgcctcgcagcgctctgagaagagaagagaagagaagaggagtccgagtagagacgccattgctgctgcttcttataggagaggagaaagaagcagccttgagccgatgtgcttaattacatttatacctaattaattaatttaattagttaaaccaaaacttgcttaactttttcttaaaaaaggactaatacttacaaggttaattagctttttttttggtctgacaaaaataaggttaacattacaagattagcctatgatatgactatgatgacactatgttttttttaatagagatatacatgcatggccagcttgttcagtttgtgtcacgctagctacaaaacatctctgggtttaattgcagaaaaaaaaaggacgactttttttaggttgtttaacactttggtttttggtaattgcatctttctgttcgttgcagacgtgaaacagacaaatctgacaagatagtacaagggctatacgggaggtgttttaattggaaacagtgttgttctatttccttgctttataattttttttacaagattcataattgtaaaaagctgtgatattctgcgtatttacttcttttatgcagtgttttgctgcaatgttgaaacaaaaactgttgcaccggggtagagacggcaggaggcgaggaggggcttggtctcccaaatggcttcgaatttttacggcaataggtttcgcaaattttcaaaaaagtaacactttggccttcttcaatcaaaaaatttttaaagtgtttttggctccgcctttgcacctaataatttacaaaattctaaaatgtaaaaagctgtctttatattattttcatgttattgtttttttttataaatttgtttttatgcagtgttgtgctgccatgtttgaaacaaaaaactgctccacctaatcattcacaaaaattctaaaatgtaaaaatctgtgatattctgtatattattgtttttataatttttttatgcagtgttgtgccgccatgctgaaacaaaaactgttgcacctaatgaaagaacaaatgacctggcagacatgtctcttgaagcttagatggatcaaaagggccaaaaagaaagatgttttttttctaattgatacgaagaacctgcagggaggtgtacacgtgtaaggctgcctactgcacccagtagccaaaagttgccttctgtttctaatctttggatggtctcacaaaaacagatgcttatctactggtaccttgtggacatatgtaaaaactgtctttagccaacagatttgtcagttgctttagctcattggtcaattttattctatttcagctttccaagtatactaaagtttaggacgatatatggactttagcttaaatataacacggcattgaggaaaacctgcatataatctattagcaatatgtaggataactgaaacgtagcatcttatctaaatggatcagccatatgatgtgtattggatgcattgtatttgtatctaacgtggtgagtcaatcattcagatattttagaaacctgtaaaattttcacttagaacacatgtggttattaaaaaattgaaaaggagggagaagagagataaaaaaaaaaagaagagggaatgatcattctattcacggtttgagaatgagaggagggtacatgattacattgctgctcaacacacctcgagagtgtgcaatgcaacatgcccaattacaagttctcccaagcatcttgtgaccctgccggagatgagccaagaaaatcataggatggaacacaatggaatagaattgaaggagaaaactgtgggcaaaaaaaaaaaaaagtatgccctgcccactacactagggctagggatcacatgagttcctgtaaagagagagagagagagagagagaaatttggttgctcttgccattcgctggtctaaattgtcatggtcaatttttacactataactattatcacaagttggcacgctaatacaagagtgctgaacaaataaagggcaagaatttttaaaaacaaagatctgaacattagagaagggagtgctaactagtgctagcttggatataagtttcaagttaaacacatatatgtgcacaaatagaaagacaagttcaaagacctttgtctgttcacctgacatttaacgttgacaatgtttgcatcttcatgtatgcctctaccatcgacgcctatgtcctaatttgatgcctcgacatctcaacatgtcatagatcaccatatcaccacaacaataattgataattttgcatcttagatctcatagtatatccaatagatacagtcggtagtagccaacctcaacgcttccaagagtcgatgcgccatcaccatctatatatatggtctattgtcatcactagaattcgaaacaaccatcgtaccgctagctggtgaaactaaccactggttgtgaccatggataggggatgacagtgctattgagtttgttgagtatgggagaggaacaagagaggggagagcagatataggctaatgacaagaggaattatctatttatagactaatttttgggtgggctatacgttagaggtgaagcagtgcaaaacaagaggaatgagataaaaaacttactgcgtatgtgacgtaatatatagtagtgaggtggaaaacatagacactcatagtcatgcgctatgggcatctatcttgtggctacacattatgcttgtgcagaagcccccttctgtttccaatgagtttgattactaattgttgcaaatcagaagatggtaaaaaaatatatagatgatgtgatgtatttgttgagggttggagataaatatgaaagcgtggagtacgtgtcaagatagagtgagtagtaaatgcataatgaaaaagaaagaaagaaagaaaacttagggcactatatcactgtatccgatgcaataaggtaatggattgaaaaacttaaccgctattttttttcgtacacattttatggccacccacatattatgttggtgtagaagttacatgtctatatccaaaccctgtccatgtggaactaatgttgatcatagtgttataaggggacaacctctaacaagccaatggtgttttttaccctattgtaagaacacttctagatccccttaaacacatcttgttatatactactacctccgtccttaatataagggattttgcgtatggagttgcataggtaaaatcccctatattataaaatgtaggtagtaatttggaacggtgagagtaagtgtttgtcaagcgtactataaaaaaaatccaatgtttttgtgtggaattcataaaatcgtgtcaacatccatcgcaggaacataagtcccatcttggtagttctcattccgtcccaaaaaaaacacttaacgtaggataggatgtcacatataacaaagaatccagataagcttcaatttgttcagatttattatcctatattaagctttttttttgagggggtacatgtctttgctgacaggtcaattgtagctctctactagatctgattacatcgaacccttgattttgagaggccacttgtatatcatcaacttgcagttccaggtgctgcagcatacttacaactctaccgtccattcataaatttgtcattatttttgttgaaattaaatcaacatcaacacaaagtgtagggtgagatgaggccagtgtcatcaagaggggaaaaaaagctggattctatttcagcgtggctccaaaacacatctttattttttcatgcaagctagaaaactgagaaacaattaattcaatagcaaaatataactcatgcaagctagaaaggatatgggctaatctgaaccgtcaagataccatctagggatatcaaaaataagtgatgatgtgcctttttatggtggctagcttatttatactccctccgtttcacaatgtaagtcattctagcattttccatatttatattgatgccaatgaatctagacatatatatctatctaaattcattaacatcaatatgaatgtgggaaatgctagaatgacttacattgtgaaacggaggaagtagcaataagtacattaaagcagattgcagctactcgcctactccctccatcccaaaatatttttaattttcacccatctcacacgtaccgatacaaaacaaaaggactagaatgcatctactttattgaatctcaatgcaattgttccccattttatctattctcaatacaattatttcatgctttcataaactccgatacaatgattattataaaaataaatttattttggaacaaatgaaaagagctaaaaatggaacttatttggaacagatggagtatgtagaacacatgatcgtggtggatcttatgatatctttttgcgaacacatcctacaatacaattgcatataaatataagtatatttacaaaaatataagcaagggttgtgtattaattataagtcttgttttgaagacctaatttcgtgcataattgcacgtgaaaatccattattagttcgtgagaaaacaacggctcccatcggatggcctattcagccaaagaaaaagccaaaatttgaattttcaaacttaattttgatattgattttgagatattttcaacgtattttctttttcagcattggcttttaagtcaccgagaacacatatatgaaagttttacctacaaatttatttttattctctaataaaccgttttggcttat

SEQ ID NO: 68268 - DNA, 582 bp, Oryza sativa
cctcaatcccccacgccggcggtgctgcggcgccgctcccatcacatccttcctccgatcggaatcggctcctccactcggcgcactccactttggccgattcctccatcctccacgccggcagggctgcatcatcgttcggttcccttcgtttctttccgctggtacccatcgtgctctggctgatttctcccctctccccacgctgatggcgctgcatcggtggcgagatccttcacgcgcaatcccctctcgtgcagcagactcaaaactgcaggtatctgattcatcttaatttctaagtcccatttcctatgtcttctcgcaccccaactttgcaacttactgattcagctccctatctacatttgtgttctagggtttacaggtagtgaggctgaagcggatggggggagtcatgtttgatacctgagctgttaaaattaacaggttagttactcatctcatgaaacttttttgtttgtggttggaatctattttttgtgatgcgctagtacaatatggacacacatacattttgtttccagcaatttttattagaaggggttgatacctaagatg

SEQ ID NO: 68269 - DNA, 934 bp, Oryza sativa
tagataataagtagattagatgaacaattagcgcagacaaagggctatcactctactgatgatttctctactgtacaaccaccagcctgccactaatcttccctccattgcagcacctccaggcctcctctccgccgtcgttgtcaccttcgccgccgccgcgccccttgggcacggtgacgacgagctggccgttgacgtagccggccacggccatcgccgggcagctcgcctccggcagccgggacctccacttgtcgagctccatgtcgtcgtcgtcgccgtcgtcgtgtacgcctcctcctccggcctgcaccaccaccctgacaaccccggggtggatcctgacggtgcgcacgcgcacctcgccggcgagcgcggcggcggcggacacgacgaagtggaacgcgtcggggccttcgaacaccgcgacgtcggtgtccgccgggaacggcagctccagcaccttgctgtagacgtgcggcagccgccggagatccttcttgccgccgcagctgccgccggcggtcgtggctggtgatgggtggatcctcatgtgtatgtttctttctcctctttttctcactgtcttctccttttttttcttttcttttcttgctgctggtttgttggtttggttgggcaagacgaagggtggagagggggctctggatttataggtaaaggccaagcagaagcaggtgtcacaaggttgtttctttctctcttttcttgggtgtgttcagggagcttctgcagctatagcttttcttaaaataaaaaactctctaacaatttctcttaaaataagaagttttcaaaaaaaaaaagcttttttttaagattttgatgagttatagttatagaatctagaaaataaattaaagatcgagagctgggaaactcgatttttttttaaattctcataatctaa

SEQ ID NO: 68270 - DNA, 17743 bp, Oryza sativa
tttttttttaaaaaaaaataatacaaggttgtatcaggacagctaatactggtctagacattagcaagccaatacacctagtcaatcttatcacatggcatatttgcccaagcaacagataataatgagaaatgttcagcgctctccgatccatcagtttgggcaagatataacaatggtcctgctgattcacctgctatcaggctatggcattcctgggttaatagtactgttacactgaacagaaatagatgacttctaattatcatttagttggaaataaaagctccggttaagcgggccttcgaagagtcagtatataaagctgctgagcttcctgccataaaaccccttaattttcttcatgcatttatccaactaacatgaactatatatgcaacaagtgcttgcacacaaacactacactgtccatgtaagaagtttgagatagcaacgtacaagtatacctgaaattttcttatccatttctttattccccaaaccctcagcgcggccatctttcttcctccctgtagcagtgttgtgaatgataacagttggtggccatatgataaggtcctccctacttgcttgaacaaggtcagggagcaatgactggtatgccttagaattttcagggacttttgtataatcccatcccataaggacgcatagtgccttgtgcaaaccaagatggtcaatgaatgaatccacatttggtgggttgtaagcatgcatgacaagtccatgcacatcagcaaagtccttagaagacctggaattgtgcacattgaccagacataatcacaaacaaattaagatttggtgaacatgagctgaatacttgcaaacttaatgcagccttcattacatatgttatctgaccgtgtctacacatgcccaaaaaaacatcttaactttattataccaagccacataatatacatataaaaaatatgtcacatgaaagcaggaagataggattctaatgccaaaggatccatggtagcaaaaataatgctgacaggtttgtactgtttaaataacccacaccagctgctgtgtccaaagttctaggacacccgatctttgtatggcattaagcagccaagtcacagaagggatcctatggagcagtctgaggttgaggcagctagtagcagacatagtaataattattgctagccgtaatctcaaggtaatttctactttctactccatctccttcaagatggttcatttgactattgactattcaaattgagcactgacatactaaactatgtgctcacgtgaaacacatcaaggaaaaagcatcagaagctgcacaacacatgcaccgttaatgcctaggtgctaaagcacacacctcctagcataacaaactacagatagcaaaattttaaaactaattattggaagaaaaagttaacaactgttttgcaatgatattttcctgatgtggcattttgactggtgtttttcaagaggatgataatcttgaggaacagataaagaaaatattctacatggaaagtacggctcaaccatggaaatgaaaaaaaaaagattgtgtaagaaatccgacttataagtccaccgcagctaggcgaaggaagcctggaagcgttgcttaaggatcagtgaatacatggagaaggtatagaatagataagcaagacaggcatatggctgaaaaagaagcctgagcgactatgaggggaccactatctaatattccaatgcaacttatatacctttttcagcacaataattttttacctaaattttctcgcattcattttttttctttattttcctatagaaggaataaatcagaagtagcagccaggttataagtggtccctttacaaacatttgtttgacctttcaaatatcaaaagttcccattttccgctactttcttttgaattgctttatggcattatgcaccctcactataatattctagagcgatgttggtgatcaggtcctcagtacataagaatatgaaaatattctgtgcttggtcacagatgcaacgcccattttaagtgttgaatccatatagtagacaagttggaccagagggtgaaccatctaagctcttggttcatcagtctggcattcagaccggccgattgggcagttaaaccatggaccacggttcggaaacattcatctaaaatgcatgtttccttctacactgcaccaagttggtggtaggatggcaacgtgaggctgccccagcgtgaagacctagggtcgaatccccacccgacagcccttttcagcattattttttgcaaaacagattatgttgcaggccttgatggaaggaagtgggccttggtttggcgccccactcgcaattagaaacactctttgagccccacccagtccaactgatcctagtttaatgcctagttcacctgaaaaccgtcaggtttgagcggttcaaatcagtccgagtacacaattagtcttctcaagcaaccaaaccaagctgagatcgacttctaggtttttttctgattaaaacgccagtatgatccatccttttcaactatggttgaatcttgcaatgagatcctttctacgtcatactgattttttttgtccattcaaaatatttcgtctattggcccttcaaaatattttgtctatcagtgtatataacatgtctcctcattagacatcagatctaagaaggcgtgctattttactaaaaatattctgtattgtgcaccaaaagtttgttgattgattatcgagcatattcagttcatttctaatgtcgccataatgtttcggtaaacacacgtaaagtcagatcatcaaaatcagggccaaactttgggtagcaaaaggcattctcaccagagtctacagaaaaggcaatccacacatgtgcagccatgaataaacattgaaacttgcctaaatatgagtctaataaagtatgttacgagccaaacaagcctgaaatgtttagttgggcagtttgtctactgttggcatttgaggcaggaggttgaaagatcgaaaatcagtgatcgcagcgtattttttctaatttaggtggcatgggagagaggacaatgggtcaacctggtttatccataactgtactccaaaatctaacggttcaaccaggatcatctcacctatcacaagctcattaccataatttaccacaccatccataaaagttcagctagggataaactaacttaacactgagaatacttatccacaaccaaaactacacgatattagtggcaaatctttacggtacttgccacttgctaatatggataactaccctgcagcaagaagtggaacaggacatgaaatttatatgattatatctaatatcagaacagtgttctttgcagtacacagaatcagaactcttaacacagcaatgcagctctcaaaaaatgtagctatgtatggatacctcacaaggttcacagtaacataaatttcaaacaacagtggcataaaattactaaactgaatatagaaaagaaagcatttcggttctatctataattctaatcacaaaagtaaaataccactttactctgatcttctgaggccagaaagagccaaaacaaaccacaagtgttagctgtgggggcaaggtccacaaacagtcgaaagtacaaatgaactctataagccgcagtaacaaattactagtccagtagaacacagtaatgtcaactcttaccacagaaaaaaaatcttgactaacgggaaataattttaggaaccataagggtatgatgctatactagaactacagctcgcatcaacattcctagtatcactaccggtatctagagtagtcatccattgcccagctatataattcgtgcaaagtaagcagcatggaaaaacacagtcctatcgggtagcattttccaccaaaatgaaatacggtggtgtggatatctccattcagacaggcagaacatagtatgaacgtcagtttatgtcaaaaagaaacaaacagcaaagcagtaaagccatgccaagtcaaagagtaagagtaagagcgagctcaacgatggaaagaaaccagcgcaagaacctgactacaaacaatacaagaaagcttgccaggaaggaagtgacaagcaatgcgggatcaccaaacctgccgcaggcaaggcaggggacgcgtccaccttcaaggtagctccgcctctgcgccgcgctctcgttgagcatcttggcgtacttgagaaacgccctcctgagcgcgtgccggtccaccgcggcatgcggtggcagctgctgctgctgcggcggtgccgcctcgaaccggggttgcttggggtgcctgctgtggaagccctcgtcgtgctcggcgaggtgcttccgcttggcgtcgtgctgcgccagctgcagctgctgctgctgcggcggcggcggcgggtgatgcggcggccagacttcatggccggccccgcgcgggaggtgcgggagctggggcagaggggtgagctcgaaggggtaatcaggcggcagggcgaagtaggtgcgcacgctgccgtcggcgaggagcatggtgcggcggtccaggttgtggaagccgtacgacggcgggggaggggtctccacccgcggctgctgtgcggctgcggcggaggacggaaggcggcggccgacgacgcggcggggttgcgcgcgccagggccaggaggaggcggatgccgcctggggtcgccggccgtagacggggtcggggtcggggtgcgcgcggaggtggacgccgcccccgcccccttctccccggcgggcggcggcgggccccagcgcgacttgcggggcgccatcgcggcggcggcggcggaggaggaggagtgcttggggtgaggagggttagggttcttcatcggattcgcgatggattggggaattcggggaatgggggggattggggatttcggttttggatttggagcttcgctgctgcggagcacgaagctgtttcactggaaaaggcatggaattggaaggcgtctccacgactttacgccatccatcgtggaaggcgaaggcgtatttctgtggtcaaccagcttaagtttctctctcctttttttttcaaccgatattttttttaaaaaaaaaaacatggtactcgtgtgtacactcactctcataaacatacgcgcataatcatcttgttatcgatatatatgttgtctatcacaattgactcgcttttttaataaataataatgtgtgaaatgcctttgcttgatgccgtttgtcaattgtaaagcaaaacattccctgagcagcattgtcaacaactatatagtgtcaaacacattatatatggcctgtcaaacacattctgaaaaattggcgcatcaaatggaaaagtgattttacacaccatgaaaaaaaaagattaaatatatactatgaaaagtgcttgccctattcactatcatatctgtcgtttttatttctggctttgtgtatgaagttcggacttcattttttatggaggttatgtcaatataagttatattgtcaaattttaataaattttaataacaatttgtattgtatcctatcttactataaagttatcccccactaactccttaaacttaacatgcaaagatgtcacatcatcattcactaacaagatggcacatcatcatccactaattaacaagatgatacatcatcatccactaacaaatcatcacatttaaacattatgcaaacatgctatatttttatagttattataatttaagagcttttcaaatataaacatgttaaattatcatccaacataattcacataatgttttaatgtatatcttatatacttatatagttcatcctcacttagttagtgcttaaatgattaatctatggtccaaattatctttctccttttttcctctaattaagtcatatcacatcaattggttttagcctttagatgattaatctacagtccaaactatctccctactttttttcttccataaaatcataccaccttactttttacgtttcaatcaccatttacatactatttaaatttaaattatcataaaccatattaatttacttaatctgatgttatctagctatcttacacgttattttttttgttatcatactaaattcccgcagcaatgcgcggggtttcacctagtttataaaaggtaaaggtacataagataagaggacatctcctcgaagggtaaaaaaccacttcccatgtcaaacattagatacacaaacaaacctaaaatgatactatattacatataccttcttagcaaaactcaattacctactatatacagaccaagcactcaattagctactatgatcaaacatatggtgatatggcatctttgtttctctgaagtctgaacaagatgaagctctcacacttcagtgccactaaccaaactgatactgggatcctcctccatctgctgaagaggctccaaggtggcgacaatgtcgcgcatcaacggcctagccttggggttgcggttgaggcaatggtaggccagcatcgccgtcttctggactgccttcaccgggtagtcctcggcgagcctggggtctactatgccaagaaccttcttcttctgtatcagcattgggaatgcccagtctgccaatgtctgctccctgactggcctggacttgtccaatgatttgcgccctgtcaagagctcaaggagcacgaccccgtagctgtatacgtcgctcatcgctgtcagatgccctgaagtagcagaaaaaacagaacattggtcaggtgaagtagaagtatattagtctgttcaagattcagatactgatctagcaatgccctttgttttgttcagtgtcaagggatcaggtcatgtctacagtggcaggccaagttcagttggcattgaggcattgagctattggcatcaacctaaattggctaggatgttaactggtgataactaggcttattgttcatttagagatgcaagatgaagatggcactacctgtcatgatgtactccggggctgcataaccgtaggttcccatgattcgtgttgaaacatgtgatttgtcgccgactggtccatcttttgcgagcccaaagtcagagagcttcgcattgtattcctatacaccaaattagttcaggaatcaaacaagaaaatggcaaccatatggtccatgaaaaatcagacaacaacactttactatcaactataggacattttactagagaaaaatttctaattctaatttatgccccattatcattaaattcagttggcatgaactttcttgaataagaacatttaaacagcagaaccgaaacaagtgtaggttctccttgcaagttgcaagaaattttaatgttaggcaaatgagatatgacatgacggttaagataaaaaaaaaaactccatctacctcatcaagtaatatatttgatgtcttgaaatcccgataaatgactggcttctcagcttcatgaagaaaagcaagtccttttgctgcacctagtgcaattttcattctggtgaaccatgggagtggtaccattacccctgtgttagtaaatatcagtacttgaacaaataacaaatatagtggctgatttaaatgaacagataatgcataattgatcatcacattggttatgcagtatctagaaagaaaaaggattgtgattcataggtagtagatgataggcacaacctaagaacacgtcgacaacagcatattaaagtatttattgcatctgtcaaaagaaaaatgatttattgcatagtgtatcatataaaatggaaatcccattttaattctctcgtatctgaattctgttccacactcgcactgttggactcatgtaatcaaaagataaagtgctacattatgaaggtaaaattgaaattcagcaaaacaagcaacatggtttagccttactcgaaaacaggtgtgattccacacttcccaggggcatgaactcataaacaagtactctgtggtcatcttcacaacaatacccgatcaacttcactaaatttgggtgagagagctgcccaagaaatatgacctcagcctgcaaacaagaaaaataattttatatctgacaacaagaaagcaaagaatggaagaacatatcaagataataacttgatacaaatcatgcttttatcaatatagtactaatcagaaaggccaatcaccagccactctctatgcccctggaaactattgtctccatcatggaccttcactgcgactcgcagtggctcctctattgttaatccttcgcgaagatcactggtgatgtatcctttgtagactctaccaaatccacctccccctagtaatgaatcctgcctgaaattttttgttatcctcttgagctcctcaaatgtgaatgctatcagagggttccgagccgactcccttctcagttcctccacctctttcgcgttcgacggcagcatgctgtcatccttttcttttctctcagatgggctctgcattttaggtgattctgtaacaacaaaaagataagcatgtcactggcttgatagtacctaaagcatagattataaatgattaggaatgctttgtgaagataggctaaacatgagtttctcaagataaacaaaatttcacatggcataatgagaacttatggtaattgacttgattttttttttaaaaaaacactaacaataagtatagccacctaaaaggatcaaactaattctgcaggaacggaatagtaatttcattatgcattgaggcaggcatgtccttcgaattattaggatttcctttttgctaaaatcggcagcagtttcaattcattaacaaacagtgcaaatgaacatgtagctctctatatatttaggatcaaacaaataatagaaagtattgcaccatagagctgcaacttcataatcacatagaccaaaccaagaaaggacagtggtacctgattttgttgcattggaagaaaccctgttaaagtatggattccctttaaaccagcagttacccataatacccaattccgcgctttcaaaaaaaataatacccaattcctaaagaacaactcagctttctctgtctgacccagaacaccaagaagaggaggcagcaggcagagatgtctgcaatgagaaaatggtttgatggctgattctttgacacagaaggagccttaatactatcaggactagaagaagaacaggctctcttaaatagaaggcccagccaaaaatggggataaatctagaagaagaaaagaaccaccaagagaaaagattttgggctttttgttctcatatgagagctttctcagaaggaacaaaacgcagagatgaaaacgaaggtctcaaccgaaacatccctgtctgtatttatcatgtgtttaatgaggagaaaccgaagggtaaacgcaaagggggcaaaaagaacggaatggctgaacagttcaattctggtagtccgtttccttttatacataaacacatcctttacagcaacggcatggatcttgcatttaagaagggtatggaagatttctctttttctttggatttttggttttgtggaaggggataaaaaggggagtaggaaatgcagcaatcagacagcagataaaggcagtacactcaccaccaccaagaaagaagaagaggggtgcacttgagtttgagtgggacaatggagagtgtagtggtggccatctctcctccatgtctcttcctcctagattccattggcttttggagttgagacttgagaccccttgaccttggttgggtttggttgggtttgctttgccctcactcctttccaaactgctttcttggttgtggttgggagttgcaaggaatgcactcatctagcctccatctgctgcttgaatcttgatctttcagtgagatggatggatggaatgatggggtttcttggtggacttggatatggtggtgactagtggtgcccatcaccacccactaatcactactcctactcagtaactgcggccacaggtaagacttatgactgcactaatccccatttctttgctgctagaagaataaaaatccctcctttttcacccctccttgtggtagtagcagtagcagcattcgctttctttctttcttcctttcttttcctggtgatgattaacctttgttgatggagggccaagtggatgtctgaatcacagtgccaggtttgcaatccccaaaaaaagacttttttctccaggggggagaggagaggttgcaatcgccgcaagagtttgtgttctagtggaaatttttcttggacttggccgctgttctggctgggcatgaggatgagagagagagagagagagagacctggaccagtgccaatcttccaagcccaacacccaccaaagccatcaccaactagcaccaccatttgatgagttctgctcctttcctcctcatcccattaggtacaaaacatctgctctttgtccaatttgggggtgtcactgtctccctccatcctcttcttcatgtccagacaattgtcatgcccaggttagcctaatctttgccttagtttatgatcaagaaatgtggctccagatacagcacaatggggcctgcacccactaggccactagaggcagttacagttaggctgttcctacatgtgcatcatatagttacatcttgaattatctactagattaggttggtgatcctgtcactctattagattagtctttggagttctctgactaggggaggtgtccatgtccccttggggctcagcaacacaatgtgaaatgtgaattgcttgttgcattgtataggaacagtttctcgtttgatcgaatgctaaaccacgacattagtgaacaaataagcatgtcggtgtgaccaaacaatatatacttctatttggatcggtgtgggctgtctgcttgagattaatcttaatgcgcccgccaagtgttcgactgattgcctgtgagagtagtggtgctgagctctgtatgtttgtgggtagtgcgctattaggttgcccaattttgatctcaccagtgcttaaataaggctaaattctaggtgattggattgtgtgagctccagctggtgttgcacttcttcttggctgtccattttgtgctagtcctaattatgtcgacaccggctgctaggatgtataaattcggattgtctttggattttgtatgactatttgcaccttgagggtgctgacagattcgtctgtggctggtgtgaaagaagttaattgactagagtgagcatactttggtgtgacatctaggggatattttgtttaggttcgaatgctgcttgcagcaactcacagttggcatatcatcaaaatagtatgatatcattgtcatgctaattaacagattaacatctcaaaatctattactcatgagagtagccttcacctacaaaatatcaaagaaaagggacatgatagtaaagagctgattctagggaaagttaagatttcacttttctctcagccatcgagttggagtagttaaccatctatatgtcatggaagaatacactcttcggaaattcaacaccttaaaataaaatagaaaaaacaaaacctgagttcttctttgaagcaataaaatcaataactcctattagcacaagtctgtaaggctttgtgtaaagttttgttacgtcaaagaaacggggtccacttgggcttccatagttgtctggtcctagaaagccctaaaggcaaataaagtagtgcttgttaatcttgtcatttggcaattaaaaccctaatttttaactcttagtttctagtctttattatcagcgtactgtgtgctttttgtaagtcctaattgcaacctatcagctacaataggctgatgcatgctcttattcattttactttctatttttttattataaatcttctgtatttgttgatgattgttcttattctgttattacaatagttcattatgtagttgcagtttcagtgtttcagcaaattaatggtttttaccttgccatgaactcccaatatagtcaaacagttctttttacttactttaaaaggtatagttcagattagacttaagtatttgattcaagactttttgaagccagtggtggtggactaaacttaggtacaagtggccaagtgacaaaacaagcacagttaatacatttctgacaagccagtggtggtggactaaacttaggtacaagtatgcctgaactgtccaattgatggaagtctatttttctgaatcgtagcattgacttttagaaacttgtggaaattataaaaaaaaataaatgacattctcatgttcatttgcaattttgtagcttatataggataggattctggcttcactacatgatacagagcttgatcttactagacgcggcataacttgaatttcatgcataaccataatctgcattctctcagtttgttcctatagatgattatcattttgagtgctattgactttttaaggtcagatttttcaggaatactgggacactttgccctctcttcgaaaaatcttgtcaatgcgacttctctagatatcacagctgacagtgatgagtttgatgctttgcaaggcaggttgggaggacagttcaataaatactccacagtttccatcccatgtctgatgaaggttcaggagttcatgtgttggaaagcctacctgcaaggctgcaactggccataagaatcctcctgcaaaaaatgtatactcatttttcatgaactgcgtagaatggacagttgccatcatcaatccatccttgccagttgccacccagatgccagaaaatgatttggcatctgaagtttcataactatacaaaatatgcagaacttaaaattgatagtacaccatgcagtaagcttctacggtgagtctaaaaacatgtactcctgtatcaaaaccattgttctgacaataccgaccagcctcccaaatctcaattggatggaacatcatcaattgacatgaatgcaggcagccactgaacatgaatgcagatccaacccatatggaacccattgtttgctctgttgtatccaatgatgcaaatttacatattataatgcacagaaaaggcaagattgatggtcggtgaagcatggtttttctgtgaagtgaagaaatgtgattgattgaattcatgtcatggggtgttcggtaagcttcatactgtatgtatgtcggatacttcaggttcttctttatatacctgtaatgattctccatatttccttctgtaaactattatctttgcattactgaagtgcagggcacatatctactggatgtgattcaagatatcctgctaaaatcgtaccacacgatcaatcaggtttctgtttgcctccatgttcttgagtgtctataatagcatgtaaaaaggatatttccatcttattaaggccccctaaacagtttattcatcatcagttaaaaagttgcaatgaggttggctctataagcatgctctttaattctgtgcaatgctagatgatatgcctaccacttaattactacgcatgctagatctacacaaccagccacttacaagttacaaccatctgaaatatattagttgattgagtgcaagtggttgaatgcctgtaaagtagggcgtgaaggattataccataccaaaataagcatggtccatacagattaggaactatttttttccctcaaagtatgattgttctgtattttttttagatttgcactgccatgagtgttcacggattaagtaatggttagtgagaatgtaattattggcattagaaactgtacataaaagttgatagtgcatggctactatgttgatattttgttacctttttacttatgctataaatggttgacaaatactagaaaagagttcaggggaacaattactagatattttaggttctattcaagtattatgcatttctcgctgtagtttgctgaaacctcgatgctgatggtaggcataagtttatcttgtcattaaagtatatcttcaaggtctaatgatttgagcacaatgtgttgaagacaccttgtgtatttaattgaactctaaaccttagagtttagccttttagcagctatttaaactgaaaaccatgaggttagcctttacaggatctcaaaagctggtagatgggtgtctttttgccagttatgtctaacagagcactagataagatgattaaaacacgagttcaagaaggttaggcctctactaacaaaccaaaccccttaggtttgttatcttctactgcattgtacagtagctggactctctgtacttaaactctatagatttaatcatcgcatcaggcatctatagactagatcactagatggacaaggctgaggcatgatgcagcccatggaggattgtcagagccatttgttagctttggaaagcttgtcttgcaagcaccctacagcatggcacaagcacgtcccccacagaatcatatgttctgtcctctgtctacctctgtctatatatatatctcttctcccgttgcagtaacttcatcgtgtaaaggcaatggctgtttttctgcttcttctcattgtttcctttctctcatatcatcccattcaatccactcaagaatcacattcgcatgtagatttttcttgcagatgttactactgttttttcatctttttgtgaaatcatgtgtttcatgttatagttatacctgtgctttctattgtctttcaggttcatattgtgtacttgggccacaacgatggcctcaatgcttcccttactgcaagtcttcatctccaacttctatcaggagtctttacaaggtaattgattgtccttttttctactcaaattaaagacaaataacaaaagacacaccaggtatacttgaagttgaatgtgccaaaatagtcatatggagtgcaaaaacttcatcatctcacatgagctattgttgcgcaacactgtatctagattaaaaaaaggctaaagttgaattattaatttagaaaattcaaaccccttagcttagagaatctagatatatttgttcttatttggcgagaaaatgtggctgaagagtgaagcgtcacttgtgagctcaacttttgtaggtcggatgaagcaagagatgctattctgtatagctacagctatggattctctggttttgctgcaatgctcaattcaacgcaagctgccaaattatctggtatgcatttacctttatcccgttgactttgttctcagaatatacctgtatctacctagttaatttccatgaacttaccaaaaactccaatgatcattatatgagcagaagcagaagaggtcatatcaatattcaggagtaggatgctcgagatccatacaacaagaagctgggacttcatgggcctcagcctgcatattcagaatgaacaatcagccggaatgcaattgaaatacggagacgatataattgtcggtattcttgatacaggtaaatttcctgacagtttcatatacctgtaattccagtttcactctcatatatttgttgctctatattcccaaacatgaagtgcatggtgttctagccggaaaaacatgtggtccaaccacatcgcgagaagttcgagctgatcagctgaatggtgatcgatccctctgacctttgtgttcagacaaatgaaatgagcaaacttgagatgaaagataaaatcatgtcttgcatcttggcatgcgatgcgaagatctgaagctagcatttcttttactactcattcatgtactcctactgtgaaaatgcgcaggagggctcgaagctaaacaaacggtcattccagccgcgcgccgggcgtacatccccaagcaaaccttcgccttctgccaatccctcctctcctcgcgcctcctcctcccgtccgccgcctcccccacggcgccggcaccggccctgcccgtgcaggcgctactcaccaccgctggcctcctgccgcaccaccccgacctctccctggtcgcgctcaactcgctcctccgcgtcctctcccggcgcgcctcctccccggcccacccgctcctcgcgctccgcctcctcctgctcatgctctcccccgcctctcccctcccgccgcccgaccacctctccttccccttcgcactctccgcagccatctccccgtcccacgggaaccaggcgcacccacagcgcatggagcaggtgtccccgcatacacctgcttcgcaccggaccggaatatagttggcaaagcaggagcgaagatcggaaaaagaatcgtatcattcatttcttttagaatttgtaagacttacggtgcaaaactgaagctaaggcatgcaaacaaaaaagtgtgagttcttgcaacaaaaattcttgttccctctctaaattctgatgttagggaactattcatacattacagcatcagcgagcctacttattatcttccttcttctctaatggcctgagatcaatgtgtaatgtgttgataaacctcagctcccactagattcttttcctccataaataccagctgctatctcaggctctcagctctttgtgcagttgtgtttgataaaacctctagggaaaaatcagttcggctacctacttctctccgattctccctgtcacgagagcgcggccatggcctcctcctcgtccggctcctctcccatttggtcggcaagcagcccgagcacctcccatatctccacgcgctgcgggtgcgcctggtcgtcggcgacgaacgacctcaccacgccgtcgacctccaccgcgctgtacgcggggaccttcctgatgccgcggctgccgatcagcttcctgaccctccgcgcgtcgtccttccggttggagtcgaggtagatgttggagagctgcacatacacaccctcgtcggcgccgagcttgccgagctcggcggcggccacctccgccagctccacgttggcgtatgtccggcagccggtcaagacggagccccagacggaggcgagcggggccattggcattgtctcgatcagtgccaccgcgtcctccagccgaccgacacggcagagcatgtccactgtgcaggcgtagtgctcgtgccccggcgcgacgccataccggcggcgcatctccttgagcagcctgagcccgtcctccaccttgccggcgtgcgcacacgcggagagcgctccaagcaccgccacgccatccggtcgcacgccgtcctccctcgccatcctgtccaggcacgacacggcctcctccgccatgccgtgcaccgcaaacgcgccgaccatggtgccccagacgtagtcgttccgctccggcatgccgtcgaacacccgcaccgcctgctccaggcagccgcacttggcgtacatgctcaccagcgccgacccgacgaacgcgtccccgagcagccacggcgcgctcgcctccacgtaccggtgcacccactccccgcactccagcgcgccagcctgcgcgcatgccgcgatggccgtcgtgagcacaacggcgtccggcgccaccccatccacaaacatcgccctgaacacccccagcccctcgcccgccatccccgtgcgcgtgtacgcgccgatcaccaggtcgtaatgtatagcctcccgcctgggcaattcg

SEQ ID NO: 68271 - DNA, 544 bp, Oryza sativa
ttaatctgatattttagagcaactttcatatagaaagttttcacacgaaacataccgtttagcagtttgaaaagcgtgccacgagtataaaaagtttatctccatgttgttggagaaacgaacaagaccatactaatcttttgtggtacatgcattgagattgtcaagtacttgtacagaggccgtgtttacccctaacttctaattttccatcacatcatatcatattcaaaaattttctacacacataaactttaaactttttttttccaaacttccaactttcctcgaacttccaacttttttcagaaactaaacacagtcacagtcagaaacaaaaagctcgtccagactcagagtttgctttgcgttgactgtaccatcgtactcacactacacagtgcatacatctattgtagcagctacctgctctctgcattaagttgtacctcttctgaaacggacacatatcttatccgcacaagtaatctcgtgtacacactatgtatatgaagcaacaaaaaaatctaaccgatttattata

SEQ ID NO: 68272 - DNA, 987 bp, Oryza sativa
ccaaaacaacaatggacccacatgtcagcctctactccgcttcttcctctctcccccttctttcttctctttccttcttttcccctttccttccttctcgtcgatcacgctgatgccgatagctcagcgcacggcgggaggcgggaggcggcgtggggaggcggaaggcggtccaccaacgccgacgctcgccgaggtgctctcgctctccccgccaataactctccgcaaccgagcgccatcgagctgccgtatctacggtgacggacgaggtgggaggtggcaagcgacggcgacaacggcttgggggggggggaggggggcggcggtggagctcagggaggggatggcgatggcgacaacggcttgggggggcggcggtggagctcgaggaggggatggtgacggcgacaacggctttgggggggggggcgcggcatcggaggtcgggcgaggatggcgacggcaactgagcagaggctagcgacggcggcggcggctctcgacgaccgaggcgcagaggcggaggtcgtgcggtcggctgaattcggcgggggcggaaaggctcggcgaagctggtagcggtgaggagtacaccagccgccacgccgaccggtcgttgctgcgggccaccgtttggcaaggcgttttggttggccaactctagccagccagtgagcaagtttgaccaacgggatggcttggccatccggttggtcagtctgttggacctcctttttgtgcttgaatgacgaaaatttggcttggagaggttgatagagaggctgcattcagaagcctctgttcctatcccaggctgtgcgcacggaaaacgaagccggccattaacgtgtgattaattaaatattttctttttttttaaaaaaaaggacaaatataattttttaagcaacattcgtataaaaactttttttaaaaatgtacaatttagcagttttaaaagcgtgcgtgtggaaaaggagagga

SEQ ID NO: 68273 - DNA, 746 bp, Oryza sativa
agtaaatagctggtttggagtatgtctgttgttcacagtaggctagccatgaattcagattagaccttactagtaaaattttggatttctagaagatcctgtgcaacttgctgtgtaccctattttcgtagtgcataatcattttttctgcgatggatacaatacggaaaatttagccttaaaggacctttaggactaaaagttctacctgaaagacctatacagattagacattatgtggtagaggcctttggtttatttccacccatcatattagacatggtaacaggcaatatgtgctaactggtaacatatgtaactgtaatcacaacatttgggacttgagagtgcttatgctttgttcaagttcaaagagaagccctttcaaacagggaaattacatgaactttttacaatagcttgttagtgacagttgtccttagtaatcaactttttctttgttccctttcttaccacataatggtctgattaccagtttgttcaccctgttaagcatataacatgtatgatcaacatatgaaccatttgttaacggtttggtcatttcagaactttcaaaatttggatcacatatgggtaatgacattggattggatggatacagtgaacctgatagctttatgggtcacaatctggtatgcaattacttgtaactttgcatacagtttgttctcatctttattagcgttttgattttttttatattgttaggggaaagcctgtag

SEQ ID NO: 68274 - DNA, 2493 bp, Oryza sativa
gcatgcaagcttgcccaatgaagccggatcgataaccttttggtttatcgcattgaagaactggcacaacttgatgattgggtcttggaccttttctagaaggataccctaattgcgaccggtagcagttgcgtcataagaacatggcagtcatgtgacttcattccaaccaacctcttatctttcatgctaaccagtctcttaatgttcgcacagtaaccggatgggactttgacaccccacatgcattccaacatactcgttttttctgcagcactaagagtgtagcatgccggagataggtaatagcggtcatttcctctgtcctgaggatgcagctctttcctgatgcccatgtctttgagatctttccgtgcttgcgaagtgtctttcatcttgccaggtgtgttcaacaataccccgagcacgccttggcacacgttcttctccacgtgcatcacgtgcatcacatcgatcgcatgacgaatatccaggtcttcccaatatggcaagtcccaaaagacagacttctttttgaatagaggggtctcaccgctcgatgtggatgcacatgtgcttccgctcccttgcataccgggcattactccaaatctgcaaattcaccacgatacagaatgcaatcatttagacaagcgtgaattttctgtatgtcaagactaaggggacatgtaacttttttgggttggtacgtcgattctggcaagacattgtctgtaggaagaatttctttcaagagctctagcaactcatgaagctcttatcagaccatccgttgctcgccttcaagtgaagcagcgataggaccacttggagcttgctgtgctctgccttacatccattgtaaattggagttttggagtccttcaccatggttgtgaacttgtgatattccctatcatcagtgtcaaatctctccccgtcgcgcaacatctgatctagattaggttcaccgtgatcgacacatgtttggtcctcctcctcctcgtagcctacatccgcatcatgcccatgacagttgccagcacttccctcaccttgattctcctcgctaaggaaattgtccataaaaccccttgtaaggatatgtgaatggacccgctgagctggaagttgtctgtctttcttacaatcatggcatggacaccaaatatattctggtgcatcgactaagtttgtgctggtggacgtggcaacgagagccgttactcccctgaaatactccacagagtcacgatccgctatagttatccattctagatccattatatccagtgggtacctgcggttattatcatttattacaaaccatgaaggaaaaaaacaatgaagatttcatcatttacaagcacattagaataaaaacaactaggaatgaccattttaccctacgacaaaatagaggtttttgcacacacccacgtcaccttaattagatagtcatggctaacaaaaatattaaaaaaattctattttttgtcaatccgaaataatatttggctaatgtgaaacattaatgacgatggcatagatggaataaaccattaattcaaatttagcataacacccgagaacagatctacgaatgacttatggatccatacaaattaatgactagtgcattttacatgtattactgcatggcagttcaattcaacgagcgggtgtgaatcggggtgagaaattctgaatatttaccttgtaggctttaatcttcaaccaaaacccaagaaaaatcaagcaaaaccgcttccacctcctctagcggatcgatgggcacccttaacataaatttgagataaatcaaactatcaatggatattttcgtggccttaacatagtttgacaagcattaatttgactaatggccatgacgtagatcgaagaaaacattaacgcaaatttagcatttcatccaacaatagacacaaaagagataaaaagaattatccctaaaaacaacacccatagcgtattttacatgcatacgtgcagcacacgacaattcaaatcaacaaccaagagttaaacgaagcgagaaataatgaatatttacctttaggcttcaatatttaaccaaactgtcacatcctgattttcgtttcaggatttataaattatttaataaattattaatagaatttatattaaacgttcattaatttactagtgaagttaaatgtgggaaataaaatttcctaaatataaagcatggatggatttaatttttattaaattctccatggttaattatactctctggagttttctcggatttttcggagctcaattcataatttttaatcatacaaagagcatttcagtaattaaccacatattaaattaatcattaaatggtctaattgtaattttgttaagtactttgagtgtccaagtatttttcaggatttttcttgaaattatttgaacattggaaggatttttaataattcaaagatcatttaagtgattatt

SEQ ID NO: 68275 - DNA, 6360 bp, Oryza sativa
ccaagcgcatcgggtcacggtggttacgtcttaccccctcggccaaatcttgcataatcgagagggtactggacgggtggtgaaatgggcaatcgaactttctgagttcgatttgcactttgaaccacaccacgctatcaagagccaggctctcgccgattttgtggcagagtggaccccagctcccgagcctgtctcagtccccgaggccagctcgggcccctcacagctgcctcacaccgctcactgggtgatgcagttcgacggctccctgtctcttcagggcgccggtgcgggggtcacgttgacctctccgagcggagacgtcctcagatacttggtccgcctcgactttcgagcgaccaataatatggcagaatacgagggactccttgccggactaagagtggcagctgcactggggatccgccgcctcctggtgttaggcgactcccagctggtcgttaactaagtctgtaaggagtaccggtgctctgacccgtagatggacgcctacgtgcgccaagtacggcgtatggagcgccattttgacgggattgagcttcggcatgtgcccagacgggataacatgattgccagcgaactctcacggctcgcgtcctcgcgagcccagaccccaccgggcgcctttgaagaaaggcttgcccagccgtcggcgcgacccgaccccttaggggagatggatgcgcctgaccggcccccgaggcccgtcggagtccaggcctcgggacctgaggggagtgctcccaactcccttagattgattgcttggatcgccgagatccaagcatacctcacagataagactctacccgaggaccgcgaagggagtgaacgcgtccatcgcatctccaaacgctacgtgctggtagaagggaccctctatcggcgcgcggctaatggaatcctcctgaagtgcattcctcgggaacaaggcgttgtgcttcttgccgatatccatgaaggcgaatgcggagcccactccgcctcgcgcaccttggttggtaaagcttttcgccagggtttctattggccgatagctcttaatgatgcggtcgacctggtccggcgatgcagagtgtgtcaattccacgccaagcaaatccatcagccggcccaggccctgcagaccataccactttcgtggccatttgctgtctggggactcgatatcctgggaccgtttaggcgggccccgggcgggtttgagtatctgtatgtcgcgatcgacaggttcactaagtggcccgaggcttatccggtcgtcaagatcgataagcactccgcacttaaattcattaagggcatcacggcccggtttggagtgcctaaccgtattattacggataatggcacccaattcactagtgaactcttcgacgactactgtgaagacatgggcatcaagctctgcttcgcctcacctgcccaccccagaagcaatggccaagtggagtgcgccaatgcggaaatcctcaaaggccttaaaaccaagaccttcaacatactcaagaagcacggcgattcatggatcgaggagttgccagcagtgctctgggcaaaccgaactacaccaagccgagcaaccggggaaacgcctttcttcctcgtctacggcgcggaagcggttctcccatccgagctcaccctgaggtctcctcgggctaccatgtattgcgaggctgatcaagatcagcttcgcagagatgacctcgactacttggaagagcgaaggcggcgcgcggccctccgagccgcgcgctaccagcagagcctgcggcgctaccatcagcgtcacgtccgggcccgatcactctgcgtcgacgacctcgtcctacgccgcgtccaaacgcgtgctggattgagcaagctttcaccaatgtgggagggtccgtatcgagtggtcggcgtcccccggccgggctccatacggctggccacgggcgacggcactgagctgcctaacccgtggaacatcgaacaccttcgtcgcttctacccctgaggggggggtcgggtgtcaggtttcgggctcgggccaaccccgcaccccctcgggcgtgtagggttggccgggggctgccacacatgcacattcttatttcttttttttttcagtatttcaataaaagaagtttcaatttcctaaaggctgtatctgtgctgtttttttttttccttttgaagaatcttgacttgaaataggtcactcgtgctcaatcctgccctcgggggctcgggtcggctaaaatcgcaaaacggggcccagaaccgagccgtgccccgaggcgtggtgaactccgggggggaatcggcaaaaacccacaatcgggtcacccataaccctcggtcaccacgttcccggcctggccagtctcgacatgtggatctcccaggcactagccccgacccgcgccttttgaggaccagaacctgggcacaagcccttattcaagctaagacacaaaaggaccacggcacagatcatcctcatctcatactcacagcaagatgaaattaacacaaaaatttcttcatttttgattacagattaagttgatctatacaaaaaagaggcccgaaggccttagaagaaagaaaagaagaaaaaactgaagaatggcgggggtctgggggctcaatccgatgcgcccggatcgccggcctcgtcgtcactgtcgtctgcaccaccggcattgccctccttgtcggagttgggggcgaacgcgagccgaggggccgagccctcgaagctgtcgacgatatggtcggcggcatcccggacctgcgcgcgcgcgcggtccacggtcccaagagggaactcatccagcgccatccatggagagaaattggggtccctggcctggtaactcgccaggacgagctccaccgctccttgggcgaggtccctcgaggatgacttaattgtcttctcgagctcctcggggagccgttggagagccccggccatcttcgagaggcgctgggtgaggcctccctggttggcggcgtactttacggtccgccctctccagaggcccacttgccgaccggcgcaatctaggcgggagacggcgtcccaaagcatgccgggccctacctcgcctgccaagcggagggcttcgacctccccggcggacgagtccagtgcgccctgcagatcggcgatggtgcgttcggcagctgcgaggcgggcggctaagtcgctttcgcccgtggccgccccgccgctgcgcgccctcgcgtccagctccttcgcccgcgcctcgagctcagcggcccgttggttcagtacggccctctcggcgcgggcaccttccagattgcggcgcgcctgctcctcctgcgctgcctcgcggagggacaggctgaccgccagctgttgcgccgcggcctcggccccctcgagagctcgctcccgctcggtgagcgcgtcctcgcggaggcggagcgtgaactcttcttcggcgcaggcagcctcgtgcgccgccagcgttgcttcccggatggtgacggcagcctcgcggtccgccagatccctctccacgacgcaggtgcgctcttccagcgccatggcgcgcgcctcaagggcctcttcacgccgccgggacgccgcttcggtctccgccgcccgctgttctcgggcagcggcagcgtcaagcgccccctgggcggcgtcgagtttcttccctagctccgcctcccagctcccgtattgaaggcggagggtgtcctgcgcctcgttcatcacggtggtggcaatgagggcagccccccgctcctcctccacttccttggcgatctccgccagcaccttcttacgagtttcaagctccgagacgtgccggcggtgagccttacggcccacctccaccatggcctccaccgagcgtcgcccctcttcgacacgcgcccacgcggcgtcgagctccgcccgctctgcctgcaggacctccacctgggcacttaacccatccaacaccgtggtgtttgcggcggccaaggcctgtagaaggggctctgcgttcagtggggcgatagaaggcgtggggaagagccgccttggagaggatgccacgcggctcgggccgccgatggaagtgccggactcggggatgtcccccggacccggttggtcctgagcgacgcccgagggagtgggtccaagcgacgcgcccgcagcctcgtcgccagccgccccggaagttgtcgcctgagcgtcgcccgagggagtgggcccaagcgacgcgcccgcggcctcgtcgcgagctgcctcggaagtcgccatcgcctcgtcctggcaaaatccggcctcctcccgagcggtttccccggcctggcgggcccgggcggcctcctcccgagcggtttcctcggcctggcgagcccgggcggctcctgggcggcctcctcggcttcccgtaggcgatccgcggcctctcgccggtcagattcccgcctgagggcctctgcggctgccggatcctcggcctcagactggccggacttggaatggcgggagggacgcgacgggatctcgctgaaacaaaagaaaaaaccagaagacgaacaagatgggtgagtgaaaactcgcgttgagagagtgaatacagccacgatgggtgagagacgaacctgcgagggggtcggttaaacgaccactttggaggggaaatgaggtttccccgagatggttctgtctcccccatcttacggggccgcttcttcttgcgctccccctcgggctgcgatgttggcgcggccccctccgggcgcctgctgctggcacgcgccgccccgccccctcggggaggagatgggggaggtgttcctccctgcttcctcttaccccgggcgtcggcagggcggctgctccccgggcccctgtcgcgggacccagaagcacgaccccctctcggggtagattgttcccccctgcggctcccgcctgcgccgtcgtggccctttggagctcgctcctctgaggccccgaccgccatcataatggtcaggatggaggcgcggtctggatcgctgcagagggggaggattccttggggaatgagggccgcctctacggagttgagattcagcacccgttggaccaatatcttgaagtcctcaggagcccagtcccatctcactccctggtgggtcctcgtgaagtcttcggacccggtgtactcccaggcgccccgagcgcgtcgctggagcggcgcaatccgacgacggaggtagtcgccgtacaccatggcccctgtgagcccctgggatcgcaggcccgccaggcggtcgaggacggcgtcatagccatcccccagatctaccggcgcccgccagctggaggcctgcgccgggggctggctcggaagtcggaggcgcgcttcgtcggcgaggggagtgtagaaccagtcgctcttccagtcgtcccacttcttgcggagggcgcaggggatgtagcggttcagcaccggcccccgtggctggaagtagcagccaccgactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatggcggaaccagccctgccattgcaaaggggagaaagaagacggaccgccccaggtagtctggcgccgggcgtccctcgcccagcgtgaccatctcctggccggtggcagattccggcatgaagcggcgcgacagcccagcctgtctctcgctcacgatgcgggaaggcggcagcacgctaccatcgagcagagcggagccccgtgccatggcgccggaggaagagaagattaagagcgagcgcgtgtggcgaaggtagggcacaggaaagaaggagttagggcgcaagcggcgaaaacaaggggaataatggcgaaaggaaggaaacagattccatcttcagtgcctttatactcttgccaacgctgtgcccggctcctcgcttctcgcgccctctatttcgccccctcgtttctcgcacccacgcttccactaatcctattcgcccgcttgcggcgcatgaggtggatatgcggttgtggcagtcgagatagatcatatcgtgcgcgcgctaattacgctcgccgaccgaagcgacgttaccatatctccagatgaaacgaatcgccatgtccagattcgtgtgctactcaagtaatgtggcagtcttgaagagaccgctcattgttgacagccgagttaccattgccga

SEQ ID NO: 68276 - DNA, 4617 bp, Oryza sativa
ttccagatgttggataatggcatggtttttgcccactcagaggatgttgaggctgttatctgttcttattttcgtcacaaggactttgataggttggatctattcttaaaccgaatacggagtttgtacaagctcacccggtctacttatgatatattgatttctggatatcagaggttgaatttacacggaaggctcgacttggccataaaagatatgagggaagctgggtttgcatgagttcctgcaaaacattcattgttctgtgacctcctaaaaacaaatttcctgtggattttggaaaagaaggtagcgtcctctttatacaaacaattccgtgctttcagtactttggatttgttaaatgtcatttgacgatgttgctaactcctttgataaactaatcattctttacttcattattgatgttgtactttattctttactcactgtaaaactgggaaacggctaaacaaactgaaatctgaaagagaagtgcagaaactatgttgcatttgaaacaggatgtttgtgctttcaacaagttgaattggcttacaacttttaagtgtataggtttgatatgcgcttactgcttccattattagcctgaataaaatttacccttctaattgtaattgaatacattttcttgagctattgtattatatatatggagtctgaacatattttaagatgcaagaaagacaattcacacaatacaaccttaaagaagttcagtcacaaaagtttgctccagtatgtggaatggatagttcctgcactgaaacatgattaatcttgcttgcataattttccttcggttttattcataagagatagtgcatctcacttcttaactcaaaatatctataagtgctgaattgtgctcttcttttacagcaggctccatgtcagaaagcttcatgcaaagtttgagcttaaagcattgcctcctgttcattcatgaaaacaacgcctcgatgacaggaattaattaatacttccatgatgcttatgttccttgcaaaacaagctagtaaacctgtttgtatgttacttttcagaatctcaggtccagttttgtacaaaccatcaacttgttttcttctcctaataggaaaaaaaaaacgtaccagctgcagtcatgtctctaaactttttccaagtatttgtcagccattaagcatagtcagaaaattaatttgaaatgcaaaacttagatagaactatactgttatgtaaccatgccgacaaacatgcttgacttgctttcacctgaatgacggtataatccagagcttggagtaccttgctccaggattgactttgatttttttttcaaaaaaggtttcgagctttgctgtggccatgtctcaaggtggaactgtgagaaaccttctatgagttgataaattctgacgttgtgagcaatttcttgaatacactgttcatggtaaccacattcgtgagttgattatcatgaggtttcaggacgatgaatctatacatgaacacaagattcagactcacaggatgacatgcatgatcttttcccattatccaacaaatatatgggatcaattgactgaagactttcatacctagccaattcgtgagcttctggtggagccgagctttggtgtcatgcaccaattaattcatactcctatattagtttcccctttctattttccctttctgttctcactttcagtttcaactcaggtagcaattttcttttattcttcttggcacattggcattcatcctcgacaagttcgcatgtgcatcaagaaaattttataagctgtaaacgttctaccattcatttaatcacctaaacatgaagtaggttgattgtgcacattatatttccatttcttacataaaccatttaaaaatattacaaaagctttgtacatattattcttgatgattgtttcagaccttatgtgaggaagaacaactatttttaatgattttaattattcttacataaaccattcaaataaaagatctttgtgaggaagaacaactattcttgattgtaattatgatgattttaaactacacataagggaggttactgtcgcgcgaatacaattatagactagtatattctgaagaaccaattactgagaatttcgactacttgtgcagatgcacgtgagcactgcgaatttgtgattacagaaacatttagatgtattttatgtttgagattcaacttcactaatccaatgtggcaatatatacaggctacaacaatctccgccgcccgcctccccgcctgactctgccttaggcgccaccatgcggcagcagcgtgggtagacgaggaggaggctgggagcggggcgaggagctcgacgacagcgccggccgcggccctgctgaggatggaggagcggcgaggagagaagagaggcttaacctgctgaggatgtacatatctttaatcttttattaatataacatagtaggagcctctcctgctgtttaaccggctaaaaaaaaaagagaggcttctggccgccgcccctccgctcctccccgccgctctgctggcatgcttcgaccatcgtcgtcgtcagaggcggcgtcagaggcggcggggactaggacgacaacaacggcgacggctacggagcagcaccgaagacgacgcaacgaggaaaaagagggagagccgacaggaggagagggaatgatatgtggggcccgccccaccataatatttttaaactgatatgtgggtcccactattcttaaattattttttgcgtgtcgctggcatgtgggctcacggtttttattatttctctgagatataattactacgttagcgccacgtcaataccacgtgggatggagacctagtcaaaccagccacgtaggcgccacctcagccaaaaccactttttaaaccgccgagggacctcgtttacaccggttttgacagttcagggaccggttgtatctgattttggggttcaatgacgaaaattggatttggtgaaaaattaaggaaccttagatgaacttattccttttttgtttgagccgggctgggattggatggaacatacggggaaaaagtgtagcgaaggtccctcaacttgtcatcgagttataaaatcgtcctccaatcacaaaaccaaatatatgacatccctcaacttagggtgtgtttggatggtgggttttgcctggataggagatggctgtttggtcgctgggcggtgtgggatatggccaccaccccagagaatattcgcggatgaggcgatccagggatgggcgagcgcacgctagggaaaaaagtgacgtgcgctcacctccttcccctcgttttctctttctgtcctctcctttttttcctcttatttgagagaactcattatatgccattgactttatcatacgttcacgatttgccactgactttatcacgttctacaatatgctatcgacttttgcttaacttatacaatttaccatcgccgtccggttagtttccgttagtattgtataaatttgtcaaaatgaccaaaatacccttgggacaaaaacttttaaaatttggataaaaattctgaaatataagattttaagtttttggccaaaaattggatgtttacaatcttatgtttataatatgatattttgaattttttatccaaattttagaagtttctattctaggggtattttagtcatttggacaaaaattgtagtactaacataggctaaccggacagcgatggtatactgtagaacgtgacaaagccgatggtaaatcgtaaacgtgtgacaaaattcaggggcataattctctctctctctctcttttttttttcctttctaaccggtcaaaccctagcttctcccttcctctcccctggcggcgacggcctcaagcccgggaggcgcacgggtggcggcgttcggcggttcagggagcggtgtccggcgccggagcttgcagctgaagaggcggtatcttgctgaggctacaacatcgattttctccatccactcatctcccaaaaccaaaggtatactcccagatctgagcttgtttgttgttgtttggtgatgggttcgttcagatctgatgtattatgcttatttgtttgtatttttatatcttgtatgcatctctgtccatgtatatgtgtgtgaatgtagtaggcctgattgtgtatcaacctttggcattgtagatggacaacagaacaaggtttatgatttatgcgtaaaggtaaagcagccaaacgataatgttgtctggaaaaaaaattaaagaagccaaacgacaatgttgtctggaaaaaattgaagcaaaaatatgttgcgactcttgccaatagtcagcttgaagccacacctaggactcagccgccacctaggacaaaaccgggtcaaaaaccaccgaaggacctaaagttaaacctcctctgtgattatgcaaatggacaaggtaatagaactaagccctaggtgtggcttcaagctggctccgcccctgaaattgacctcaacgttaactcatggttctgattgttttttttcttaacatttttggtagtatgaccatgtgcaaacacaacg

SEQ ID NO: 68277 - DNA, 1219 bp, Oryza sativa
tataggcaggccttgcgcatgactcgccgagctcctgtgcatgcatgcggtcagacatttttaaaccttgctttcctatctttgctgtctaatgtttactcttgaagttacaactaataactgtccttgaatgttctttgtccagatgagttgaggcaaactgtaagagctgagattgaaaaaaatcgccgttgcgacgataaacagaagattaagttcttgatcagtgaaggtctgcaacgattaaaaggccttgatgagatgcttgacatgacaggaaatagttaacctgagtttcatgtcggatatgaggttcaatttacacggaagctgggtttgcatgagctcctgcaaaacattcattgctctgtgacctcctacacctgatatttccagaacccataaggcatcaggccacatgaacttgtggcctcctggattagagtttgttagaacggacccattcagattctttgcctcgttctatccaggggataggaaagatatcaggctcagatatattatcatggtagatcatcgatggtgtgcgtgcatatgggacgaaaatgcagttaccgaggcatcatgcttgattttgcacacatctattcagtcaagatatgctagcgagctttagaagcaattgggatttctttagatgctatcttgagaccctgaatttccaggtgttacatctgagaaaatagcagctagagatggattaagctgaagaaaggtatctgacttgtcgtttaggtacgtctgctttgaggcgatgatgttcaactttttcagacccgatggcttacttttcatatttgagatactgacctcatgtttcagtcctgatgttcttaccatttcttcgttgcaatttcttagctggtatgatgaggtcattaaacatgtactttctttccaactatttcattatatgccacaataaagatacttggtaatatatgctggtcctgccgtgctggtatataaaaatatgctccatgatcttaagcttttgttttgttgtgatcatatcaaatgaagggatacctgctaacattacttccattaggtaacttattatgtgacaatcgctgtttttagtgctttccggacccaattgtggggatctcactatcaccatcgattgagctggtgctcacactgttaatctactctagattttggaattttggattatgttgtcttacttaaaaaa

SEQ ID NO: 68278 - DNA, 10554 bp, Oryza sativa
agtacggtattacgcttctcagtggcccgaacctgtatacatcgcccgtgtcttgtgtgtttcctgtctcgcgagccttccacatacagagagcttagaatctcaccctgagtccccggccgaactggcaaaggggggcctgtgcggtctcccggtgaggagccccacgctccgtcaccgtctatcgttgggaaaagatggacataaactttgttggtgcatggtgcctatgagtatgaacacacattgtttacacaaataaataaatatactacataagcatgtgattagtattaacgggtttttctttatagatgcaatacatggatgcttagaagaccatggttcccatcggttatctagatccaacaaggatctgtcaatcccagcataccgtaacgctatcagaaaacactgaacagctcaagaacatgacgcctgaagaaatagcggaatacaagaagggcttgcatacgatcaagttgcttactatggtacaatacattagacgagctttcctgaaatttcaacggaaaagagtcctaatggccgtatacaactttaagtaaatcccatagatttctctatacacatctgtgttatttcatccgtgactaactgcaccgtcgttaccatgtagcaatcatgaaatttgtttcttgatctacccgaagtacaggactgttacagtcctggacccccttgattataatcacatgacgtatacacaattcctaataatcttacaattgcaagtgattctaatccatgcatgtgtacttttcatgtattataattaaatctcctccttaatacgaatcgctaatatccttacaatgcgtacaactactacaagataaagagtggagaacaactataaataaggaagaagctactagtgcatacatactggctggtaatactccactcacttaatgtatttaaattcttttacttgcagtatctaactaattccttctatgtgtatgtcacgaagtattagaagcaacctaaaggcagtaccctctatggttattacacatgcaaatttctcagtgttaatgtgaggtacaggaccaacgcagaggatgtaagtcttcaactcaacgtataagtccaattgagaactgcacatctaaatgacatacaaatatattctcgttcttccgtacatgcagttgcctagaatcaaacatcgaacaagctttgacgataaaggcattaaaaatatgcagcaggacctctgccacttcatccattgcgagtgctgtcataaggatgtaaggatggacggttcttcaacacagaagacagcctagcgacaagtgataaatacaagtctcttctggagtggaacaatgcaatgccatgatgtattaattagatagtgcattcaaaatgacaactgtaaaaattattgtaatatattgacaacacttttcactactgcaatatatgtatttatgtcagtattaaatgtttgttactatctaaatagtattatgtattaattaattaattatttgcaacattattgattaaaaattatttttaaaaaaattggcgggaaattttaaattttggcgtgcatattttaccaggcagccccgccttctttatcacaggcggccccttccctctttcccaggaggcgtgccgtgctcccgttcacctgcgaaaatcggcgataagaaggcctttgcctacaaaaatgtttttggtccgcctgagaagagaccgttttcagtcctatgcaaaaaatgttttttctagttgtagtggctggtgataatcaaaattcaaaagggaagattagatggatcccaagtgcatgcatgcagtacgcttctgggaaagaagaggatgcatgttcatgtgcaaaagcttgctgaatatgtacgtggaccaagaaacaaaggaagaagattacggctcaatgttgtgctacatgggctgagcctgttggactctgtcatgcgtgaaaactcgagttgggcctcgtcagtcagattgctctcttgccgtttggatggcagccggccctaagggaaagtttgtttgtgtcgctagcgtaagcttagattgattcatctatttttttttaagaaaccactaggatataggccctttcgcagagattcatctattattatttttgctaattcttcggagttgcttggattgactgtcgttgtcaacccgttcgtgcaatcgccttcgtgtcgattatgtggattggatttgtgaaggttcgtgtgattgacgtcgttgaggtgttgtacacgggtacaaggttgctgcgaggattgatcgagctgctactttcgagttatcattcgtcatcactgcaagaacgggccaccctatatcataactgtttcaactattaatgtatataattttatgtgtagaatagtgttggtgacgtgagactcggagatatatagaaatagactcaattattgagcatgccctaattgtactattccaaaacatgtgacaccttaaatcatgggtggaaaagactaccaaacttgcgcagttgcgctttacttctaattgtaaatgcatgcatctcttttttatacatgtgtatcattcatcctatattttggaactgagataacaacgttacaatccgtactcccggagggacgacttcccggcacctacacactgtagcggaatgaaagtataggttagtataggttacatgaaattggacggtagggaatgtttcgtatatatgaagctaacgcccgcaaaaggcgacaacatatggttgttactgagagacacatccatacacgtccagacatccaatttaaacccctctctaactatcctccacgtactagagaagcatatatataattagtcgcaccaactggttacatttttcctggccggtgtaatttgcaattattgcgcatcgtacaattcaatgacaacttaaactgtctttaatatatatcttcaaaagtaaaagactatcgttatcaaagtatcagtgcatcgacggcaacacactgtggaatatatactggaccgttgtattgcttgggcattaagatcaggtcgatcagtgctggttcgtaagagccatcagtaccggaagtcaacccaggcacaaaatttccagcactgatgacccctctcatcagtgccagttctggacccggcacagatagagcttgcgagcatcttgggcaagatcagattaactcatctgtgccaggtaataatttgaatccggcactgatgattgtatatctctgtgctgggtattagtttgaatccggcgccaatggcttcatacggtcatacctgtacaagctatacataataacctgcattgatgtttttttttcgagattaaaaaaataaataaaggaaaaatgtgatttggttaagcatgtatgtactagggtgatttttgcaacaaaactaagcaggtgggtggacatttgcaacgaaaataacttttagggtgtaatgcatgtcaaacttcaagtgatttagggagtgccttatgcaattttccgttcattaatttttcaggcagacctaaaaaagtaacgcttgtaaaaatgttgagaggccacacagatctagccccacttgtgaaaaccaattttcatagcaaaatctaaaaggagactgcctgcaaaaataacattattttcacaggcgaacctcttagcataccacctatgaaaattgattttaactttgtcaccctaaacgcaccacctgcataaaaggaaaaaacctaagctacacataataacctgcattgatgttttttttcgagattaaaaaaatataaataaaggaaaaattgcaaaaaaaaacatcccataagtcacttgaaatttgacattccaccttataagttgttgcacatacccatccttagtcttgttgaaaaaaccatcctaacacacacatgtttaactgaatcagtctgttattggtgatgtgagatttaccacaggcgaagctagccaagttaatcttctccaagtgcttgcattagacttatttttcatatttgatttaactttttttttgcaaatagcgaaactccctacgacaacgtttaagctctcgtccgcaaatttatctgtggaatctcacaatagaaaatgtcaaaagtatttaattttggtaaaaatcgcattgacagctcacacttatgaaaacatgtggtttggttaagcatgtatgtatggggtggtttttgcaacaaaactaagcaggtgggttggcatttgccgtcctcccaccagcctctccctcctggtagctgcgcgcagcccacaacactgtccctgcccgctaccaccgtctgcgccatcccccctccggccacgatggcctctctctcctagaggctaccactgtgcctctccccaccatcgtcccctggtactcgaccccggtcagatatgacgtggaggcactagataggggtgggcagaataagaccgaaccgaagaacagaaccgaaaagaccgagactgaaaccgaaaagaccgagaccaagaaattcggttagtaattcggtctcagctctggaaagaccgaatttttttcgggcaattcggttattgtcttcggttaaccgaattaaccgagaaaaccgaattgtggccaataggcctaggaggcccaataagcccactaaattgctaaaccctaaaagccagcactaccactcgtcacgaggccatcaaccccatccatcatgctgcctctacctccgatccatccccatcgcgtgtcgcgtcgcgggcatccacagcgtcggcgccgcctccggccagcccacctccgttgtggccccgacgagcaccgccatccgcctccgccacggcccgacgagagccgccgtccacctcgcgccacctccagccatcccgcctccgccgcagccccgatgatcgccgccgtccgcctcgcgccgcctccagctggccgccgcggccctgacgagtgccgccgtccacatcggcgctgcctccagctaggccgcctccaccgcggccccgactagcgccgttgtccgcggcgcacctggcgagcagcggcgtggccttcaccagtgcttgccgctgagccggtgaacttctccagtgatttcggtcagaccgagactgagactgaaaaaactgagaccgaatttgccggtcctgagttttttcggatgaaattcggtgctgagttttcaatgactgaaatgaccaaaaaaccgaagactgagaccgaatttttcagtcagaccgaacgcccacccctagcactagatctagctacggaagtaccggatgcgggcacgacggtgccggatccgccacctccttcgctggggagtgggtgcgttgtcgccacctccggtctccggtcaccacacgtcatgccgcctctcccatgccagagacagggcgccgctgcaattaaacctagccacctctatctcggcccgtcgtccggttctccagcgacaccctctggcagcagcgatcgaggtgggaagaggggggcgacgggggctagggtttcgcccctgagccgcccacgcgtgggcgatacgagagcctgttagttttttgttttatcttgtttatacgttatatgaatatagtattgtaaaattttgaagaatagatgtgtgttggtttattgtttggggtgctagatgaatttttattgttgcaaagtttcttttttttttgcaaattttagggtgtatatagatttttttcatgtcctggctactgtagctgaatggaagttgttttgcttgaataggacaatgtaggacaatggagagcgagccagctcctgcgcacagaagagtaggaccgcacaaactgataaggttgcacctgaatgcttatggaaccagcatcaatttaccggcaccattgagggtagtcattggtaccggttctacaccattgaggttacaccaatgacctcatcattggtgcctattataatttaatactagcactataggggtgcaccctttttaatttttctaagtgcgaaaaaacccaaaaaaatattttgcattttattagacgtcaaccacaatcacactttacttcccccaagtcatattatttttttaacccatattctttggaatgtactccctccgtcccgttaagtgcaacaatatatatataacctccttactatctcacccaggaacaattattgtcttggaagcaaatgcttttttaaagaaattatactccagtccatacttaatactgtagatgatgtcaaatgaaaattttgtcaactacaaaattgtagatctcatcaaaatataaaactttcgtataggttctatctccatccgagatcgtttataaattttaaaaattcacttatccaaatagatttgagaccttataatatatatttttggttatccaaacaacctcaaatagaaaatcattagctagaaagttgtagaactcatataactttacaaatttcagataaagtttatcttcgtccgatttcgtataaaaaagttactaaaaacacacatatatgagttgtggtattaatgatgctggttttaattataaagcggtacctagggtagtcctaatgggcgggtgattgctccctccccaccccagcgatcacccgcccctccccctgtacgttacttcctttccccctttctcctccccttcttctcttcctactacaccataaatatttgaattcaaatttaaattttaaactgatatgtaaactttttacttataaactttgggtctataaactaatatttgaattcaaattcatatttgaaacgggtatgttaacttttgacctataaactttgggtctataaactaatatttgaatttaaattcaaatttgaaacgggtatgtaaactttttacttataaactttgggtctataaactattatttgaattcaaattcaaatttgaaacgggtatataaactttaggtgtataaattttagatgtatagaaatactatatataaaaaaatatttgagttcaaattcaaatttgaatcggatatataaacttttgacttataaactttaggtctataaactttaaatgtattgaaatactatatataaaaaatatttgaattcaaattcaaatttaaatcggatatataaacttttgacttataaactttgggtctctaaactttagatgtgtaaacttgaggtgtataaataggtgcataaatttactaaaatagaaaagtaatgcggtgccaaaaaaataaaaccaggtggagggagggtggggggtgaattgattgctaccgccaccaggcgagcgatcgcccctttccgcggtacctatgacttcagaaacggtacctatgacttcgatgcggtattttggtggatgttgttaaaccacatcgattgtccggtatcagggatgatggcgcggggtgttttcggaatctcggaccacctttgcagctcttttatatatgagctggctagccttcatcgtgatatactactcctactaatcagctgctaattataacctccataaattctctggctgatcctaccttctgttaattttccgtgaaatactgcgtggcagggcactagctagttatgtcccattaccttcctttcctctctcatggaatggttggtcgtcgtccggttctgcagccggttcagcgttgcaatccgactggtgcccaagctcgcggcttcttccgacaacagagcgcgagcggtgtgctgctacatgcatatacgcacaagaagtctggtgatgccgccccttctatggaggcatctagctttcagcccagtgtgtggggagatttctttatcaactacgaaccgaagcaactacaggcaagagcacgatatttttatatctatgtcttttgcatgcatgatacactggtgaaaccatctttggttggtcggccgaaatccaaaatagtcccgattccactaaaaaccggttagagctactttttgatctttgctcccagttggtaacatcaaccgggactaaagatcatttttagtcccggttcaaaagacggaaggtggtgtcagacccctcctttatctttagtcccggtgggtgacaccaaccggaactaaaatatttttactctcggttggtgttaccaaccgggaaaaaagatcgacatgcgccatgcgagatcaatagaaccaaggcgcatggaaggatcagttaataagttctaacctttatctcctcctcttctcactcaccctatcccttcctcttcctcctcccatctcttcctctacctcatctggatccgccccctcccctcccctctcctccccacttctcaacctcctctcgatccgccccctcccctctcctccccacttctcaggcggcagcggccaggcggcctcgcgcggccgggaggcgcggaggcggcctcgcgcatcctcacgcggtagccggagggcgaggcacagcgcgcggcgggcggcacgcggcgcgggcagcggagccgcgcacagggcagcagcgcgccggctctcttctctttttttttataatttgtgattgagagatgtataatttcttttttagaatttgtgattcattgcatggatctgagatgtataatcgatctgtgatgcatttgatttgtgtgtaatttttttaagatttgtgatgtatttgatttgtgtgtaagtaaattaggatttgtatttttatttgtgatgtgaatgatttgtgatgttactttgatttggagatttgggatttgatttaggtatatgcatgacactcgatttggggatttgttgtttgatctgggtatatacatcctactcgatttgagagaaaataaaaagaaaatggaccaaccgggatatataggagtaaaaaaatatatataaactgatgcgctcaacctgaatgttttatccacacacatggaatgctaaaggagctagtttggatagttaggggctttctccctatattcctttttgcttgtcattatggacacataggtctatagcacacatcgttcttttttttttctaataccatataaatgcgcacaaactcacatcttgttcttatgagatccactttctcattatatatatttactaaaagaataaatttcacaaaaatacatatactatgaacaaactatcacaaaactacatattttacataaaatttatcacaaaactacatttaagatacagtgtcacaaaactaaatatttagtaacaaaattatcataacactacatatctagaaccaattttagtaacaaaactacaatgtttatagctacaacataataatggtgctacatatttaaagtataaaaactagataaattcaatactgaatatgtagttttatgatatttggccttaaatctatagttttaacataaatttggtgctaaatctatagttttttgatacaattcattaaatatgtggttttatgataatttgattaatatacctatattttttgaaatttactcttactaaaatagtaacaataaaacattttaattggtaatctagatactacctccaagttgataataattatcgttttaacaagaacatatagtctacgaaattaatttttaccactattttctattaaaatatatagttttattaaagtaccttttaaacattaattcttcaaaaacattaatgcttcatgtttagaagttaaatatttcagacgttatttatagtcaaggtttttcaagtttgacaactccaaaatgacaattatttttaacttggatagagtattaattaacattgctttcacatgacgattcataaagttgtttatgcctctagcgtgcataatactaccttcctttttaggttataagatgtagtcaaactgtttcaaatttaaccaaatttatagaaaaaaaatagtaatatttttgacccaagataaatttattataaaaatatatttaattattaatttaataaaaaaaatttggtaatataaatattaatatatttgtctataaacttagtcaaacttgaagcattttgactttggccaaagtcaaaatatcctgtaacctgaaacgtaggcagtatttggcagtagcttttaagcatatattttttatatttttataaaaaaatgtttttaaattttcacttcattcatgtaaacaaaatatattcatcgatggtgtatcttatttgtttttttatggtagttaattttatgctgattttggcatataattggtcatcgaacaatatggacaacaaatccacaacaaacacaagttatatacattgtaaattactgactcaactcaactatgttggttccaatatttttctttcggttgatcatagataactaatcaaattcatgcgtgcaagcagcgatcaaaggagtggatgatgaataaggccgataagctacaacaagctgtccgcacactgtttaggacctgtaatgacatggtggacaagat

SEQ ID NO: 68279 - DNA, 4420 bp, Oryza sativa
  unsure (1)..(4420): unsure at all n locations
tactatgacaaatttacggtagattcagtgaataaatggatttaccctaatcattcccgctggtcactactgtaatcaccacttccaacacgcagttgagagcaaccttggcgacgcgcttcgccgctcgacgcttccaaccatgctgcggccagcggcggccgctggcgccgccggcctccatcagcagcggcgtgcaccgcgggtgcacgtcgacgtcgcactccacgcagcggtacatgcagcggccggcgtcggaggtctccctgcaggcgacgcaccgccggctggccgtgaggacggagagcgtgagctcgtggtcgcgatggcgccggccgagcttgactcgcttcggcagggtgaggcaggcctcgtggacgtcgaagccgccgcacggggcgccgccccggcatctgtaccggtagctccccccgaagatggtgcggtcgcacacgttgcagacaccgaaagcgccccgcttgccgccgtaaacgcgcctcgttagcgagtgctccgggtgtaaccaggtagtgtatctggcggaacccatattgatatatatatcgatgtatcgaatcgctagcttcgtgtggcctagctgtgggctgataatgcttggttttcgttgtgcaggaggtgaatgcttagttgtcctgagtggcatatgagtacatatacatacatacatacatacatacatacatacatacatacatacatacatacatacatacatacatacatacatacatacatacatatatatatatatatatatatatatatatatatatatatatatatatataggacactcatatggggcaccatggtgcccgggcaccatggtatgaaatacacaaattcgcccaaatttttcaaaattttcaaattgtgagtatatacttagttataagtattcgattcatacctatacctagcaacaaaacaactcaaatttaactttatttcacaatccattattacatacctaactaattatatgtttggatgctatatacctagaatcaaaatctaacaaaagcaagtttgaattcagttcaaacttgctttgaactagttagtaaagtagttaatgttaatacctaaatatttgaaaaagtttcatactcatttgaattgggtatatagtaaatttcaatcatggtgcccgggcaccatggagcaccaaacaaatttaatatatatatatatatatatatatatatatatatatatatatatatatatatatatatatatatatatatatagtagtttcgactttcgagtcatcggtcttagtggtgttttttttttccaatacagacaaaagatatgtcaaaattatgatttgtatacacggtaaatgtgataagtacgtgagttagccacattcacccggagcatgcacttgaaactcgaaagaatagtctagatgtgttgttgcgcttaacacgtgtgcaatttattttatataaatttcacaaaactacaagtatatttgagtaatttattgtaagctacagatttaaaataatatatcataaaactatatatttaacactaaaattaccacaaaagttgagtatcacaaaactaaatgtttaacatcaatttaatcacaaaacttggatgttgataattcaaacataacattagtactaagaatttaaactctaaaatctgtagtttaattaattttattattaaatttatagttttgccatacctagttttaaacttgtagttttatgataatattatataaaatatatagctttgtgatacaccaccttaaatctgcagttttgtgataatttagtaaaagtatctgtatttttgtaaattttactctattttttcattatatttattgataaattttcttctaaaagattaatagatgtaaatataacataatcatagtgtaattatattataatttgaatttaactataataaaatttgcatgtaacttttaaaaatcgcacggtaacacgttatttgtgggaagcagacgtttcgtacgtgatggagggacgcgcggtaataccttatttccgcaaaccggacatcatgcgacggaatcccatcacctttatgcttgccatggttttttaattcccgcttgcatgaatcttgaagcacatctaacaatttaaaattttaggaaaatacatgcaagttacaatgtaattacgcgataattataccgtatttacatttgataaagttttaggagaagaaaatatcaacnaatgtatagcaatatcttttttttcttcatattgacaaggatccatggtaaaggtgtataagtttcaattttaagttacagcattatttatttcatccagaaaaagtaaaaaatacacttgagagttgtttcatatcgatctagtgttgaaaaaggtaattgatgatagaatataggggagagatgaaacaattgatatggaattttaggggttttcttcacagcctttgttgtcgagctctcttttttttcgttgctaattaacatggaaagtgaacaaaataactctaattaaaatctgcttaagttaacaaccaaaattcctttgggttttaagaataactatatggtaaactagcctggcagagcaaattgttatgcatagttctatgttttccttggggctccccctctcaaagattcctgcggcgatggagatgaaaagagccagtggcgtgtcgtatggtccttgtgccatctagaagaaggttggctctgccattgctccgtcagtggttgtgtcctagtgctcattttcctcaacgacggggagcggcggtggtggtaggcggggagcccaggcattggtggcggtggtagctagttggcctacggtggtttaacgatggtaacatggaatgttggcatgactaaggtggtgtcgacgacatccagtgtggatccagtctaatggccagatcgcccttcaagtgagcgaggaggctacagcaagaaagatagacggcaggctcattcagcggcaacaagtgtatctagatcaagcctaatggtcagatcggtagtgagcaaggcggctacaatgaggagctgaagcgacaatttcctgatgatggctaggcgtgactctatatttagtatctaagtgccactagttatgatgtgtttgtgcccgaatccgtccgtacgtatagttgcaacttgatgttggaggatcttcttcttcttcactttatctggatgatgttagcgtgcgaaggcacaaggggctaggagctatcggatctggatcgattgaatcttgcctatggcaaaggcaacatggggattagaggtggatagattgaggatgtgggtactacattagtttaggcggcgtttcaactttcaagatcgacttagtgtcgtttttggttcggcaggactcgtcaagtaagagaacatctgggtttagggttacagtctttttccattttattttgtttattttgtagtttccaagttatgagacctggaatatatctatttttctgtgtcccttgtgtatatccacttgatatagagaccatcattttatttattattaaaaaaaagttgtattatttgtagtgattatgaatgcatcggtgagatagtctttttagtttcacttctgtgaaactcgataggagattcattctatttggtttgacccaaacagtataagtgactaatgagtgagcgtgttgaatcggtggagcatatgtacatgtatacttaatgccaatgcaagttcatgataagcataaattgagaagtcagcgatcctcgattccttgcaaccccctagaccttggtggcagaggaaaacaacaaagctttctaacttgacacgcattgacattcgaaagtacgtgtgcatgacttggtcaaatagtacttactactccagtagttactcgtaccaacatccatcgtactcaggtcgtgctttttatgggctggccgcacgagggctactgggctttagcggttgcacgcacgcaagaccgcaagtccgctcgaggagaggacaaagagggtgtacacgaatgttcgctactattagacagtcacgcgaacagttccgacaaccttcctcttactcgtacgtctaaccacgcctgcatgcaaatacgtgttcacatgagagttgctctaagcctgccttttcaaagaccaagtccacccatacctatgttattttattctcctagaatcgtacacgtgttcacgtacgtcaacaatgttggttcgtcgcaacggacgtttttttaaaaaaaatatatatccttgattaactccttatgtttctgttaaaatttatatatacattattaaacattctaattacatatataaatttttatacataatatttatacatatacgtatatgtataaa

SEQ ID NO: 68280 - DNA, 8867 bp, Oryza sativa
aacattattaaattattgtcggatagtgaattggaattgctagctgctttcatacaaaaccggccacttatcttatgcttttgtgttctgcaggcgttggacaagatcaggttcgagagcttgacggacaagagcaagctggatgctcagccagagctgttcatccatattgttcctgacaaggcctccaacacactgtcgatcattgacagtggtattggtatgaccaagtcagatcttgtgaacaacctgggtaccattgccaggtcagggactaaggagtttatggaggcactggctgctggtgctgatgtgtccatgattggtcagttcggtgttggattctactctgcctaccttgttgccgagagagtagttgtgaccaccaagcacaacgatgacgagcagtatgtgtgggagtctcaggctggtgggtccttcactgtcacacgtgacacatctggggagcagcttgggaggggtactaagatcaccctctacctcaaggatgatcaggtactaacagaatttcattgaattcttgttcaatttgtgctgcttgtattgctgaatgcccttatagttcatgaatgtggcttgctattgataaatgcatcaactagtaattctgtcctcgtaggattattacgaatattgttggtacttgattttatagccacttttagaaagaacatgttgatgtgcctcaagttttcaccataggcatgcttgagccaggtgcttaatcggtctgtttaagacataaaaaatgtctctatgtaggggcatttggtgaattgattgaacagaatgaacatatttcacacactgttgacattgtgataatctagatagatgccttaacatttcgaactcctgctgtgaaaattatgttagtatgtttctgccttggatgttatgagtaatcatgttacacatgtacttaggatctataagcttattgttgagctcataaactgattgtgtatgcattttttttctttgggtctggttttgtgtcagtttgattgcgtgtggttgtctaatacttcctccgtttcacaatgtaagtcattctagcatttcccatattcatagtgatattaatgagtttagacatatctctctatctagattcattaacattaatatgaatataggaaatgttaaaatgacttacattgtgaaacggagggagtactatgaattaattagtaacaagtattactgttctactgttgtgaatttttagaatcacctgaactcctaagttgaactgtgaaatgtgctataaggtgtcctggctctaatgtgttcatttgttattgacaacttgctcatgcttcctgcagttggaataccttgaagagcgccgcctcaaggacctgatcaagaagcactctgagtttatcagctaccctatctctctatggactgagaagaccactgagaaggaaatttctgatgatgaagatgaggaagagaagaaggatgctgaggagggcaaggttgaggatgttgatgaagagaaggaagaaaaggagaagaaaaagaagaagatcaaggaggtttctcatgagtggtccctggtcaacaaacagaagcctatctggatgaggaagcctgaggagatcactaaggaggagtatgctgctttctacaagtccctgacaaacgactgggaggagcatcttgctgtcaagcacttctctgtggagggtcagctggaattcaaagctgttctctttgttcccaagagggcaccattcgacctctttgatacgaggaagaagctcaacaacatcaagctctacgtccgccgagtcttcatcatggacaactgtgaggagctgatccctgagtggctgagctttgtcaagggcattgttgactccgaggatcttcccctcaacatctcccgtgagatgctgcagcagaacaagattctcaaggtcatcaggaagaaccttgtcaagaagtgcgttgagctcttcttcgagattgctgagaacaaggaagactacaacaagttctatgaagccttctccaagaacctcaagctcggtatccacgaggactccaccaacagaaacaagattgccgagctcctgaggtaccactccaccaagagcggcgatgagctgaccagcctcaaggattacgtgacgaggatgaaggaaggccagaacgacatatactacatcaccggcgagagcaagaaggccgtggagaactcccccttcttggagaagctgaagaagaagggttacgaggtcctctacatggttgatgccatcgacgagtatgctgttggccagctcaaggagtttgagggcaagaagctcgtctctgccaccaaggagggactcaagcttgatgagagcgaggacgagaagaagcggaaggaggagctcaaggagaaattcgagggtctctgcaaggtcatcaaggaggtgctcggagacaaggtcgagaaggtggtggtctcggaccgtgtggtggactccccgtgctgcctcgtcaccggcgagtatggctggacggccaacatggagaggatcatgaaggcccaggcgctgagggactcgagcatggccgggtacatgtcgagcaagaagacgatggagatcaacccggagaacgccatcatggaggagctccgcaagcgcgccgacgccgacaagaacgacaagtccgtcaaggacctcgtcttgctcctcttcgagacggccctcctcacctccggcttcagcctcgacgaccccaacaccttcggcagcaggatccaccgcatgctcaagctcggcctgagcatcgacgaggacgagacggcggaggccgacaccgacatgccgccgctcgaggacgacgccggcgagagcaagatggaggaggtcgactaagcgggtttccttttttttcccctcgtcaaatccttcgcagcgaaagtacaccatggagcattggagctagcttatctgttttaccttttgaacatcgcgttgttgggtcggttcggtttattttgtgcgatttgctttacctttacctagcctgcaatgcatggggctagattgtgctatgggttctcgaactgcgtacgttaattatattgctaaatatgagtattatattagtgtcctcatgagttgtctattttttcctctgcaagttagatgtatcaattaattttgcgaatattcttctgcctcaattccaccttcgagcaccagctttgcaatttacagttacagaaacatatgattgcgtagtgtgaatgggagatcttgtcacgctgatcaaattgatcaacagcaacgggaggagttccttgcagcgaatgcccttggcaatttatactgtgctttgttggtggtttgctcgctctggtgtttgttggcgattgcccgttggcgtccaatccttgcagctgatttctttggtatccttggagcacctgatgaaaatttcttcagctcacgataacaattaaatatatctgttttctgttagcaataacaatcaactttttcttcagagcaaacaatcgactgtttcttcagagcagctcactccggattacctgacaaaaacacaattaggactagtaggtacctgacaaaaaccaaaaaacaacataacactcggtcctcgttcatattcacatcagctaaattttatacttcctcttcatcatattataaatcacatagtagaaaaaacatagtagcatctataacacaaaataaacatatcattacaattattcaatgttagatttaatgaaactatttttccataaaattggttaaatttaaaaagcttgactagaaaaaaaatcaaaacaaattacaatatgaaacagagagtaacaaacactgctaacagacgagtctcgaagaccatgaagtgggattatgtctacgcttatgcacgtatagcatattgtcattggatcttctataagggtcaaggaaacacgaccgctgaaaaaattctgatgatttaaataagttttgcctatgttttgatgctcaaggaaattgatggtcaaggaaacaagaccaactgaataaattctgatgaattttaagttttggcctgtaaagacagatgctgtgacataatccatctttggcgttatggcaatttcaatcagctctgaagcataacgagcatagtattttgctatctggggcttatgagttgtgatgttctaaccacatttccgataacttgtaagcattaagcaatatacccaccagtgccaccacttccattgctcaaaagcgtaaagtcaatatcaggcttctgcaagaatcttaaacctatcgtgtccatttcctgatgccagacctctgcacaacttgcctcgcctccagaacatcgaaccatttaccagcagcagcataaatgtcagaaatcaaaacatggcagccagactgctgggcgttgagattgaggctatggatctcactctgaactctttcagccacatcaaatctcttgtgcattcgacaggcacccagtagagcgccgaaaaccatgacatcgggtgccatcggcatgctccggatcaactcctctgcctcttcaagaagccctgctcggcctaacatgtcaaccatgcaaccatagtgcttcacctccggctgcactccgcaggtagacgccatgctctggaagcaccgtcgaccttcatccaccagcccaccgtgggaacaagctgtgagcacaccgacaaacgttatgtcgttcggcttttcacccgttctcttcatctgttcgaatgcgtctacggaatcccgagcattgccgttcattgccaacctggtgatgagcgcgttccaggccgagacgttctttcggtccagggagttgaaaattttgacagcaatgtcagttctcccgcacttggcatacatgtcaataagagcagcaccaagattgtactcgttgttgagcaccatcttgtgcttgtcgatgaaggcatggacccatcttccttcttccagtgctgttaaatttgcgcatgctgaaagcacactcaccatggtcacctcattcggctgtacattgctctcagtctgcattgcgcgaaacagctcaagggtatcctgatagcgtccagcctgagcataccctgaaatcatgcatgtccaggaaaccacatccttctctggcatgacatcgaacaactccctcgcgccatccatgtcgctgttcactgaataaccccggagcattgcattccatgacaccagattcctgactggcatctcatcgaacatcttcctcgctaacggcagcagcccgtggcgcgcgaatcctgtcaccatggagttccatgtcacgacattcctcccaatagctggcatccgatcgaacatctcccttgccacatccagctccccggccgcggcatagccccccaccatggtgctccaggacaccccattcctccgtggcatttcgtcgaacaccctcttggcactctccatctccccgcacttcacgtagccaccgatcaccgtgttccacgacaccacgtccgcgaccccggcgcacgacccgaacacctctcgcatcgacgccgcgtcccggagcgcgccgtacatcgcgaggagcgcgttgacgacgaagacattcgccaagaacccgtgccggacggtctgcgcttgcacctgcgcgtccgtgcgcgggaaggccgggagcttacccacccaaccgaggaggggcggcaaggtgaacctgtcagggacgagcccgcaccggaggagggaggagaaggcggcgaaggaaaggcgcggggacgcggaggaggcggaggcgcggatgaggatgttgtggaggaaggtggcggaggaggaggggaagagcgggaaatggacggcgcacagggcggcggcgaggtgggggtgggaagggaggagcgggacgatgcggcggaggtgggcggggctccggcggaggtcgccggagacgacgaggcggccgaggaggagcgggaggaggtgaggcggcggcgccatttttatcttctttttttttttctcgccgcgtggaggggagaaggctttatttgaatatttgaaagcttgtgattaacgtgagccgttggatgcgcatcggatggctgagatcagataaagctggagaaaaagaaacatttatcactagctactggtttttctatactactgtatgagtggaaaattgtacacattttatgtgcagaactttcattagtacagagttaggcttatcctaagtcaaacctatttaaatttgatcatgtttatatgaaaatatggtaacatctacaatatcaaattagtttcattaaatcatcaatatatatatatatatatatatatatatatatatatatatatatatatatatatatatatatatataaatttgatcatgtttatatgaaaatatggtaacatctacaatatcaaattagtttcattaaatcatcattatatatatatatatatagtaaatttgtttggcgctccatggtgcccgggcaccattgttgaaattgagtatatacctaattcaaatgggtatatatatagggtttttttaaatgatgctatatttttctataaacatgatcaatcttgaaaatatttgacttggtacaaacattaacacaatgtatatatctaagtaaactgcggctcatctggaagacgaggtattcagggagggatgtgcatgatagaaagcagagaatctgaatgctttgcactagagattcatgtcatgttgtctactatcaaattgagcaatggatgcactccgcctgacttcgaaccagaacccaaaacaaaagagagctggtatgttactatgttagctagatgttcataagccatgctccaatttctatgttcagctatccttgttctcagctgccaatcttcaaagcttgattgcctttgatttttacatttgccacgctagccagtgcgctcagaggctctgaatccaccatagttgatttcttgacaggatcaacaaggtcaagcctcttctgcagcttcctccttttgtatgtgaaagggtacctatgaccttcttcaacttctgtaactgactggctggcaggagtcttcagcttcaatccttctgggtaacgcattgtttcagactgctccaataggtgtttgtaagggccagcggtgtctgtaccaagggtcaacacctcagaaatactttcagcagttttcagaccatgcgtcatgtatccatttgtttgatgacaatcagtattccttgtaaatggatcaggagaactttcaggaattacggcattttgttgaccaaagttcttcaaaaggttcttctcgtggggtgcttcattgcaatattccggactatgtttggttgttgactgatggaaggaattcggcattcgagaatagtaaccccttttaagctcctctggaaccataatttgcactccaaacggactttcaactgagtgagggtaagtatcaagtgtgccttctctttggtagggacgcacatgtagatttctcaaagtactcttgcttgtgtttatgtggtagtaataagctgaattcatcgcaaaaccatgaacatccagtgcagaagcgcaaggtaagctggagacctgtattcccagttggtctgctagcatcggttctggtgtacgatgaattccttcattgtgatcaatgagggaagcacaatcggtctttattttcagcacacctttgggcaatctaatacatgtagtaagctcaccaggaacatgaaagacaggactcttcaatgagctcatttccattgatttgtctctgtagactattcccttgcgcttggctgaacaatgagtggttactgtcccatccatacgtttggttcgcttcaaaggtggaagggttgcatctttaacctcattggcaattgatagacttctattgaaaggagaaccgcttatgtcaacacctgtgaggggatcttcatgtcttctgtcattccaactgttaaccttaccctgaagaccagtactcgccccacatcgtcctcctaccttgtccatggatgcaaacttgaaaatcatgccatcatgatgggacttcagaaaatgataatatcttcgtctttcaaagatcatcagtaattctctagcctgggaaacttctggagaataaaacccaccattcaatctgtggaagaagctcttcactggactcccaaagaacaggtcactgccactaaacagctccttcattgttacaaagaaatcatgttggtccatgtctgggagataggctgctagacggaatctatcatcttctgttagacataagttccatgtctccaaagaaagaatatcattcaattcaggcaaatcataaagcccataagggacactacagatctgatctccagactttgcaagctcacaattgacctcttcatgttcatagtcatcggattcatgaataggaaatctctgaagcagcattttctcctcttgtgtaatgtcctcgtctccacagctgtaagcccgctcttctgtaggcgcacaacttgctaccttcacaatgcccattgatcgaaggaagaggtgcaatgctccgatcggtatcagagataatcatagagacgaaagtcaacagtgtgtccagcacaataccatactatccgacggaagatccctgtgaagaaaaaggaaaagaaaaacaaggaatatcagcatcacaattcatctataattcaatttgaagaccatatttcatgacctcatgcaccaagtaggctggaaggaaatacattgcagagccaagcctaaataattcctggaaatagaatgctat

SEQ ID NO: 68281 - DNA, 4006 bp, Oryza sativa
tattacgctcctcaccgacccgaacctgtatacatcgcccgtgtcttgtgtgtttcctgtctcgcgagccttccacatacagagagcttagaatctcaccctgagtccccggccgaactggcaaagggggcctgtgcggtctcccactgaggagccccacgctccgtcatctggcgcgccaggtaggggactctgcgagggattttctgagctctcgcactctttcgtgtgcgccaagcttttcctgttcagcccaatggccgagccagcaaaggcgcacgacctctccccgagtatgagcggtgacgacggggagccaaacccacgccgtcgagctcgtactccaccgccccctccacgccaaagtcctatgcgggagaaggcgctcgagagggccgaaggatccgcgacttcgacacccacaggaggtggagaagggcggcgagatggggagcgtcgcctcctcgtctacggcgatggcagcacgccccagggcgcgctccaagctgcgggcgcgctcctacgtcacccgcccgtcgcccatgacccggagtctccagcccaacgttggctggacgatgtggccaaattgatcatgactgcacggcagcgcctagatgctggtgggcggtcctccgccaccaaggcctctggtgctgctaccaccggctccgcgtcgtcaagacggagggcgcggcgagcggcagccgctgttcgccattcggccgccactccttcgtcaacgcctccgacccggaaagatctgcgtggggaaccggatgcccgcatcagtatcgagcgccggcgtaatggccgacgtgctccccacgcaacggagggcgcctcctcgtccggagtgtcacctcaccacggacgcggggatcagccctccgtgcccccggttgttggtgtcggctgtagagcctttgtggcgagccttcggaatgtccgttggcccccaaggttccggcccaccatcgccgaaaaatatgacgggagcgtcaaccccgccgagtttctccaggtctacacgaccgggatcgaggccgccgggggtgacgacacggtcatggcgaatttctttcccatggccctgaaaggacaggcgcggggttggctaatgaacttgccacccgcgtctgtccactcttgggaggatttgtgccaacagttcaccatgaacttccaaggcacatatccgcgcccaggtgaggaagcggacttgcacgcagtacagcgaagggatgatgagtcacttcgctcgtacattcagcggttctgtcaagtccgcaacaccataccatgcatccctgcacacgcggtgatttacgcgttcagggggggtgtgcggcacaaccgcatgctcgaaaagatcgcctccaaagagccccagactaccgcggagctttttcagctcgcggaccgagtggctcgtaaggaggaggcatggacctggaacccctccggttccggtgtggcagcttcggccgcccccggatccgccgctcagatagggcggcgtgacaggaggaggaagaagaggtcagcccataccgacgacgacggtcatgtcctcgccgtcgagggcgcttcgcgggccacccgaaaggggaggcctgcgggaggcaaaaagaacgaggccggcgctcccaacagggagcgcccaaccggcaagtggtgcaccgtccacaacacttcccttcacgacctcgcggactgccgtgcagtcaaaagtttggctgagcggacgaggaagtgggaggagaagaggaggcaggagcgccgagagggcaaatccccggcggttccttccggtaatcggcgaagtgaggccaagcagaaggcccccgccgaggacatcgatgacggcgatgatgacctaggtttccaagagcctggggccaccattgcaaccgtcgatgggggagcgtgtgctcacgtttctcgccggagcttcaaggccatgaagcgagagcttctggccgcggcccctactcatgaggcgacgtgtcgggcgcggtggtcggaggttgccctcaccttcgaccagaccgaccacccaccgtgcgttgcccggggagggcagattgcgatggtggtttctcccaccgtttgcaacgtgaagttggggcgtgtcctcattgatgggggagcggccctcaacatcctttcccctgcggcctttgacgccatcaaggccccggggatggtgctccggccgtcccagccaattatcggtgtgacgccggggcacacgtggccgttaggtcacattgacctaccggtcaccttcggtggatccgccaacttccgcacggagcgggtgaacttcgatgtggcggacctcagtctgccctacaacgcggtcctggggaggcccgcgttggtgaagttcatggcggcggtccactacgcctacctacagatgaagatgccgggccccggtggccccatctctgtccatggcgacctcaaagtcgcgctcgcttgtctggagcagcgcgcggaccacctcgccgctgcgtccaagcccgagggtggcgacgagaggcttggcgcctccgcccccgccaccccgaggcagcggatgatcacaggcgacgaggtcccggtcaaggaggttgccctgggcgacggcccgtccaagaccacacggatcggtggtcttctggacggcaaataggaagacgcgctcgtctccttcctgcgggcaaacgctgacgtcttcgcatggagaccggcggatatgcccggggtccccagggggttgattgagcaccgtctcgccgtgcggccgggcgcaaggccggtccggcagaaagtgcggcggcaggccccggaacgtcaagccttcatccgcgaggaggtggcacgacttctggaggccggattcatccgtgaggtcatccatccagagtggctggcgaacccggtggtcgttcccaaggcgaacggcaagcttcggatgtgcatcgactacaccgaccttaacaaggcatgtcctaaggatccttaccccctgcctcgcatagatcagattgtcgactccactgcggggtgcgaccttttgtgttttctagatgcatactctggttaccatcagattcgcatggctagggaggatgaggaaaaaactgcgttcattacccccataggaacctattgttatacgacaatgcccttcgggttaaagaatgcaggtcctacttttcaacgtactactcgaatttctttgggtagccaattaggacgtaatgttgaggcttatgtcgatgacttggttgtaaagacgcgcaaccaggaaatgttactctcagatctagcggaaacttttgagagtctccgctccgcccgcataaaactaaaccccgataagtgtgtgttcggtgtacctgcgggcaagcttctcgggttcttggtctctgcccgaggcattgaggccaaccccgagaagatacgggctatagagcggatgcgccccccccagcaaacttagggatgtgcaatgcgtcaccgattgcatggccgccctaagtcggttcatatcgaggctgggagagaaggcgttacccttatttaagcttctcaaacgctccggaccgtttacctggacggaggaagccgaaaatgccctcacccagttgaaggcgtatctaagctctcccctagttctggtcgccccggagccagacgagcccttgttactctacttagcggcgaccccgcaagtagttagtgcggcattggttgtggagcgcgatgaggacaattctcatttcacgcttccccaccctgtgccgacttggcccgggagagagcagggaggagaggctcccgagccgaacggtggcccaaggcccccgacgaccggagttggccctctacccgcttgtcagacggtgctaggagcccccgacccccaagaaggccccgacgccactgtgggaaggccgcacctatcgccctttgaccccgaggctaaccctgtgccgactcgacccgggag

SEQ ID NO: 68282 - DNA, 15030 bp, Oryza sativa
gaaattgtacactcaatcaatctccttatacactaaaaagtaaaaacatcgatcctaacaaagtataatgttgacaattatttaagtcatcactactaggaaaactattctccaaaatgggtcttcgcagacggacgaccggtccgcctgcaggaagtaatctgaaagaactgaattatatattcgtgagatggggaagtaatctaaaatatgaatttcgaacccagccttacctaccttggttaacatagttaacattatacttaaaactaacttccaaaattctatcatggctgctgaccatccacctgttcggcaaatttcaaatccattgtcccttttgacattttgcctgccttttgacattctctccaactgaaactttgttgtctttttgaccctgttaatttgttttgtctccagatagaagtcacagattataatggatttcaacatctttccatctgtgcctgtatgcatgtgttccaatggaataatgatcatgttttcattaatctgggaacgtgcatgatgcccaagtatatcaaaagttgctgaattgggaatctgagctcttttgataaactagtttagttgattactccacttgtcttgatgcaaacaaaaagatggatcgatctaactttacttcaatattttggatgcagtagaagatattttggcacaactcctgttaatacaaaaatgatccatctcatcagcatctcaatctctatagctagcttgctagaagatgctttgctactttccctcttggcaccttttgatggaacaaaaatgcatccttttggtcaattaatgctacttcctgcatcccacgtacacattgaccactttacttgatcatggacactctctggtttttaataggtaacatcattaccttttgaatgtatgttccgtcttattttaaaaaaatataatataaaaaaaatacatgtttatggtacctttaatgataaatcaattcacaataaaattaataatacttaagtattttttaataagatgaataatcaaaagttaacaacataatatattaaaaaccgaaaaaagtattattttccaacaacggagactagaggagaggcttagaccagatagcgcaaacatggaaaaacatctaatatatgttgaaggggctgcttagaagattgattgctaaaatagcataaatattaatactatacccatgagtttcatggtttcatctttatatgaagttcccctcttaattatccccgtttcttgaaatatatggaactattttccaagcatatatgtagatatatattacatacagcctagcagtcctcattgcatggtagtaactgtatataagtagtactattattatatgtatgaagtttcacacttagaaattttactttatagtatgagctgcaataacccacattcttgctgacttcattcacttcaaaataacaaatactccaaaattccatactaaaagatatatgactatcaacagaaaattaggatggcatgttccaaaattccatatataaatatgatcatgacatggatgaatttttatcaaatattaacccaaaaaaaagaaaaatggggaaatgatgaaaccaactattattatctatcctttatattttactccctccattccatattgtaggtcgttttagttttacctaagtcaacttctctaactttaaccgagtttatctagcagcttatttactatgtcatttacacccagccggtgggataattaattttcagtggttatatgactttaccaaagcaagaaattaagcacccctaactaaaaatgtgccgacatctataataacaaataaatgtagtatcaaaacatatttcaaatggtggatttaatgaaactaatttgttgttgtagatgtctatgtatttttatattataaactcggtcagaattagagaagtttgacttaggacaaaactaaaacaagaactgagagagtatgatcctatatatgatttttcagaatatctaataattttcataagatctctaactgtttatttttgtgttccaaaacctcttatactctcttgttatgaatactagtccttgattgaggaacactttttatgtaacggttccttttttacttggcatcgaatactatctatgtacaaacattaattagccgctcgtattgtttgagaaaaatataaatattttaaaagataccaaactatcaaagcacctaattataactatactacttacattcatcaaaacattgtaatttaaaagtttttattggtcaaaaataaaatcacactggccaacagtactggcaagtaaaagagatcagagagagtgtagttccaatccttacccaggaaccaaccacatgttgaaggttggtcgaatagatggttgcaaaatagaaccatagcggagctggcccctaatctagtaaatatgatccctaaaaagattagcaagcatcctaccatagcacaaactttagaaaatcatgggtggactgctgatatcaaaggagcactcattgtctaagtcattgttgagtacttgcgagtttgggacttggtggacggggtaatcttgtaggatggcatcccagaccaacatcattggatgttcatgaggtctgaattgtacacccgtaaataagcatatgagtccttatttgttggaacaatcaagttcactccatggatttgttgaaggataaaacagagaaacaaatcaaatcaaacatttgagccaattttaatcatatctacacctacccttccacctgaaacattttacttgatacggattttacctggcttaatttcaacaaacttgctttataacccccccaccccaccccaaaagattgctttataagaatatatatgtaaacctttcaaaaagaaataagaggagtacaaaagcaaaagacctcccctccctaatgggccatgaacacatcacttgggacttgggctgctagaaagcgattgggcccaacccaagtgacacagacttggacactagtgctaaggacagccctgttgctgtcaaccacgaggcccacgttggtcctcacgtccacagaaaaacaaagcacaaaaaaacccaacccttgcgccggcgataactttgcgagcccccccgcgtggacgcggaccaccaacctcacctcctgcacccgtgcgcctcctcttctcccgctcacatgacatgcgggcccatctgagtcagcggcgtatggatcgatctggtgaacccggcgtaggtatgacgagcgaatgccacatgggtgacacagctgtggtgtggttggtcgcggcagtgaaaggagaaagaagcgagcgcatggagttcatcgggtgagcgttcttggtagtaggagattcttctccaatccgtgggagaagagctaggaggagcggaggaatccgtgtcccctcccgcggacctgcttctccggctgcccgtaagttggatttttctctgcttcgctccctcccctcctcgcgccattgtttttttcttggtcctttggctctcgggtgcgtcgccaccgcgattcgatctggggggagagggaggaggcgcaggcggagcgcacgagggaggtgggtggaggagagggtggggggcggcggcttagctgctgtggacggcagaaggggtttcttgtgttccagacaagaatcctgaggagtgagagcattacattgacatcctcatcagggctttgggtgtggaaagaagcgtataatgatgtattccttgttcagaatttactgttggttaaaaagtatatgtgcttcaacttttgaggacagggccatagggggtgaaaataagatataagtaaataacttacaaggaaacatggatgagagtgtgtaccataagcacaatttcgttttgtttcaataccaaatattttcttttaactaaatggattcattgacaataaggtatttgcttcaatatgcgttcttattacttcatatcataccacattttgtgattggggaatttcatatagtttcagatgctatgttagtttgagccatatcgtccaaccctgctcactccccctcctaaatttccattttccatgttttgttgtgcaggaaacatgctttctccctatcagcctttgtgatgcattgaacaggggttgagaagtactgtaatttttgtaatggctgggtgttccttggcaacactgagaggacaacatcgagggagatggatccaatctcacagcaagctccccacaaggattatgtctattaatctgccaaagaggtaaaaaagttttccgtactctgttgatattagtcatcttgagttcttcaatggtaatttaatgtttgattttcttcatttgcagtaatcacagtcacaagattcagcttccatgccagtccaatttaggaagaaaacagaaaactggtgcatttgctcctttgggttttcatggaaggtgttgccggatcgaaacatcagttaaatgttatttcttgcagtcgcttgtggattctgagagtatgatctcaccaaatttgttattgctttctgatgaagctctactaactatcagtatagtttttgcatatttggctggagttgtaccctctggccatgcatttcctcatgctagaaaccatagtcaaaaccaacatcttggagctccaggtccatctgattctggtaggtaagagtagctgcttaagtatgacttctagatctcaaaacattggcttgacaataaaaaatgataatgtattctttccattccaatttctagggatatgaaatggttacctgaagggaatactaggttttaccccagcgatacatggagtgaagtgagaatgaaactttcagaagccttgcaatcgaatggtcgagatgccacttcggatggcagcgatagtgaactcaagaacaatcgcaaaaattatcctttgagtatgcttgcaattcatggtggtcccaggctgcggcttcttctagctacctttcagctacttgagatggaggcaagagggccatcaactttttctttctaatatgctggggattatcatggatgaatactgaagattacccatgcatacttcacttatttttttttctaagggagagagcatacttcaaaaagcttaagcaagctggtagttgtgatattttctactaaaatggtgccactatccttctgtagagtattataatggatgaatcctgaagattgttcttgcatgtttcactagcttagttaagctttctctctttgtttttttaatgttacttgactagccactagaactatggactaaagttcagtcagtatcaagatatgtttttctttctaaccagcacagctgtataatatgtcagaacacatgtgttgattttgttgtagttaatttgatcttgtgcaggtaagaaatgttcctgaaagttctgaacttgtagatgggatcaaatggttgcaaatatcaactacgttgattgatggcttgattgaaccaacatttatgaaatggattcaagaagaaaaagcctgggagaacagcaagatcaatgaagtataccattattttcaactgtcttacatttctccatattgtcatgccttcaagtccctgatagttttcttttttcctgataaaggaacttatgaagacggtaaccagcaaaataaaggaggatgacaggatcttgaagaggttcaacagattagggaaatctgaactctatttggatctgctttatttcctgagatttggttctgcaaggtactatttatcttcacttcttgatccatatggtaccacttttttccatctgaactccatctcctgtttaagagtttaagatggcactattggttgtttattgtctgtacttatatccatatatagctatttaccaaacagtaatccttccataaggtaaatgagttcattcttatccttcatttcctgatggcaggtcttatagctattttgatgctaaatttctggctgaacatggagcgagaattttggaggacctggttattttcttagctgacgcggtcgctagtatttacatagagcttatatcagttgatggtgatatgccgactgatgttgttggttccagcttagctctatgctcgctgtcaaccagagaacttcaaagaatgcgtaacgaggtaatagttgtggataattcaaggtgttgcttgtgcttttactgttcaaatgtgcttttcaaaacttgcttgtatatacaccaaaaaataagcactttttatgctcacagtttggatttggtaagttgatgatttatagttggctttgcatgaagttagtagtctccttggagacaagccaacaaatatttaaatcctacccaagctggaaaccatatcaacagactaacagatcttgaaatattttttcttcaagtactcttattgttctcgtatggtattgtagtgttatatcatcactaattaactacgaccagccttctcaagttctcatcatgatttacgtgtaagaaatgaactgtgaacagagacgatgctgcgattctaatatactacattttgtccacatgtgtaccttctgtgtcattttctcttaaccttataagacattttgattgccaaacaaatatttttaagtgaatatcacagtacatgttacgtgaataatctaattgggcaaatatttgcactttgaactctcctctttttggttaatatttttaagtttttaggaaacatctctattccagttttttcttacttccagatttgataatccagtgctaaatttttttaaggtggcaattaatgggtggctgcaccagtattttgagtcagttgtctcaatgtacgaggacaggtttgagttatatgttttatccagaaaactttgtgaaaaaccagcagataatcaagctgaagtgacaaactggtggaggcttggatttggaaagccttccaccgttactcttctagagtacgttcacataagctcattttctcttccggtgagaaggacgaaagaattgagagctctggctggatggtattcgcaatttccttttctaccattcttttcatgaataattcatggaaacatttctgtgcgacttggggcaagatgaacataactttactctgttctgttgcaggaggtattatttcagcctattattagaaatgtcagatattgccatgcctttcataagggctgttgtcaccaaagttagtgctgcagtgtcgtacttctgggtgtccatgataggaaggtctctgggattgattttctcagggataaggcaatcacttggttggagatgatcagatgtttctttggtttttgattgtgagatcttgtgactgagcgatatttgcctcgcagtcatgtccagttttgtcaatttatataggcttttcgttgacctttttttttactgttgagatggctgacttctggtcctcgttatacatgttctgtatcacataatgtaacaaagttcattgatctgaccaaagggtgaaaattatttgttaatcttggaatgcatcatgtggtatataacattttgaaggcaaaccacacatttcaggacattatggcagaagtcagattgtctgatccaaaaacttgtacagatttatccagtctgcaccaatttgagaaaacaatatttcaaccatgagtcattcccactttctatgcaaaagcagaagcaaactgcccagtgacttgcttgggtttgctctattctatgctgtgtttagcctcttccagaagaatttttttttactattttaaatttttattatttcaccagccgcggttggtatggctgttttttcttgcctctagaaagtttttttttttgccactagtgtggccaacgtggcaaaacattactatcacgccaatcagactggtgtggcaaaataacattactatcacgccaatcagactggtgtggcaaaataacgttgacacgttagatagagcggcatggtaacattgtttcaccgtgctaacatggctaaaaggtatagatttagaaaggtttacttttaaaattaaaaattaaaaagatttaaataataataataattctacaaccagctcctccacagaccaggagacgacgatggcctaacctgtcctgcaatttgctgttcggtgaacttccactggaagagttggtgtcctgactaatctaacgacagttgatcttcccatgaacagcttcaatggcacaactccagaaagcatctacgcatgcaaacttcagtaactaatttccatacaaacttcgtagaaaacaatgaaggtgaaccagaatacttctattatactagtagtactcgtagatagcactatagcagtacaacacacaagcaagtccatgaaggctcagcctttactaggaagttgaaggctcaaagtttgttcaaccttgcaaacgcaagcgcattccagcagcagcacgcaacacatggttatttagatctgcatcggttacactttcagtattgatccaactaaccatctcaaggaaacataaaaagagtagaatgtaaccaacaaaacacaggtcaatctttcaattgctgtgaaggccaagaacagtcaacagtcgcgagttggggacgaattcaaaatgcaactgctggataggttgttaagatcagcagcagtgtacgtcatacaaaaatagataaatcaaaggaaatcagtgtaggcttatagactttggaccatgactctgcttcaggagtgaaggaatggaagtttaacaaatcatctcaagtagactagtgtgtctcaagtggccaagtgtatggataaatatactttttaagtgcaagtatttccgtcaaacaatgtgagtctaacacatcatgctgaaagcaaataatagatcgaatttacaaaccatacctaagcatagcactaagccagtgagaggcagcagtagcaaacgcgtaggtcaacattccatcagcttattgttcttcgcctgtttggtgcgtttaggcaatgctattctttctctctgcaaggaatttagcaatgttattcgacaatatatagctcaaggactgtattttttttgcacaggataccagcttatattggcaaaccatgctcagtagcctgccagtttctgacagaaatactgaccaagaagccaaatcacatccttcatgcaaacaaagccagcagttttcgcatgaatttctttcaccttgcgcttgtgctactgccgctgagcttcatctgtcctcccgtcggttcatgcattgagcaggagaggctaaccctcctccggttcctcgcggagctgtcaccgccacatgataatggcctcgctgcgtcatggaggaataggaccgactgctgtacctgggaagggatcatctgtgatgtggatggtgcagtaaccaagatcttgctggcctcaagaggccttgaagggcgcatctcgtcatccctgagcgagctcaccagcttgtcgcggctcaacctgtcatacaactcactctccggtgggcttccgccagagctgatattctctggcagcatcgttgtcctcgatgtcagcttcaaccgcctcggcggggaactacaagaggtagactcatcatcatctgattggccactccaggtactgaatatctcaagtaatctgtttactggagcatttccatccaccacatgggagaaaatgagcaacctagtagcgatcaatgcaagcaacaacagcttcactgggcacataccttcctctttctgcatcagctcactatcctttgctgctcttgacctttgctacaaccaattcagtggcgaaatccccgctgggataggtaaatgctctgcacttagaatgctcaaagctggccacaacaacattagtggggccctcccggatgatctcttccatgccacatcattggagtacctctcttttcctaacaatggtttgcaaggaacaattaagcttgtgataaagctcagtaatctagtttttcttgatcttggggggaacagtttcagtggcaaggtcccagaatctataggcgagctcaagaaactggaggagcttcgcatggaccataactacatatctggggagctgccatcaaccttggccaattgcacaaatctagcagccatcgtcctcgtgagcaacaaattcacaggagaccttgctaaggttaacttctccaacctaccaaatctgaaaactttagatctttgcacgaattacttcaccggcacaattccagcaagtatctactcatgcagtaatttaacttggttgcggttatctttcaataagcttcacggtcagttgccagaggagacagaaaagttgaaatcccttacctttgtatctctttcgtacaactactttaccaatatcacaggtgcacttcatatactcaagagcttaaggaacctcactaccttgctaattgggggcaatttcatgcatgaaactattcacaggatgaaacaattcatggtcttgagaatcttcaggttcttggcataaatgattgtgcactgactggaaaaatacctagttggctctcaaagctaaaaaaattggaacttctacttttatacaacaatcaacttagtggaccaataccaacctggatcaagagcctaaactaccttaagtatgtagacttatccaataatagccttataggggaaataccaacatcactaacagagatgccaatgctaagatcagacaagattgcggatcactcaaacccaagactctttcggatgccagtttttgtggctccatctcttcagtaccatacggctaatgcattccctaaaatgttgaatctaggtaacaacaaattcagtggtgtgatccccatggagattggtcagttgaaagcgctcctctcactcaacttgagcttcaacaacttacatggggagatcccgcaatcggccagcaacctcaagaatctgatggtgctagacctgtcttccaaccatctgacaggtgcaatcccttcgtcactggcgaacttgcactttctttctaacttcaacatttcttacaatgaccttgaagggcctgtaccaactataggccagttcagcacatttccaacttccagttttgctgggaacccgaagctatgcagccctatgcttttgcaccgctgcaattcagcaggagcagctccagtctccacaatccccacaaagcagtacattgacaagtttgtcttcgcaattgcatttggcatgttctttggagtaggagtgctatatgatcaaattgttgtgtccagattctttggctaaaccagacaataatttgtgctggcttgtactgttgtacattacgcaatgggtcacagaattgaaataagcaaccaacagccgactttctaattaatataaccatctccaggattccaaccgtgtaggatatggtcgatgagtcggtggaaacatagtaaactgaaatcatagattccaactgtgtcatatggactatggtcgacgagtttgtggaagcatagtaaactgaaatcatagttaaaagaactgtgtccatattgtgtggggatgtcaatgcttaccgatataatctatactaaatactatatacggaatattttttctgcaatttgcaacaaggtatagttaattaggaaaaactgggtgatggttccttttttacttaaaataggacacttcttttttatataaaacgtcagtaacagcctgaccgattgaaaaaaaattacaattaattatggaaaattggggttacgttttctcattaaaatgagacacttctctatataaaacgttgataacgcactgaccgttcgaaaaaaaattgcaacaaggtgaccgtaaatctgcaactgacaactagatctctgcaaaactagagaacaaaaaaacatgtaagtggaaactaccgaagctcacacgagcacaatcccaagatcggtaaaacgaacatgatgattctttcacaagagctttgcagctagccttgattgatttacctcaggagaagagcgagcgagcatagcccacgaactcacaggagtcgcaggatgcgaccctcgggccttggccctgcgccgatccgatcccatcccatccgatcgccatgcctgccgagcgccgccgagcgccggccgcccgcttcctttcgttggacggtgggagcggcggctactggcgaggatgccggagttccaggagatcggcataggtgggccttcaacatgtgggcctaagcagtctgggctgggcaacgggtggacaagaatgaatgaagtgcattttgattccctacccagtggattcgtatccctgaagcgtaagaaatctttttcagaaattattttatggtgttttaacgctctcaactgaattttcatatatgatatgaacacgcttaagtaatgtcaagtatttttgaaatattttttcatatgatttctttgtgatgtttcattcgttggggcttaattatacagtggttgttgttgttgcagtcagtattttctaaatgttacatttttctccccttcaaaaaaaaatgttatatttttctaaaacattttagaaacttaattgaaacatttgagtaagtaatgaaacaattttttataggtagtgaaacaatttcatgtaatataatattttatcaaaacataatcaagtgagatcttattataaatatttaatcgcaacgagaataatggtttaatcaaattataaattagatgagtattaatagatgcatgtatgcaggctcggtgggagtgggacgctcaattttttctctaagcattgtccaaataatttattaaatcttatcttactacaaacttataacccactaaattctaaagctcaaaatgcaaagatgtaacatcatcgtcctcgactaataattattacatttaaacatcatgcaagcattctatatcaactataattttatattgaattttagagctttaaaatgcatgaatgttaaattatcatcctacataattcttatcatatcttactataaagttatcccccactaactccttaagcttaacatgcaaagataccacatcatcatccactaacaagatgtcacatcatcatccactaattaacaagataccacatcatcatccactaacaatcatcacatttaaacatcatgcaatcatgctatatctttatagtttttataatttaagagcttttcaaatacaaacatgtgaaattatcatccaacataattcatataatgtttcaatgtatatctttattatgttttatgatatcctatatacttatatagttcatcctcacttagttagtgcttaaatgattaatctatggtccaaattatctttctctttttttcctctaattaagttatatcatatcaattgtttttagcctttagatgattaatctacggtccaaactatctccctacttttcttcttccataaagtcataccatcttactttttacgtttgaatcaccattttacatactatttaaatttaaattatcatagaccacattaatttacttaatctgatgttatctagctatcttacacatttttttttattgttatcatactaaattcccacagcaatgcgcggggtttcacctagtattactataaagttataatccactaaattctaaagctctacatgcaaagatgacacatcatcctccactaataattgttatatttaaacatcatgcaagcatgctatattatctataattttataattattgaattttagagctttaaaatgcaagaatgttaaatcatcatcccacacattctatatagttcatcctcacttaggtaatattaattttctcttctctcattaagccatattatcttaattgtttttacccttagatgattaatttatggtccaaattatctctctctttttcttctctcataaagccatagtgccttacttttacattgaatcatcattctatatactatttaaatttaaattatcataaaccatatcaagttatgtaagcttatgttatcatacacatacttattattatcatagtaaactctcacagtaacgtggggggtttcaccttgtaatatgagaaaaatacagaaggtgtgacaacatcatccgcaagagaatgccatgcatgatttttcgatatggaaggaagagaaagaggatagaagaactccgtttaccagaaggtataatagacagcttaatcatgtataccattctaggtaaaatctatagaatcgaatcatcaatgatacatatctgttatttcagataactagcacaacctgttgtaaaaccactgttcatgcccttgctaactcagattttctgaaccaaaagaactagtgtagatagctaaaccaaaaaaaaaaaaaaagcgttaaagaatgtgttacatacttacattgctttgccacctttatttctttttatttacaaggcaggtggcaaaacgaaagaatattatgaacacaaaaacctacaatacaccactaacttacaaacaaaattgtccagcaatggttcgaatttgacgggtgtatcacaaggtttctgcaacgaacagaaaaacgatggttagatggttcacaaaatcttctgagaaagaactaacaaaaacaagactgaaaatctacaagatctgtgacaactatagcatatatatatacttgccaaggactgcacataacattgaaaatgtcggaattcttgatggcatgcagaaacacatgaaactacagaaactaaattataatatttcaatatgtatataaagcagcctaaatctcctttcttagcacattgggaaacaaataaaagtaccaaaagattatggtaccatttctcatttagtagtacaaggtgatgcaa

SEQ ID NO: 68283 - DNA, 4832 bp, Oryza sativa
aatcttcggaaattcataactaaatcatcgtaactcggttttgagtggttcaagttgctaaattcatctaaaatcatgatctacatgtttgtttactttatatgtactgtttatttggtttttattagtctttttcttcgttttgcgtgttagcttgtcgtttccgtcgttgcgaaggttcgtgagtgcgtcggaagtgatcaagaagattacttgaagaccgattattgcaaggcaagtcacacagatcctaaacacaatcctttgagcatgttgatcctatatttaaattctctatttatttcaactgtgcatttattttcgaatgtcaccgggtggtgtgaacttattcctttgttatggccaatttgcattgattactttattccttgataccttgggttattataacttgactagttgggctttatatattggttcagctagatattagttatgattgcttagccatgcttagaaacattagcacactattgggataacttatgactcactattatttaaggatggcttaatgatagttcacgatggttaatcgtgattggttaattaattacttgccaactaaaacttgataatggtgggttgtgagcacatggttttgagagtcgtgctcatgacaattaaggaccggttcgcgagctactgttgtgagacatttatcgtgccaaccacaagccagcgtgggcaacggctttatcttttgtatagcgtgattcattatagtgcgccagactgagaagtggcgagaagtccacgggggtcgctggggagtccatgcctctggtttttgagggggtgattatgatccaggaaaggtgcgctgtaatggattatgttgtgcaaggggtattgtcacaactcctttccgaggtaccgtggtggtattgaggcacatggtgacatgatgtggggttgtgtcttgtgggtacagtggtacacctctggccagagtaaaactattcgaatagccgtgcccgcggttatgggcgggttgagcaatgtttttcgtgattagtctcacacctctcacaataattatggatgttaatacctgataataatttgcttagctcctggtttggagttagatctgtacagccgggtatggttgttcaggatggttgggcctgtacagcatgggtgtgctgttcagtgttgattaaaatttttaattaattactctactgttttactactcttaactctttgctaaatgctgctttcgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttaattccgctgctgttttcttttcttttgtaagtgtgtaacgttattattatgatggatttgtatattaaattgtcagtttgtgtacctcggctgattcctggacgaggattttatgcacaaataagttcggaaattactagtgaatttccgggcgtgacaagttggtatcagagccatcttgactgtaggataagccaaatggtcaaaccttaaggacaaatcttccgaaaacataatttgtgaaaattttcctttcttccttatctagaattctttgcaaatcgttttgtcgttcttcccccttcctctttcaacttgagtagtcgttaatcttgatggagaaactcgaagacgtcgatgttgtcaacttctgcaagtcaagtggatcgaggaataagaagatgatagtcgaatcttaagtgttcagatagagtgaagtttggaacctatcttagaacctatgccgccaaagtgtctttgaagaatagttagtagggtagaacgcttgttgtttgctttgtgtgtaggtatggttgcattcccatcattggagtagttcattgatgagtgtgtaactatactaggttgcttgcttaatcaacttgaacaatataatggtctacacacatcagatcagtgttaacctagttaaggtcttgtctttagtgtaacccctctccttctaccttttctaatctgcatcagaatggtgggatcatttccggatgaacagagcagaacgacaaccaatcacttgggaagagtttaccgaaggattcaagaagacacacgtacctgtaggagttgttgctttgaagaagcgtgagtttagggctttgaagcaaaaggatcgtaccgtggcagagtatcttcatgagttcaatcgtctggctcgctatgctccagaagatgtgcgtactgacgaggaaaggcaagagaaattcttggaaggtccgaaggatgaactgtcagttatgttgatctctcatgactatgaggattttcaggagttggttgataaagcaattcgactggaagacaagaagaacaagatggataaccgtaaaaggaaaatgactgtatcccaggaggcacaaggtagtagccagaggcagcgtatcaagccactccaaattggtgaatctttttctgcaggtcaagaacagtcacaacaacagtcacaacagttgggcatcagtggtgagatcaactcagagactaatgcaagcaatgaagacaatgatgagcaagctactcaatcagtgtcatttcagcaggatcagtctcaagaagataacagtaatggaagggagcatcgggtgtgtttcaattgttatgagccaggtcacttcgtaaaagagtgtccgaagccgaagcgtcaacagccacaaggccaagtcaacaacattgtcctcacaggagcaaatgcagtgccggttgcgtctcaagggatacagctcagccatcagttccaaagcagcagtagctttctttaaaaccttagaataattattggagttgtggaataaaagatagactgtagtttacctatgcctttttctttctagccgttccgaatctcgggatgagattctttgtaaggggggtagatttgtcacatcctgattttcgtttcaggatttataaattatttaataaattattaatagaatttatattaaacgttcattaatttactagtgaagttaaatgtgggaaataaaatttcctaaatataaagcatggatggatttaatttttattaaattctccatggttaattatactctctggagttttctcggatttttcggagctcaattcctaatttttaatcatacaaagagcatttcagtaattaaccacatattaaattaatcattaaatggtctaattgtaattttgttaagtactttgagtgtccaagtattttcaggatttttcttgaaattatttgagcattggaagtatttttaataattcaaagatcatttaagtgattattttaattgggaaagtaataaaatcctcctcctcagcttgggccattttcggcccattccttcctttccttcctctctcttccgccggcccaacctgagccgcctcctctcctctcagctcagccggaaaagtctactttccctccctgcgctactgttcatcttccaactcaggcagagcccgagccagccgtgccgtgcacagtgccgccgcctcttccttccaaatctcgcctccccgttgctctttttctccaattttgctgaggggaaatattcctcttatcctcctctatctttacccccaaaaatcggagcaaatcgttgagtatcttatccgaatcaaactcgttttcgagtttatctccaaaaccgagtttttgatttcccggatcgatttcttgcgggaggagtccgatctcttcaatccaaggctataaataggaccccctagtcctcctctttcgtttgccccctctcccgtcctcttccgtgctccgtagctccgtcgccaccgccgccaagcaaaccgccgccgccggccatctccggtgccgccgcgccgccgtctccatcgtcgtcgccggtcgccgtcaccaccgttgggtgcgccgtggtgaggggaagctcggccacccttccttttccgtcgccggtcatcggagctccgccgccccgtgcaacccgagccgccgccgtcgcctcctcgtcgccggccgtcgtcggtcgtcgtttggcacgagggtgagtatcgttgggttcgtctcgtcgtcctctacgtgttcatgtcctccaaatccgcagccggtcgctctatctccggcgaggtcgccatcttggtccggccattgatgatgtcatcatgacgtcatcatcttctccttttccagttttttctaatagattaaatcttcggaaattcataactaaatcatcgtaactcggttttgagtggttcaagttgctaaattcatctaaaatcatgatctacatgtttgtttactttatatgtactgtttatttggtttttattagtctttttcttcgttttgcgtgttagcttgtcgtttccgtcgttgcgaaggttcgtgagtgcgtcggaagtgatcaagaagattacttgaagaccgattattgcaaggcaagtcacacagatcctaaacacaatcctttgagcatgttgatcctatatttaaattctctatttatttcaactgtgcatttattttcgaatgtcaccgggtggtgtgaacttattcctttgttatcgccaatttgcattgattactttattccttgataccttgggttattataacttgactagttgggctttatatattggttcagctagatattagttatgattgctta

SEQ ID NO: 68284 - DNA, 1466 bp, Oryza sativa
cccacatgtacaacagcagtatgccagtatatatggcttcgtaagctggcttgaaacaacattaattggccgtacaagaaccaaacaaattggcagtaacaaagcctctctgcgcccatcaatggcaacatgaagatacgtacgtactctctagtcaacagcgtgtagagacttacagtagcggtacgaggaaacaaaggcgcaaatgtctcttttcccttgaagaaatgatcaaatgaatcaaggcaagcaaactctatacgttttcatttcagggtttcaaagcttaatcatcgccttcattttctatatatgtttatatcaacttttcttttacaaaaagagagtactgaaatcaaccgggtcagacacgcgctgctataccaaaaggattccaaagaattgcttgtgtgttgacgacgctaggatctttgatggcgtcaacaagaccccgatagaggtcgcttaattggggtattgccatggaaaaatggtgcgcgtgacgaacggccggtcggaggcattgtaatcgaagagatcttggacgagctgtgaatccggctgatgttgccaggcacatttcatgtgtgataccggcttcaagggcaacaacatccttaaatataatgaacgggtgggttcgaaaggtagggtttttggatggccctaccactaggctggctgccttctttcggatgggaagcaggccgggcctgatgggcgagctgttggaaatttggtcataattcgacatattttaattcaaaataacaagataataaatatgatatttacaatgggatttgatccagtgatagtggtgaatgtaatcaacatgagcatgcttaatatagaataagcatcaacaatcacataataacacaatgttgacattgcgatgaacattaacagtaaaacttctaattgaaataatgtaagaaggttataccccaagaatggtcctccgctggagtttgaggcagtattgcctccgttggtattgacgggagcctccgtctccttgtatccagtgttgccgttgtctccagtgttcgacatattggtgaatgtgaagtagatgttgacgaacagtgagtagtcgcgccttgcgctccccaaaaacctgatcgcccgcccgtccgtgcaaacgtcgcagcagcgcgtggtttcggaggcctactctcccaacgcgtgtgcacacactcgtcgggatgggattaccgtagcaacaacaacattggaaaatggatgaaagtgtgtctgactgttctcgcgggagatcaaatccattctcattttataagaggaatggaagatgaagagtaagagtcatggaataggaagaggaatagagcaactaattgtcatcaactagccatgaaccatcctccactacacaaccatcaaccaacaatcaattaggagtaattgatgtaagttaccaatggaataggaagaggaatagg
